United States Patent 7,868,149 (PLANT GENOME SEQUENCE AND USES THEREOF) - sequence listing, part 90

SEQ ID NO: 47081 - DNA, 15075 bp, Oryza sativa
ttgcatgggaagaaagtagatttatataaggggagtgccatagtcatactagttacaaggaagttttaacatgttttcctcgcctaacatcttttccacttggccattaggattaaaattgaatggtgagagaagtatatataaagtgtgtattacagggacacagtcataaccaaaaacctaactgctcttgcgagtacaagtgcatgcatgattcaagtgttctataaaatccctagcaactgtaacacttcatatattaaacaagcaacgagcagcaaaggaaaaacatcacaataaaatttgacatcaagagttcatcaaattcagaactagcatgatatgtcaaaggagcacacattatagcttcaaagcgatcttgttaaatataaattaatataatggtcattgttgaattctaagttactcaactacaaaattctaaattcctatagagttcatcatttattttatttatttatttatttattttaattttattttattttttttgggggggggggggggaactataggagaaagtgacatacccaagtaatcttcaatgtctgccttcaaaatgcgcccatcaggaccagttccctttacactcgacagtggaacctgttttaggcagcacaatccttgtgttcattaagtatgttacaacaacagttggcaagtaacaacctagacagctaacatcagaaaacttacattgttatcttccgccaattttctagcaagagggctggagaatattcgatctcctgaccgcgaaggttcttcagtccttggggcctttagctcagatgctttggaaggctctctttcctccacctttggttctgtaggctcagactgagccttcagttcagaaggggctacaggtgcagccaaagttgaaggtttataatccttaaacttcttgatgtcaccctcttcttccacggttacagcaataatctaaaatgaatagcatggacataattcaaccaagattatgtcagcgaaacttaaagactgaggtatttgtaataactgtattagtaaacagaggataataaatgattgttcaaatatgtacctcaccaactttgatctctttggaaccatctccatgaatgatcttagcaagatagccctcttccatgcactccatttctacggtggctttatcctagtcagcagaaatgcattcaaaggatatttagattctcttgcagcttaaataaaagaaaataattgagcaccactaaaaataagtactaactaagatattgctgccttagagatcagaaaacttacagtctccacctcacaaagaacttcaccaggtgagaccttatctccttccttcttcagccaccttgcaatgttcccctacagacaatacaagtataaggtgtaatactaactagatgaataccccgccgcgttgctgcggaaaattaagttgcataatatgtacaaaactaaaacaatttgatacaattttgagcttgaaagtaattgagattgcatgtttttaagagagaagaaaaaagagacatttggaccatagatctatcatccaaaggctagaaataattgtggtgatgtggcttaatgagagaagagagaaatagcattaactacacttagtggggatgaactatataagtatataggatacatgcaattcaaggaaaaacacaagaggacattatgatattcatgattcataataaaaaaaattggtgagatatacctcggtcattgtaggagagagtgatggcatccctatttcctgatgtggtggcaggtctggaataaagaaattatggcaaaacttaagaaataagacaattaacagagtgctatatggattatggaatcattgactggagttatgtactacctccatcccaaaataattgtaattctagtttgattagcatatattaagatttgagataaaagactatgatatccctcatcaaatggtgtatacataagagtgggaaggtaattaagggtaaaataggaataaatttgaatgagaagtgattatgggacaattagtactctattgtgacaactattttgggacaaatgtgaatcctagaaatacaattattatgggacggaggcagtagacaattttaacatagtaaccagagcaatgggaagatgtggactgaatttcaaatagacttttctttttgaagcggataaactagatgcttagatatcattaaaaaaagaaagttgttctgatttttttaaaaaaagaaataggcgtggagaaaaatatccaaaaatagtggaatacagcatcacatgcatgtaaaaataagtacgtgggaagacagggtacagtaaataaaatagatagtaaaaaagaaaaagatccgcaaccaaaataaccaaattagtaatctatcgtcaaccaaatatgtttataagaaaccctcttgcaaaaacatgacaaccaaaaggactgaacagctactttgcaatatcctggttattttatgaagttatcgcaattaaagggcataaaacacgtaagtaaagtacctgcactgcttgagaaagatcttgctgaagctatctgtccactggaaaagaaacagggaaagaaaagggaacattataaagacgccatggtaaacagaagtacagaacagctatcaggcgttaggagaacactattagaaatttagaataggacaatcagattcaaatctcattcccaggattggagtttgttcttaagtaaaggagattatcatttagacatgtactaaaaagcagggagccagataggcatgattcaggggccttgcaaaatatgccagcgattttttttatggtgtatcttagccaacaacatgagacgcagtgatcaaatatcggtggttcatattctcttgtaagggtggttctctcatacaatatgtcccgacactgccacataagctaacaatatcatagcagaaaatgacacataccatgacaatgaaccattgagaccagtaatagtatttgggataaagttgttaggtgatctcctgcaagtgtagcttccattaagtcctagtgacaactgaaagagaaaatgacaaactagaaagtcaggacaagacaataatggtctcaataaagtgggatatatttcaaggacataaccttggaggtctcaagctcttttccaggttgcttgcgctgaggaaatctggcacctccaattcttttctcagcacctgtggaaaccaaaagcactaaaacttcaatggtgaaaattgcttaatgaggacattcaatcaagaaggtgaattctcactgtacaaataaattcccaaaggaaccaaataactactatctcaagacaaaatgagtgtgcctatactatgtcaatgagaaatcacgccttaattaaaaattatagtatcagctcaggaagccaacccatgcttagccaaaggtacaaaaattagtggagaggtaatgtgtcaagaaatgaaaaaatgaacatattggattgtacttctgttgcaacatattttttttgtacagatgtttgtaatcaattgacaatctgtctatattagactacagaccaccaacacacaatcaatgaatgcctctggaggatccaggattaccaacacctgtgaaaccaaacgttttataactaaattgcctatgtaaggctctatattggtttcagttatgatggcaggaccattttggtttgacgccaaaatgtgccctaccaaatgttgacccttcgaatagtactttggctagtgtttggtttgctaccaaaatatgccaataacacacataggttgccaagaaaaaaaaggctaaaattcacctaggttttggtattgctaatattttggtatggtaggaaacaaacaaacccataatacagaaataaaaagttattggaacagaacagaactgcatgattaaaagcagcagacacttatgaaagaaataaaggtatttgctaactatcacagcaattagtcatgtggaaggacatctccagttgagttggacaaacaggttgcttgcgtaccgtggtcaattagttgacaaatacacacaatcaaaataaaatgataaaagatgggtagcacataccatttcccttggtggggaacgaaccagaagcagtggagaagtagcgcacgaggccagaacgctcacagtctagagcattgtgtaaactccgcaactgcagtaaagcagattgaaatgtcaccgggaattgattgacgatggcgtaacattactagcgcagaaacatttctttcccgctgcagtaggcaatagatctcccgatcgaccgaaatcaggtgaattactagtcaattcgcacagacgggagcacaaggaaatccaggaacgatcgaaaattcaaccacatgcggcacgcaggctccacgcagcgggaaggcagatcagaacagatccgatggcttttccgacacgttgggatgggagacggatgcgcaggcagccacagagagaggaggcagagagagaaagagagagagagggagagagacgaaccttgcgagagtggcggaggagatgcgcggcggacatggcgacgggagaaggcaatgggcgtggctagggtttgtctcgatcggagatcgttggcggcggaccgacgagggggcggatctccttggccacggtcgccgtggcggcgctggatcggtcgaggcaggcgtacgagcgtctcccggactggctgcggctcctcccggcgtggtcgaggccgcgggacagatgaggacggaggggggtcgtggtggtgtattgggaattgggatgtcgagtcgagtcgcgtccgggaatcacgcgccgggagggggcgagagaacaagatcggtagcgagtaagcttaccggggggccgggcctgggaagggagatacagtccgatggtaaaaaaaaatatagagttaatttcattttggatgatactttttctttaggtttcacttaaaatcattctttgtttaaatttttcaatttggactaggtaattttatctttgttgcacaattgatcacccccaaaccgcatcttcatcacttcaatgacttcgagtaaattgttaaagacatgccggcaaacttttatatctatatgcatgttatccctttacccaaggagacgctagacatgactagcaaatagaattaggttggttcattatgtaacaaaggtaaagttacatagttcaaagtaagaatattggttatagggtagtttaaagtaaaactttggcaataaaatatggctcgaaatgcaattcactcaaaaaatatatactagatgagtgagtgagagtggggcaggggatagttgtaaaattctttaatgttttgtgtggagcggatactatatgaaacctccagtgttgcagcggatcgttcgtgtgtaatgtagttataaaaattttaatatatatgtatgaaaaaaacattaaaaaagcctgtaaaagcatcatctaagtactcccttcatcctaaaatatagcaaacttgtactggatgtgacacattatagtacaacgaatcaagtaaaaacaacaaggatagtatctgtactaattcatcgagtccaagaataatagtttatatcatcatgatataaggtcattcccaatccaatgactaggatagtgtccatagcattaaataagctgccacctaggataaaaaatgatatgtcaagtaaataaatgaggaaagagaagaaaaccatgtcttgagacatggtttctacacaacatccaagacatcatgtgagataagtagcattaaattgaagtatggaatagtggtgtttgcattagaagagtggtgtctaacactattttcttgatgatggggagtttatggaaattatgtctagtgtcataggttgagaatggtctaagtacacttaaaaagccacatggtccacagtagaacaatgaattcagaaataccataaaatattttgtgcttattaattgcttctgattatgcacaatcatcaacggttgactttacggagtcataatttggttgaaaatgtgaccttttcatccacattgccttgcacttgagccgattagtcaatgttgtacatcaagaataactcgatggacatgccgtgaggaatgaccatagtggcacaatgtactatgggcaatgtaagcggaagttcttattctttttatctttggaaagatcaaacataagatgctcctatttcttttatggagtgtaggtacctctaggtaacacccctcgaggtaggcagaaattggtccaatggcaagcatcaccgtgaagatatgtatgttcgggcttgtgttcattctcgttgtcccaacctcgatcgggctgtgggtatcgtatggataaggcaaacgctgcagagtggtactgtatttgaatatactatgctcctgattaaaggagatatgtctatgagtgaatcctaattagtggtatgagaagtctcttaatggaacatttgaatttaatgaggaaaaggcctgaaatgaaacaaccaatttttgaaatgtaaattgattacaaattggccattttgaactattactaaggtttacagttagttctagtttctatccttgtgataccttgcattagcacatgttttgtcatgcatcttttgggttctagtcgtccaaggaggttgttgaaggtcgttatcgatcagtttcaactgtcaatattatcaaaatagaggagaattagtgatgcttgctatgcatatatatgttagaataataatattccactagtattaggtctactaaccttttgcagagaatgacaataaagtagagaagaatcgacatcaactcagacgataatcaatcggacgatgtcgagaaccagacttatgtatgaatgggccaagaactcagaattaacacgacaaactgggccaaaattcacaagtctgcggagaaaaacaacagaggaggccaccagccaaaccatgggctagttgggttggccccaggttcggccgaacctccctcatcgtcgctggatgcagggtttcttctggacggtgtggattagctcccaatgacggttggagggtatttccgaccattccaaccgtcacaaccgtcattgggaggctatataaacccctcaccttcttacttcactcatacacctcaagcaagagctctctcatttttctcaagtttagtttagtagtatctagctggtggaataggaatagagtagaaatcaggagtccggaagtcttcagaagagttcaggtatggctctagtagcttttctcttctcttttgtaagctttgtacttttattagaatactcttctatatacatttatggtatgaaaatactttccgagtatatgaatgcctactttacattatgttcatgttatactgaatatacggctagcttatctgggagatgctttggtgcgggtataatgtttgcttatgcaattactctatgtcatgacgatgatattagagtagtatctggtagtttagacgtggtgtctagattacgagatatcgttatttggggttatatgctgcggatgagatgtgggccgctgatggtgacagctcagtacgggtattcctctgcgcctgtatataatcctaagttaatttcctggggatggtactcctccgtatttagccctagttgtatagacatgacgggctgtcgtaaggaactcagcagtcaggggtggcttctcgaagtaccaggagggcatcggataaagggtattaactagtatatcggttaactagaatatatgtatactatgtatattagaagtataggaatagattgtctttctcttttctttccacttagcttagataatatattatgagaatgagtagctaatgcttatgtgtcactctacccttgattatcttaacacctgcttaaaatatgattattacaggtaatatttaaattattagtcaagttctctcaacatgatctttccacgagataaaataaataagatacccttggaatactctcgggtgaaatgttataatgatatatccgtgcgcttgtggataaactctttaactataatataccaggagtatttctacgccattgctgaaaattatatttctattaatgtcgttaagaaataccaacaaagtgtaagtgaagctttataagaagattgatcctattaatgtcgttaaaaaataccaacaaagtgtaagtgaagctttataagaagattgatccgttcaagttgtatgaagatgaaggcggtggtgccaagttgcatcttttagttgtatgtatggtcgtaggtcgggatgaaaacggcttggaaatgaatggaaatcagatctactatttttgttttcttttttaactagaatcgaaagtggaaaccccagatacgaaaattacatagaatattatcaaacataaatatggagtaaatatgaatcggagcgtatacggtaacgaatatttatcggaataaaaaataattctaactaagattctaaaatcaacgaagagatgaaggccattatttttttatcacaataaatcagcatttctatttttatcaattaaataataatacacacgtacacttcacttccctaaaaaagtgcaataagcaaaactatattcatctggcattgcctaataaaagaaaataaattaatagtcattaggcaaaagagaaatagatctaaagcaccaaactataaaaaacatctccattcaactaaccacatcaacactcggtgcaaatctgaacatccggaagagaagggtaaagctaatcagctgtatattaaaagcaatttgtttccagttccgagaaaaaaaaattctaaattcgtttctagaaagtttctcatcaatttcggtttccgacaggtagtagcattaccatgtcaatttcagtttccaagaaaatattccgaaatcatttaagtttcctatattttctgaacaaattactcactactaaaaaaggcaaatagctggctgccaggtttttttttgctagcgggcggtggtgccaccagcgacctaaggccaatgaaaataatacatattcactagtggccggtcggccactagtgaaaatcgactttcatagataaccaagctaagatggtcaccgacaaaatacgattttagctgacaactgcgtaaagagacctgccatcgaaaatatttttcaaagcaaaaaaaaaaagaattgaaaatcaggatccaaaacagccagtacagaatcacaaattctcaaaatcccccatcacatacagtccttgcactgtggtcatcgttgtagttggcgagagagagcgtaggtcgtcatctttagatccatgctcgtgaggaatagcatggccgactggtagttgccaatctggcgtcgtcttgcatgcccaccaccgccggatgtggacgtgtgctcgcagtagaggtagtcgttgccaccattgtcactgagccgcaaccctagccaccatcaccactgagggtcagcgtcaccgaggctgcgtatcgagtcgtcgctaagcttgtgggcagagccatcactgaggacggccgccaccagatctagcggtccaaagcactaccgctggctatcttcttgctcctcatcgtagtcgtttcgtccgtttgtccgcgccggttagcaagggagcccgaggtcgccagaactagtgtccatggtctcattggttgtcaatgcggtggcggtatttgtagacggtggttttctcgttggggtatgtgatggtaatgatgcgattcggcggctgccgcctccatggtggtagaggaagggcggtaaaaaggtgatgtcctgaaaaattattttagttccggtcgatattttctgtttcggaaaatacttaaggcatctacaatgtaagacactcttagagtgccctcactaactgagggtactctaggggtactcacctctacaatgtaggccacttctagttagtcaaatgagtgtcccaacccaaaaaagcccctttctctcctcttcctctctttcctattctacccctctcttccctctctctctttctccctccgcacgaccgcacgcacgttcctctctccctccgcccgtcgttccactcgctgcctgcttccctctctctcgccgccacctactgcgcttgccgacgctgcctccctcctcgccctcccttcctctctccgacggcgagcggtcgtatcgaggagacggtggcggtggcctcatcgacgatggcgctgtcgccttcttcatcgcgctgccgccgccgcctccctcctcgccctcccttcttctctccggcggcgagcggcgcctccgcctcgcccttgacgcgtgggccggtaacagaggggagaggggtggaagaggaaatcgaagctatggggtacgtcgcctcaataacctacctatgcaatgggttgcttcactccgtccccttggaaaaagcgagcgagcaacacgttccccatcaggggcgcgcgttctgtcccagggggacgacgcagacagaaagcctaacggacggcgctagggggatgggccgaagcaccgcattggtgatgcccttatcgatatcggaaacatcccgaaccgggacagttggtgcgtgtgtcaagtttggagttttaacagaatcttgtcagttcgtataacgaacttcctgagcggatacgtgttggtggaatatttggaccatctcggtgcgttcccacgtacagttagctcctctgctaattgtatggacagtttgccaataccatcgagcaacaacagaggtaacaggccgcctggttacgcatgggctcagttgacccataatttaatttgttattatttttcccttttcaaacaaaactcttgtggatatttatgtttggtgcattattttttctataagtaatctaatgaccccacataaaattattactaccttaattgtttggaacttactccgctactaccattttaataattgtaagggtgagtgtcaaaattctttccatgcaccatttgactaaaaggcgctaattaattataattataattgttcgggagtgttattaaagttttctttgaggtggcactcacttcaagtgaattggtgtaataattagctgtagctcgttaagcaaaagtcaggatgatattctattacaagcaaaagtatggatgatattctattacattatctaaaaattgactaaaaggcgatagtcttttcacccatactatatcatttcagtgataacaacaccacaacactgccacacgctcctaattagtactccttccgtcctgttttaagtgcaaccatgagttttcgtatccaattttgatcgtctgtctaatttgaaaatttttttaattagtatttttgttgttatgagatgataaaatatgaataacaatttatacgtgatttatatttttaattttttttcaaaaaatttttaaataaggtgaacgattaactagttgagtacggaaaagcatgactgtacttaaaatgggacggatggagtatatattcttactctacagactgtattactgtacgtctgtaccctttatttacagatgcatgcatctagcatggctgcatggggaccatgtccactaattagtccatgcaatgcaatgccccagttcactgcaccagtaagatatacgggcaggtactatatactatacgctacaaatggtcaccaatttgctcacgtgtgcttttttgtctgaccttaattgtcactgtgcatgtgatgaaaggcaagcatgagtccaattttatgtcacgatttgaagcagttacgttgcagccttttttcacatggaatccactaccaactgatcggtcgagttcacacactgcattgcaaggcatggatgtgatcgagttgaagtattgaactcgcgatcgatcgcgcgcgagagctatgtttttgcaggttcgttcgcatcatcatcaatggctagtttgctcggacatccagaggagctcctctaggtagtcggcgccgaggtcctccagctcgaggacgatctgcttgtgctccccgccggtcgtggcggacgtcgtcgtcgtcgtcttgttcgccgtcgccgtggcaccggccagctctgatctcttccgccgctttcgcttggagtgccgccccttcagcgccagcacgggcgagcctccggccgcgccgagcgcgagcgcgcggagcgactcgcgcacgcgttccacggggaagttgagcgccgcggccgcgccccgcgccgagagcgcggcctggtcgtaggccatcgcggcggcctcggccgtctcgaacgtgccgagccacacccgcacgccgttccgcgtggagtccctgatctccgccgcgaacctcccccacggccgcttccgcacgccgatgaagcccgccgccgccgccgccgcccccgccccgccctcctcctttctcgccgccctctcgcggcccgcaccgccgccgggcgccgacacctcggcgctccccgccgtctcgtagtcgtagccagacggctgcgattccgaggatgtcgacgacgccgcgccggcaccggcggctgcggtgacagccatgccgccgccgtagtaccagcagtggctgtgttgctccatgtgtgtgactctgtgagctgggaatgtttgacttagcggctgcgatcactgtgatgtgtgcggcgaagtgacggggcgtgtttgattattccctttccaggaaggcagcggattaaattagcgcggggtttatatagagccccgagagggttgggtggctctgtgggcgacgaattttccaggacggtgcggtggggcccgcgcgtcgacaaatgactatgacatgtagggtcatgaaaacctggaagtttgggcgttgtcgttggacttggctgacgtagggcggctgcataggacaaactagcgggcgtcagcgtacacgatccacacccttgctttgctggtggtgtccactgagcaggcctcggcgcgccttcgttaagtggcccagatcactagatcagaaatggattactgtgtttttaagctagtactccgtatctagcatcaccgatgatccaaggggtagtataagctataacacacgtgtctcaaattagggcttcttattttatttatttacatataagaagcgtcagcgatgatatggaggatggtaacgtactatttgctgcatggacaagcatataggtatataggtggtatttgaatcttctgaagatgaaggtaaagattaaatgttccacgtaaaatgaggtggtaacaacgtgtgcttaattgcgttttaattattacaaacttgaaacatggattaatctgatattttaaaacaacttttatataaaaagttttcgcacgaaacacaccgtttagcagtttgaaaagcgtgccacgaaaatccaaaacttcatctaatgtttgtagtggaaaccagtggcagatttaatttgggggcggggggtcttgagaccccactactgccactgggaccatggagaccctcctaagcccccactaaaaattatttgcatagattcataagatatgggagctgaagactctcctaatttgtttagcccccactattattttgttctagatccacccttggtggaaacgaacgtggccatagccatatactacgtgcttccccaaaaaaaaaaagaagagagagagagcatatactacgtgctgaaaccgcgcaaacaacgaaattgaagagcacctcgcaaaaaaaagaaggaaaaagaaagaaccagttaacagcggccacaacaataggctgtactctggtactagcggctggcgtggaacaatgataagtgggtataccaagaaatggtttccccatcgcaggttgggttgagtttgccttggcatgatggaaatttgggctgcgtggttatgggctgttgggtagctacttactcatttgttacgagcacattttctaaacgaataagtctactatacatccttaactctttcctggatcgaatcatatcccttaaccacaaaaccgggtataacacctttcccaacttaaaaaaccggtgcaaatcgactctttaggtggtttgcgaagcgattttgctgacgtggcataattgacttggtccaagtgcactaatgtggcaatccagtcattaaaggaattaaaactagaagtgggccccacttacaagtgacaagggtaagaataaaaaatggtgggcccacctatcagctccactactactctctcaatctcgaacaaatttttaacacaattttgttttcaaatttagatagcttgcaaaaggacagtgacactgccccttaaatttataaaagtatttcttcaggtttgcaagttcagataatgcaaactgagcaatgagcatgctatattcgtttgatcgatcaaagtcgacaaataaattgtacttcattttataattatcagacggatgcaagtagatctacagtgttgaagaacaaaatgaaacacttgagggttatagcaaggttgagtactacccatcgtacttagcaagtcataccgaatatgggtatgatgcaagggattacaaggacaacataagcgctcatttgtataaagcactagtaaacagttgcggttgaaaacaataaagctatggataatgttaagcaatactccctccgtactcgtaaagaaagtcgtttaggacaatgtttaagtcaaaccttgagaatataaatcatgaataactcttaagttgttaagtttgaaaatataaaaattatatgaatagatttgtcttgaaaaatactatcataaaagtatacatatatcacttttcaataaatatttatagaaacaagaagtcaaagttgtgttttggagactgtgtcgctgtccaaaataacttcctttacgagtacggagggagtattgatcaccgatcaatgctacaccgtgttaatagg

SEQ ID NO: 47082 - DNA, 1596 bp, Oryza sativa
attaggattaaagttaagcttttcgtagacactgtttctcactagtaaatcctctctatcctttcctatcatctgcttggtgtccttggatgaaccggaggaagatctgaccacacacgttcccttggattcgatatccttggaatactctgtaggggaagtgctacatcggtatatccgtgcgcttgcggattctatctgtgatcgtaagaaatatcaataccaacgaagatcggttttcgctggcagtcctaagccccccacccctccttacgttgttgctggcggtttcgcgtatggccgccagcgaaaagttttgtgtaacgccatgaaaaattatttttctagtagtgattgcatatatcagtcatgtagggaaagattaattatgtcccaaaatgtccaaaacccaaaatgaaatatatattgattagtgaacgtattccgtatgtagcaaataaaactaagatttttggatttgataacaatattgagccttcagtgccagtgtccagtacgttattccaaactgtgtgcacctggtgtagtatttagtttttttaaaataatgttgaacgaagtttgccaacatgttttattatgtttgccggggaacggttgctgatcatttccaaaccttgttcatcctcgtatcctttttacttttttatctctagctctgcccctgctatccgagaaaagtattcttgttaaactcttcttgatcatggagcaacctctttttgagctgtccgctccttgaggcgaattctatgagccatctccttcatcggagcccatatatacaactggctatgaaattcgccccgagctaatcaatatggttaaggaaaatcctttttctaactttgatccagaaaatccctaccatcatctccgagactttgagcaagtctgctcatgccttaagattcgtggcatgagacaagaaactgtgcggcggaaattgtttccattctctcttccagaaagggcaaagcaatggtacacctctaccgttggatgtgtaaacggtagttgggaaaagttgcaagacagattctgtcttgccttcttcccagttactcgtatcactgcccttcgagtagaaattctcagttttaagcagatcaaaaacgaattaatcggtgcagcttggtccagattcactaatttagtgcagtccggaccaaccctgtccttcctcgagtatgtgctactacagcatttccatatgggtctagataaggagtctgcattttatctggacataaccgccagaggatcgttcatgcacaaaatgccgtcggaaggaagaacaattttggatcaaattctagaaaatacttccttcatgacgcaatccgatgaaccccagacagaggcatctgtgtcaaagatagaggaacctctaacgattgagccactctctgaaccatccacttttgctagcttgattgatgagaaggttcctgagcagccgtccgtcgaggatgaagaaattcagactccggatcatgccgcaattctgtttaaggatggttttgacgaagattatggcaataccctgaactatttcagtaagaataaaccact

SEQ ID NO: 47083 - DNA, 7796 bp, Oryza sativa
taagggaggtatagctttcatccgaagtaattcgggtaaataccgctccccgaatcattcgctgccatctggaagggaacgacgtcggtattctctacagcccgatcgtcgaggtcaatctcatttctgagtcttttgcattcgcttatctaagcgataaggcaataaccccaacgaacaaattcttcaagcatccgaacgggaatatcattgaaggatttgggattgtacaagatgtgcatgtctgctttgaagatagggaggcgatcttggatttccacgtctttggaattcaagactttgacatcctaatcgggctacccattgagcagcttcttattaacacaccccgattagacagcctcaaaataactctaggaggaaatgaattttcagttccattctcacgggcaaggatcgccctaaccgaccctctcccagaaattgagtcagcagaggaggttaccgcagttccccctcacaagtctcccgaggcccttctggaagatgaagtccccgatttcatcaaggaagaagcggatcccggtgagactctcgatctgccaatcatcgaaccgctacctcgacttccgcttgagctaaaacctctacctccgggcctatgctatgctttcctacacaatgacagagaagctcctatcataattagtgacaagctctctgaagacgagactcaacgtcttctcatcgtgttggaaaatcatcgttctgttcttggctattcccttcaagatctcagggggattaatcccgcactttgcactcttcgtatccctattgaccccgagagtactccctttagggaacctcaatgacggctcaataatgcgacgcgagaggttgtaaagaaagaggtcttgaaactcctacatgccgggattatttatcccgtaccatacagtgagtgggttagcccagtccaggttgtgccaaagaagggaggaatgacggtcgtgcaaatgctcaaaatgaacttatcccgcaacgaaccgtaaccggatggaggatgtgcatcgactacaggaagcttaacaaggctacgaagaatgatcatttccactacccttcattgatgaaatgttggaacggctggcaaatcattctttcttctgtttccttgatgggtattccgggtatcatcaaattcccatccatccagaggaccaaagtaagactacgttcacatttccatacaacacctatgcctatcataggatgtctttcgaactgtgcaacgcgcctgcatcttttcaaagatgtatgatgtctattttctcggatatgatcgaggacattatggaagtcttcatggatgacttatctgtctatggaaagaccttcggtcattgtctgcagaatttagacaggtcttacaacgatgccaagagaaggatctggtacttaattgggaaaagtaccatttcatggtccgtgaagggatagttcttggccaccgagtgtccgaacgaggaatcgaagttgatcgtgctaaaatcgatgttatagatcagcttcctcctcctgtgaacatcaagggaatccgcagcttcttgggacacgccggcttttatagaaggttcatcaaggacttttctacaatcgcccgacctctgaccaatctgctagccaaggatgcaccctttgagttcgatgacacgtgcctgaaatcttttgaaatccttaaaaaggcacttgtctctgttccaatcattcaaccgcctgattggactctgcccttcgagatcatgtgtgatgcaagcgatttcgccattggtgcagtcttgggccaaaccaaggataaaaagcatcatgcagtctgttacactagaaaaactctaaccagagcctggttgaattatgcttctactgaaaaagagctgctcgcggttgtttttgctattgataagtttagatcttacttagtgggagctaaggtaataatttatactgatcatactgctctaaagtacctactcagtatgaaagatgctaagccacatctcttaagatggatcttgctactccaagaatttgacttggaaattatggataagaagggagtagaaaattccgtagcagatcatttgtttaggctgcagaccactgacacacaggaacaaccgataaatgacttcttgagagatgacatgctgatgacggttcgcgactccaacccgtggtatgccaacatagtaaactatatggtatccatgtacataccaccaggggaaaactagcgaaagctgaagtacgaaagtcgctgtcatatatgggatgagccatacttatatcgagtctgttttgatggcttatgcctcaccctatggtggccattatggtgctttccgcacccaggctaagacttgacaaagtggcttcttctggccaacaatgtatgaagactcaaaagaattcgttagaagatgcacaaactgccagaggcaaggaggaatcactactcaagatgcaatgcccctcacatacaatttgcaagtcgagatatttgatgtttggggtatagactttatgggacttttccctaagtctcgcaactatgagtacattctggtggcagtcgactatgtctccaaatgggttgaggctatgccgtgcagcgccgcggatgcgaagcatgccaagaagatgttcacagaaaccatcttcccaagatttggtacccctaggatggtcataagtgacggaggttctcacttcattgacaaaaccttccgagacctcctacgagagatgggagccaaacacaatgtggccactccataccatccacagactagcggtcaagcaaaaacattaaacaaacagatcaagaatattctgcaaaatacggtcaacaaaatgggaacatgatggaaggatagattgccggacacacttgtcacgccctaaaaatcgtctaatgtaaaaatacattgtttaaatcatttttagaaattaaaattaaaagcctacaagctaaaccctaattatctaggaaaattttcaacataaaaatgagctagataaaattttattaaatactttgcttgttcctctattttctagaattttctgggaattgtttgagcaagggaagtatttttaataattggaacaacatttcacaaattattttaattaaaaagttcaaaaaacccttccttaagtggttgggccgtttttggcccaactttttccccctcccgcgcagccgagccggcccagcgccgcccaagtcggctcaagccgagccgcccgcccctcctctcatgggacaccgacatgtggggcccacatgtcgggcccttctcctacctccggccggccggccttgctagcccgagccgccccttttcccctccaaatccacctcgaatccggccaccccgagtccctttttttgaggggtttttatcctctcgttctcctctatctttaacctcaaaaatcggagcaaatcgttgagtattttatccgaatcgaactcgttttcgagtttatctctaaaaccgagtttttgatttcccgagtcgatttcttgcgggaggagtccgatctcttcaatccaaggctatatataggaccccctagccctcctctttcgtttgccccatcacccgtcccctcccgtgccccgtagctcgccgccgacgccgcctagcctcgccgtcgccgccggcgatctccagccgcgccgcctccgccgtcgccgtcggtcgtcgccaccgtcgtgggcttcaccacgccgtagggaagcacggccaccctctcctttccgccgccggccgccgtagcccgctaccaccgcgcaagccgagccgccgccgccatcccctcgtcaccggccgtcgtcgttcgtcggtagacgtgttggtgagcaccgttgcgttcatctcgtcgtcctccacgtgttcttgtcctcctaatccgcagccggccgctctatctccggcgaggtcgccatcgtggttcggccgccattgatgaagtcatcatgtcatcatcggtttttttctttttcccgtttttctaatagattaaatcttcggaaaatcataactaaataaccgtcgatccgttttaggtggttcaagttgctaaatttttctaaaaccgagatctacatgttaaaaatatccacatgtactgtttatgcttgtttttatactgttttgttgatttttgtttaattgctttagtttccgacgttccggaggagagtgtttccgttgaggaaggttccgaagcgtttgcggaagcccaaggcaagtcacacagatcccaaacaaccatttgagcatgttgaacccacttaaagctattattttatttcaactatgcattgtttttgaatgtcatcgggtggtgaaccttttccaattaattaatggccgaagatgatcttattttcctatgggttataatttgattagcatgaaccttatatgttggattggttcagctaaatgctatatgtaagtttgcttagccatgcttagaaacattagctaactaaagggattaattataaactatgttatattattattaattatggttacattaaatggtagctcacgatggttaatcgtgtgatgttaattaattgataattaaaacctggttaaggtgggttgtgagcatatggttttgatggttgtgctcatgacaattaaggaccggttcgcgagctacttttgtgaaacatttatcgtgccaaccacaagccagcgtgggcaacagctttatcttttgtatagcatgattcattatagtgcgccagactgtgaagcggcgagaagtccgtgggggtcgctggggagtccattgcctctggttttgagggggagattatgatccaggaacggtgcactgcggtgagttgtgttgtgcaaggggtattgtcacagttcctttccgaggtatcgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtctcacactactcatcaatgttaataatgtgataattaatttgactcctggtttggaatggataattcctagtttggaggtttaatttgttcaactggggttggttgttcaaatgtggttgggcctatgcaacatgggtgtgttgtatggtgtttatttaatattgattaattatacaactgttttactattctcttaaatatttgttaaatgctgttatgcaaatgagctatattatgccatcctttgttatcttgtgcacttgcatatttgctgtgtggcttgttgagtatgttatgctcattcttgcaatattcaatcatcagaagaggagtatttcagcgaaggtgatgatctgaaggattgagcttgttctggttaagatgcctgtggagtggagtcgccatagctgttccgtagtttgttatagttttatttttccgctgcgtagaatgttattctttgagaggaactatccacctctgtaataatttattatttgtgaatattaaatagttatttatttgtactctattatcaatttgttattgtgtgcctcggttgattcctggacgagggtttaacacacatgtaagcgtttggaattttggatagaaattccgggcgtgacaacactgtgggcataccggacagcatacaagacacccattggaatgtcgccatatcaggtagtctatgggaagtcatgttgactacctgtagaactcgagcacagagcatattgggccatcaggaactggaacatggactttgagggagcaggagaatggagaaaaatgcaaattgctgaacttgaagaatggagagagaaggcttaccacaacgtaaggatatacaaagaaaggatgaagcgctggcatgacaaaaggataaagatcaagaaattcaagtcaagagacaaagtactaatgttcaactccagggttaagctttttggccactgaaaactgcgcagtaaatgggaaggaccgttcgacgtcatcgacacctcttcgcacggggcaatcacactccgcgatgactcaggttttgaataactgtgggggagatatcccagcttctgacgtgcatatactctgaaaattgttgaatctctgaacacctagaaggaactgaactcagcagaaaattgcagagggattaggcaccagagtggttcggccgaaccagtgttggccctaattgcccacaatttttacaggtaagtaggtaagcacgtctattatctgtatatctctaccatggtatagtactagaggtgaaaatttaggaaacacttggttcaagcataagtgaaagataaaatttccaactaatgaaattcttcatatgattgatcttgtataatcattattctcagccgaacttgtgcttgtgaacaaccatccatgtgtagggaaccttatgcatctaggtaattgcttcatgtgagatgatttatgatgaaaggaatttttgcaactcttgttatgactattgggaatttgttttcaaaataaaatttgttttaaaagctcattcctccaattgacttcattttatacctactaaggccatatgcaagtatatcaatgatcaaccttattacgcatattactgcttgacattatattgagctttgtcaaatttgtgtgactcgtgttagatatctttcatactctcatgatcaaggggtcaatttcactttcatttccacatacatgataaaaagctaagcttctacactggaagttggcttctcacgaaaaattccattcgaataaactcctacattagactatgctttcttgtcctagaaaagtttttggtaaaaagaaaatgagaaaagcagggaaaggcatggctatgaaataaaaagagaaggaggaaaaaaagagaacaaaacttgctctcgaaacattgagcatgatgagaagaaaatatagccatgccccttccataatcatgccaaaagaaggagaaagtgtaggaaaaagggagaatcatttctttatgccaccatttcacaaaatattttacttttccatttctcaccacacataaagacccctgatctaggagtatgactgatgatcttattaagtccgtaattttggctttgcaatatatatttgatgcaggtatgtcacaatttgtcccaccgagctccacgtatcagccttagaatagaggtatattctggcactctttgccctggtaaggatcaaaaaagaaaatccttgagagataagagagaaagtcaatataaggaaaagagctggtttgcgaaaattcataaaaatcccatgagtctgacagagaagcaagaaggactggaatcaggatcattccatctatcaattactcaagatggtaagatagccactgataaagttcacaagtataggtatggttatgaatggtgtatatgcatgatccagagttgtcggtaatcttctccaatttcttttattctgtttattactctgaattcaatataatattcttcctgagtaatttagatttatcttgtgagaattatctcttggttagttcctaaacaacatacgggattattgtttactgtaaccaactaaaatatagtgattgctttggtgagtttttttttttgcggggaacgggagatatattactcggcaacagcctccttacgagccacgtgagaaataaagttacaagagttatctgg

SEQ ID NO: 47084 - DNA, 16428 bp, Oryza sativa
ttactcgagggagcatagaaagttgttaagtacagtgaatttcgagagtaaaatcacggtcatactagtacatataaatgttgatagtactaatttgggcacatgccatacaaagtttaataatattattatgtgtacccatggggcaagatgcatgcatcaagctagctagcttttgggaagtaggtccttgtgtccgataaagacataaagttcagtccccgcccaaagtacacaccttgaaaatacttcagcatgttgtgcgtataatatggtggtgaccaccaaattgttgcttgctccagcatgtgttgcattgtctgcactttattggcactctagagagagccagacagcaagtagtaggatgcaataacacacatgcatgtgttcaagtagtacttgcagttgcatacttgcatgtgttcaagtagtacttccagttgcagttgcatacttgcatgcagctttttgcagtttgcacgttccattgcaactgcatgcgcgcgaaatgtaattcgcaagaggtgccttgcaaattgccaaccttttggatgatcagtcagcagggtcactaccaccattgatctccgacagccagagaagctcctccaggtactcggcgccgaggtcctcaagctccacgacgaaccgcttctgctcgtccgtcgtcgcagtagtcaattccgtgctcttgctgatcctccgcgtctgcggcgtggcattcgccgtcgcggcggtggcggcggctgcggcgagtagttcagctttcttgcgccgctttcgcttcgagtgccgccgcttcagcgccagcacgggggagcccccggccgcgccgagggagagcgcgtggagcgactcgcggacgcgctccacggggaagttgagcgccgcggcggcgccacgcgccgagagcgcggcctggtcgtaggccatcgcggcggcctcggcgctgtcgaacgtgccgatccacacccgcgcgccgttccgcgtcgagtcccggatctccgccgcgaacctgccccacggccgcctccgcaccccgatgaacgccgccgccgcctccgtctgtccccgaccttgacgatgatcaccgcccgcgctcctcctcctccccgccacggaggatggcgcaggtgtctcgtcgggccagcccgtgtcgaaccgaagcatctccgaggaggaagacgacgaagacgaggaggaggaggaggaggacgcggcggcgtctgccgtgtagccgatgtacatgccggcgtggctgaaatgctctgccattgatttgcgcgcttggattggatagagagatcgatggtggcgtggattgacttttagctgctgattggttccaggaaggcagcgaatcgggtagcgaggtttatatagagctcgctaagagcatgtacaatagcatgctataagccagctgtaaacatattttaagaagataaataaagagagagatgggcagcgggctacagatttgtaaccagctgtagcacggactccaagatgcagtgtgtgtatgacagatgggaccaagtattaatagtgtagtatgtaattattatatgaatgagctattagattggctataaataaattggagtccgtagttggctatactattaaacttactctaagtgcagttggagggattaatatagtgttcatagggcattagggcggcagggttgtggggcccataaatgggctgtcgcttttaacgggaaaggcgtctggtcgtgtagggcacatctggcatgtggctgacatagggcggctggataggacaaaagtatatgacgtaagcgatcccactgtgtgatagtggtatgtggagtactggagtgtgctgttgccttgttcgtacgtgaagaagcttttgcttactaggaacagtgttccccaatttagatcgagatatttctgaaaaagtaaaatgtataggtgctctcttgtagctcctagtacatttttattcttaaacattgataataatgattggaatttaatcatgttaaggctggtttccattggggttgggagcccttctcaagtacgtaaaatggagaggtagattagtgcatgcttgattaagtattagctaaacaaacttaaaaaattaattaatatgattttcaagtaactttcctatagaactttttttttttgcaaaaacacaccggttagtagtttcacgaaaagtatcagtggaaaacgaaggattagaaattggattttaggctagcagtggatgcgatatgccttgcatccccacctcttccttccctatgttaacctcttccttccctatgttgtgcgggaatggctagcctagatttcttacaatttaatcttttctaaaacttattttataaacaaaactctcaagaaaacttatgatattaataaatctttttttggtgcaaatgacgctgacgccgtggccattcccctgccaccatggaatcccggtcgacggggcacccgggggatgacgccaatgacattggcaccttgggtcaacccataatgctagcatcatttgtgccatccactgagaaggactaagccgcgcgggatctcccccctcccccaacctcatttcccccctgcctgagtgaagaacagggagggttcctcccttccctctctctccttcctcacctcttcttcttaaatgtgatcgatttggagatgttttttatgggatttgttggcggaaatcgaagagcgcggtatactcacattctccttggtccatccaagaacatctttcacttgcaaccttagttcatctatagtgggatgggtgggaataaaaatgtccttcaacatcatatcctcgaactcaatatgtgcaccaatataacgtttaattaaccaacctacaacgtagtaaagacgagcaagtctatccatctacaccgaaaacgtattattataatcttttgaaaatagtctatcattcttcctaaatgtcgtacaaacccaaaagtttctttatcaatgcataaattaagattgaccacaacataagcctaaaaaatgttatcaactactagcctacaacaaatatttaattgacatggaaaaaataccctaaaaatataaatcgtgtcctaaccatacattagtctatcatatatacaatgaacacatacaaaaatcaaatgcatggctcacatctatcatatcgatccgtacccaacaataaacctaacacatatgctctcaatttaactagcgagtagagttgcgcgttcgcgcgacccaagcctcctgtctattagatttggtaggaagtgttgttacatttttttatctctaataaacaatattgttgtgataataaatagttaacatgtctaacgtgtaaaaattattgtaaatataatattggaaggttctaaattatgtatattattagcatgtattatattttaaatatttgcccaaatattttttcatttaaaaaattattcagacagatatttaaaatataataactgctaataaacttgtggagaaccctgttgttttgtattataaactttagtttaagtcattctattgaaaggaagcattgcacgtgacaacacaagcgaaaagaggcggcaccactatctgttggcatgcaatggcaactcctcaacccttttatcttgttcattcatgttttatttctccatgtacaccaacgcttcttccatcccaactcaacacgttccaccatctcctctctaacctgatattttttggatgtagctgtatttatggcaccatattttacaccaaaattagtcataattgtttttacagtatgtaaattacatacacccacattgtaattgcaccgtaaattttaaaactcaaattgtaattacattgtaaaatttaatatttacattgtatacttttctaatacacaatgtataagagaattagaattaaaagtaatttattatctacttggaaaatgagactggagagataaaagcatagttacatatgggagaaagcaatcatatggagaaaaagtgactgaaattaaataaaaaatgcggtgccatatttttttgcaaacccatattttttttctaattttgtatttttttaatgatatttttgtttttgccaaagttatctatgattgtgtttttactcccacatgtattccctagatccttctaatggaagcctcctcactgttctccttctctccatatttttagcccttctttccaaatccaatggctcatattttaaagcgtacgtggctcaatcaggaaatgaataaactttcgtcattcaatatgatgatgcctaaattcatttttccatatactccatacacatagtcactaaacaattccagtggcaagtatacatttgaaaaaaaaaatcgaagagtgtcacaacctgaagtttccccccttttcttgctttaaaaattggataaataaattgcccgaagaaattatcttaattaacctagagctaaatccctagttaataaatgcaattaataatcggaaatagcgtggtggaatttttcttgagttccccatgctccaatgcattaataagatttttagtggaattttcagagccttggaaataattttaaccaattaaaaatcaccaaagtgcaattttaaatcccaggaaaaatcctttcttctttttctttttcttttccttcttttttctcttttgggccgtcggcccactccctcccgcgctcggcctccttcctttgggccggcccgttcccctttcccctctcttcgggacgctgacaggtggggcccacctgtcaggtcgtccccttcctccagccgccagccccacgacggcaaccgccgccgaaaccgtccgcgccgccgccttctccgctccacgccgcgcccccactccgcgtccccacgtcgccgccctccccgccattcccgcccgcacgcgcgcccgcaaatgggcgggattcaatttgaatccccccactctctctctctccctcccacgtcgccggccaaatcggggggtttcccgaccatgtccgcccctctcgagcccctataaagcttccccgcatctccctctcccttttccccttttcgtcgcgctctcccgtgcctcctaccggtcgcgcgccgctcgctactagctccgccgcttgccgccacctccggtcgcgcgccgcagccgctagagccgccgccgcgccaagccgccgccgccattagcattgccgccgcgtgagccaccttggccgccgctcggtttccgctaaaccccaccggagcccggttctcctcgcacaccggtgccgccgccgcccgtccgcccctcctcgtcgccaggtcgtcgccgccaccttcatcctccgctccggccgccatactcgccggtgaggatccccccctcctccctcttcccctctctctcgtttgcgccgcctctctccacgcgctggccgtcgctttcggtcgacgccgccgtcctgtaccccgtccgccgtcgcttcccgcgccgccgattgccctcgccggcgaccgtgcgcgtcgccgccggttgccatggccggccggccggttttgaagctgagccgagccgtgcctagccgccgccgtgccgtccgatcggcctcccggccgatccggaccgtcggtcccgtggaccggcggtggaccacccgtgtggtcccggtccacggtagaccggccaccttgagccactgcccgtggggcccacatgccggcgcccccttcctcacccctttgagccgctgacccgtgggccccgcctgtcggcgccgccccccccttggatgacgtcagccctgggtattattgcgcaataattaattaagtactttttctttattagtaaaaacacagtttatcttctaaaattcataagtaattcatccaagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcagtttcttgaagacattgctgaggtctcatcagttcgagagcaaggcaagtcatgcaatacgtttgatcatattttacccaatttaccaatatcccgcatttctattaaatgttgcattcttttacaatgtaatgtgggatgggtcctattccttagccacatattggttaccttatgccattgataacttgggtatcaaaatgactagatgttggcttaggaaatgcttagccatgcttagttcaactaggacacaaatggggatcacattattacatagactctgactattggcatagctttagattggtgccaccgcaagggtgtcagttaattaaaatattctgaatggcgggctgtgagtgcatggttttgctggtcgcacccatggcagttaaggaccggttcacgggaaaccctgggagacttaccgtgcttactacaaacgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagtcgtgcccgcggttatgggcgatcaaccagattcaccgtgattagtctcacccctagtttaacttaatgaacttgtgtagttcaggtggttggttgggcctgttgcaacgtggtgtagtgttggacagtgattggttaatattgattaattactacagctgttttactgctttcaactactgctttgaaatacctgctttatgcaaaagaacccctagcttcctttggttatatcctgcatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacaaagagcctaccagcacattgctcacaagtaacaatacaagcctcaaatctcacattgcaaggcataaaataacaaatttgagcaaaaagtgattcctagggctatcttccaaactccaatttcaaccgattaaaatggaaaaaaataaggggaatttaggagtataccttgctcttcaatttccgcaagaaataccgcggaaaacaacactaaatcgaccggatttgaggaagagaggtgacagggagagagaggggagcaaaacgaagccgtcttcagttatgtatggtgtgcacaatgcgtaagattgtgtatgtcttatccttgagcctatgtagattagcgtgaatgcacgcctcgtgccatcaacagcatcaagaagcaccgcattacccagaggggatacctgctttatctagatgtgaccgagttcaaggaggattcgacatggcagtttatctattaattagaaagagtttgttagtttccttttaactctaggaaagtgtgtttagtatccaataaggacttcatgtttttcttttatatttagggaagtttctttcttgtccaataagaactagtatctatccatgggtataaatatgtacaatcggggtcattgtaaactatctccacgattaatacaaattcggcgcatcgccacccttttttacctttctatttttttcgacaagtttatgctaagacttgtcatggttgtttacatcggcggggatagtgctttgacactctaatcttgtcaatgtaagcacttacctattatatatcttaattaatctagtttggtagttcaatttacttgtatcggctgatattcgttttagggtttatgccggtatcgactaaattgctttaccagattatattagctaaggtatctaccatcctgaaaatcagtcaagggcttgattgtctagatattatgtttcttttcatacttagtgttgtatcagttaagtttgatctactaagtcgtgtttagaaccataatctctagcctgctttttgattgccaataacggtttcatcggagtttcagccgatgaggtatctagacgttgcatcggcttataaggattatatacaagatagattcagtcgattgcgacaaagatttcattgtttatctaattgtttggatttcatgacatcggtcctccagccgatgtatgctttaaccttcggatcattgcttattctatcatattattattagccgattggtttctactagattatattgctatttatcatcatcacctgattgtctttatattattatatatattggacatatagctgatagctcaaaatcctatcgatattggctggcatcggcatcggcattggctgaactactccattggcttgtcaatcgatcggctctttgatctgttatctatatatcttgttagttgcaggatcaaactgactggcacgtccacatctcaacaacctttggacctgcactggagctaaggagatctctcactctctcaggacgttgctgttgtcgacttagttcgcgccaacacagatatggtattatcggccaagcgtagatttttcatcaacagtgtataaatgaacttttctctttatctttgtaaaatgatgaactcttttcagcaaatgaattaatcaagaacacactaaaagtatccaatattcagtctatgatcatgtgcaggttgcagcgtttttgagagaacttttaacagaacatattctgaaatcaagaacaattaacattaagttcggaaataaacaatagaaacggacatttagtctaagatgatgaaaaacaaaagtgagaataatgaattttaaacctatctccaacttattttcagacttggtggtggaccaatatccctatggtttgggggataatgagccctgatttccaccttcccgggccaaaccgaatgcgatttttgtcagcacaaggattttttccccacgtggtgggcttccccgaaggggcagggcaaaaggccggtatcccgcccggccttttgccctctatccgatcgaacgaggcctaatcaattggtagagagatggttgagggagctaattaattggtggaggtgctacactagctagttttcactagaaagagaggaggcagtggctagaggatgaagatggcctgatgagtaggtctaccggtgatcaaagaggatgccgacagaaaactctattgattcaaattctagaaaattttagtgtcacacatcttagctttcacaaatagcaatattattattttatcagaccggtaattttttaatggtatgaattcaattagctctctttaaaaatgtttaaaaatagaaaattgtaatatcaatgcctgtagtaatgctcgaccaggagtaatccattgtcgatcttcttaaattaaacgctctacgcaggtagtcattgcttgatgtgatggtcactattaattattttggaatgaccctgcaagacttattcagcaggttgttaccagaaaattttaattaattttgtttccttgaactattagcgcaatatgcaaccaagtcgtctaagaagatgctgatgcacttaacaattgagaattgtactgattaagtacataattgataattatatatatgcaatataatatgcttacgtgtagtaatgcatcaacttgttcgccgagcaatcataaggacaacaaaccacacaaaattcgataattagttaaatgtcacagaaaaaaaaaaacaaaatctacgtacatgaaggtggtgtttgaatcttctgaagatgaagatgaagataaagattaagtgtttcacgaaaaaagaggtggtaataacgtgtgattaattgagttttaattattacaaacttgaaaaatggattaatatgatattttagagcaactttcatatagaaagttttcacacgaaacgcaccgtttagcaatttaaaaagcgtgccataagtatccaaaatttcatccttgttggagaaacgaacgcagctttcggtgcgttaacgaaatctagtgatataggagtattccaatcaagccatatacaattcacaacctgcatgcacccccaatatagaaatagttgtcgtgcttattggacaggattaatgaaatgctcgaaaaattccacaaagaaagatataagttaaacgtacgtagacaaaaggatcttgccgaaaagaaggttccgcgatgcagagagaacagtcgatgtggacagcaggagccgcctcccgacttttctccgtggcagttgacacgccctggcaataatcaatattttagacgcatggtctcaaacaaatgcttcactagccaaaactgacctggatcaatattatctcggagattttgagggtttttctttaaagtcatgtacgtgatatatagggtaggctgcgccttactagttactactggtcatgttcaagtcaaaacatgactggattaaaaaaagttcagtgaatgagaacgacgtcgcaatcaccggtaccatttctcggtggacaaggccgtgtcgcaacaaaagaatgcaagatttgtgatgctacatgtttaaccggtcatggacttttggacttctttttggctcattatatatccataagatttggtttataatgagtcgacttttggactcattataatgacttctttttggctcattaaccggtcatgtctaagatttgtgatgccacatttttaaccggtcatataatggtcgacgcttgcagttttaggtgtggttaggggtagatatgtattgagtcgactcagctagataaaactccactcgttagacttttttttttgttagaattaatagatgggctaaggcccattcgaagattaattctttggaaaatcataaaaacccaccttatgggatgacatgcatatgaagtttagtaccaccttgcttattctaggagagggggacctccttaaaagggaggatgccctcctagccatttaaagcatgtgtggtggagagaagaggggaaacacacacgcgctcgctcgcctggccaggcacagggtcgaatggtccgcaaaattggctcctcacctttgcgcaggcggcgcgcgtgcagacgtcgaatggtccgcaaaattaaaattggctcctcacccttgcgcagatgtagcctccttttgcagttttgttttgctgcgggattggattcggatttgttttattttggaaacatttcgaaaaatctggtgcgtgaaaacggcatggagtccggataggttacgcgcgacttatctggttcggtttacgcgggcgccctgatcagacgatctatctctatataaaccgagccgccgccttcatgcaatacacgcgaaatcaatttagggtttgcctcctactctgtactgcgccgtcgctcgtagactactccatcccgctcgtcggcgtgcaccggcgatcgggagatcaggtctccggaacctctgccttcgacgtcctgcaccgggagaaggcggcaataagatttttgggaagcgcttcgcgcgactgctccctgtttgtctacgacggctcgccttcctctccgctcgcgtgcttcgcgactttgtcgacgctcgcaaccgcgagtagttcctgccgagcaaccggtctttccgccacctcggtacgtgttcgacatgttgcgcatatttgatctgttcatgttttactgcttagtttatatgtgtagatctaatgatgcgttcaatctagtttacatatgcaatgtcatgatttatttatggaataaattaaattattatgtgcttataatttcaacatgaacatgattgcaaatacacttaactgcgtcggcaccaatcatcgctgcaagagcagatcaagatggggaagtgcagaggacgcggagttttctgaaagtatatagctccatacctacctacaacctatattttgctatcataaaattgaatgcaaaccattttaatccagccatttatgtaatacattttagaagaaatataacatgtcatattccatatttctgatcccacaattatctcaaatgtaaatgatattgaagtacctatgtgtacgatgtttctcatccaaatttccaattaaacaaataaactcagcaaaatattgaagtataacaacatgaatttccagcaatccaaaataaaacgtgcgctggcagcgaacagcgaacagaaaacggcaaaaagagaaacagagcgtgcgccccagaaaaaaaaacgtttttttcggttttttttcccttccacgcgatggaaaagatctacgtttcatttttatagttttttctgttaggatgtttgttcggattggattataatttttttggaaaaggtttcagtgatgatcagtatttttttatttgtagtaaaatttatacactaaactttcaaattatagatataattctatgtaaatttacatatataaagtttctctctatatagaaagtttcctagtaaattgttcctttaaaaaaatccatcagcattttattatttctagtaaaatttacgcacttaactttctaactacagatgcattttctacatgaagtttacatatacaaagtttatatatatataatttacatatataaattctctatataaaaagttgaaagtttccacaagaactgtgttcaaaatgctataaaaaactataacgaaaaaaacgaaatatgaaaaaacggaagtgaaaaaaaaaacagaaagaatacttgcaacggattacgaaacaatcacgtaaaagaaggaaaaggaaaattgaaaacggaagaaaatagcgtgacccgatttgatttccctcttctaaactgattcgcgtgatccactgatggcgaacattcgcctacaaccctgttcgaacacaaccttgctttcatgctgcagcctagctactacaaaataataatttagatctcaacaaaggggccaaaatttgcacatccatactctttctatgtactgtcattaggatcaattagtagcggtaagactgtaatgacctgaaagttcagactggccgtgtatgtacaccaacatcaaaaattacatcatttaataaataatggagatgagcatattaagttttttcccctgaagtggagctgaagaattaatgagatgtggttgagaaggattattccgtcattgatagcaatggacccaacctattgtgcaacaaatggtggcatgagcaataagtttcataagtaacaactgaaaaaggtaccacaaagaaagttatttaataaaatgaatgcatttttacataagtaagacaatgtggcattcgagaggacaatttcagattcaccaaccatctgcacccgaaaccaacaaacctggccatgttcggtgtactggctcatccatgatatcatcaagcagaagaaagaaagcttgaaggtacccagactttctctgtacatcaagaagctcattgctgaaaaaaaaagagagaagaaatcgatgaagaagtcagatcctcctatagtagccaaactgcaaacaaatatgaatggaaaaagaacacagtgagtaaggtaggagaacatctattttttgaagtaaagacatgagtgatgtgaattatactgagaagaagttgattacagaaacaattggaggatattacatagaacagaaagcaaactgaattttcatgtcaagaaaaactcctaccagcttgtcgaaacaagattttggtaatactaaaagggggtggctatcaagctggaaaagtggatgggtttggagacaaggaattttatacaggttcaggccttcttaatcaagaagtaataccctactcctgttcgggatgattccgccgagtgtattattgatcatatgatctgagaaaaaatcgtgtcctgagaaggacccggaccactccttatatagaggaaggggtccgtattacaaaatacagtccatatccctaacggaatatgatattacagataaaatacaatcgtaaccgactaagaccccgggtacttccttgacatacaagttaagaaactaacccgagttcccataaagatattctatctatattcggtaccctgtatccaacctaactataactgccatgtagatatggggtatccataatctccacacagcttaactccgccacttttctgtcatctgagcaaacgccctagaagatccttctattccgctgaagctagatattccaccaggttgtgatctctttctctctttctttcaatctttggcctgatgatacgagcgaaagcaaagaaatcagtcagacagatattatactcgaattgcataggggacaaaaccaaacttctgttggaattaatagatgggccttagctgattcgaagattaattctttggaaaatcaaaaaagcccacctcataagatggcatacatggggagtttaataccaccttacttattctaggagagggggacctccgtaaaagggaggatgccctcctagccacttgaagcatgtgtggtggagagaagagggggaacgcacgcacgcgctcgcctagcctggcagggcaggcggcgcgccgcaaaattggctcatcacccttgcgcagatgcagcctccttttgcaattttgttttgctgcaggaaattcggatttgttttgttttggaaacattccgaaaaatccggtgcgtgaaaacagcgtggagtccggataagttacgcgtgacttatccattcagttacgcggagtggagatcgtgcgggcgctctgatcaagcgacctatctctatataagccgagccgccgtcttcacgcaacacacgcgaaatcaatctagggtttgcctcctactctgtgctgcgccgtcgctcgtagactactccatcccattcgccggcgtgcacaggcgatcgggagagcaggtctctagaacctctgccttcgacttcctgcaccgggagaaggcagcaataaggtttttgggaagcgcttcgcgcgactgctccctgttcatccgcgacggctcgccttcctctccgctcgcatgctgctgttaacaaccaaatttggtaatatcggcatcgggaaagaagattagatcgaagcaaagttagaggcggagatcgagttcgaaaacagagcaggaatcggctagagtccaaatcggctgcgataagatcggctgagtctgagtcggaataggtaagccgatgtagccgatctcaacaatacaacttgatgtatggtgtcaggttggattgaggtgcttcaaggtgattgccgcacatggatagaatcctaaggaggcaattgtatctattaattaggatgttttatgtaatttccttagagatacgtttgggaaaaagtctgtcgcaaaaacttatggtatcttagagtttgttagagatagcagttgtgtccgttatggacatatcttgtaattctcgggtataaatagacccgagccctatgtaatttttaacacacacgtccaatataatttcggcgcatcgccactctttttcctttagttttgtttcgacaagttcttgctttcgggttgagccgcattggtttcgatcttcaacaagaggtaaaacttgttatgacgacttgtgttctcgggattagggcttccatctttatgacactctgatctcgtttatgtaattcattgagttatcttatatcttacataatccctggcaatatcgttatctaatctacaatcgactaacatctgtcggtagagggcagccgattaggttagatatcgatgttgatttagattatataagatatctacaactctatgaaacttccagcggcttgattgtctagatattgttcttcttttcatacttaatgcgcatcagttgagtttgatctattaagttgtacttagaa

SEQ ID NO: 47085 - DNA, 8769 bp, Oryza sativa
atttgctttatatgcttcattgacttgttaaatctgcccttttacgtcaaaatattgttgtatttaagtatattagacctttgtttgatatattatacttgttttaatatcatgatatagagtagtatcggagtattagccgatacatgttagatctatctgatcggctatgctataaacatatatagtcctgttattaatatatattttgatctaagtgatttatattgtctcggcacagcgaccgatctatcccaatcacttgatttaagtatatatcgatgtaagaattatatattggagatatctacagccgatcgaatagatttagtttttttattgtttatttacaactgccgatcgattcacacatgacatctgctcaaagataaatgatacgtcatcggcacctagccgatcggctatcatttatagatttaaccgcggtttctttgcttctatttcttgttgattacaggatcaaatcaactagcatgctagcatacccgaaggcgagctttggacctgcactggagttaagcagatctcccaggcctcgtgttttctgtcaacagctgcgcgccttcgtcgacgcccgcaaccgcgagtagttcctgccgagcaaccggtctttccacaatctcggtacgtgttcaatatgttgcgcatatttgatctgttcatgttatactgtgtagtttacatatatagatctaatgatgcgttcatgctagtttacatctgcaatgtcatgatttgtttatggaataaattaaatcattatgtgcttataatttcaacaatccaaaaaccttattataggccctgtggttttactatggctggttttgccgatgcactgaggccagataaattcaccggtgtgcactttaagagatggcagatcagggtcactctatggctgacagctatgaaatgcttctgggtgagtactggcaaacctgtgggagttcttactgctgaccaggagaaagaattcgatgaggccactactctctttgtgggatgcattcttagcgttcttggcgatcgtctggtcaaggtgtatatgcatatgaccgacgctaaggagttgtgggatgcactgaatactaaattcggtgctactaatgctagcaatgatctgtacatcatggagcagtttcatgactacaggatagctgacaatcgttctgtagttgagcaggctcatgagatacaaaccatggctaaggaactcgaactccttaagtgtgtcttacccaacaaatttgtggccggctgcattattccgaaactacctccatcttggagaggtttcggtactgcactcaaacacaagagacaggaatactccgttgaggggttgatagctctcttgatgtagaggaaaaagctcaggaaaaggacgccgcgtctaagggcgatggtgggcagtccagtgccaatgttgtgctcaaggcctagaacaagagcaaggggaaatacaaagctccacagaccaccaacttcaagaaacagaagaataacaacaaccatcttaacctggatgagaggacttgctttgtgtgtggcttgactggtcatctggccaagaagtgtccacaacgcaaggggatgaaggcacctacctgcagggcagactttcaagtctgaaaatgtgactattggcaacactggagatggaagcgggtatgctaatttacctactattttttcagttaatcagtctactaactagtgggttgatactagagccaatgtacatgtttgtgctgacatctcattgttttcttcttatcaggtcgcacggggttccaccatcctaatggggaatggggtttcaccgttcatggtgttggcacggtagatctgaagtttacttcgggaaagatcgtgcagcatgtccctactatcaataggaatcttgttagtggctcccgtctgactagggacggatttaagttggtttttgagtctaataaagtagtcgtgtctaaacatgaatattttattggtaaaggttatgagtgcggaggcctattccgcttttccctttctgatttctgcaataagtctgtgaaccatatttgtggcagtgtggatgatgaggctaatgtttggcactcacgtttatgtcatattaattttggcttgatgtctcggctatccagcatgtgtttaattcctaagttttccattgtcaaaggttctaagtgccatagttgtgtgcaatcgaagcaacctcgcaagcctcacaagactgccgaggagagaaacttggtacctctagaacccctacattcagatctttgtgaaatgaatggggtgttgacgaagggtgaaaagcaatatttcatgacgttgattgatgatgctactagattttgctatgtgtacttaggtaaaaagataaaaagacttaggtctgatcgtgttggagagtttttctcaaacgagtttgacttattctgtaaggaacatggtatcatacatgagaggatgcctccctattctcccaagtctaatgggattgctgaaaggatgaaccgcacactgactgacttagtgaatgccatgttggacaccgcagggctacctaaggcatggtgggggaggcattgtttacctcgaatcatgcgttaaacagagttcctaacagaaataaggacaaaacaccatacgagatatggattgggaaaaaaccatgactttcttacttgcgcacatgggagtgcttggcgaaagtcaatgtaccaataacgaagaagcgcaaacttggacctaagactgtggcatgtgtctttctgggatatgctcatcatagcattgctcatagattttctatagttaaatctgaggtacctgacatgcatgttggtacaattatggagtctcatgatgctaccttctttgagagctgtttcccaataaaggatacacatagtagttttagccaaccctctgaaataattcccagtttaatcacaccgccagaacaaaactgaacatacacatgaacatgtcactgaggaggatgacagtgaagctcctcgaaggagtaagagacaaaggacggctaagtcttttggtgatgatttcactgtgtacctcgtggatgacactcctaagtcaatttcggaagcatatgcatctcctgatgcaaactactggaaggaggttgtccgtggtgaaatggattccattatcgctaatgggacttaggaggtgacagagcgaccctatgggtgtaaacctgtggggtgcaagtgggtgttcaagaagaagcttaggcctgacggtactattgaaaagtacaaggctaggcttgttgctaagggctacactcagaaagaaggcaaagatttctttgacacttactcacatgttgctagattgaccacaattcgtgtgctactttccctagcagcctcacatggtcttctcgttcatcaaatggacgttaagacaacttttcttaatggagagctggatgaggagatctatatggatcaacctgatgggtttgtagttgaaggtcaagaaggcaaagtgtaaaaattgttgaagtctttgtatggtctaaaacaagctcctaagcaatggcatgagaaatttgacaaaacattgacatctgcaggctttacagtcaatgaggcagataaatgtgtgtactatcgccatggtgggggtgagggagttattctgtgattgtatgttaacgacataatgatatttgggacaaaccttgaggtgagaaatgaggttaaatcattcttgtctcaaaattttgatatgaaggatttgggagtagctgatgttatcttaaacattaatctgattagaggtgagaatgggattacactcttgcagtcccattatgtggagaagattttgaatcgctttggctacattgatagtaagccttctccaacaccttatgatcctagcttgttgcttcgcaagaacaaaagaattgttaggaatcaactggaatactccgaaatcattggctcgctgatgtacctggctagtgcaactaggcctgatatctcctttgctgtgagcaagttgagccggtttacctctaatccgggagatgatcactggcgtgcgcttgagcgagtaatgcgctatctgaaaggtactatggaattggggcttcactatactgggtatcctgcggtactggagggttatagtgattttaactggatctctgatatggatgagatcaaagccactagtggatatgttttcgcactgggtggtggtgctgtttcgtggaggtcttgcaaacagaccattttgacaaggtcaaccatggaagcagaactgacggcacttgatactgctactgttgaggcagaatggctgcatgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctattaggaaattgagaaacttcgaagttataacgttggattacatccaaacagctagaaacctggcagatcccttcacgaagagactatcacgaaatgtgatagataatgcatcgaaggagatgggtttgagacccatgtgagttatactatggtggtaacctagtctatgtgatcggagatcccgtgaattagaacctgggaagaacaaaccattagtaaactagaggagagtaccaatctataccatctccaagtgaagatacatgtactctcatgagctgcaaggcaggttggctatgccttaataagttctgttggctttaattagcgaagatgctgtcctgcagagcattcttgaaagaactcacctttgtaagcttgactgttggtcgcagtctatggagattttgggtgaatcttgtaggaagcttactaaagacctaggagtatgacttatacgctccacccgaggggtagtctacagacggtctagtatcagataagactctaagtgaaacttgcttgcacaagacttgcaattcaaggcgtagtccattgttcaagttgtgagtaagtgtagcttggagttctagatggatgttcaaccttaatcggtctccatgttcaaccttgcgtccagagaaggttgctgatttcggaagacaacattgtatgccggttgttctaaagagaccagaagaaaaggaggtagaaaattgcatggtgctttgaggggagtcgtgggtgaggctgcagcatggaaatattttgaacattggatagacccagatcaattccaaccctttccaagaagctcctagcgaacgaacatgttacactaccacagaaaacctcattggtgccgtttggaaaaccccctaggtccctggaaggcggcattgatgtagaggggaaataggtgcctgtttagaactgacacctttgaggtttcacaaataaaaaaaaagtcagctcgagcagctccccttcacccctccatcccgaccaatccaagaacacatgaagaatattcaagatcaccagaacccaagaacacaaggaacacaaaaacactaagaatggccagccgacgtcggggagggcgccgcccgctgttgccgcctcccttcctgcagccgcccaccactgccgccacccttcctgccgttgccatcacctcccctcccaccggatttggtggaggggtgggcgccgcctgccgctgtcgccaccgcctactgccaccgcacgtcgccgccgccgcttccctcccacctgttgatgagaaacacggtggactaggagatttgcttcactctagtgaaggtcctaggcttgcctcgagtgtcaagagcgtgccagctagtttgatcttgcaaccagcaagaaagacaacaatcgtaattagatgaacgatagtcaatcgggtgacagagccgatgacgtatcgtcaggacccgtcacatgtaataaaatcattttctatatgccttagaacacaattttcttttttcaattttatcaaaattatccaactgaatgttgtggtttgtcagatgcaaattatattactagtgacaattttctgaattacctgaactttgcatattaacatagtatactgattgtccccccatgcttaatcacagtaaaacaaaaccaactctatgatactacctttggtttttaatatatgatgccgttgacttttcgacaaaagtttgactatttatcttattcaaattttagtgcaaataccacctcatgggatgggatgaatggggagtttagtaccaccttacttattctaggagatggggacctccttaaaagggaggatgccctcctagccacttgaagcatgtgtgatggagagaagagggggaacacgcgcgcgctcgctcgcctcgcctcgtagggcagggcagggcaggtgcgcgtgcacgacgtacgcgtcgaatggttcggttacgtggagtggagatcgtgcgggcgcgctgatcaagcgactattgacggtccttaaatcataatatctgacagtgttggtgaaatatgtgtatgcaggtaatttgaggagaaaacacatccgtcatgcgacaaaatgcacctccacgcattcaggacacgtttacatggattggaggccccataactcaagtaaacacctccaaatggtcccatctaccatgccaatgggctgagggcctcaaaattagtgtccacgacgaaaaacgggctgaatggagtcctcccgggttcggccgaaccatttcagaggtcgttgatcccgagattcgacgtagatggccctgattacatcctgatggtggttgcggggtagttgggtcatttcccatagcaacaaccatcatttggagcctatataaggaggagttcactctaatttccaacacacaactttgagctgaattacaagaggctctattgtatcttttgtacattagaataaggttgacagtgagggaaagctctggaggagtgcccggaagtttggtgctcatccaacttctacctcgacgagtgtagcttcctaggaggaattcgggagaagtaccggagctgtcggtacaccctgctctgggttcggagaacttcttctataaagtaagcattcgtgttcctttgttttgttatttaattactttttgtctaagtaagatagatttccatctttgcgggttcattgtttagttgtcgtactaagtgccctagtactgggactccgggtagaaaaggaagttcctacgcaagtattagagtagtaattaataacttagacgtggtgtctaggttagagattacctttgtttgttgtgtatcccatagatttgtcataggtagacgacaggtggtgacagccctgaatcctgtcctagcaatcctccacattcggatacatcatagagctatagccggaaccacgcttgcagattagcaggggtcggtgcccgaagcaacagataggaatttacctttaacttagcttagataattaaaatgcatagaaagtcctctctaacctgcctagcctacttatagttgttttccttggatcgtcttagccttagatagattacacacgttccctgagttcaatatccttttagggtcacccgaaggtgactgtgctacagtggtattccgtgcgcttgcggatttatctgtggtcgtaagaaataccaacaagcatttctggcgccgttgccggggaacggttgctaatttatctgagtctaggtcatcctcgtatctttatttttatttcttcttcttttattcctttctttgatggagcaacccacaattcaaaatctctctgctcctcgggctgatctatgtgagccatcgtgttattcaaaactaatcctttcggatggctaaaaaatcggtcctggctttatagccatgattcgagagcaaaccttctctggtggtattagtgaaaacccatacctccatcttcgggactttgagctagtgtgttcatgcctatccatcgtaggcatgacacatgaaactctaaagtggaagttgtttcctttttctcttagagatgaagcgaagcaatggtacactatgtctgtcaagaaattccacggtgaatgggaggagcttaagagcaatttctaccttactttctttccattaacccatgtaatcaatcttcgattagacattctttctttccgacagaacgagaaggaatctctcggtgtagcttgggccaggttctcacagttaacttagtctggtctagacttgtctttacccgaccatgtgttgttacaacattttcggtatggattagacaaggggtctgccgcaaatctcgatatttctgccggaggatcattcgcacacaagacaactgccgaaggaagagaactcttagatttgatcttagagaatgattatcccggatgtcgagattatccatgaggaacctttgcatgtggagtcgaaacccgactcaactgtcgaatcctcattccagtcgttggagccggaggaagaagaaattcatcctccggaaattccattccaattcagggatgatctttatgaagattatgagaacaccttgaattattccagcaaaatcaaggctcatcccaagcatgagccattcgaggaggtgatgtttgtatcttcgttcatttcttctgaacctattgaccatcttcatgaaactgaacgaccctcatcaccctcgatcaagt

SEQ ID NO: 47086 - DNA, 12616 bp, Oryza sativa
ccaacctcaatgttactgtgaagctaaagatcatcaaaactattcttcccttgttctcgaatgatgcacagaacggtgctgtctcattttgtatatttccatcatgatttcgaggaggacctgaaaaccaagagcacagagccaagggcaggatgacctggtttttggattaatttttctttttcctgtttgtttcgttccagttacactgggaattaggatcaatttacaagccttcttttagcccgtttttatgggtttactccgcaagttcgttgacagcagagtaaattcccgggaaaccatgcaggatagcctttatacgatttgccccctttttactttttttttcatctttgtgcaaaaccaagaggcgcagaggtaataagttgcaaatcttggggagtttggtttataccctttctccgcaaaattctaacgagaaattcacaattgttcagagtaaatgatgcattgcttaatccattttgatgcttggtgtgtgcttgttttcctttggccccttcatctcgttgatatctgacgttaaagctggtttatactagcataaataaagaaaagaatgttgttaataaaacatgtgctgtgttctccaaatcatcattttcccgtacgttgtaaagaggtcgtgcattgtctgtttgtttggtcgatgcatttgttattcttaacaagtgatgggcagtagggatccaaataagctactccatctatctcaaaatataagtatttttagctatgaatttagacaactaggtgtttagatttatagctaaaagttgttatatttaagtattttttagttatgaatcttgataactgggtttgataactgggtgtgggtgttcagatttatagctaaaagtagttatattttgggacggagataatagttcccttcactgcttaattcttgtggttagcgactctaagcagtctatactaatttgttcaaagatttttatgattatgtgttaatgtagctgcaaattaagatgaagagagagcaataatgtgtttattctaatcatatgcacatctaggtttgatcggaaaatattgagttgatacatttttattcgccaccgattaactttgcttgcttttttttatggcaaataaatagccaatcttaattttatcaaaagtgcaagcaataatgggatttttgtagcgaagcacgagcttcatgattccccatgtaacatccctttatatttagttttttttttcagtggttaacacctaatgtggctcatatagagtactttgcattcttttgcagcacgttgttgaatacgaaaaggttaaaaaatagtgaaatctgcaattagtttttctatgattccatttggcacccttgttaagcacgtgtgtactaaaaacattttttattgttccaattgaagaaagagaaaattgctctgtgcaagcaaacattttctccctatgcatctttgttttgctccctccaataaaaacacaaacaagtattgtttcgaatcttgtagttgaactttgctataaaacaacatgaataattatgtttgacatgtgagaatgataattttctaaatagagcaaatttatgtgctacatgttaagttttccaaaaggagcaatttctatgttatatcatgtctggtcttgaaaaataattttctgttaggtaatcttttaaaagtagggagaatttgaattttgaattttgataaacgttattttgaatagttatgggtataattttataaaataaatagttaagaaatccatatccgtcggttagcacgataagttggcataacatgaatttctatatgttaggtggctttaggccctcctcacgtctatatctatacctaattaaaaaatatgcaaggtttctgtaaaaaaaattttcgtccgtccttttttctgactcagttttacccgtaatttttcgctgtttttcttttttttccgttttcgtgttgttttgtccgtctctcttttttatttgcccaattcatttttttctcgtggcttctcgctccgttttttcccgctgttttctttttttttttccgattcgtttttttcgtgttttttttgttttttcatctggtttttacctaactaaaaaatacacaaggtttccgtaaaaaaaaattttcgtccgtcctttttttccgattcagtttttcccgtaattttttgcttcatttttttggctatttttctttttttttccattttcgtgttttttttgtccgtctcttttttgcccaattcagtttttcccgtggcttctcgctctgttttttcccgctgtttttccctttttttccgattcgttttttttcgtgttttttttgttggtattttcatccggtttttatcttatccaatctgttgcgcacttgtacttcaagctacttcctcttgtgttttctcctcccattgattgtaaaaatcgataccccactccactcttattatttttttttcacgatttcctcttttaattcactggatttaatctcattggttgatgatgctcggctggccatttttatcccaatcccaaattttatggatccgttccgattttggaaaaaacagaaagactagaccgagtggataaaacccctcaaccggtcaaaaaagatttagatttgatggagaggatcagctccgcatacgggcaaggtactacgccaccggatctacacgcgggtagccgccggatatgccgccgccgtcgtagccgacgtgggaagccaccatcgccggcggatcggtccgcgaaccagatctacacacggatagccgccggatccgccgcggggagccgtcggcgccatcggatccaccgcagaaaggcgccgccaccaccggatcaagccataggaagcgaccggtgccgtcggttccgctggatctacccacgggaagccaccacactccgccccccctctctccttatccgctcgtgaatagagtcgtgccctcgtcgtcttcacgccgcgccagcgtgacaggagggagaggaggagagggactggcgacgccggtgaggggaagggaagggggagcgggagcggcagagagagggaagggggaggaggttctcacgatggtggaatgggatgggaaagtgtgattagggttagtgtttttagcactgacggtttgatggatatagaatcgatccgacccgtccatcaaaatgaatggcacagatcgatcccacgtcaggccgacctccatctcgggccaccgcactgctgggccacgcatgcttcatgggcaaggagcgcaatagcaggccgatagggtccaatggaccttttctttttttttctttttttagcacttttttatttctaaggaatatatttttttgaaggctcatatcatgaaaaactaaaccgtaatcgtctaatatttttatatttattataatttcagtttacccgttgcaacgtacgggcattttttctagttaactctgaaaatgctacctgatgatcggtcactggaattaggcccacgtgatcggttcctgtttccctttttggcgtaggtgttttttttttcaaaaatccctgattcgtcacgcatcgtttgtttttttgtttttaggaaacgtggtcaggggcatttcgatttaattctaaacaatacgatttatcaccaaattttattgcataataaactttgtatgtataaacttttttcgaacacgcgtgaaatcattgtatcatttcaataagcaaagaataaaaggtcggacttacgaaaacaaaaacacgccaacacacccactggaaaacacacacacacacacccataaacacacctcccctcctcctagggcacaagagctattgtgttggccaacaactcttggaacctagaagctcctgccatacactatagtgtgccctcattactaatggatagaaccacacttgtcacgctaggagtaacaccattgaaaacataagcattttagtgtttccagatttcccacgcgactaagataataagagagttaagccctttttctcgttcttttgcaaccctttactgcctttgaccaccaacacgaaaacttgcgcgtgtcatgatttcggtagagtggagaaatagccaagcctttggagaactagtgacaaaccttgtctgctgaaaacacaagaaaccaaaatgtgttgcattgtctccttggcttgatcacaaaggggcaagcggctggatgaggcaagtaacgcttggcaagatgatcagccgtccaacaacagttgtgtattgccagccaccgaagaaacttgcatttaagatgtgcccaactcttccaaatccttctccaaggagcaaacttgactgcccccatgaagaaggtctcatatgcggatttggaagtgtaaactcctgactttgagaacttccaatagtgctggtctagaattccttcttgcagcaccaccctcatggactgcttcccaaatcctgatgtattctgcaagcacctgcaccgtcaaaggtcctctaatgtccatgatccacttttagttgtccaatgcttgagccactgtacaatgcttgattatccttttcaattcacataagttaggggccatttccaaaataattcttccatgcacccatctgtccacccaaaacaaattagattgcccattcccaatttgcgacaacaccgccgaactaaaaaggtcatgagaaacacggggaacttggacgagcaatccttgccaaacacgactattgtctatcttttggagccataaccaaccaatccaaagggcccaactcatatattccaaattaagaatactaaggccaccataagctagaggtcggcgcactctatcctaggccattaagcaattaccaccattggtgttttcttgtcctgaccaaagaaaccccctccttcttttgtcaattgcttttgcaacccactttggtagatccatagcaatcataagatatataggaatggcgaatagaacaacccgcaccgagatgagacgaccgatccgattcatgagggaagctttccacatggggagatcatccgctaccttgtcaaccaaagcatgcaagtcggtcttagacagtttcttaacatttaaaggaagacccaaataggaacaaggaaaatccttgatctcacacggtaacacattcacgatcacttccaactcttcttcattgcacctaattggagttattgagctcttttgcatgttggtcattaggcccaatgcatggacaaaaatatccaaaacattcttgataatggagagatcattcaccgttggtcttgaaaacataataacatcatcggcataaaaagaacacctttgctacatttgccgaacatcaagagtctgaatccaaccctcccgagctgcccggtccataagagagttgagaacgtccataacaagaataaactttcattgcaaaactttttgtatagaaacttttattgcataaacttttctcctgagaaacttttgttgcatcaactctctctagaaacttccattgcataaactctcttttgattttttttatagaaacttttacatacatatttttgtagagatgaagccataaacttttgggtacagataaacttttatagacatgagatttcaaaccaattaaaaaactcaaaaaacttcatattcaaaatcaagcattctcaatatctcaggaactattcactctaaattggaaactttccacaatcctactccaaatcatcaacattcaacttagcatggaaccgtgcagctcacccgagggcaatagcccacctccaaccccatcgtcaccaacgctcgcaaccgcaacaaggcacccacttcgccattcgctgcaccggcgctgacggcctttgccatgcatacaccatctgccttgctagggaagagaagaaataggggagggggagtggagggctcggcgcgttagtgaggatgatggtgcgcactgttgctcgttgatgcatcaaggagaagagacgacgtgaggggcagaggcgacattgcgtggttgaggcgtgagatgtggaggaatactcgatgaatcaatctatggtgggtggaaggcataagatgtggataaggtgttcgctagcttccactgcatatgatcggtcgcgaaataagccccctcgatcttgcccatttattaaaagagaatcttggtttcccatctctcctgcatatgtagaaaaatgttaagttggtaaggaaaatatatagtagaaacttaaaaataatcatatatataaaattctaggacaatggtagaaaattaaaacacaacgaagaaaaaacacaattcctttttttttctatctccttcttcactgttttgtcatttttatgtagtatcgtcttagttatatatttatataagtgttattttttaaattccccaaataactttttatgccgtgatttacatggtaaaccacacctaataatgaattttacatagagtcggtgtgcacatgacaatggctattgataggggagtgctattacaaaaatgcatatgacaatggttagtgatacatttggggagtgctattacaaaaatgcaaggtaatttagttggtaagggtaagaccatatatatagcttgtaattaattaggggcacacgacgccatagctgctttcaaaatcaaaaactcctccaaagagtctacctttttattctgattctgagaactatagttataaaatgtagaaaataaactagaatcgagatgctaggtgattctcaaaagctaactaataaatagttgcttcttagaagcataaactcccccaatcaggaccttagcctagtagcaataccaataacaagatcaaccaaacatggaaaatgaaaattaacagcaaacaaagtgacaccggaaaaataacatatgcaaaatacgtcgatcacaactttcagttaaacacacatgcaattaaacatggtgaatccgtactgtccccttggaaggttggattttaagcacatgaaaagaaattatatattactattccgactaaacaaagagacaattgatttgtgaacatgttatgaatatttcatattactcaccataccatgctaaatccaaaagtttacatgatgtgatgataattactacgaatatgaatactagcagtgttcatattaaaggtcaaagagatcaaaccgccgttcatgttccgaaattagattcggtcacctgcagtagtattgacttcaaacggccaccaaatgtccatacgagctctgtgctggatccatgagtacttgatgaaaagctcttggagttctctttccaacggatccagctcatcttcaaagtccacctcgatcatttgcagttgaagaaataaagagttgtgccacccgtcataggtctctggacttataactttgtttgtgaccccggtctaagtggatcccaagtgggatgcatcccaagctagtgtagcacgtccctagggactccttggtcatcctcccatcaacttaaatagctatgtaccccttcagggtttttgagtttttttaattaaagtctagctattgctacttttctagataaagccgtgatcggttagatcattgttttctcgctacgagacccaacttatcatgtatatttaattcctatttgcaatatcagattatttttattttttacttgttttttcgatttgcttgtataaataaggttgatctacacccgcaagatcaacaatccacggagagatgtggcgatcgctaaggcgcaacacaacaactcctcgtacagttgtagtcgggtcattaacttttctctcaaattgtagttattatcaacttaccgaaatattgaattaatcgtagctatgagcatatcgaggaagctcaaagcttatcaggtggtacagagcttatcattacaattgcatggtcaattgtctttttatgaaaaaaaataagaataccacaggaggctcatttcccttaaaattgcaacattggagggtatatctgcaaaatatattactcaactactccttccgttccaaaaaaaaaggcaaactctgggtttccgtgccaacgtttgactgtccgttttatatgaaatttttttataattagtatttttattattgttagatgataaaatatgattaatactttatgcgtgacttatatttttaatttttttttataatttttttaaataagatgaatggttaaacgttgggtacggaaattaggtttgtcttttttttttttttacggagagttagaaaactactacccccgcgtggccgcgtgtggccgccggaccagttcgcgtcctgtgccttttcctgcccatttcccaccaccaccacgtcacgtcgtcacccccacatccaaagctaccccaccgtcagccccacccactcccccaccgtctcgtaggacccacatccactggcccccacgtgtcatcagcataagaccgccaagcgcggtaaaggattcacgcccctttggtcccaccatttcttattacccttatattattaaaaaggaagaaggcgacgacgacatcggtgaggtctcctcactcctctcctctctctctctctgctctgctttgaccccaattcccaacacccctcccccttcgcttcgctgctcccgattccggcagcctcgcgccgccgccacattgatggtaatagttggatccgccgcctccgccgcagccgacgacgatgggactctgctcctcctccagcgcccgccgggacgccggcacacccggcggcggtaacggcgcggggaacaaggataacgcggggaggaaggggatcgtggcgtgcgggaagcggacggacttcgggtacgacaaggacttcgaggcgcggtacgcgctcgggaagctgctgggccacggccagttcggctacaccttcgccgccgtcgaccgccgctccagcgagcgcgtcgccgtcaagcgcatcgacaagaacaaggtatgggcccaaacgagcgtggtggtgtgcggctgacgcgtgggggccatgtgcccatgtgttgctcgattcgatcggccagttgggctagcctggacgacgaccacctttgcggggggcgtcgcgttttgcacgtggggttgggttgccgaggaaatgtgaaatgtgaatccggggcgatactgtagtggtagtggtacaaatcaaaaatgcactgccactacctaatgctgctgcatgttagtactagcgcaacttgcagattgccatggaggtgatccatctaaaccatcgaatctggtgggatgactccattcctcatttcttcactcagtatatgtacttttcagggatgaggtccattcctcaaaccaaggaaactattttggatcaagtggtcaatggacatctcaatcctcaaaccaaaataccaaactattttgggatgtttaaatcttcattcttgagcaaaataggaaccagtcaggatggaggcaacaagtggataatggactatacacatacgtaatggacacatgtggcgtatacaaatttgtttagttccaaaaccagtataaagactgcacaaatgcctcctaacagatacggcaaggcaattcctgaaagacactgatatgtactgaaacgtaacacattcgtatatgaccctacttctcctgtacatgaaggtcataaattcatgagcagagaaatgtaatatgtgtattcagaaaataggacgcactgattttctggactctgcattattgtaaagccttgtcagcatgtgctatgctgaattgaagcatcaacagaagtagagaactagcctctattttgaaaagaaatgatactgctctaacttctcaaatgggatgttttcgttgcagatggttcttcctgttgccgttgaagacgtaaagcgagaagttaaaatactgaaggccttacaaggccatgaaaatgttgtacatttttacaatgcatttgaagatgataattatgtgtatattgttatggagtaagtcatggaaaaactctcaaatgtttatgaaatcagtagaagtatatctaagtataaccataaaatgtctaagtgaacttttcatggccttagccaagttgaaggaaggttcatatgtgtgtttatgcttttttttagaaaccacccatattttaagtaattgatcttactgaggtctagtattttagtttgtgcccctccaaacaggactttggcaattcaggatctaattacatggaaaagaaacaccacatgcaaactggcataatattaataccctcgtaaaaatctagaaattgtaccgggtaaatatcaagttcaggataaatagttggcaaacactttcatgtttctcatctttgttctctttgtatcaaggaactgtgcaagctaatgaagatctgaccctgttacatgtatttgacagattatgtgaaggcggggagttacttgaccggatactagccaagtaagtcaatttttgaagtttgtcaaaaatttttactttaccacagaactgtggcatgcttttttggttgtgttgggattacttattctaaatatagggatgttgaaccggagagcatttcaattagtgcttcgtgccacaaagagcttggaatttaatatggatgtatggcatatagtcatatattgttttcctattaccataaaaccaaaatattacagggattgacataagtttatgtgagacatccactagccatcaactgtcaggaattgttcaaagattttttttcgactgaatgttcaaagatttttatttattattaagttcgtttgaatatttgatgtatgtagaaagcaaattcactgatatcacatttgttctgctcttacaggaaagatagccgttatagcgagaaagatgctgcagtagttgtgcggcaaatgctcaaggttgctgctgagtgccatttgcatggtttggttcatcgggacatgaagcctgaggtatgctctaaaagtacaagactaagtcttcttataagagtaattgatcatttgatatgtgtatttacagaacttcctcttcaaatcaaccaaagaggactcatccctcaaggctacagattttggtctttcagattttataagaccaggtttgtgtgtatgttgtaactacttgttctattgttttcttgtttaactttcttccattccatatgaaatataaaagagaaaaatctctatttggccttgtaagttagccatatcccttatttgctctcccgaaactaaacctttttacccttctagtaattcctattctattagaggtatggcttattatattttctatgttaatcccttctaattccttgtcaatgtaaaaagggcattcaccgatccatgtgcataaaaaaatgttgataattataagtagtagtaaaacttgatcgccatcttttattagaacatacattctttttagagaaccaagtctgcaggcatagaaaatgacaaaactatttacaaattttagtagcagacatagaaaaaggtatttaggcccgagccaattaaaaagaaaaacagctattttactatgcatttataaaaaaactaacatgctaaagttatactctctacatgttaaaaagatattggttttttttattaatgacaacattagaaataggaagactaaaaaagaagagataattgtccttgcttccagttgagaaggcattagaaggtaaaaaagtacttcacacataattcaagtagcaaactaatggagaagtaatacgaggggcaaatatagaaacaaagttgagaaagatgggcatgaggggttgagcagttccgcatgggcaaatgaaggatacgactaacttttgagggcaaatataaagaattttctcaataaagaaattattctcagtgtaattgaaattaagttgccgcactcacagggaaacactttcgtgacattgttggaagtgcctactatgtagcaccagaagtgcttaagcgtaagtcaggcccagaatctgacgtttggagtattggcgtaataacctatattctactgtgtggaagacgacctttctgggacaaaactgaagatggaatatttaaagaggtcattttgcctaaactatctttgtcttacaaccattttattacatgtgtttcattgattaaaactattttcttgccttacaatcactatattttcttctttttttccttcgatgttgccgtattatccgtattactttgatatcgttctaacttttagtagtccatacttccaaggaagtgcgcatgttattcttaaaatacttctggtctgttttaaggaaattcagaatcttaggctggtatgtttcagttaagtggctcttcatcttgtccaaaaaggaagaggaaggatcagcacatgggtctagatgatgtggcaaatgacatggcaaaacagaatgatgtggaaagccacctcacttaaaaccacttgagaaacaatcatagggacattatttgcatgatttcaa

SEQ ID NO: 47087 - DNA, 1955 bp, Oryza sativa
  unsure (1)..(1955): unsure at all n locations
atcatgttggaattactgaccttgtctcaaatcgtgtccatcctctgttccccgcttctctttccacaatgctaacaaagtggcatattctttttggtgcaggtgttgaaaaacaagccagattttcgtcgcaagccctggccaaatatcactccttgtgctaaagactttgtacaaaagttgcttgttaaggatccccgtgcaagattaactgctgctcaggcattatgtatgtaactttatatcatttttggatgtcttaaatttaagtatgataatctgattagggaaactctatatcattttgggacatcttgaatgcaagtttgcaaatctggttatttaataatgggattctagtggcaaactgttgctaagtctgagtgcagtcatgcaaattcacaacttgattactgggtgactcttagatgggatatatctaaggggatttatgaagggccccttcaggttggaaacttatgtatgagggtccaacctcaaaggcttactcagcgatcattaatgggtttgcagtgcatactccctgttagcttaatacttatttgtttaacttctgctgggggttcagctttggcttgttatttgaagccatgtggctatgcttgctactcatgaaattcagacctccattgccttttatcgatttgattgttaagttattgctatgtatatggtagcactttctgattaccatgcgtaaaataacagcttataccttgaatttgatagaaacatcttatgttgttttttcatggttagacatggttggttcagttactaaggcttggtacaatctaatattgatacataaccaataccaactaattcatgttttcattacatcatagcaactaacatttgctgttcagttggttatttatcagttatcacagatggcatactgttggtataaaaataaacaatcttattatcacagtgctctactaacatgaaaatttacatattattttcttcagcacatgaatgggtgagagaaggaggacaggcatctgatatacctctagatatatctgtattacataatatgcgtcagtttgtaaaatacagtcggtttaagcaatttgctttacgggtaagttatcataccataacttaagggaatcttatccatgactcaggatgatttcggagtcaattttaaatgtttacatctcttgtaggcgttagcttctacactaaatgcagaagagttgtctgatcttcgtgaccagttcaatgccattgatgttgacaagaatggaacaattagtctggaagaactgaagcaggtacatccttgttggaattcctcgctacactattggcttgtttttttttactaatatttagcataatccatggaatacatttctttgtaatttctcttcatcttatttttgggccactgttctgaccaagctctcttccattctgccacttccctcatgccaacattctgtccgtttggaaacaaatactggaaatgtagaaaaatgaaaatagggaaaaccataggataatgtaagaagtatataatggcaaaactgtttagggattgccattgttaaattgtacaaaccccagtggctgatgcaggattttggagatgggggtacaaacttgtaaagaaacattaatacatggaaaaacctaaagctccctattaaagcaaataatactcaattattcagtaaatcagaaaataagaaaaaatatttataaatcctttgaaaaaataaatattaaggtttcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47088 - DNA, 711 bp, Oryza sativa
cttcttaccaccggaggactcctgcaatggattcagttcccctcgcaacctgcattagattaaaaaaaaagaactacttttaaaagaaaagctacaaaatccagagagatggactttgaaggtgatccatcacatatgtttcctacaaaatatagtgatttaataacacaattagcattcaacatacttgatgagattatcaacacgtgtgtcaactgtcaggtaataatgtggaattgtttgcttagagcttagcaggcggttcgcagtaacctggacagaattgaagttaaaacactatcagatcaataacatcgcataaaaaacgacttaacagaaagaacgtatgattgaaattacctttcttatttgtgcattgggaacatcggtgtaacttagccctggagccgcaagagcttcctttctgcaacccttagctacagaagtttgtttaagaaaaaaattatcaattgaattctcacagatagaataatagcataacacaaaataaatctggcaaatataaaggaaagcataaaaccacacatttgaacatacagagttcaagcaaattacattaataatatttcatttggatcaaccaggatggtgctactaaaacaacaaaattatttagaaattcaggcacacaggaacaagtaaactaacagagttgagtgaacaaagcaagcaaaaacagatttttttttt

SEQ ID NO: 47089 - DNA, 9496 bp, Oryza sativa
ccgtattgttctattaacatctagaaaacaagtatcaggagtaatcaactaagcttttttttaaaactgaaaaacagcaggggagggcccgtggttaagattttattaatataacaacagacaaaagccaaaaaaaaaaagaaggaaaattgcagattttggatccaatcctctagtgtataccaactaagcattactgatattaccgcacaaaacaaagttcaccaattataaaactaaactacacaagtggtacacattgtttgagtagcaaccaaaatgatctctccaaaagcatagagatatataaacgttgcatgaaaaattcaaataacaagtgatgtggattattcagccctgcccagaaaaaagcaagtccaacaaaaccaaacatggttaacaacttaaggaaaagcatcatctcacacacataactccgatatctactttcagaaactgttcactagttcagtgaaatgcttcctagcacagatagtgttaacatgcatttaactttcataatgtcatgggaaactaataataaactatgaaagtattatatgattaggaagacagagcactcactttaggcctactaaggatgatcctggaaactttgccaataattcatatgcttcagtatccaatccaccctgaacaacttcagcagtgcctcccttagaaggtgcttgcttctttccagatgatttagccttggctggcaattgcccaagcctagattcagcaacaacatacactgctccagttgacttgtccttaacctgttcgcaacacagtacacatcctcaacagaagaaaacatcaacttacaagcagagaagggtgacagttgtatagtttttttctgactaaatgaatggggtggtctagacatggagcagaataggaaacaatagtcgataatgtctttcttctacaatcaatttgatcgatttatcacaaaaaaagaaataagtaatgcaagaatgcatcattaagttaaacaaaaagggtctaaaatgttttttcgcaaacagtaagaacagggcagttgcagctgctagattgactggtacatggttctctatactgataaatatggattaaccggatgcagcaattaaattatttgcgggaactgggaaactactataagatcccaggagatatccactaaaataaggacaagcatcatgtatgtgcagcaaaatgattataggataaacaagacagccacttaatgcaatataacacagaaaccaatgatctattgtgtatagcattatgtatgcattagtttacataacatccagagttcaaaacttctgcacattttggatttactagcgagaagattcctcaagagtatttcactggtttttttgcttaatatatcatcagtgaaagttctgttccttgtaaaatcaagttttgtatgtatgatgttaacagtgggtaaacttgacagctatagtctaaagttaaagaatggaaaaatagcccaaggaaataaaggagaagtactaaccttgacatacacaagattggcattgacacacaaggctaaattgcttggaagtgtccagggagttgtagtccatgcaacaagtgctgcattgtccgcatcaccgataatagggaaagacaccatgattgctggatctgggacagtctatggcatcataaaaagaagttactacaaattgcatagaaaatttatgagctacgacatgaacaaagtcaataaccaaccctatagtcaagtgcggcctcaaagtttgatagtgcagtcttgcatcctgtactgtaaggcatcacctgggacaagaacaagagcccaggacactttaactttcaagaaattcctcataaaaataaatccattaacagaaacaacagataaaaaccaatcaattatttcatgtaatcacaatagcattatctacaaaatgaaaagccacttccatgtaacctaaactctgctattcattcttctcattgagacataccagaacaattccattctccacacatataaattccaaattctaataaaaaatacagttaaccattgcatacttctgaataccataaaatttcaggttccctaccgcctcagcttgtccactttgtagcaactaaatcataataaatatgcaaagcaaaccccgagactcaaaacctaatcaggcgtgagatcagaaatttaaccttgaaacccttgtagacgaggtctttctcccagagctgcgagaaaacccaccaaacggactccatgaaatttatgtccatggttttgtagtcgtctttgaagtcgatccacctccccgtgcgcgtgacgacggcctcccattcggcgacatacttggtgacgatgccgcggcaggtctcgttgtacttgccgataccgaggtcgaacacctgctgccggttggtgatgccgagctgcttgtcgatctcgaactcgacggggaggccatggcagtcccacccgaagcggcgggagacgtggcggccgcgcatcgactggtggcgggtgaccacgtccttgattgtgcccgcgaggatgtggccatagtgcgggaggccggtggcgaacgggggcccgtcgtagaagatgaactcctcgccgcccttcgtgcggcggagctgctcgtggaaggcgtcgagctccgaccacagcttgagcacgcgctcctcctccgcggggaaggagaagtccttcccctcgcagacgtcctccatggcctccgctcctgaggccgcgaccccggcggcgaatggggctagggtttcgggtgaggcggcgaccgcggcgaatggggctagggtttcgggtgatgaggcggcggcggcggcggcggcgggggggtaaggggaggaggggcttggaacaagagagggggaagggtttagagctggaagttcacgtgctgcgtgcgtgcttctccttctcttcgctagaagggaaattttcatttcgacacctctatttgtcgcatttgtacaaattgctctatttttatcgtgttcagtttttgctaactcaaacatgccgtggcattgacgagaaaatggatatttggccacgttcaaaaagcggcttagttggaatgccatcctaaaaacgtgtttcactaaaatgctaatatgaaacacgcaatcatagccactttgtcattttctctattttcgtcattttcaattccattttcgctagaattcagcttgatgagaccaaattgcccctgctcgtcggctgaaaggggatcgagatcgagcgcggcgaggtggtcttcgttgctgacaagggcgtcgacgatggtgtgggacggggcgaggccgagcttggcggcgagtgcgtgcagctggcggccctcgaggagagccgagaggaaggccgctgcaggagcgcccggtgtacgaggtccacgcggcgggatcgcgcgagtgagcgttggaggcggacgaacgaggagtgcgaggtggcgtcccgatggtgggtccacgtggccggagcagaggaggcggcgagcgagagcatggcggcggcggcggcgacgacgcgcagcataggcatggcaaggtccaccgccacttgcaactcaccggagctcgacaagattggggccgcgggcggtggcagtgggcaacgtaacggtggcgccgcatggtggaggcggtcggtggggacggcttgaagggagcggaggaggtggaggtagtgggagattggggcggtggtgacgacttcgtcggtggagccagtgaggaaggccgccgctgagagccaccacggccttgggcagccgcatccacagccggacggcggcgccctctaccaaccacttcttcgacgatgggcacgggcaacggcgcgacctccggtgcccaccgccgccaccttccccgacaatgacgagcttcgactgagttgataaggggcaattttatctcatcacctagtagatgagagaaaatcttttcgaaaatgaataaaatggcaaaaatgccaaagtggcggtagacgcacgcttcatattggcattttatcgaatcgcattttcgggatggcattctagcgaaaccgtgttttgaacatggctaaatatccattttctctggcattgacaatcccaaattttcgtaagtaacaacataaacatgtctcaaatactgtaacacgtcatatgataccaaaatttaccagaattcggtaataccaagttttagcatattttgctggtaccaaattatacagtagcattagatgtatttaggttgatctcttctcaaacttttattatgatagaagtttctgagttacaatgtagcattggtaaaataatctttagtttatcatgttgtatagttatatcttatcaattgttggcattaaaaaaatggcggggttagttttggcatcaaactgaacacaccctatattagcaaaagggtgccctttcacttggatattttactaacagcccatatcactacagaatcgtgcatatcgaactcctcaaaattgcaagaaataacggcacagtgatgcgcgataccatcatctcaagtccacaggatattaggatggacgatttttagaccatgttggatttggattaagtatggtgacgtatatcacgataaaacaatggttaacggtgaacaattagtactgtgctagctgctttagaaaatggcattttgggctatgtgtcagtactataatccagctcgactttttatgagtttttgtttttccaagtcattttcattcgtgttgtcaccttgaaacgagacagaatggctaatcttgtttgaactctccgtatatacattgcaaatacaataggagcagtgcatggtgtttcgtttcattcatgcaccatttcacacattgtatttgatatttgcatcagattgctacgaagctaagaacaatcgctgcattcctacatctacgcgcggttagctcgccggcgtcgcctgcggcggcttcttgatggtcttatcgctattgtgaaccatcagcatctcctgcaccgccgcggagagcagcgactagggccggttcaacattttaaagggccctaggcgaacttcacattatagaccctttagaagttaagaagttaaggctattttttaacttgtaatatctataaagcatctatactatagtaacagaaataaacatttctaacatgttaaataataaatcaaacagtttgcaagttgcaatataacaatttgttctcgataaataatatcgatagtatgattgataacttaaaaaacacacagtagaaacaaagtactatgacctaaaatcagtgagggaaaaatgtatataatcaagggcctaggcctaatgaaaactgatccaccatataccttaatttaattagcttatggacttatggtgcactgaatggttgtataatctcttgaacggttgaacccagaacggtagaaccctaagtccctaatcttggtaatttaacggggaacaaaaaataaattagaagaaccgatcaattctaatcagtgagaaggatcgatggattggatcatcaattctaatcagtgagaaggatcaattctagcctattgggctaaatatctatacaggatccccccattttagcttggccctaggccatcgtccttatggccctactccagagctggccctggccagcgacgccgcgctcggcggctgctgctgcaagccgtgaatagcacccgccgccgccgcgtgctccacctccatgccgagccgagcaaccgatcacgttcctcctcctatctcgcccaaaatctcacctcgcttcgctgctctgagcacgtctgcgctgcaatggcggcgacagaaacatatacgtaggcgcgcgcgcggccatcggctgccgcacgcggcgccgcgcccagatacggcggttcagcggtggattatccgttttcgcgggcggatggatcagggcgcgcggcgttgcggccggtggcgcgcgcgcgcgctcacgcggaggcgtgccggaagttggctgcggacgaacactctgcacgcggcgcggcgcgtcgcccgaacagcaaaaccgcattcacgttaattaccgttctttcatcaccgagctaatccatccgctccacgttaattaagttgggtttcaaacacgtgacgcgtccctgaagggaaaacgggtttaccctgggttgagaaggccaaattgcagggaaaaaacaacagccgcgattaacaggttaaaggagctctaaagcagttaatgtggcactgtatgcgtgtcgccgaccgccgctgacaacatgtaacctccttgtaaccttttcaccccctctgctcgaccaacgacttgatagccacgaaactttgaaaataagaacagcccttgccttgagacggtcacgtacgtcacgcagcccacgctcttcttggaagcatctcgccatgagtgccatcgccgccggccgccgtcgcgtcaccatgccgtactacgcgctgttcggcgaggtggtcatggatgggatcgtccgtgtggaacccatgggagggttcgacggtacagccactgcctactatcttcaggtacatacgaataataatcgatccctttctttccgttccaggatgaactccctgtgtgccatgtcgtcgttggtagtggtactgattcgtggtagttttggggctgatcaaagtgttagtttgttttaaaaaaagatttggtgtttgatctgtcttaggagctgtttggttgggctgattttggcccgttgcatctctttctttccacaggcctagtagaaaaaaaaatacgaagcgcgtgttaaaaaaaaagttgcgaagaacaccctggccagctgcttggattcgccgcgtttttctgatggattacttatctttagcagaaaaaaaaattgttcacttgttcatatgaatggtagtagtagtttaatgtattgtgtgctgtgggacgtaggattctggtggattccgttacttatatttagtaccaaaaatttagcagtttaacaaaaaaataatcaacacactcacatattcaaccttctttgatctagctgttaagctaattaactggaaccatttctattttgcattctccaataaaacatcctccttataggttaacagttaattaggtggtaatatttgtttcatttgatctgcagttgacatgcgacgtctgccgtggggagactgccaaggagatctgtctgttcccagatcacccctgccctcaccatctaggtcagatggcattcgtgatgtgctatccgacctgtgacatactgtatggatgcattttcttctttcatttccatctgttagttgtggtttctaaatttttgcttccatctgtttgtttgaatgtagtgcaaggactgtggctccctgggctcagtctccctcatacccggcaaggggaaagccctcacccctgattccaagaacatggtgatgttaatccattgcgatggacacatccctatcgctttcagcccggcaccctactggattgccaacaaggtgaagttcagcactttagctccagaaattttggtttggctgtgtgcgtccgattagacatagaggccgggtttatctcattttcttaaaaaaaaaagctccagaaattttgatgaaatccattgttcactgatgtttctctgttgacaggtcaatggggatcagcatgagttgcacttctccaaggatgggttcgagggctacggcgacaatgatgagctgattctcaccagtgccaagttcaccgtcgagaggctgaagaaggccgaggtgccttaagtacatctgaggtaagtacatattcagcggatggtttccccaaatgtgcaatttcttttgcatttttcctaattcatctccttttttgtcattggtgcagaaaatgtcattcaaatggcatatcaaggctaaagacagggcaaatcatagactatcacaagtggtcattgagaataattttttgtgcttccactgagcatttgtgagaggctggaaagcgatgttatctggatgatgaatgatatctgtcctttcttttggtgtttgtcatatgctttcagatctaaaaacttcgtctaaaaaaataacttctaaagatgaatctaaacaaatgcttgtccagattcatctctaaaaattagtttttttaaggacggagggatactccacatgcctttgtttctcggtttctgtacacatataaaccactaccatcacactcccctcgtttcgcagccgtctggtaaggccgacagaaaaggcccatccttccatctcgacttcggtttggtttagtttccaactttttcttcaaacttccactttttcattacattaaaactttcctacacacataaactttcaacttttccatcacatcgttccaatatcaatcaaactttcaatttttgtgtgaactaaacacacccttcgattatagatttgacctggtagaatcctcaaacaaaaggcaggtattagcaagatactagtataactgaataaacgttctccattctactatcctgcatagtaactgactatatgacaattgacagtcgaaattggaagccacacgatcaaaaacgaaggatgaaaggtagagccaggtatcttgcaaatttgataggtgttgtctactgtattgaatacatcaggcttgttgtttgttcatatgtgccaatttctcataatcttcataaattccggccggcatcgcccagtggaaaagaaaaaaaaaacaatccagtccatttccttgtactatggcccgtttggcaattgctagacccaagtgccttcttgaacgccacagctagcctacacagacgcaaagaagaatatacacaaatacatagaaacaaattacagcttaaagctgttaaactgaaaaccactaaggagaccataaattttattatgagaaattttaccgtccttaaaaaaatatttgaggtacctaaattctacttaaaatttttggtaatacctagtatctaaaggtactaaattttacactagacaatacaatatggtacctctggtatcttctcaagaatgataaaattactcttttattataggtaccgtaaaattttgcaactcatgttgttagtactcctggttaacttcaacgtagaacaacaatcacgtaaatactagagattaactatataatcttaaagatgaaaaagccttaggaataacaagtttatatgttatatagttccaatagaaattcggcagaatatttgaacaatttagacatgaacataaatgttaataacaaagacaatatagttacatcgcgggaatggaaaaacataggaataggaaaaacatagcattttgataggaatacaagtataaaacagaggattgcaaaatacaggaaaaacatagaaacggccatttgattaggccgca

SEQ ID NO: 47090 - DNA, 7094 bp, Oryza sativa
ttaataatagtttgatcctatcagatttttgatagccgttcaagaaatttagttcaaagtcttttcaaaaattggtagcagtctttatgaaaaaaaaaactttcaaaactacccgacttgggtaccatagcattggtattttggtaacattatgtttaattggttatcctatcaaaacttaataacattaaaatttaatagagtttaaagtggcaataaaatgaacaaagtctttaactatttatcacaaatatgccagtcattatttatgtgacatgtcatgcaggtaagatcacgatcaaacaatactttagaccggatgatgtggaaaaccaagtttaataaactcgatgcacgcctagtttgtaaatttaggtaaaaccctgttataaatttaagaactgataacgcaatttactctgttcactttttacggtaaccgtacctacatctaatcatacgtgctaattacatggcaccatgctatctctcatcgtttgccttatataaaatcaacattaactaaaaattaaattttaaaacttaattttaaagttgatgttgatttttttatcgaaatttatttttcagcattggtttttaaatcgttaagaacatacgtagaaaacttttactcacaaattattacaattttgcttgtatggcgtatcatccgtacatgcccaaacgataagggggctaattgtacctgcggctaatgtgtgcattcagcctagctacctctcctgtcgaatactcgaatcacgttcgtgcatcattgtaacacgcgaaaattcagtatccgacctctttgggactgtttgataagtcactcgtaactcatttcatccgatcctaaacatcgtcctatttccattttccctttcctaatcattattttaccggttctaaaaaaactctcggagtatgatgttttatttatagagtggactgaaatactatttttcttcttactattttgttttgcataaggctatgttgggaagtgagttttgattttgctatattctgagcatacttctcgaactattaaacaatacgttttttctaaaaaaaatacatgtaggtgtttattaaaaaaccaaatattttttaaaaatatataataattgttatttagttaatcaacatatttgtcctcagctctatcgaactgagcttggatttggagggaataataatcggagtgaggtgcgggagcgagagtctttccatgatgacatgcgtgtaacaacttgggtcaacgtggctttcttctggctcactcgtactccctccgtttttaaaaagatgatatcattaacttttaactacatatttaattatttatctttttccaaaactttataattacataattttttttaataataagaacgttaaatgtgtgataaaaactcaacaacgtcatctatctaacaacgattgaccccgccgtgggcgcctgtgctggccgtcgatggtccgtactagcatcgtatccaccggcagtcaagacatgatctattgatctccgagtccagtttggtttggagaaaattgatagagagtatatatgggtctgggagctttggatgttcatattccagtacctgacgaatcgaattttgagtccgagtcggaattgggaacacatctgtccagccaatgaatacaatcgtgcagtctcattggtacgtgtacccaaccaagtgacaccaatcgttgatcttaagagaagtttaatattatagcccactattagctccaatttatctatagtcaatctaatagccaatttatataatagttgattactttactactaatatatggtcccacctatcatatacacattatgtcttggaatccgtgctgtagctggctacatatctgtagcatgctgctcttctctctcatcttttatctcattaaaatatatttacagctggctaatagcctgctattgtacctgctctaatttgtctgctgctgccatctcatcatggctggaaaaaagaggcagaacaaaaagagaggagacgtgtcgaagccatcgcaacgacggcaagcaaatcagcgcagtaacgcactacccgcggaacagaaacccaaagaggacctgatcagcaagctccccgatgacatcctcgtgcccatcctgtccatgtgcccctacgccgacgccgagcgagccgccgcggtttcacggcggtggcagcatctccacacccggctccccaacgttcggttcagcatgtccgtgcaggggcttctcgcgcctcttggcgagtcgagcaaaccgcgcgtgcagagcatggcgcgcacgcttcagcggcgctgctgcggcggcggcgacaccgtgaaaacgcttcacattggttaccggaaggacgtcccgttcgagtgcaggtacgcggaggagttcgtcgcgctggccaacgcgacgaggctggagctgggcgtgcagtgcgcgagggggctccccgacgaggacgccggcgagtggtcgctcgagctgccgccggcgaccgccgagctgcagctgcggctgtactggtacgcggtgcggccgcccggcctgcacggccccggcgtcgcctccctccggtggctcgcgcggaacggcctggcggtgctacgcccggagtcgttcctctccggcggcggcgtcgtcttcccggcgctggaggagctgcacatcgtcaagtgcacgcttccggccggcggcggcatcgacatcacgtccgccgccatgccgcggctgaggcgcctcatcgtcaccgacgtcgccgtgatgagcgccgccaccaaggccgggatcgccgtgctcgccgacgagctggcggagctccgcgtctcgtgtcgctgcgacaccgagcccatggcgacgtccgaccccgccgcctaccacctgaagccgcggttccgcgccctcttcacccgctactcgtgcgtccgcgtgcgcgcgcccaggctgcgcgtgttcgagtggcgctgctgcttcgccgacgaggtgcgcgtggagagcgtcggccgcctctcggacgtcgcggtggagctcgccgccggccggctgccgaggctgtgggacgaggagagcaagtctctgtcggtagaagactgcgacaagctgatgaaaggcatcctacgtgggctcctgcctggactgcggccgcgcagctgggattgggttcagaggaaatgcgtcaagcgcgatgaaaggtggcttagctttgagatctcaagtgccccaaagtatgatacttaactgattactgatgataaataatatatattactccatccatccataaatatttaacgctgtttcgtcttaataaaaaacttttgtgaaatatataaaactatatgtatacgtaaaagtatatttaacaatgaatcaaattataggaaaggaactaataattatttaaaattttttaataagacaaactgttcaacatgtttaagaaagtcaacggtgccaaatatttagatacgaagaggatattattattgtgtagagcacttgtttgtgccgagtcacccttcaatctaaccttgtttttcatgtaccacacgttgcttaagatacaggtgggcagaatttaaacgtaaatattcgtagaatgatacaattatcaccacatattgatctattttatcaattttttacatgactaattagatgatatgaaaaacgaaaaacaatccaatgcttgtaaacttttttcgtgactaggctctcttcggcagtggaaaaaggaaagaaagtttgtttcgttttccacgagtatgtttcccgaactactaaacggtgtgttttgtaaaaaaattatataggaaagttgcttttaaaaaatcatatgaatctatttttaaaatttaaaataattaatactgaattaatcatacactaatgacctatctcgttttgcgtatcttctcaatcttgcaatcttctcatctctcgattaaatcatcacatgttagagcccacaagatcgaagagctaatctccttatggcccctaacattgtaggccacaagcccgccatacgggctgctattttaattgagtgttcgatgatagaggttgaaaacccttcatcccttcacgcaaaattgagtggtggattagcgcatgcctaattaagtacaagctaaaaaactttaaaatagattaatatatatttttaaaaaataactttcctatataaaagttttactaaaacacatcatttaatagtttaaaaagtgtgcgcatgaaaaatgagggagtgaaagttatcagtctaaacaataactgtcatcaaacttaacatatactactccgtcctctaaaaaaacgaattcctagctaccaacctggacacacatgtccaggttcgtaggtaggattagtctatttcttgggacagatggggtattggctagtagagggtccaatttaactactccaaactgtcaactgtcgtcaaaaatctaatcggatcaaaccgcctaccgcgttgctacgaatcatggacagggtcatcaaccattgttgtacaacatcaatacatacaactctatcgtcacccggtatctccactgcttagtcgccaatgcctcgaataccatgacgtttgccagcatcaggttgaacgtggtcaccccgtccgccgctatcgccgcgcgggccgacatcgccacggcgcacgccgagtcacgttggaggcgggccagcacgagggacctatagctatggtgttgtccctgctccttcggcaagaagtctcgggagtagagtcgcagagctagcccctcctcatgctcccccacaacctctgtggacatgacggcggattggtggaccgacagagcagtacacattgtgtcgacgggtggtaccgcaactacggtatttggatggtatgaggatcgttggtactagggtatatgtgattgaggtaaaagagatggagacatggatttttatacaggttcgagccccttatcttacaggtaatagccctacatcctgttgaccggagccggcgttgctcttattcatctgaatcacacaagtacaatatttgggataacatatctaactgtcgtcgacttggcggctagataaccaactcgtagacgacaacagggtagtcttcctcctcgaatccgtactcggtgagatcagagatggcactagatccctcttgccggcttctgtaggcaccggattgggtttgtctaggctaaactctgatgtcgagatctgacagcgtattggtttgtattggcttgtggctttgtggcgtgtcccctctcctcctaggggggcttgtatttatacccagcccctttgtccaagtagaactaagtagataaatatggatacgatctgagtagtccttgtcgttttcatatagaactctactcgtcattccttatccggaactccttctatatacgaggtttgtttccgtataagatatggtatgtgatgggccctgccgagtttagtcgactactattaggtatgtggtatccataactatgacacattgtacatgggaaagtgatttcatccctcgaggggatatccctcgtttcatttatgccacctaaatagttataaaattttttgacaaaaatggtaagatagattaatataaaatatatcactccacaaatatgtaagactaaattcaacttctacaaattgtaaaaaaacaacaaatatagctgcaaatgtactataactatttttagcttattttgttctttttgttgcaaatacaataggagcagtgcacggtgtttcatttcatccatgcaccatttcacatactgtatttgatatatatttgcatcagattgctacgaagctaagaacaattgctacattcctacatatctacgcgcggttagctcgccggcggccggcggccagcgtcgagctcgccgggcggcggacggggttgcccgtcgatgcgctctaggtagaaccggctcggcatccacacgctcctgcgccaccgggcgtactcgctgaacagccacccgccgcgcccgcacgcccggggcgccacggcctcgctggtggcggcaatggcgccgccgccgccgcaatgcgaccgcatccacgattggccgggagcgcactggtgcagcgcgcagcgtagccccggcgggaggcgcgcgcagcagcaggtcaggaccttcctcttctcctccggcgacggtggcgcgccccgcctcagcatgctcctggcgaccctcttcgccggcggctgccacgcccgcgccgcgcgcttcggcgctggcgccgtggcctcccccctgtccacgcttccgccgcttccgccgcggcgctcgccggtgacgggcgggaggcgcggcgtcgcccgcggcggcttcttgatggccttattgctcttctgcaccatcagcatctcctgcaccgccgcggagagcagcgacgacgtcccgccacccatcgcaccgggcgcgcgctgcaagccgtgaacaccacccgccgccgccgccacgcgctcgacctccatggcgaactggcaaacgatcaagctcctcctcctcctcctcctcctcctcctcctcatatctcgcgcaaaacctttcctcgctgctgctctgagcctctccgagcgtctgcaatggcggtgacagaagcgggcgccgcactaaacatataggcgctccctccgcccgcgcgcgcgcgcccgcggccatcggctgtcgcacgcggcgccgcgcccgcccgccagcccgcttggcgccacggatggatgaggacgcgcggcgttgcggccggtggcgcgcgcgcgctcacgcggaggcgcgccggaagttggctgcggacgaacgaacgcacgcgcgcggcgtggcgcgtcgcgtcgcgtcgcccgaacagcaaaaccgtcgcattccgccacgggcagaattagcgcggcgcgggcggggtggttagtttgcgcgctaattacagtttttttcatcgaactaatccatccgcgttaattaagttgggcttccatcgtgtagcgcttccctgtagggaaaacggctttcctatacggcgtgta

SEQ ID NO: 47091 - DNA, 7458 bp, Oryza sativa
ctcgatccaaattcaccacttgctcgatgcgatttctcggcgtatattgatggaatacttgtcgatttcattattcattttgttcgattatgattgcctgctgcttgcttcacggtggccatgttcatttactgcctagatctagaattctgtagttgaaggctgttctttgtgtgcttgtatgatctgaaattgctaataactgatgatttgctggacctaactccatttggccatgatctatttattttcttacttttcgatctctaattgctgcaagaggaaaaacaaagcagaattgcactgaattgttgccgatgtcaggtgcgccgtttgggcggaattcgcgtgagccgaggtaccatgttgagttccatcctgtcgatgcgccatttaatccagtaagtttttgctaaattttcctctgttttacagttacaggaataatcagctttatttagttgtcacaaattctgcacactcggtgatcatgtgtacatcttttagaaccgaagctagcaagatctgaacaatcctcatacctgctaatgtagcctactagccttggtgttggtaatataaaggcattgtctaaactgtagtgagatttagtgattagctgtgataaataaacgattccgatctaagcaatgttgattatgtttgttgtaaatcatgtgtttttcattccattctcatcaaaaatttcagttattttcagcaattgtcgctctttactttattccaagaacacttcctgttatcacaatcaaagacttctatggtgtactatgcaggagaatggccaggaatctgtaccaatgactagccacgtggggaaacattatacatgcttcctacctgttgaggaaacaaaaaccatgaagtcgataatcccacaaaacgcaaccaatgttatcatagaaagtgaacggagagttaagccaaaggatccagatgaattgctggaaattctcaaggatcagtgcttctacagggtgagatagaactctttctttatgcggtcagtagaactgcatgtgttccactgcctgattttatattgactgaacaaaaactgattattgctattactattttgacacagcatgaaggttggtggtcttatgaattttgctactacgggaaaatccgacaagtccacgtagagggcgagaaggtaagctgccccatcctgtttattttctttgctcagatcagtcattgtattttatcctctttatgcactatctaaaaaatatctgagatgcgtcaatccaagagttgctagtttttacaggagagacaagttctggccacagttacacactacattatgaaaaataaaatattttatctttgacaataaatgcagccgacagtttctagagcacttgaattgccacgtaaagtttgtgttgtttgcaggttattcaagaatatgttctgggtgaatatgatgctgatgcaactgatgcttactatgaaaatcaaacatctgactctgctgatgaagatgataacctgatagacacctctaagaggtaatatacgaatataaggatatataaagcaaattatatctgtaagctaaacccacttgaatgaatctcttttcttcatgtttcaggtatcatgtccacctgtacacaaatgggactgtctgcgatctcactgatatgccccgggaaacagaggtatgaaaaaaaaaaacgttttgtttctatgtcatattaagtagtatgtttgactgcacttgctactttctttctacaggttagatttgtatgttcagaacccactgtagtgattagttcaattaaggagatctcttcctgcaaatatgttttaacagttcaaagcccaatgctttgcaagaatccgtaagtttcaatattcttttctctcaattgtctttacgccatttcatgttttgagctcattttcctgttctgcttgcaggctatttcagcaagaaaaacgtaccctctccattcactgcaacgagttgctagctgaagctgaagccactgtggatgatgactctcttccaaaagaagctcagatcatcatcccagatccagatggattgcataattatgcagcttatgctacttgattatgcatcattgttatagcatcagacagtgaagaaaatcatcttccgggtgcaacggcaatttggcaatgctaacaatggtataggttgttcgcggagcatattatccattcatgtgaagcaggtttgagatcatcagactaacattgatcatgaggaacattacgggcgatgagtgcttctgtactagtgcaaacgaagtactaaatttcagtgtcaaactgtagacagtaacattttcttgatatatgtttatagaagaaaatcttgtgatgcggaaaagtgcatgtgcaaacatcgtttcattgcgagattatggtattgctctgaagtgaagaaatatcatgtgcattgagagcaaaggtgttcccttttttcttgagtgcagatgacggcaagtcggcaacacaagacaggggatttgcttaatgtaagatgttcatactaagtcaagggatttgctttaatgttaagttgtcacactaagccaaaaagcatgtactccaatttcaatgctatgataaagagcaaatttgcttttgcgattatgttatttgagaatagtacaatttgcaaaataaaggtgataagaggacttcaaaatgccattagaaagcatacagaactaaacaaactattctccaagaaacttcgatctgtactttagtcaactgtagaatggttcaatgaattgacttggcctactatacattttctagtcaaaccaaacatcgataagatcttcggtgaacaccattagtcaacacaggatttggttaagcgttgtacaagtggcgaaattgcctatgcttaccaaaatggcatgatccaattatcctaaattgaattactccatctaccctaaaatataacaacccatatagattcgttgtaatgtagatgaagattaagtaccaacataaaaattattagcacacgattaattgagttttaattattttaaattaaaaatagttttatatgatattctaaagcaaattttcacattaaatgtactaaagtacttagcattttgaaaatcatgctaacaaaaaccgagctaaaacttgcatcttaatcagaactgaacgagcctgatgtgtcccattttatattaattgctatattttgggatggaggaaataataaaattattttgtgtgatatatataaaatccatctaaatttgaggacgtgcagttcagggctagtagtgaatattccacgctgacagacaggtgggccacgcggtaggcagtactagccactgagtgggacccaccagcaaccgctggccaatcagatcgaagggatgtatccacgcctcccatgtggccggaccgcgcgagttgcagatccccaaatgttactcaagcacatacccacacccactgattgcgtggaccccacgatcctatgggcccacatgtcatttgctaatctagtgggtacattgaatcgctgggttggtggagctaactgtactcggaattaacgtaaattgactatcctctttagtttatcggatacttttatgagagagaaggaagaacagagagagagagagagaggagggagaagaaaaaaaataatcgaaaataaaataaaataaagagagagatagaaccccagatctctccacagtttcaacgcctcaaatctctcaactctcgtcccaatccttaggtacacgcctccctctctttcctccaatttttgttcggagggaggacgaatttcagttcttgtttctgtttcgatctccaaccaaatctggcccaagaaaatttgagtttcttgtgtggtagatgccaccaatgtgtgccaagcccctctgagatctcaccggctgatcagctgatgtagtttgcagtcgaattttgttccgtttttgggggcaagattgtgttcttggagctgtagattggttatacatttttttttccatttcttggctcagttttgtccattcgacgaggaatttctcgtcgtgtttgttgttgattgattgatccaatctttgatgcgccaagaagcaagatgaacacgaattactcgtccctcccattgacctccatcgagctccaatccaaccagcgcacatccgaggtcgccaatggcgtcggctacaacggccacgccaagatctccaagcaagattcgttcctggtcgacggcgatgccgccgccggcggcggcggcggcgagaacgacgacctgccgctcatcggcgacggccccgccgggccacccgagggctccggcgtgcccgccgcggtgttcaacctcgccacctccatcatcggcgccggcattatggccctcccggccaccatgaaggttctcggcgtcgccgtcggcctcgtctccatcctggtcatggggatcctctccgaggtcaccattgagctgctcgtgaggttcgccgtgtactgccgcgcgctgtcctacggcgaggtggtgcacaaggcgctcggccgtccggcgagcatcgtggcgcagatgtgcgtcatcatcaacaatgccggcgtgctcatcgtgtacctcatcatcatcggagatgtgatgtcagggtcactgaagcacattggtgtcatggatcagttgatcgggcatggcgagtgggataaccggaggctgctgatcttggtggttcttgtgatctttctctccccgttgtgcgcgctcgagaagatcgattcgttgagcttgtcgtctgctgcatcggtcgcgcttgctgtcgtgtttgtggttgtgtcatgcatcattgcgctggtgaaggttgttgagggtaagatcagtatgccgaggatggggccggattttagctcgagggcagcaatgctggatttgctcgtcgtgataccgatcatgacgaacgcctacatctgccatttcaatgttcagccaatctacaatgagctcaaggagaagacacctcacaacatgtacaagattgggaggatcaccactgtgctatgtgttgtggtatatgcactgactgcggtctcagggtacctcttgttcggcgaagacactgaatctgatgtgctcaccaactttgacaaggatctcgggatcagattcagctcaatcctcaacttcattgtcaggattgggtatgtcatccatctggttctcgtcttcccggttgtccacttctcgcttaggcagacggtggactcgttgatctttggcgagttagcgccccatagcaggaaaaagatgctcaccttgacagtggtgctcttggcactcatctatcttggctcgacgatgataccaaacatctgggtggccttcaagttcaccggtgcgacgacggggttggcactggggttcattttcccggcccttattgcattgagattggacaaggaaggcaagtctttaggtaagggtgagaggctcctgtcaattgtgatgcttggtttggccatggttgttagcattattggagtaattggaaatgtatacagcctgaggagcaagtctgcatgatctatcatgatgaacaatttagtagggttagtgcattgccatggcagtcatacagactgtattagcatggtcagatacagaagacagcagaggtactacttgagcaaagctcagatacattttgtttacctttagaggtgcaggagcatttcttgaaggtttttgtttttgggagcttggactagattgacagattctttgatgtatttgcatttattggtaaggcagcacaagatgataagaagctggttgtgttgtactgcgaggttgttgcctgtctactacatgaaaagaaaagaaacgatatgtttggcacttgagttttcaggcgtttttcataaatgttcgggagtagtggagtatagagcctggagatcattttcaccgttgaaaccgtaggccagaaaattactggtttaatttgcagtcgcttgaatgtaatgaaattctcccccataacctaagataaatgctgagttgcacacatttttatgttttttttggaagtacaagccctcttaataaccaaagtaaacaacgaagcgtcgaccgaaatgtccgaaatattgtactcttgagatctctccaaattagttgtatggatacgaaaactgagcatcatgtaggttagagaatagagagatcctatcagggccatcgccattgttctcgagaaatcaaaagtctgtcacgatagttttgctgaatgctatagcacccaccaaaaattaaaatatcaatcatgacattccttttcttttttgttgcaaaacggtgtcgatacatcagtaattcaatatgttacaaaagaatgcaacaataaataacagaactacaaaattgttgtctcatgatcctgaagtactgctggtgcatatcgttgttaacagcacgcagacgccttgtagctttaccctgaatccctgagtccatgacagacggtatggtaagacagaagagaatggtacagcagccacaaagaagccccacaccaacctgcgagtgacaaggaaataatcgagttatggaagataaactgcagaagaaaccgcctttcgctactactagataaacataatgctggcaggccggtatctgaaaatattttagcaccaactaattaatacaaaatagtaaatcttttggcaaaagcaaagatcaaaacaagcagtatcggtgaaagagacgaaaccatttggcatatcaaatgaaaaagaaatcacctgctactaaaactgtgagttgctgaggaatgtaaccatgcatcgtgcactctgaaacactttgtctatcttctgccaaactaagctctggacatctagaagcttcttcactttgtcctgaagcattgagtgacgccgtatcgtttcaccatgtatctgcttccaggaaaggcaaaaatcaagtttaggaaaaaaaatacataccatatataccctgtgagaaattttcataacagagtttttttattcttttacaaaaataacagaacagagtgaacaatatataacagtgtataccttcaaaaacaatttgagaacagcctgaacaaactcaaagttattcctgcaggaaagctcatgtatgaagtagtccaacagcaatgaaatggattgaagttcaggtctctgctccaaattttgtggctcatcatcgattaactgtagcactcgtagttccatatctaaagatgatggtgataagccttttaggtagtcagtaaatgccgaatctgtaaaacagatcaagagtcagcatctcaaccatgacaagcatcagcagcacaggccacaacactaacaaatatctcccggttttgaccatgcttctgtcggcaa

SEQ ID NO: 47092 - DNA, 18755 bp, Oryza sativa
  unsure (1)..(18755): unsure at all n locations
tacaagtacatggttatgtttcctgactttgtatgccactttttttttatagctcgggcacatgcggaccaacaaactgtgccccaagtacggggaggaccctgaaacatctcgaaatggatgtcaattccatcaggtctcatcctcctgatattgtgagtaatgctcaaataaaaacatcaaacaagaggttggtagcaaaagtttcgtctgaagcttttgaaactgaaggacctgaaagtattgaaaaggctaaacctgtccctgtaaaattcaaatgtggagcacctgagaagtcattggataggaacatgtcaatctcagcttctttggtttctgataaacgtatgatggatgctacagattcgaaatcaactggaaaggttaataagattaaaatatctaacaagataaaatatgatgattatcctcctgatactcctaagccatctgttgtaataaggcctcctgctgaagtggagaaggatctacctcgtaagaaaattattatcaagcagcccaaggtgcttggagatcagcaaagacctactgaacttaggagtggtcaggagcccagaaagacaaggaaaattgttgaattgtcaagctttgagaagagagacagagaggatgataatggtttttctggacaacctattcagatcatatggtcctcacatagatagaggaggtagggagtctaggtggagaaaaagaagcaaaggaataatggaaagtagtgaatcctggagagcttttgaggagcaacgagagagacaagaacagagactaattgaagctaggatatatgatgcaaggagagaggatgagctccagaaggcaaagaagaaaaacaagaaaaagaaaaaacatgaatttcgagatgatgacctacttgatcctggccatacaaaaatgacagaagggtacctgaaagaggtcgagcggcaaagagacgtaccccagctgatatgacagaatacacaccaccagctaagcggcacagaggaggagaggtacttgttctcaaccctgttttaataggattatgcattgttttagcaatgttggtatgttagacctttttgtaattccgccaccagagatacctgtttctgcaacttattgtttgtagaaattgagaaagggcaaaataattgtatgatagcctttcaaccagcgtcgtgcttggttttgttattcacctttagagagttgggactagtttttctcaactaaactgtcccattgtgttgtgcgttctcaacaaaatagtttgttttgatcaatattcagtttgatcatccccgtcaacatcatcatctttattaattctcttttggcacgttcatctttagttttttaacatatagacacccgcattttgctacaagggatgtgatacccatttgtgagatataggtcggataatgcagataatccattgttgttttttttgcaagactatgaatttaaacttaatttatttgtttgcatactgatgcaggttgagctctccaacatattggaaaaaatagttgaccacttgcggacaatgagctgttcattccttttccgtaaaccggtgacgaagaaagaggctcctgattactttgacataattgagcgtccaatggatcttggtactataagggacaaggtgcgaaagatggagtataaaaatagggaggattttaggcatgatgtggctcagatagcactgaatgcacatacatacaatcttaaccgccatccccacatccctccgcttgctgatgagctcttggagttgtgtgattatcttcttgaggaaagcgcggatgtgctagatgatgcggaatacgcgatcgaggactagtgcacactaaccagatatggcatttagatcttgctatattctaacttagatgctgtaatgctgacctgtaggaggggggaagagcacctgtagaatttttcattttaggctctggctatggtatacctgggatccccaattccaactattttgcctcttgttggtattgggagttgggagttggaatgtacacaaactctaggttagacattgagggcccactgtaactattggcctcttgctgtaaaaatgtagcgatgtaattttttgtccatatccatggccttgggtgtctcaaattctgatgttgtagcattacatcctatgtgaatggcatctaaccatgagtcaaaggtgcaacacgtcaaagcatgtgctaaaggttgtacccggtctaacctgattggtgaaggtcccttcaaatcctgcatgattagaggcttaccatgcaactatgcgaagtcaaaacctgtaattgtaactgtaacgtgagagatggtgtaccggcagtacaagttgtttgagttgctgccagatgatgatgtatttgatgttgcatgctttgaatgagtattcaccgctcaacgatatcattggatggtgcagttcatagtttcatacctttggtttttggtttgtgatgttgtagcaacagaacaacaagtaatcatccattaaacaatcaagtccctttctcctacttgctgaatgtactgatggctcaagaggagttgagtttagagtatagaatttttaagatgctgacctgccaagtaaactatacaacaattccctagctctgaagcacctgctccagatgctcttagctgaaagaaaatctttgaagtgtacgagggctgtctggaccgtccgatcatgacaacgaacgacggcttagtccaagccaatttcataatggcccagatactcaatttttgcatggtcagatcacatctaatataatagtacaaaaaacaactaaaacgtgtactagcatctagcagtacgaaccagcaaactggcatgcatttgtctactccaaaagagcaccgcttaacgcgggacgcggctgctcacgactaaaccatttttataattttattctcttgcttttagtaaaaaaataatggcagtagtagacgaagacctggcaagtccttgggcttaaatctcacgagcatatgaccaattgaccatatctatgcacgcgacaaccaaaacattacaattccacgagtccgcgacctgttctactcacgtcaccccgcatccctgatcaaacaaagcatttgctcgggagcttgagctcgagctccgtaggccggagcagccatggtgtcgtcgtcgtcgtcgtcgcctcgccggcgagctctcctcctgctgttcgtcttcgcgtcgtcgttctttgccagcgctgcaggtgagagggttcttgagtagttttgtttctttgatgaaatggaaggcgtggagattgatcgatcgatcgatggtggcgtgccgtgtttgcagcggcggtgtcgcggacgaactcgtcgtcggcgttcgtgctggcggcggcgcagacgcggcggaaggatccactccgcgggctgaggtactacaccggcggctggaacatcagcgacaagcactacctcgccgtgagctcctcatttccgtgataaatttcagctcgcaatgcgatcaccttggtgttctactgttcttcctgcctggttcttgatgctgacgccgtcgagttttgctatgcttgtcgccgcgcgcgcgcagtcggtcgggttcagcgcggcgccggtgttcgttgtcgcggccgtctggttcgcctccctcgcgctcgccgcgttcgtcgcctgctgctgccgctgctgctgctctggcgccggcggcggcaacggcaacggcggttactcctactcccgcgccatcttcgccgtctccctcgcgctcctcctcgtcttcaccgccgtcgccatgtaaaaccatttctcctctccaagccatttcatattacaaagtacaaaactgttcagattttttttctagtataagtttgatcaaatttatacaaaaagtttagcaacatctgcttcattaaaactagcattaaatatatttgttttgcattagaaatgatactatatctctttataaatttagtcaaatctaaatatattttgataatatatttgtttgtggaaatgctactatatctttttataaatttagttaaatttaaataagtttgataaataaaatcaaaacgacctataatacgaaacggacggagtaatttctaattttggacgccgccgccgtcgctgtgggtgcagaatcgggtgcatcgtgctgtacgacgggcaggggaagttccacgggagcacgacggcgacgctgcggttcgtcgtcaaccagtcggacggcgcggtggcgagcctgcgcggcttcagcggtttcatcgaggcggcgaaggcggccgccgtggagaaggccaccctccccgccgacctccaggggaaggtcgacgacgtcgtgcgccgggtggacgcctccgccgacgacctcgccgcgcgcaccaccactaactcccgcaagatccgcaccgcgctggagaccatgtatgtgtgagattttcttggtggacgccatgacctcgtcacttccatcatcaagaagatctcgtttgacattctgtttgccttcttctcgtgatcgcagaaggacaatcctcatcgttgttgccgccgtgatgctggccttggcgtttcttgggcttggtgagcataaagatttctttgctggttttggtgaattttgtcaaattcgtttgtttctgtattcgagtaaataattgacaaattcttgttcgattttggtgcagtgttctccctgtgcgggctgaaatcactagtatacacgtaagtacaacatcacagaacgtacatagacttgtatatagtacaaaatttttttttactgcaagtttgtaaccttcagttcttctgcagcttggtgatttttggatggattctagttactgcaacattcatactgtccggcacttttcttctcttgcacaagtaagttgttctcccttgttactgtcttgttaaatatattgcttgattaaatataatttgaaaaaaaggtgagattttgatattctaaaatggattgagtaaatttagtcggcaaaaaaaaacaaatttactgaagtggaatattctgcttctgaaaagttaaaatttttttgtatgaaccagacgtactggaacactttgcatctcagtctttacattgactagttacatgcttgtatgttataatgggtcaaccccatataattaggggtagattaggagtcggtatgtcggtgtgttaataggctaggtctatataattagagataaatgatactctttcggttctaaaatatagtaacttttagtttttagaattcgtttcaaaatataacaacttcttcattaacattctcttctcaaccaatcacaatactccaccgttcaattttcccacataccttcatttcttctccaatcacaacacttctccatttagttctatcaactttcttaataactacgtctaacttttaaaatatttatattctgaaacgtagggggagtattacttttcacgtacgcactgaacacgttaggacggtgggatgagaggagaacgactatattttaagatagcagatatcagttaaatctgaatcattaagacactaacacgagctctgctctgcttcgtcgtgctcgcagcgcggtgggcgacacgtgcgtggccatggacgagtgggtgctccacccgcagggccacacggcgctcgacgacatcctcccctgcgtcgacgccgccgcgacgtcggacgcgctccgccggagcaaggaggtcaactaccagatcgtctccgtgctcaacaacctcctcgccaccgtcgccaacgccaacgtccccgcgtcgtcgccgccgtcgccgccggccagctaccgccagtccgggacccccgtgccgctcctctgcaacccctacaacggcgacctctccgaccgcgcctgcgccgccggcgaggtcgccgccgccgacgcgccgcgggcgtggcggggctacgtgtgccgcgccacgggggcggcgccgtcgtcggaggtgtgcgccaccaccggccgcctcacgccgacgatgtacgaccagatggtcgccgccgccaacgccagcgccgggctgacccagtacggccccgtcctcgccgacctcgccgactgctcgtacgtgcggcgcgcgttccaggcggtgacggcggcgcactgcccggggctgcggcggcacagcggcagggtgtaccaggcgctgctcgccgtgtccgtcgccgtggcggccgccgtggccgcgtgggtggcgcactcacaggagcggcggcggcggagcgagacgaggcggttccaggtgtcgccgtacaggttccccatcgaggagaagtcgctgctcaagagcccccggcggccgtaccggcgaggcgacagcggcaggatggcgaggtagaagaagacatcgccatggatggatggatggatggtacagtgtcgaacaccttgggacgctgccacgcgtgttgagcagtttaggatgtgtttagtgcttcgatgattattatattgtactgattaatgatctccatcgaccatacaggttatacattgtacagcttgaaatgatttcgtgaaagaagtgtgtagtttgagaaaatgcaatatcgtgctcgcccacgtcgagaagcactgcctctttggtttctaacatttcgccgatcctattcattagccctagacaacaaaacacaacagggtatccgattgatctggcgcccattgcgatgatcggaaagcagcacaccatggatcacacgtagaattgaatcattagcccaaaacatcgcaaaaactacgggaatcagcaacaaaaaataaaaagaatgcagacgtgaactatggatagtggcaaatgatctccacctaaaaaataaaaaataaaaaataaaggcgtcctctcctcgcagtcgtgccgcggaagattggaccggatcatggcggcggcggccgccggagacggcctcagaaactgcaggacccacacatcaaaaccctatcgccggcagcaggggacaccacgcgtcgagatcgatcgagaccaactcgcacccgaaaaatggcgaaagagaatcaaacagaagcagagagctcaaaatcgaacgcacatggcgacggcacttcgccgatcgccaccgccgcgcggtcctatacggagagcccgctcgatcggccgccggaaacctaaccccgcccccgttcgcgcgctcccatggagatggcggaggagaaggggaaagcttctccagatcgaggaaggcggcggtggaggtgcgaaaatttggactcgactgacttgtgggcctcgagcttttcggcgttctcgccaaatggcgtgggctctattgctttggatcaatctagacgtgggccgtagctggcaggacttggcccttttcgcgttcgtgtgatcacgggacaacgctgggctcgttgacgaaagacgggaaacccgtgacattcgggcctgttttttaagagctccaactcctaaattttgtttcaggagagttgggttttggagtgaaattgtggagcaggtctatactctactctatctctctagcttattttatgataacactctacccagtttcgcttagaaaaggtgggagctagagctggagttgtgctaaatagacccttcccatgtcagactcttagcaactcctctctttgtcttcgaatataacaacataatttgttccaaaatataataacttctccgtcaacatttttttctcaaccaattataacacttcaccattcaatttttcacctacatccacttcttaatcaatcataatcttttatcatttaactctaactactttcttaatgaccgtttcgaactttaaaaattcttacattcttggacggggtaataccgttttttttcagtagctttctctttacataatataataatgatagatataacgatttctttatccttttaattaatggtatgcctgaaaatgcgtagcaaccgtagcattttataagaagaaaaaaatgcattgctttttagggggaagggaaacgaacattcgtggtaatgtacgctcaacacgcatgtaaactggacggcaggatgcatcatagcggcaaaggcggcatgcagcagcagcagctagggccctttgtggatgaaagaaatgaaaaccccaacccccacccatatccaggagatgtagcgagcatggataatctgataatgctagaggccagattagggaccttaattagggacgggccttccaccataaattaatacatgtgtcgctcaatagttgacggaaatgcagctgtacgttaggagtatatataacatatccacaaccacagacaccataacactccatatttctccatctcatgagacaagaccggccacttgtactagtaaccaggttccataattcttcttgacgctttaaatagtaacacgatcttcgaaatatgtgtttaaatatatttttctattataatatatatataataaattaatacgtttttatttttattataatactcataagataaagagtgaattgtactttaagccacttttgtttacctaagtttcatttaatttggatcaccctctatctaatcttctcactttgaactagttttattttttttaccatttttcattttggactgtgcaaactctcttcgcgagcacaacaacagaatcaaacacactctcatggcaacaatattccctatttacgtgcaattcacatctttattaaatgagaggtttgatgttgctatacaaaagtgttagggtggtctaccgtaaaaaaaaaataaccattcaaaaaaaaatggtggtctaaagcacaacaaaggtaaaataaccaagcctaatgtgaaaagattggatagagggtaatccaaaataaaacttaggtaataaaaggtgattcaaaatgcagtttaccctaagatgataaatctatatatgatattggtttagtgcctttaataaactaaactagctgtgtggcccgcgcaattgcgcggctagcacctaaacaaaatcatatatttttagtatgattttacttaaaatttattaaatagctatctcattgtcttaagagtttgaaagaccaaaccttatcattcccgtgtttctaattatatagttttttaaaagtcacaccagttgctaccccttatgacatctccttctttatttgcttgttcgatctaccactatttctattcattcttcttggaacctttaaaaattggatcttatagtttttagagttttttttgtcacgttgggtttcgtttttataatttttaggcgtcccgtcaaacgttgctattatactcctctatggtccgtccactatctcttctctttattgtcattgagattttaaaaatcgaacataattattgtttgggttcatttttactttctagaagtcccgccaaaccgtcagcggctttgccattgtatttctctacggctcgcccgctgtctcccttctttattatcattgagattttaaaatcaaacatgattatcattgttttttttactttttagaagttccgaacctttaaaaattgaaccttgtagtttttagagtatattgtcttgttgggttttattttttataatttttagaagtctcgtcacacgatgccactatgctcctctatggcccgtatgccgcctactctttattgtcattgtgattttaaaaattgaacataactatcgttggaattcattttttatttcctagaagtcccgtcaaccgttggcggctctgcaactatactcctgtacaccccgcccactgcttctcctttttattatcattgagattttaaaaatcgaatatgattatcattggggtttttttttttactttttagaagtcccagcaatcaccttgttcgtttgcttcacggcctttctaccgtcccttgttttaatcgttattagtattctatttggtgttttattaacagtttttatatgttgtatcaaccgccaccactctactctattataggcctgttacttaatttatctcgtcatgtcttttagatggtcttttctttcaatagtctttatttttatcataaactttagctatttataaattgtattccaaattgaaaacttatttttcattttgtaattttagaatttttttttcaaattttaattaatatcgtattgtgttcttttaatatttttattttttattttcaagagaaaagcccgtgcgctgcaacgggtgacaactattttagtcttaattcactgtgagaattcgcttggatctatatatttctataaaatcataagctgtggttaggagtctgtttgtctaaagtcagcatgcgaatttttttatacgactcctatatttccaaaagcggacgaacttaaaaatcaactcaaaggatatatattttttcaaaagcgaacaaatttataaaccgactcatacacggatgacataccaaaataccgacaaaagaacatcttaaattttttataatagtagaggtttcttttaaaaaaatagtagaagtagaagagaagagaagattacggacaaaaagtcctttttcgaggcaatcgtacaggaatcggacctttttatttttttatacggtagaagtttttttttctcttttttttattttttcttgcctttttttctccacagatagtcggactttttttatggagtcggacgtttttttttacatagaagttctttttctcctttttttctgtttttttataccggcaaaaacatcttcaatttttaatagtacagatttcagttgtttcaaaattgtattcctacttgaactctcttttaatttttctaattttggatattatttattttttattctgaattttaattaatcacatattgggttcttatgtggattcttctttcaatattattttttttaattccgaatttcagctaattttaaattgtactcctatttgaactcttttttttttttgctaatttcggattttatttttatttttattcccaattttaattaatctcgtattgtgttcttatatggactcttcttttaatatttcatatttttaattccgaattttagctattttaaaattgtattcctacttggactatccttttttttttaattttagattttattttatttttatttcgaattttgattaatctctcgtattgggtttcttatatggaaacttcttttaatattgcttatttttaatttcgaatttcagctatttttaaactgtatttctacttggactctatttttttttctaatttcggattttattttattttttattttgaattttgattaatctcgtattgggttcttatatggactcttatttaaatattgcttatttttaattttgaatttcagctatttttagattgtatttctacttggtctttccttttcttttttttttctttttcttcgattaatgtaggaatttctagcccctacagcgaacgtggtgcctcctttcaaagttgttttaataatataatagatagatagatagatagatagatatagatatagatagatagatagttattgatagttgaaattataaaaaggtatcttaactttatttaaatcgtaaacaattatggaaccggaggaagtacgtccggtgggctagccgtgtgggccggggccgggccgccggccagcgttcgcgacagcaagtgcgcgggcgcaatgatcctctgggaagccaccgcgcgcgacgcccccgccttaattttgacgcgcctacgcacaatacaacacgtacgccgccgaagccgtacgtcgcgcgactctcgcggcacgcaagtctcgctcgcgcgcgggttgttggtagatgcgcatgggtggcaggatttggcgctgatcgatcactcgaaacacgggggctcacggtgcgcgacgcgtacctgcagctataagctagccacgggcacggaccttaggtgtgtgggtgggagacgacaggacaggcacgctagtaggcttaattcatctcacgcgtcatcgcttgactgcatgcgccaagtgaggggccttcagagcttgtactgctatcatgaaaaattctaaggaaaaattagaccgtctttagttcacccccaactacctaaaactttcaacttttcatcacatcacatcacatccaaaactttcctacacacataaatttccaacttttttttttaaactttcaactttccccaaacttctaacttttttcaggaactaaacacagccttaataacattcatacaaaatgtacatatcagttcgtagcattttagtacaaactcaactcacacgttgagatacacagattttttttatttcttaatgtgtaggtcaaatttaaacttgatttttagtggagtgctaaatacaactatactctatattatcttcttttaaaaaaattaagtttgtaacattatttacattggatttaaaagaagaaaaatacatgaatgacggaatccactatttttttttgcggggaaaagggaatatattactcctcacaatcaatgtgtgagatgaaattacaactattcttaggccaaaatttagacatagactcacatcgtgccttatttgctaaggtatggcttacacgattttggttacgatggcccttgacaattctaatctccctatttccagctaacaagtctttcacctctcggacaagaaaagccaggtctgatttatccttttcctgtgatttgatcatgtgaatagccaccaggcaataagtttctacgatcaacggccaaagagtccattgcaaagccagagctattccactaccctttaatatacgatcatacaaaagtcgcaacctatatgtgttgttaacatttactaacactagtacgtagcactagggtgctgtttgactctcgaattctactagtatcttttattattctgtttagagtatatatagcctcgagaaaatagtacaaagtactacgcaattttcagaattatgaaactcagaaaggtaagatctttttcagacatcacgcatacaaaaacaagcttgcagtagagcggtagtagcatttgtttgacgcagctaggatcaccctaagattccaaccactccctgtttaccaccacacacaaactttgtttactgcacacttaattgcccttttacccatgcctaatgacctaatcttgtgacctttttgaacgctcatagccgagctatagctacaagacagacaagaaaaaggtccacatggagagattccaaagacttgctcagtttaaatttctccccctatacatgctactccataaatcccaaaatataaaaaaattaagttgaatttgacaaatcctaaaaccatgagtctatacagtctcttgagatatactccctccggactgataatacttgtcgttttgaataagggtgaggtcaaactttagaatatttgattatcaatcatttttaaaatatttatctttcaaatatggtgactacatgtatagattagtcttaaaatgtattttaataagatcatatatttgttaatatttttatacatattataatagaaaataatggccgaagttttttttttttgagactatgccattgtccaaaacgataattattatcaacccggagggagtagtactaggatggtataataatactgtagtagtatcagcaaataatactacatcctttcatgtaatttatggcctctctctgtgattttattactgccaatccgacgtgaacgtgtagtaacagcaacagtagtaacaaacatgcagtccctaccatcttctgaacctgccacactttgtcaccgctttattcgcgtcctttcagcatttacgtatgctacctgaccataccatgccatgcgtggtccacataacacatcggccatcatcctgcctccatatcgactctcaagtagtgacattattacaaccaaaaagaaaagaaaagaaaatctcaactgaatagatgagattaatttaggtcttaaatgaaaccatcacgaacttgaaccataaaggccaatgcaactaatgcaagtgctcatttaattaacaaatactcctactaacaaacatctctgcactgatacgcggtagaagcgaaagccatcagatatcgtatagtactcccctttttgcaggggcatgcatgtgatgagcgatttgcatcggatcaggctgacagctttggcgtttttgtgtctccttttggcttaagatctactacttctacacctcgatcgatcgctgctgtccagtgtaccagagttcaaatggcctatttgagaaaggttacagtgtaacaaagtttaaatgacctatttaagatagtctaaaattctgagaagttgcttgttagtaactactccctccgtttcacaatgtaagtcattctagcatttcccacattcatattaatgttagtaaatctatatagatttatacgtttagattcattaatgtcaatatgaatgtgaaaaatgctagaataacttacattgtgaaacggagtaagtagttctttttgtcaaaatctgcgtgaaaagttagattgtttggtgaagtttctgattatgtaagaagccgcaggcctgcacctaacagaggctccccgaaaccggtccaaagacccaaacggttgtgttggatcttgtagtcttgtcaagaaaccggccaagccccatgaaactccaaatagtataaaaaaaaagtcaagatttgccttaaagatataaatacgagcccaatttatttagtagctgccattgcaacgatgtgcagtaataaactagtaatagtagtatagcatgtgagccgagccgtgcagctgcagctgcatgcttcttcctccttcgctatatatgcagctgagctgcacacacgatgagcagtagtagtagtagtataatttggtagtagtgagcaagtgaaactgcaagtgagctaaggtgcaagaagagagaggtggagatggattggtacgcgtggctggcgaagaccgggttggcgccggcgctggcgtacgagtacggccgcctcttcaaccagaacgagctggagcgcggcgacgccgcgcacttcgaccacgacctcctcaagagcatgggcatcgccgtcgccaagcaccgcctcgagatcctcaagctcgccaagaaggactcctcctccgccgccgacgcaggcggtggcgactcctcgtcgtcgtcgtacgcgcagctgatcgcgcgcaaggccgggaggtgcatcgcgcggtgcgcgcggcggctggcgcgaccgcggggtgtcggtggagggagggggtcgtcggtgaccgtggtgccgaggatatgcagcggcgacgacgccgtccgcgtgggggcagtgcaggcggcggcgacgaggaggaggaggagcgtcaagaagatggtgctcatgatcaccgacggcggcgccaccgccgcgaggggcggcgtcggcttcgccgccggccggttctcggggtcgcagaaggcgagcctgatgttccacgactgctacgaggaggaggacgacgactacgaccacgaggaggaagcgcggtgcggcgacggagccgagggcggcgacgaggatgccgaggaggaacggtgctccgacggcggcggcggcggcggcaccgacgtcgagatcaagtgggactccatgttccaggacctgaagccgacgtgattgagttgaggcaatttgattaattcgcgagtttgtgtgtagctttttgtgagagaatttttacatctctctttgtggtgcgagagcttaattaggatggtaatgtgtacgtgtctatttgccatgagtttagacgataataatatcgagcgcaaatgttttgagtgagattaattgaaggtcaaaggaatttagtgtacgcgattgatcgaatacccactgcataactatgaattattttttcaattttttttagcacaaggcaggatctctgtcgatcaagtaaagttaacaactgatgaattctctctcgttcccggcaattggctgcaagcctgcaatgtgctacatgcatgatttattacgttacatattcatggctgttaacgtttgttcatcgcaagattatgcgaaaagtaaccgctgaattacaaggacttgtctaacaaacattcgcatgatttgtgttcctcatgagcttaaatagaacttcaggatgaccgacaaaggcataagcttgtcccctcttaaccagttaacattgcacagcagacatcgttagtactcctatataatgatgtccgtcgatgtaaaggcgctattattttagactaaaaagggaaaatgccatggcatggacttggatgacaccaatctgttggaagaaaatagtatagctcgaaatatagcagcagttgggggtacaatcgttgggtgaccactgaccattgcctacttggtcaggctctctagccagcgcatgttcaaatggcaggccagtatcactggcaaagctactgaaaatgacggttatgaattatgatgctgtccaacagaacggccagtcacgtcaatgcttgacagagagaagggccccacgagggtacgaggatatatccagcttggtaacaacagacaggcatagacggcacaggattcccttcaaagaatgacataaaacggaggtgaaatagtttggacaagttcgatgaatttctccaaaatattcccacttcacacacgtcaactcatattggtgtagtaaagacaattaactgaatgctttaaccgctattggcacaattaaataatcggtgtgtagccacatgaacacgggtgtatcagtattcagtacagcatacacgagttttcgattagaccattcaatatgatagtacccctttcattctttcatggcagatgaaaccacatacattgctttgtgggcacaaatagaatagggcccggggtaaaatgattgcagtaaaaaaaaagataaatcactcaaaattgggatgcttgaaagaaaaatcaagaacgagtagccaggtagaaatctcctgtactaagaaaaacatgttttcccagctggagatcaattggtgggaagccttcaatgaaatccaccgtaatctgtaagaacaaaggcaatttaaggcatgaagaacaagtattctgaaaaaagttcagtagaagttgtagatttaccttgccattcccagcctggaattcattcttcaatctggaaatagaccttgacagtaaatatacttttaatgcatcaaaatgctcacggttgcctgttccatcaaagtagacacttatgttaccatgcagaatataacaaagagaatgccaagacattaacaacgaaaatagacaagtacaccctatcagataaggttgtatttaccagcggcatggacaaggagatcatctgtgaccactggagaaacccttgcaatgtaaatgacaaacgacatgtcttgtacattgtgagactcctcacagatcattacctgccaaaccagacaaatgacaatgagattaaatgttttatatccatttcaactcgtgtcaacaccaattggtggtgatgatagtgcatataacttggtgttcatgtaagaaaaatcaaatcctccaattgatagagataaaagtcagttaacagtaaactgaaacagggagaatatccaaactcactgcatctggtggcgccgccatctttggaattagtggattgccaagagcatcccttatatactgatcctgaacagaattacagtagctttcattaaggatgttctgatttatgaaacaagaaccaattacttatgccaatttagctgacctgtgactgcacaatctctactagagtattcttgccatcgtccataggtttgtaatatacatcaactaagtctgtcggctcaagttgcgctgtctttcgtaacttctggattctgttcacaacctggacagaaatgctcaagaattattagcccagatcatgaacatcaaacttatgactgacaacagagaaaacgtatgcaatcaaacacgccgctggaagttcatagcaacatgaagtcagacatgacataggtcaggtaaagattaccaaattcaggcatcaaccagtgcaaaaatactactaacacataattctcagtactncagggtgtcatacccaggagtacacaaatcatatagttaattacctctcgagcaactccagcttcaaacaatgattgatcagctcgaagatccaaaacgactaacacatcacctacatgaaaaaaaaagtaatgataatatgacaaaatagacagatagcatacaaactactcatatggaaacatatttgacataccatctcccgcagcatcaatttcattctctgccacatttgcaggacgtttaaattgccggatcacctagagggtaaaatgtttcagagaattaaagatgcagcaggttggaaaaataagtccactaaatgcaaacctgtgcaaactaaagtgtagcatcatgtcattcatcatgatgatcagaaataatgcccccaaaataaaacaaatgtcaaatctaatttttagaataggtgtgcttgcaaaccatttgctagacagatatgatct

SEQ ID NO: 47093 - DNA, 5538 bp, Oryza sativa
ttctttcacctcaaggtcaatatgaccactcttatgacattagctagattaacaataatgaattagtgaaaaggatattaatctacatgtgcaatcacaaaaagtcaggaaatcatttcggttcccaaactcacaacgaatctataataaaaatatataagagcatataagcatcagcaaagtcacaacaaagagtagcattttgcctccttggttacatagttttatgtcttatgctagtttatgacatttctggtcaataatatcatttccatgtgtagaagtcatagaattttgcagcttcttgtactgaatctacagggaaactacaaagttcagaaagcttatgtatgcaattatgcataatcagtgaattacaccaataacacctcatcatggagacatgaaactcagctctaaagaatttataagtcagaaggaatataaaacctaaaatgatgaagaaaaatgtttcctattagtaaacatcattacgcaaatcatattaagtaacttggcagaatctctagtagatgaactgttaatggcttaatgcattgggctctacaaaagaatggctataatacaaaaacagaaatgccatggttcatgttacttacaagaaaaaatgcaacttgccgatgactcttatcagcagcaagctgtgctggagttagaccagtcttatccttcaccatcaagtcatcctttttgccagcctgaactagcacagtgcatgcctccaggttccccctaatagcagcccaatgtaaaggggtacaacctaggggcagcattgtagtaaagaagtaaatctcatgctctgaagtgtactgatataattggagatatggctaagccattggtttacactgttatgtgcacagcagtacaggtaataatggaaatagataaatttagcacatgccttctttatcctgccgccccctataagcatccaaatacaaaaggagacgtatagaatccgcaaatcccttgtaagcagccctacaaggtaatatgccaaaaaaaaacagagagagagagaaagaaatataaggggcactgaaggtttatggggacatgcattactaagtgcactggtagaaactactactccagtgcaacataagataatgataaatgtagagaacaaggtacaaaccagtgcagtgggcttcttccatcattatcagggacatctggatcagcattccacttcgcaacaatatgataaataaatgctgtctggccatactgcgctgcaacatgtgttgcctgcaaacagcagtatagagttctggaagaaattcactgccatagacaaaagttgtggattcttgcttttcattttacctagagaattcataggttaaatttatttatttatttatttatttatttatatactggaaatccctgatcccctagtgtggatacaacagttaacttggcaaacaaatatccaacaatacttagttgtctttcagaatcatgaaccaacattggacaaccaaagcaacaaaccaggaaaacagggaccaaaatacagaagggaagtcaaattcagacctgataaccgtataaatcagcaacatccaccttagctccttctttcagaagaagctcagcaacttggatgtgtccacgtacagcactccagtgaagtgctgtttgcccagtgtggtccacagcatttacatctgctccatgctgttcaaagaccaagcacaaaatcatagtccggtcaaacaaaattatatgtgcagaatgcgctcactgaatagcatagtgatacttcgtctacatgcagagaataacatactctgactacataccacaatcaagataaattcctggtaccatcaaagtatgcatgttatgtgcgagtttattcatgcacttagtaggcacacaattagtaacctttcttattcagactatactgagcctaccatacactcatgatcttaagattaaaaggaaaagaagacttaaacggaaacacctcaagggcgctgcacaggccagctgaattctcatctgctttatccagcagtaagcatgtccacattctcaatgatccaatggaaaaaataaacatacatccatatgaaaattcagggataaaccaaagcacagtctcactagttccatttctattcaagcctacaacatacaaaatgagatactgaaaaactggcatcatctccaggtcatataaacatccgaaacctactaaaagcacatcaatttccagctataacagcttgcagcagtcccaaaccctccatattcacctaatgcagttggccaccaacaaaattgttcacaaacctggagtaattcaaccacaggcactggtaatttggtatccaaaacaccagccaatgagctaaaagtgaatacacctagccaacacagtataacaacaaacagtccacggttcaaaaacatataaaattgcggctcataaagtgcattggttgatgacgcatcctaccaaacccccacccaaatccctcgctagctagcaaacaacgactacacgaaggccagccaaatcgcgagacgctcgggcgggaagcaggaggggggaaaacctcgaggatgtactgcgcggcggcgacgcggttgttgagggcggcccactggagcgcgtggtagccgaggccgtcgggctccgtgaccgggtggccctccccctccactagccgctgcagcttctccagatcgccgtacgccgccgccgtgtacacgtcgttcttcagcgagtcgtcctccgccgcaggggccggcccctccccctcctcgccgtcggcagcggcggcgggggatggggatggggacgcgggcgccacgggggcggcggaggcggccatcgtggtggtggtgtcctcgagcacctcgatctccgacgccatgggggtggggatcggagttggggagtgtttgactgggtgggtgttttgggggggattcgttggggtttcgcaagttgggtttgggtttggtttgggtggaagcggagaacgagggggaaggagagaggcggaggcggcggagacgaaggttggtggtgaaacgggaaactccactgtgattggctgaaaaaaagaaggaaaatccccacagtgactgcaagtttagcacatcaccgttggatgcataatggaaagggtggaacagggtgggtattcggtgtcggtttttcggtcattttgattcaatgtaaaaatatcaggaccgataaattcaatctcggtctcggttctgaccgaaatttaacaacgtttttatatatgcaaagaaataatggaaattttcaacacaaaaataaaaataaaaaaaccgtaagcacgtatgagtaaagacttttattatgttgcatgcctagaagaagtatggatatgaaaattagagtttaatcctattgaacttagtggattgtaggttgcatttagacatattttgttaattcggttttttcgtctattcacttaaggagactaaccaaattgaccgaacaaaatttggtatttcacccaatttctcggtctcaatctcagtcttttcagttcggtctttttctgcacaactctagagtggataatgagcgactctccttgtcctaaccttaacagcagtaaaagtcttacttggctaggagttaacgagctactccctcctctggtttcataatttttaatgatttagataaggtttaatttaaatttttataacttaaaaatattcagtttaaagacaaatacagtattataataaaaataaacacacatttaggtatagtgaaagacatattttgaaaactatatctttgtctaaaacattaataattattgccgatgtttgagatcgtaactacgatattttgcatactgtagggatcgttgttaccagggtatatacgagattgaagtaaaagagacggagacaatgatttttatacagattcaggcctcttatctgataggtaatagcgttacttctgttggctgaagccggtgttgctcttattcatcataatcacactagtacaatatttggaataacacatctaaccgttgtcgacttggagacctgaaatgaaacttctatatatgtgttcttatcaaaacttctatatatgtgttcttatcaatctataagtaaagactgaaaaataaactttaataaaaaaactcttaaaatcaactttaaatttaagattaaaaattttaaatttggctggcgagtataggcataagccaaaagatgcagtgatcacctcatgcacggctgcacgatggatccatcgccttggagtccaccattccacggtgacaaaacacggcaagtccgcagcaggctggcttggatggatcggatggcattccgttccatcgattacgcgttcaacagctccgatgaaaccatgaacgacaaccagcgagagaaaaaaaatatatcaggaaatcgatttcgcacctggaatcgggacaagtcattcttcgttcgcgtgatcgcgtctctttagcggtacacgatagtattatacacgattattgtggactgacccagtcggccgcctcgtggaatcaaaccagtacgaccgacgtcgtggacttggcagtcagtacgctgccgattccacacccagtttcctatctaagggcaatcacagtgtgtcaccgatttttgccattgctcgtatgccacgtagataaagaacctcgtaagcttcatacttcacagtgcaaatactagtagtgggtctcaccggtgacaaactttttactttttatctctctcctttttcttctcacccaaatgagtactagtactattagcttctctccacacaaatgagtagcttcttccaagaacccggtggcaaactttggacacaaaaacttttttttgggcccagaagcaaacgtggcgtgtgctttttcctttgcagactagggagggcgaggctgaacgtcacgtaagtccaccgtgaacgccctaatcacatagtacatttttcgccccctgttttcctttctgccattccattggcagttcggttctttgggacaaaagttactccctccattttaggttattagatgtttttactttggttaaagtcaaactactttaagtttgactaagtttgtagaaaaaagtagtaacatttttaacacataacaaatttattatgaaaatatattcaattattgacttgatgaaactaacttagtactatatttgtctataaacttagtcaaacttgaaacagtttgactttgaccaaagtcaaaacgtcttataacctaaaacggagggagtaattgacagcctgaaaggaaaggagtaattgacaagaaattacacgaaccaattaaaagctgctccgagagaaaacttgttgtagtatcgacagacatgtactccctccgtctcataaaaaaccattctagtactggatatgacatattttagtgctacgaatctgattctggataaatgtatgtccagattcgtagcaat

SEQ ID NO: 47094 - DNA, 13279 bp, Oryza sativa
  unsure (1)..(13279): unsure at all n locations
nnnnnnnnnnnnnnnnnnnnnnnnnnnnnnnnnnnnnnnnnnnnnnnnnnnnnnnnccatagaagtggaactatttcttactaatatttatgcattttgcgactaaaatgaaaaaggaaaacgaacgcgaaatacttataagttcattataaaaatgatcgcgtcttcgctcttataggtatttcttttatgtgctaaaactaagtgtttttttatgtgaaaagaaggcagttccaagcattatggtggattaatcttgctggtcccgacagaagaaagatgaaacctagaaactgtccaactaggacggcaaagcgagtgttaaacaaaatggaagaagatgggagaaggacgtcgccatgggtggcacagcgtggggcctccggagctcgtgtccccaatcaggggtgttggtgtccgccccaacatctccattgggcaagaggatactccactttatcaagtcctttgccagcttcctcacaggtggtgtaatcatcagcattgatcatctttaaccaccacctagtagccaatactcaaatacagtacctgctatctgtgtggagagatgggtgagtggtagtaggagaaatttgagcaagctgcagttagatgtaggacagagtacagtagctatctactatgtggacagatgaatgagagtagtaggataaatttgaggaataagcggttatctatagtatttgtcatgaatttcctttgattaacgtgtaacgcgcaaaaaaaatcagctgaaaatgacggaggtagtaaaattttagagttcagataaatctaactatggtgatgatttaatatgaaaattctattttgaatctccatgatttcaataaaattgtaccgtaggtttttcaaagaacctgaacaactgaccgggttgctgtactataaatcccatgctggtcattttaaaatatccatagtttataacaagatgattgagttaagctccgatggaatctcctttgtattagagttgtttgcatgcatatctcgattaattagaaatgaatcttgtaacttaacgtaaggtaaggttattctacatacaggggagattgtcaccaggtgattccaagtaatctactccctccgtcctataatataagggattttgagtttttcttgtattgcttgatcactcgtcttatttaaaaaattttagaattattattttttttgacttactttattatccaaattactttaagcataacttttcgttttttatattagcacaaattttttgaataagacgagtggtcaaacaatgcagaccggtcatcttacctgtcgtgaactgtgatctgacatctatttcaaagaggacaataatttccatgttctaggtatgggccaagaaaaaaaacacgcacacttttgattactgaataattaaaccacctcgcaagtgagatattttagctttatgagatactagtttgctgtcgtgcatggaataaagagggatgtgattgtgaaagagtgaagcaaggatttcgtccccacgttgaacccttaatcaagggcaagagggtgtccaaattagttgatgatctgatcccggggaaaagttcatccttaaaccgtgattattttagcatggtttaagactttaagctaattggagacgaatgctgatgaaaagaaaagaaatactatacctaagcgtcttgatgcattcagttttggatgcaccctgtactttttttttttactcgtctccgacgcacacggcaagctgtttctgcgtgttcttcttgtcacatagcctgggatttgctgtgaccaggagggagcatagtcaccaccagccagcctcactgtcacacactgttttgcttaagattccttgtaccctgcactttattggaatccaggtccagttaagtgacagtcaaaatggtaacagtgttgagctgcctgaccacctgccagcaaacacaccttgatcctgtcacacagcaaaacggcttccgaagaggcatcctttgtaggattccaatcgtacataaaacaaattatttgacatttcgaaacagaggattggagctttctacatttcgaaacagaaaattctttagaaatggcttaatgcatgtatatcttagaaaaaaaatcagtagaaaacatatcctatgtagacaaacttatatgtgtatcgtgcatatcagtaacaaatatcaccaaaacttttagacaaaaacttccaataatattttacctacatgtatgtaaagttttaacttaaattcattatattttagtagcacctcaaaattacagttgtaatagtataaatctattagaattttattttttttatctctctatgtataaatttgaaggcgagactttacacatagacgtaacatgattttaagtacatgttcactttttctttactatttcggtaatatttgttagttagtttgaacggtatgcatacgaaagcttatgtgcatgacataagttcctaagttagtaagagctagctctaacctctttaaagtttctctaactctatctctcctctcatacaaatttttatgtttcttctattgtctgtctaaatgattattttcgtgttttaaaatattttatgttacacaagtacttttattaaaatcctatatttttttcatttttctgtgtttttcaccattccattatttaaaagggatctcagtgtgctcttcgattcttcgagaaacgcacatgggtcttccggctagctccacaaggtggtgggctagacgacctggtttcgaagcctcaccccttctaattattgattaggtccttccctgatgtacgtgttttctgtgctcttcgattcttctgttatcccatttaccactttcggtcgtctgaatttacaccctcaactgttttcagtgggtatgtcgtcgtaaaagatcgtgttaatctaggggaaaaaacatctttcacgcataacctactaataaagaagattagtagtagtaaagaagattactggttcactcccaaagcacatggccccaaatccccagcctgtggggaagcaagagggcacagatatcctcaagctcagtcacaggatcacagacagactcacagtgttagcctcctctccgtagcagattggcagatgagcaggacgataggactagcagtagctagtgcaggtggtgtttggttctcggagaaggtgggtgggatgcagggggcgagaccactccctagtttgattcatgggtgggatgatcctagtttttatttggtgcaagcgataaggaagaaaagggttggatgttgcctgaagccatcgtcaacccatcgtcaaagtgcttgacacaccccatacatcgaacaaaataatgatataaccgtgaattcataactggtagtaggttattatatttaggataatatgagtattttagcggtaaaaaattaccttttataagtaatagtattagattattatatttaggataacttattctattttggaacaaatgcttaagagcttacgatgcatgcccattataataacatactatcttcgtcccaaaataagtttatttttcacgcatctcatacatactaatacaaaaccagaatactagaatactgtcacgccctgaagtttccctctttgctttaaaattcataaaataaatcgtccgaagaaatgatttaatttaacctagagatgaatccctaaattaataaatgcaaataataattggaatcggtatgtggaatttttcttgagttctacatgtcgaaatgtgctaacaagatttttaatggaattttcagagctctagaaataattttaaccaattaaaatcgagcacaagcaatatttaaatccctggaaaatcccctttttccttttctcttctttttcttcctttttccttcctttttttcctcttattgggccgtaggcccacttcctcccgcgcccttcctccttgctgggctggcccactccctccctcctctctccgggtcaccgacaggtggggcccacctgtcggccccttcttccacctccagccgacggtggcaatcaccgccgaaaccgccgcgccgccgccgctttccccgctcctcccgcacccactccgtgccccacgcccctccccacattgtcgcgacgccgccctcgccttcccgcccgcgccgcgcgcccacaaggggcggattcgaattttgaatccccccagctctctctccccactcccccacgtcggtgagaaatccggccgcctcccagcctcgtccgtccctcccgagcccatataaaccatccccgcattctcctcctcatttttcctttttccatcggccgctcccgagctctccaccgcgcccgcaccgtgcgcccacccgcagccgccatctccactgctccggccgcctctagcagccgctagggccgccgccgcaccacgccgccactgtcgtcgggttcgcgcggccgaggtccgcctcgtccacccctcatccgtcacaatccgtcgccgaagatcatccgtcacaatccgtcgccgaggtttccgcttgccgtggactccctctctccctctaacctctctcttttcctctcttagggtgtcccggagctcggccgctgttcgccgtcgccctccggtcgctcgccgtcgccgttcgtcgtcgcctcctcccgcgccgtccgaaccccggtgaggcacccctcccccgtttttccccttcctctccctcctagcgccgagccggcgccgccgtcgcgccgccgcgtcgccggtcgccgccgtcggtggccgcttgccgccgcccctccatggccagccggcttggagccaagccgagcccggcagacaccacccccccctttggagccgctgccggtggggtccgcctgccaaccactccctctctctctcccattgagtcactgacccgtgggtcccgtttgtcggcgccgccccacccccccccctcgatgatgtcagcatggacctttattgcgcaataaaatccgttaaggccttttcttttatagtaaaaacacatttaatcttctaaaattcatatctaattcatccgaactccgtttaagtccattcaagtctcagtaaattcataaaaatgcatagaatccattaaaaatggttttgtttcctgtttcagtagtcttatagcatgttttgcttgtgtgctttgtttgtcgcgtagatctcggccgtttcgtcgctctacggtttctcgaagacgttgttgtggtctcatcagtgtgagaacaaggcaagtcatgcattacaattgatcatattgtacccaatttataaatgtcccgcatttctattaaatgttgcattcttttacaatatcatgtgggatgggtcttactactcagccatatattgtttacttcctccggttccatattaattgacgttttggagaaggttgaggtcaaacttttataaatttgaccatcaataactttaaaaatatttagtttgaaggaactagaacaacatatatagatttgtcttttaaagtactataataaaataaaagtaaacatgcatttatttattatatatattataatagaaaaataagatcaaatatgtatttgtagaccgtgtcattgtccaaaacgtcaactaaaatggaaccggagagagtatcatctattttcatcaactccgatgtaataagtgcgcatgtattatgagtgtgtatttggattgtgttttaaaataattcttaaaaataaatttattttaaataaacaagaggagaaaatgattttattattgtgagacggagggaataaccgcgagaaattcaggtgttttatccagttggaagcgagagggggagagaggccacatgggccacatgcccaggaatccagctagccggacacccaggtggcttgcaccctcttgcagtcgcgcggccttctgcttctttacaggttttgccggtactcgcgcgcgccccggaactcgcgtcgcgtcgcgtcgcccaccacttcttccccccgtctcgcctcgcggcgcgtcaccacctcgccaccaccaccgcgtcgcgtcgcgtactactcgcgtggcgcgcctcttattctatgcgtataagagcaagtattagtacagtggactactcatagcaagtttaataatagtatagcccactactaactccaaatcatttatagacaatataatagtcaattcatgcaatatttgcttattatactattaatatctagtcccacctatcatacgcacattacgtattgcagtccgtgctacagatggctacagatatgtaacttgctgctcttctctcttcctttatctttttaaaatatgtttatagttggcttatagcctgctattgtacctgctctaacttcaaatcatctatagccaagttaatagttgattcatataatatataatagttacatataaatatatattacactattaatatatagtcccacctttttatacacataaaacattttgaaatccgtgttgcagctagctacaaatttgtaacctaatttccttcttagggcacccgcaatggttatctataggctctctacaagagatccatgtcaacatattttcttacttggaagatattaaatgaagagagagagcaaaactatctactaacctggagatagtctatagagaaaaacgaggcaatgcattagagagctatagataccgatgtagacatactattgaggtgatttactattaatctagtctattgctgagatgtacatgttttatagagagcaacttactttaccattgcgggtgctcttactcttctctaaggccctcttatcacattcacttgtatttatagctaacttgtagtctgttattgtactcgttctaaggccatgtttagatcccactctaaattttttcaccctgtcacatcgaacatttaaacacctgcatgaagtattaattataggctaaaaaataattgcacgtattgcgactaatttgtgagacggatcttttaaacctaattgctccatcatttgataatatggtgctacagtaaacatttgctaatgacagattaattagacttaataaattcgtctcgcggtttactgacggattatatataattagtttttttattagtgtccgaacaccccatacgatacgctatataatatctaatatgacacgttaaaacttttacacctgatctaaacaccccctaaatcacctcacctatgtaccactgtactatccaccgctcccatgtcggcattccgttctttcagctgcgatttcctctctctttttttgttatcttctccgtgggtttctccgctcttctcacatggatctttgaccggggaaaagtgatggatggatgctgtgcattttgtttggtcacttgtccattcaggttttgtttggatctagtcttagatcgtggagatcatccagtggcagtactagtactttgttactgtatgtattattcaggatggattgcacatttgattagtatttgcatgggcagaaggaatcaggcaacagtttaagaacacaggatgcaatcacatttggcaaaggctttttagctgaagattggatactcctctcaatctgtcgcctcaaacaagcagcaatgtatgcatcgcacgtgaggtcaatgggaggggagattgatgtcacgtggcaagccagaaaagaatgggcatgttcactttgatttcattttcaaccttaccaaattttaggaaagttgctaaaaaaagtgactacatttagtttgctgtcaaattttagtaactatataagaaattttggcaaactatgttaaaattttggtaatgccaaaatttagtaaggttttttttttgcaacaaagtgaacaggcccaaagaaaacgtcttcgtacatttcgcttggtcgacatggcgagcacaggagcgaaacttcagtaaattcattatccatcatagcacaagtatcaataaaaaaaataactaaaataactttttttatcaaattccagtgtagatattacttattttttctacttttaatgtacttgtttcatactgccacaaacttcaatataataattatttaaaaataaatttactttagaacaaatcagagaagaaaaatggtgttattttaggaccaagtatgtccgatgtggttaggcagctgtgacacatacggatgtttctagctgcaaccatgactgtatttaattggaccagtggctcagtactcctcccatacctgccacaccagacatttccgcacctaatttgcttttggttactagggctacatttgctgcaaccttttcttcaatcttgtctctttgcttgccttgcgtacttggctagtagttggtcgtcttctgtttttttatgggagaaaagaggcccatgaatgttcttggatcacgataggccgttctaagtctacaagcctggtagtgaggctggtaggcccaataaattcggcccattgaatggcccaatcctgacatgaaggcgagaatcagtgggctccgtgtgcaggtaatcagattctggaagtgagcctcaccatcaaaggccgtgtgtctgtggcccttttaagctgttgctggtttgcgacgggaaaaagtccacttagactcccttaattgttcaccgaatctaattcatgagccttaactgaaaaaacgggtagaacgactccccgaattatagaaacgagtgtattttcactcctccagaggttttggagggcggtttttactgacgtggtggtgctaacccgatttttattacacatggcgcttatgtggcattagaatttaaaaaatatccgtgggacccatatgtcattcaaacacaaaatatattgtgggacctaccaacatgtggggcccacatgtaatcctttctccttcctttcttcctcctcccttcctcctcccttctctctcttttctctcccccttttttcttcccccttcgaatgagcagcagcagcaggttcagcccaccaccacccaccacattacccgcaatgtctcctgccgcgcccgccccagcgagctcctcgccatcgtcgaccccagcggcgccgccaaagtccacccttctcaagatcctcaccggccgcctccacccctccccgcctcccgacctgctcctcctcaacggcgtccccgccaccaccgccaaccaccgcccccgtcacccggcgcgacgtcctcttcccgctcctcaccatccgcgacacgctctgcttcagctccagcacccgcctctcccccaagcacatcgacgcctgcgtcgacactggagctgacatgggtggaggcggaggagaaagaggcgcactcgcctcgacaccgtgccgcctcggcgtcgtccgccgtgcaccgccgctcggtcgtgccgccccttccgccgccgctgcacgcagtcgtgtgccgtcgtcggcctttctctctcaaatcccgtcgccgtcgcccttcccgtgtccctagcgactgccccgagtcgccgccctagccgctcgtgccttcttcccccctttcaccgcaccgcttcttccgccgcgctaccgtcgccggtgactctcggtcttcacgccgtcgtgtgtgcgtcgcagtggtggagtggctcgaccaaaccaaccgtgcgagccgcgtatcgctccttgcgcgcagccatgtcggcactccggcgagcttcgccgccgccgccggtcgccatcgtgtctcctctccccaatccaagccggtgaatggattgcccatcttctcctctaccctccagtgctagcactttcccccggatcgccgccgtgagccgtccgatccggcgccccctccttctctcctctcgtcttgccaccgtggctgcccacgtggcgttgaccgaccctgcccatgtccagtcagccggtcagccctcctctctctctctctcccgtgcttgtgggctctccacgtaagcggcacgtcgacgacacatgggacgaaaaccgggtcaacaccaccacgtaactgtcacgtcagccaaaaccgcttgcaaaatcacccagtaagttaaattacacctgttttaatagtttaaggaatcatcttatctggttttctggttaagggtacaaattagattcgctcgatatttaagggagtcaattggacttttttcctttgcgacgctgctaggcccgtaaggctatacgacatcaaaagttacagtacgcattgcgctttaggactttctttcttcatcttaaaaatcgaattattgacatatattatatgtttcatgcttcgaaacatatattttcttaaagaaaatttttctactacattactacattaactatcactattgcctctttctcctagtagttgtaagtagtagtgctagttatttttggctattatctaaaaaaaagttatttttggctgccctggcggcctgttttttctttcctgttttgttccagaacatgaacaatgttagttagatcatgttttgtcacttgaaagcttccgatagctggagttatatattacttcctccatttcacaatgtaaaactttgaagcattgcttatattaatatagatattaatgaatctagatatatatagtgtttagattcattaatatctatatgaatatggacaatgctagaaaatcttacattatgaaatgaagggagtatatcagaagcttttcaaatataactagtgtctacatacccacaaatccattggtcatactcgtgacaaaatgcagaatgcaatcttttattgatcggtggagctgaagaagcaaagcaaacaccttgtgacgagttagatgggatcaaattgcacacggaccgcaccgggtacttcgggtacttctatagttaggacttgttctttcctccaataaaagttggacaaaaatttagatatccgtgacacgtttcatgtgaaactttctatataaaaattactctaaaatatcagataaatataatatcagataaatatatgttttaagtttgtaatagataaaactcaattaaccctatgttaatagcatatcgttttatgtaaaatacttaatctccatctgcatgagtttcaaaaaccaccttagtccaatgtagcagcagcagctcgcgcacacgtgcacgcgccaattcgagtggcgagtactgcgcatttgaccgtccaaaagcgtccgctagcttgatccacgcacaacagtcacgttacaaaaggggtggcactcgtagactggacagtgcaagtgtggaccagaccgtgtggtggcaatggcatattggcatctgcaacgggcaagacggcgaggcaaacggctacctccactcaactcgcctcctcgccttccccatcgcatcggatccaccaaatccttctcggtttgacccagcacgcgcatccggtccaagtccaaccaactggctgcgcagcctgcaacgcagcaacgtccatttctctctttttttctcataaatccccttaatttttcccctttctccaaaggcgccaaattttgcagaaaaatccaaaccccggctcaatccccaaatttcgtcgtcatatcccccggcgaaaaagaccaatgcgcacgcgggaatgggagtacactcctactgcgccaccaaactcgcctcgcacacgcgcgggcccacatgtcattcaccgattcacgagtccaaaactaccgcggtaaaaggagggagagattttttttcaagactaaaatcgccccaattctgggatacatcaccaatttttcacaaacatctcgatatgtatcgaattacataggaaaccatgtgtcgaaaccatgggaacatttcctctaagctaatagtgtagtaataatctcacaatttttgatgctgtagtttaatcatgagtacacagtttaatctctctatagtgaagaagagttagggcgtggaggaggagacaggtggggtacagttcatgagatggcgatggccgtcgaccgccgcgccggcgccgccaccggcgagggcgggagccgggaggagaagttcttgtaccggaaggccgcggcggcgtcgtctgcggcgtcgtcgtcgccgtcgccatcgtcgaagttgagcgcgtagctgagcgggtcgtacccgaactcccccgcggccacccgccgcctccacctcagcttctccccgctccgccgctcccccggcgagccgaagcagcagcacaccgtcgtcctcagtctgtgccttagcgacgacggcgacgtcggcggcgatgcctccatcgagctagctctcgccgtagtagtggattgggatcactggtgattttttgagatgaattttccgatgatgagatggtggttttggtttgggtggagagacgaagggtgcggctaaatagggacgggcctctgacggcgtgaactgggaagtgacggcggctagctactactccctccgtctccgtcccaaaataagtgcagttttacactattcacgtttaacatttgaccgttcatcttatttgaaaattttttatgattaatatttttattgctattaaatgataaaacatgaatagtactttatacgtgactaaatattttcaaatttttcataaatgttttaaataagacggatggtcaaatgttggacacagatatctacggctacacttggtttgagacggaggtagtacggagtacgcggtgggggaagcgccgttacgcgtgcagttagacgtgggggccgtttggggattttgcttagcgtaggcgggttgcggatgacgacgtggggcccacggctcagcgggaccagcaacggatcgatgatgattgatgataacggtcggtcgtgcaggcagcctgtcgcggatgacaggtcagggctaatacgatcattatgctgttgcagattagcatgagcacatatgtgatgaactattagggcacccagaattgttatctatagactctctacaatatatctatgtcagcatattttcttaattggaaaagattaaatgaagagggagagcaacgctatctactaatctttagatagtctatagagaaaaacgaggcaatggattagagagctatagatatacatgtaaacataccattgaagtggtttactattaatctagtctattgctgagatatacatgttttatagatagcacattatttt

SEQ ID NO: 47095 - DNA, 6938 bp, Oryza sativa
cctgcagcccattcgagaaatacacgtaatcaaacgatttgtttaacctgacgattttctccttgacccatgaggacatgagtcacgtcgcaccattaagctccaaaaaatatgagacaaaattgctgacaggatcacaggattgggttcagtctcgatttgccgatcgaacccttggaagctgtgggctaatcacaggtgcatgtggcacacagtaaattgcactaaaacagagggctaacttgtcacgtatcgcaacttgcaacgtacagtacccttttgtcggaaaaagttaacctaaatttagatgcgatgtaaactaatacaataatctaaatatatatttttttaaattcattgtactctactgtgtcataacaaattctagtttatttgtttttcctttttgcgcaggaagtaagttctcagagcaagtttaacagatgaactcactatcacttatcagtctatcttagaggggcgaatgcctttttctcgtgaaagggagatgcctaatcgtatcggttactgtgtgatagtctgacaaccatatggcgtcccatgagaacaaggataaatcagctataaacttatcttaaaaaagagaaaaaatgcgttagctctcgtatagtaagagttaactctatacgtgttttaagataaacacattgaatgtataagtaagagaaatagtgaagagaagaaaatttaaaggtaacttaatctattatatatatatatatagtaaatttgtttggtgctccatggtgcccgggcaccattgttgaaattgagtatatacctaattcaaatgcaattaaaactttttcaattacttaggtattaacattaactactttactaacaagtttaaagcaagtttgaactgaatttgaacttgtttttgttagatgttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatatatacagtgactggaaagtatcaacggccaggcgataattacgataagttgatggctgcaagcagttggcctgctgccggattgctttcgatcaatgtcgctagacgctgcacctgattaagggtattcccaacccaattactatgatagtgtccaaagtattaaataagttgtcacctagaacaaaaaaaatgatgtggcaagtgaataaatgaagaaagagaaggaaaccatgtcttatgtaagacatggtttctacacaacattcaagatatcatgcgagataatagtgttgtttgcattgaaagagtagtctctagtactagtttcttgatgatgtggagtttatgaaaaccatgtctagtgttatgggttgggactgctctaatgacgtgtatagacgaaatctccgaaagcaaatgtatcatgacagttataaatatgagagttttcttgcaaaatcatgtaaagttataaatcctgcgaaattttcctcaactattaacaactgccatacgttgcaacaaacttatcatcttcgtttcaaaataaacttacagtacttaataaaaatgtgacacaatctagtacaacgaatctgagcatctctatccccatacaatgttagctataactacaagaggaggaccaagacaacggagagagatcccatatcaaaacttcaactcaatatccagttgaattagccagagaaaagctttcccaaatcttgtaactttgcaaataagagatccaaagatgaacacgacaggagtagaatgttacatttccgagcgatcgatctaaacctatatgaaccacatgtttcattatttttcttccaaccacggactcacatctgtacacatgctccctggctgaatccagaaaggggttggacatttctatgctattggaagtttggaactcaggctccggttgctcgatctcatcgtcgtgggcaatcaacgatgtttctctgtcagacatatagaagagaaagctctcatttttgcatgcacatttctcaagcgaccagacatcatgtttttttaaaaaatataaaaaatattttaaaatacatcaatttatattaaaatttaaaatagtaaaatacttcactaatcgtatgttacactgtaaacttagccaggtatcgtaagcgcgtggtaattggagttgagacctgagacgtggcatctggcacgcgaatgagtcacgtaaattggccttgtttagttggggaaaatttttaggtttggttatcacatcggatatacagacacacatttgaagtattaaatgttgtctaataacaaaacaaattacagattccgctagaaaaccgcgagatgaatttattaagcctaattattccatcattagcaaatgtttactgtagcatcacattgtcaaatcatgacgcaattagacttaaaagattcgtcttgcaatttacacgtaatttgtatattttttcctacatttaatcctctatgcatttgttcaaacgctcgatgttacagcgtgaatttttttattttggaaacttaaacagggccatacgagaaggaaaaaaaaaatccgcgacccatcggagcaaaaaccacaccggcaccggcaccgcgcgaacggccgcggctcgcgccacgccgacgctctcccgccacaaccgcgggattccccccccccccccccccaccgaacttacctaagcgtcgcctctcgtcttttttcccgtgcaacgttgcaagtgaaatcatcaatcgtgcgtgcgctgcgcccgaccatggagctcgcggtcagagcagccgccgcggcctcctgctcctccggcgcctcgctccagctcccgcgggcccgagccccgctccgcctccttggccaccgccgcctccccgctcgccgggtggctgtcgaggccgccgcgatcgccgtcgagccggtgagttttaagtcatttgatgttgccgcccctttgcctgacaggtgttcggcgttatgcggacctggcagcaggtcagctactaggtggtctggagctagtggaaatctcgcagcgattcttttttttttcttgcgcactgaggcgatttcttgcctctgctgtaaatggttagctgtttctatctcttctttgctataagtgcataggaggccatatatctgcaaagaagcttcgtagaatactgacaagatacattatctgtggatgatcagctgagaagttacatggacttatggacctataagttttttgagacttgagactagtgaccacttgggtaaattgggtttcgggtacatgctgatgatgactagcagtaacggggcacctacatataccatggtggttttgacttctgcttattcaaggtgcccacgtatgctggggcagagatgggcttgtcaataatcacattgcgtctgaatgtctgatgtttctcattagaccctgccctgctgtttgtgtgttatatcttggacttttggagttccaacctgacaataacgatagcctttttcgttctgtgtgaaactaaagaatttggctgtagcttctttgaagcaaaggctggaatgaattccattattaaaaaaaaaactgaagaattgattgtctctgtgttttacacttaataggaaaacaaagtaccgcagagtaacaattcagaagccgaggtgtttgcatgccctgtttgctatgagccattgataaggaaaggcccatcgggcataaacttgtacgtacaatttcatttctacattatgttttgcatgttttgttagattggcatttatgatatgttccttttatgcatgctccaggccatcaatttataggtctgggttcaaatgttcaaagtgcaacaagtcattcaccagcaaagatatcttcttggatctcactgtcacttctggaacaaaagaatatagtgaattgaagccagctagaactgagctgttcaggagcccactcgtctcatttctttatgaaagagggtggcgtcaaaatttcaatcgaagtggattccctggacttgacgaagaggttcatttctaggacattcccttcgttgtttgatatctcggcgttactaaataacaaagtctagccaacgtgacctgtggtgtaatatatttctgtttcaataagtaaagaagcaatgttaattcaccaagtgtttactatagaacataatcatttcttatgtatgtttttctgatctgttgttggtttcatcagtttcaaatggctcaagattatttccaatcagttgctggtggtgtacttcttgatgtaagctgtggcagtggcttgttcacaagaaaatttgcaaaatctggatcgtactcagctgtgattgctttggacttctccgagaatatgctttgccagtgttatgaatttattcagcaagatgatactcttgtaaacacgtgagctctcttcttcatgtctctgaatttcgttaatatcctttctgcttttcgtgtgagtacaaaaaattacagcatatgtcacacaaatgaaacaagacataaccttaaccacttctaacataaatatattatcaattaagcattttgcagagcatcactttgtctgtttgaagttactagtttatgtagtttaatttaatctatgcatcaattaccaggcaacacaaaaattacgtgattaacatccaaatgaactgcaattgacacagaattctattttctccatctggtgctttttaagacaaatactccaatctttatttagttcatgccaggtgcacaactaactgttttcctcttatgcttacacagaaatcttgctcttgtaagggcagatatttcgagactcccttttgcttcatcttcaattgatgccattcatgctggagctgctatccactgctggccctccccttcgaatgcggttagtatctgtccaatttgctctcatgattaaggtgactaatttggtctgtatagcagtattggagtctccagatttatgataatgaattgttctgtaaaactgtcatcactttaaactgctttcacctgaatctctgttcttctgctcctgtttaattatcaggtggctgaaataagtcgagtcctgaggcctggtggtgtctttgtagcaacaaccttcttatcttctcccaggaacaatcccttctctgttgaagcgttgcggccactgagacaggtaactttttctacttattttctgcttatctaaccctatgagcttatgcagtcatactcacattgctgctttatatactgcagattgttggaccagttaacaccagctacaattacttcaccgaaggagagctcgaagacttgtgcaaatcctgcggtcttgttaattacagcagcaaggtccagaggtcgttcatcatgttttctgggcagaagccgtagcctaaaattacatcaaaacctttgtagccaaagtatagctgtcaattctacaaaagtctttgtaaaatgccattcaccgatacctgcatagattagacccagcagaagtttttgcttggaattcctctccctgttatgaagatatagttgtcacatgtatactgtgcttcagtacagtgatgtaccacagccagggtgtatttcacacctggaagaaaaaaaaaacgttctagtactattttcccaacttgtatagggcctcttttggaatggaggattttttcaggaattgaactataattcctgtggaattcctataagattcctacgttcgaaagggccttaaatgatttatttaggcccataaactttcaatctagggtttataagtttgcaaaatttatattagtactacctccgtcccaaaataagtgcagacatgagtttccgcgcccaactttgatcgtctgtcttatttgaaatttttttataattaacaattttgttgttataagatgataaaatatgaatagtactttactcgtgacttatgtttttattttttttttcaaatttttttcaaataagacgaatggtcaaagttgggcgctgaaaattatggctacacttattttgggacagagggagtagttcactacaagtccaatctgccaaaaggttacatcaacatgttatgtgtgaatagcgaccagagttgagttgtgggactggggacaatcagaagacgggggcgtctaagtgtctactccctccgttcctacaatataaaggattttgagtttttgcttgtaacgtttgaccattcgtcttattctatttttttttcaaatataaaaaacgaaaagttgtgcttaaagtactgtggataataaagtaagtcacaaataaaataaataataatttcaaaattttttgaataaaacgagtggtcaaacgttacaagcaaaaaaaactttaaatcccttatattatgggacggagggagtaactattagccatgtttagatttggtgtttaactattagtcactcatatataaataacagctctcatgtgtctttgacataggggtccagtgacaagtgacagatagttaattgtcacaaagtggtaaatatttaaatctctcccagaaaagggctggagagaggtgatccgtccgcccatgggctgctataaaaagagtgacggcccatctagtgggaagattgggccctccaatctaacgtcggttcccaccgcgtaaacggcccagatctcacgccagcccggcccgcctgcgcccgcacc

SEQ ID NO: 47096 - DNA, 3542 bp, Oryza sativa
agaattttttgtttatttatatttgggagtaattgggtgcgctcagctccggtccagcgcccggcgaattccaccgttagcgtcgctagggtttcggtggcctgcgcgcccggcggtgggggggggggggtctggcggtctagggtttgcggccgcggcttgcgccgtcgcggcgcggaggcgtcctcgtcgttgttgttggtggggcggtggcggaagccatgggcgacggcgagcgccgcgaggacgagaacccgaccaccagtgccgcaggtaagctcgattccacggagcttgttgccttttggtttggtttctgtggtcccgcgacgcgagcttcgatccccgggtgggactgtctagggttgtgaattgctgcgacgaggaggcagggttttgatgcgattcggtccgcgcgcttgtgtacttttgtgttttttctgtggccaggcttacacattacgctgtaaattcggtgcctggtaatgaaggttggatttgatgagctgcagatttgctgtctggtgtcctatatatatatgattagatgatcatttttttttgaaagtttaggaggggtttggacaaaagctgtttctttcagcaagctccccgtgctgtcttatcaattgtcatgaactttctaagccctgaaggaataccagcatgctagtatcttttactatataaatagttatgtattctttccgttttgaattgtgactggatagccaaccaatctgggtaaaacgagatgcccaagatcatgcaactattgccacaactgattactatatatatatattcattttagagagcagaattccatgtccagttgtactccagtttcctcatctaaatatggaattcataatacatatagtaatgatgaattaaaaaagatcctttagctggataagggcatactttagccaagtgaattttcaatgcagcatgcatggtgctcattcctgtgtctactagggaagtgaagctgtagaatgaaacaacggactgtctaagattctcaattgccaaaagatcacatgaaccctctgagaatcgtttatggctgcaaagcaacattcttctgtttatacatgttgcattacaagagtttagcatcattctgcgagccttttttatcagtctttctaagttccgaatttgactttgttgatgagatgtcaattctttaaaatctgaattcataataacaccatctgtttttgtggacaataattttaggatgtgagttgcagtgtggggatggacaaaattgcttttaagttttaattgttttgtccttttcttctacaatctggattattgatttgccataataattgatgagtgttgattagacttgatcaattagtactgagttaattgatccaaccagttatgctgttgctatttttgttatcctttgcagatgacgatgatgatgaggattatgatgaacctggtggagggaatcacttcttgggcttcatgttcggcaatgttgatgattctggtgacttggatgctgactatctcgacgaggtagttgaacaatttttgaaatggtggaatatcctttttttgttacatgtttttttaataaaaaaatatcatgctgcctctagcagatatactgcagaatatgcatgttagttagcatttctgtgtggataccctgtgatttctcctagatgatatagtccagtaaagaacttgttaggtgggaggcaattttttatttgccactgaatgattcacacaattcctttacactgagatgtggacagagtgtgcaaattaaaggattgggtaaatttacagcagtgtaggaggaatatatgcaaaataaaaagtttgctcaatgtaatattgatgtactccctccgtcccaaattataaggcctatatttttttacacggtctacaatgacatactctgaccattaatttatttcatattatgttatcaaacaactataaaataagtatcacaataaagtattttaaaatacaaatataatgatataacatgcatcatacttagcatagatatagctagtgtaattattagtcaaaatttattgagtttgattttccttgatacaaggacgccctataatttgggacgtagggattattgttttggcagtatggatgtagtcctttcatctcaccactcaccatcataagttaatttcttggcactacagcagcatggacctacctctaatggcggtccattcactacattttatttaacatgagtcctttatttttttccctgaacatttaacttttatatatttttctaattagagttaccaatttcttgataggatccaacataagtactgagcatcttataccccacaaactaataatgtgtcagtattgattttgttaccacacgtccacaccattggatagagttagtattgtatacaatgaaataagttatagccgcatttctgttgtatcacttctattttccttgatttaccaggatgcaaaggagcacctttttgcactggcggacaagcttggcccatctttgaaagacattgatgtatgctatcttataatcattgttaagttaatttgacttatattttccttgtcaaacaagttaatactgtcgttttcttatatagctgatcaagccttctgcagcaccaactgatccttctgagcaaggtaaatcgcaagttcgtaactctataatgcatatttttattgtttcttcgcctaaccctgtttataacaattcattattttctgccctttctggcagctccagtttctgttctataccaaatcatataaaataattgatgcctgatccttttactgtcctgtagactatgatgcaaaagcagaagatgctgttgattatgaagatattgatgaagaatatgatggacctgaagttgaagcagctacagaggaggaccatttgctatccaaaaaagattacttctcttcaaatgcagtttatgcttcggtcaatagtaaagtttcagtgtttgatgaggagaactacgatgaggatgaagaaccaccaaatgataatgatttgcctagtgataatattgtgcaaaactgcacttcaggtaataatggagtgcatccctaactgtactttaccttcattgttctggtattagaacttgttccacttcttctctctcctttcactgacacttctctccctttatctatttaattgtagcttcagctgagcaactggatatggcaccgtcaaatgacaaccttgctgttgaaaagatgtctagttcgttatcagaaccagaagaaagttttgaaagtgaagcttttcaggtatttttgctgttttttctttttgtagaactgtttccatccctcttgaacaaaactggatagccgcatggcatgtatagttggaattattgtcaaaccagaatttagttcatggttaattgtttttgagtatctctcctgtcacataaaaaaatcagtttaggtttgggaaatgtttgatgagacaggagttttct

SEQ ID NO: 47097 - DNA, 1738 bp, Oryza sativa
gacagtgatgagtcaacttcagatgttgccttaagactgaaagactcgtgcctttccgaacaaccgatgaaagataaagatattcctactgctgtacaatctccagttttccctgatttttatccactcgagcatgaaaattgggaaaatgatattgtttggggcaattcaccaacaaccgcaattcagccttgcttaacaagctgtgcaatatccaaagaaagcttggatgaccacaatgaagaccaggccgagggttatgtctctgggtgttgggatgtacagaataaatttcatagttcttcagtaatggcagatccttttgggcatacagaaatacctgattcaactagttaccgttcccctgagaacagctattctccattaagaaaggagactgctcaggagaataacagcttagatgaaccaaataacataactcaaccggttaaaatcgacaccacacggcatttaaacaagctctctttactgaacaaggagttgttagaaggatcttggttggataacatagtttgggatcccagtgaggatgtaccaaagcccaagctaatctttgaccttaaagatgatcacatgctttttgaaatattagatgaaaagaatggggatcacctccgctctcatgctcgtgccatgattgttactcggccaatgaaaacttcagcagtggaaaatgttgaccataacaatcaagcaattgcattgagtgggagattcaacatttccaacgacaaattttattctaacaggaaaatgtcgcagcaagctagatctcatgctaaaaagcgtgctacaatgggcttaaagttggtacattctgttcctgctcagaagctccagaccatgaagccaaagttgagcatgtaagtttttcttcctctgcatgactctatgaatcttgcattcattttcagttattttattgaagtgataatattgtaaatctgagctttattcaggtgcctgcatagccaaaatatttttttcacgtattattcttcaataacagaactgggtaatctgtctttgattaaacatacttgcttgagagaacaactgccagtcctgttgtcttgaggaaatgttttcgtagacatggaactggcatctggctatgttcgtgaagataaccttttttgccttggattttcggttattgtaattggcgcagctgtacactgtcatgatcgatcatcagagagcataagatacattttcttgattatagttgaatatatgttccttttaggaccaattgttggatactattggggaaaaaagattgctttagaacttcaaagttcagccaggttatagttctgggaacatgcattttttaccaaagaaaatgcacaagttttccagtggaaagctttgtgttcaatattgattgactttgtctacatttactgcactgcagatttctatgctctggtagcatcagctattcaaagctttttggtcttaatcgtattcaactagttgtatttggggtttttagttgtcgtgtacttcaactactgaactttgttgttttctgttctttgttgactttaagtcgctaaattttgtcttttgatcaacttttgtgcagcaaagaaatcgcaaacttccatagaccaaaagctaagtggtatccacatgaaaataaacttactgctagatttcaaggagatgagtgcagtcatgggccaatgactgctattgtgatgacttt

SEQ ID NO: 47098 - DNA, 1106 bp, Oryza sativa
cagattatgttatattggtaggaacatgtgctgataaatattatctttagtttttgtatggatattcatcttattatttgaaatcttatctaaagttcagtctttatactgttgttttactcttcttttttttttaatagattgtttcagttcttggattagcatattttagctttagcttcactgtcatgtgttgcactttctgaaaatattgcaattcttgcagtgttggcattatcttcatttgtttctttaattcttctctttcttgctagtttgtacgatctattatttctatgtaacatgacttgaaaaatcacattttgtttttttgcagaatataatttgaaaataagctgttttctattgtatttactttctcaatgactggaatgtgaatcacaattttcattgcccctttatatctgtcatagctatagtattacactaaaaaaacatattcgcacgttttctcttgcatggcatcatttcagcatatctgtttgtagtgacttttaacttgtcatccataaaataacagattttattctcctggcaggaacctcatatggaagtattttcacctgggacaaaaaatatgcagaattatattctgaatcggattcttgtgtatgtatatcgtgagttccgtgctagggagaagcctggtattattcctcagattcgagctgatgaattacctattcagcctcctataacagaggctattgtgaggaaacggttaaagcattgcgcggatttaagggttaaaatctatcactcatgttattattactcttgtagctccttctgtttctctggtgctttgactttcgatgttgggtgtttggtttaaccaaaattaatgctgtccttcattgatttttacagaaaggaccaaagggacatttgttctatattcagagacctgattttcggattccatcggaggaagaactgagaagattattgacacctgaaaatgtgagtttcccaaaattacttccatcacttgtatcgataatgccttgtatgttacatttgtgacttttgatgcattaatcagtcatcacattgcattggccgtatgacagttgccagcatgt

SEQ ID NO: 47099 - DNA, 701 bp, Oryza sativa
tgtgtcactgccattttcattgccgtccatagctgaaagtgactgaatttgtctgtcccaaatttcctgacatttctctttagtttgctgctgaagctgcagaaaagacatcctttgtccccgtgcaaacttactaactggaatttcatccattgtaacacccgatgcagcttgttcacttgaaagcttcctcaccatcgcgatccgatgccaccttgttaacttgtcaatttgctcttctggaacgccaaatttgagtagcaactatttacaacaatatcagtgtcaaatctcagtgaataaagtgtaaaagaacataaaaacagcatggctgaaatgcaagcatggggtatattcttccatgccaacaaaaaaaaaatacaggtatctaaattatgaccgagtgtgtcaatggcatgtgcagactcgcagtaggtcccacttgtaattctcgcggcagttggtattttgacaaaatgtgtttgttttacatggtatgaaggcaattaatattttgttattacagggatccatgtgattcttcatcataccccagttaataaaataaacatctgagataattatatgttcacactaaagcatgttccatgatgatactaaggcatctcagtgccttgaaccccaggaaatgtatttttgtgcatcatactgctaagattgggagggctgatggtacctct

SEQ ID NO: 47100 - DNA, 5915 bp, Oryza sativa
ttgtcatctgttctggagatgaaatggataacttatgtcttaaaatgctgaacttttaatgcagaagattatgttgctatgtatatcttaagaaagttgctataacattatgaagagctctgtgctctacaatacaatctctcttttttggtagcttttcgtttgaatgtttttccctgccggataccttcttgtcctttggtctgatctatagtgcactgtaactgcagaagaacaaatgggaattcttcatgttcatcactctagaagtttttgcaatgatcattactggttctgctgccattataagtattgtctgctaagtcctttgtggttctgtccttaataatttggagtgaaaaaaaatttccataagcctcaatgctgtttttgtcacagggatggtaagagatccggcttctccagcatcctttattccttggctcagctattctgcttttaaccatactggggcactttcctttttcataatggacctcttccttttcttcggtgttgcagttctagcagtagtccaggcatctcaggtatgtaaaggttgaatttagcttgctacttgatctttttttttctcatgagaaaccaacctatttttgacctgataatgaaaaaaaccaggaagcatgtttattgtctttacaaccatcagtaaatgttctgtaatacaaagtttcatatagaaacttctctgctgattttatgagggtttgccccagaaatttatgaagccttgctggatttgtcaaatgaacatgtcataattatatagttcatgtgtgtatcccctataaagtttggatacagtagaagtaacattgaattttaggcaatgaaattgctgtgatacataattcagtagcaaaactgatattccaattacaagatagagttgaagtcagtagatgccaggtattatctggcttatttgatctattaattagttttctgtgatgtttctgtatacgacagatctttccatctggtagctataactttttcagaatggacacgaggacttgaggagcattttttctgttctgttttatgacgtgttcatgccttacttccatctcccatgcagatagcgaagaacattacaacaaacgagatggcaaattccatgagatacagttatctaagaggtccaggtggaagattcagaaacccatttgaccatggagcgcgcaagaactgctcagaattcttgttaaatggatacaatgaggacattgaacgtcttgatcatacgtcacacactgatgaggaaatgggaatgatacagatgacaaacgcagtctctcagaatggcgagggcccttcccaccatggtaacggcactggccattcttgtgctgaatcacatgctcactcaaaatctcacagtcaagtaagttcatctcagtgttgtgaccacagtaagaagaccgatagaacaccattgggcctagggctgggccttggacgaaacagtgcttcccggcagtatgtccggtctcttctcccattgtgatttgttatatgcagatcatgtgtgtgctctctgtagattgtatgtgttcatgctgaggctccattatttatttagctgcttgtgacataccacataggtttcgctagcttacgttaatattgttggggtgctagctgtgtgaaaattcagatctattagatccagtattttttgtggtgaatacataggagatgaaggtagcaaggtgctcatgaatatccgctgatccgcagttcagaaatgtcttgtcgctcctgaaaagagggcaacaattttgtgcagatgcagcagcatgaaacatcttcattgctgtgtcccttggtgtcaatataactccagcattttagcttctggatcttacatctgtgggaaaatgtagttgtaaactaagataattgtaaatttattagcaaattctgaatttagatactcttgttgtgatctatagctgtactgacagtccagaaagttgtaataacaaaacaaatatctgaactcttgacgtgttatgaactctcgtaggacctacgaatggatgatgcatccgttcgaaaatataggtacttgtgcatggtttttaaatgtatacggacgatatgcatatttttggaacagagagagtaatagttttttttttccagttattccccatttaacgtatctggcactggcagtacgacattgcttgcagcttgtatctgagtatctcgagttaatcactttttagcccatgaacattcagttcaggagtgaggagtatggtacctcatgatttttaagagaaggatggccttgtcggcttgtccccaccagtggatggctggctgtggccggagaggaccaaagaagtttgcaactcttccctgcttccatgttaccgacacttataaataaattcttaaatttaaaatacacaagaatttcaagttcatgcagaattttccctgtattgaaaactgaaatatctctgcctatctaatctaaaactgaaaaacaaataaaaagaaagaaactttagaactcgcaacttgggctcggtccagctccagcctccaggacccagatgccctcgtggtccagatcacccggcccggcccatcctacctcatcatcacgcaacgcaacaacactgacctacccagacagcgtccacccttccttctcccgccgccgctccaaaacccccacctctaaaaccctcgccggcggcgcacccccacccaagctgagcggccaaaccctcgacaagcatcgtcagcagcagcagccgccggagaagtaaccgccgccgccgcggtgggagagagagagagagggagatggggatcttcgagccgttccgcgccatcgggtacatcacggccggcggcgtgcccttctccgtgcagcgcctcggcaccgagaccttcgtcgccgtcagcgtcggcaaggccttccacgtctacaacgtgagctgctttctccccgctcgtctcccacccccacgccgccctaccaccgtccacccttggccttgtgtgctcgcgtctcaaatcggagtagcttacggggagcttggtggagcgagttgatctggtacaagttagaacgcgtgatttgagatgctttggagcggtgattgtgtatttaagtcatggttcgagctcaggggctagttactgattgtggtattagctcaatgcgatttgctcactactacctcgattcaatcgagctgcttcattgtacatatgagctttaacgctagctctctcaccttgcatagttttctgatgtagctaactcatttttagaaactaactggacttatttcttgttttgcagtgtgctaaactgaatttggtcctttcttggtaagtctgtttttttttttgggctatgtgaagattcttcatgtatagcttttttccttatggttttatgtgatcgaaggacctcaattgcccaagaagatccgtgctcttgcatcgtacaaggattatacatttgctgcgtatggaagtgatatcgctgttttcaaacgaactgatcaggtgagggcgttactgtgcttgcaatagcagatcttgcattatcgtgttagttactactagtactagttacttgtttaggcgattgaggcaaccattcatattattactggtaaaagcaggggcttggtgttcttatctaaatattattactggttcacttgaggttgctacattttggagatagtcagataatgtgctcctataatatttgaaactggaaatttgaatagtttctgaatgaaatggttctttcaaactcccaaaaaggatatccaaatgctacattttatgcccatcaactgctacaggattcctctcaatcagacaattcttttttatgttctaactggatctctttcaatcaggtggttacttggagcaaacatgaagaaaagatcaatatattatacccatttggagaatacattctaagtgcagatattaaggggaatgtatttatatggtccttcagaggatcagagccaaatagtgagcctgttgggaacatatcattgggagacaagtttacaccaacttgcattatgcatcctgatacttatctaaataaggcaagtggagtttcctttgctttggagatagtttagaggtcaaatttattgtgcattcaattccatttctggtaataaatctaatctggtcttacgttaggtcatcattggaagcgaagagggtcccttgcagctttggaatatcagcactaagaagaaactttatgagtttaagggttggaactcatcagtatgttgttgtgtttcttcacctgcccttgatgttgttgcagtcggatgttctgatggaacaattcatgttcataatatacgatatgatgaagagttgatgtctttcaatcatcaaattcgtggtgctgtgactgcattgtcatttcgaacaggtgttttgatcgacttgttgtaaattagaacctttattaacatttttcaccagattattacaagaatggaaatgtccaatcaaaatcctgatatattcatttttccttgcctgtcggtttagtcctgtaatctgttcttgactgtgaatactcaaatgacttgttagaaagcttgtcatattaagatgggactggcagttttggcaccacctaataattatatgttagattcagttcaggaaatgctgctgttgcattttttttctatgatacagatttcatacatgagctgaagtgtttcatatattcttttaccagatgggcaacctcttctggcctctggaggatcgtcaggtgttattagtatatggaatcttgagaaaaggcgccttcattctgttatccgggaggcccatgatgcttctatagtttcacttcattttttcgcgaatgagcctattttgatgagctcggcttctgataattcaataaaggtaagtgtcaagcttaaaagctgttgtacagaaacatgcaaaggtccaaagctgcatgcagctagtacttaaccagatgtggggcatcaactgtacacttagtagcggtgagaatgattcagcgcattaaaatcgtgcctttgtgctgcaccaaccagttgtactctcctgaatgtctatggtatttcagtgttagccttttattagtgaggtattccaggatcctcactagaaacaaactagccaggaaagatgaaatttatactggtctggaattggcattaccatgtcaaataaagttttatcagctgcaaaacgttatatcagtttatcttgatagtccagtaatctaatatgctgtttaccagatgtggatatttgatactaatgatggagatgctcgtttgttacgatttcgaagtggccatagtgctccaccacggtgcattaggtgacaagtgtttcaatcatgtcttgctttttttaaaaaaaatcagttggatattttattagtagtaaccatacttctgtcgatagattctacggcaatggaaaatgcatcttatctgctggtcaagatcgtgcctttcgccttttttcagttgtccaggtaactcactgtctttaacttttatatgaagcacatctcctactttcgaggaacttattaggaacatggcagtgatacatcatgattaacattctaggtgtacgtttttacatcaattaggatgctgagtctgttatttgtcatttcttcaatactctctggtctaataaaactgtataatggttctattctgatcaaccatgctaaggcatgtgaccttttataagtttattcatgttttaggcatactattgtttcagcggacttacacctttataactattattttattattaactggtctgctcccattttcttctaaaaaaattgaatt

SEQ ID NO: 47101 - DNA, 2040 bp, Oryza sativa
gtcatattatcatccaaaagaatattggtgggcttgatatcacaatggataattgtcccttgatggttgtggtgtaggtaagccaatgcatcagaaacattgaccacaatgcttaacctttgagctagtgaaatatagcacagatctgaagatgtttcgtcgtgtggagttgagtacaacaatttatgcaagtctcctcgtggcatgaattcatataccagtgctttgaagtcatttccacttgaatcaatgcttgagcacgccgtcaagacaggaaccagattgcgatgccgcacatttctcaaagcattacactctgcaatgaagctcttttgtgctccctttgtctctagactgaagactttgatagcaactacatttatgtcttgaaataactgtccttggtatacagaaccatatcttccttcgccaatcaaattggatgttgagaacccattagttgctctggcaagatctttataagaaactttgggaaattctctaccaaatgagggcaaagatatcgagtttgtcctttgttttcccttccaaatcaaatacaggaccaatatcactacggcaagtgtcaccatgctagctaatgggatcactactttcagtagtactggtagcttgcctttagttgtatttgaaggtgtgataggacattcaggtaagtgtaactccagtgcacctccacaaagagccaaatttccatcaatttgcatggaagttgaattcttgaagattcctttagttgggacctgacctgtaagatggttgaatgacaaatctatctgttcaaggagttgaaggtcaccaagtgacactggtattgatccacttaacttattgtgtgacaggttgagaaattttaggctaattaatttgccgaacgaggtgggaatacctccactaaaattattttggtcaagctcaacatgttgcaaattttcacagttactcaaagtattaggtatatctcctgacagattattggatgaaagctgcaaatatatgagctgcttggcattccctatttctgtaggaagttctccactgagattgtttaatgcaaacccaacttccgctattgttggaatcctgaagatctcctttggcacaccaccatgaagattgttatcagtaatggtgattgttgttaggaactgaaggtttccaaagcttaaggtatgtttccaatgaactgatttgtgtctagaagaatctctgtcaagtgtgacagattggaaagggaggagggaagataccctgtaaaactgttggtagacaagcttagtttctgcaatgtcttcagacctcctagccattgtggtacagaacctgaaaatcggttgtaatctagtccaagaattatcaggttgggaagatttgcaatgcctgaaggaaaactccctgacaattgattctgtcccaagaaaagatactgtagctgaactgaaaaattgcctaatgaacctggtacctctccttccatttgattcctcgctatagagattccttgtagctgagtacaattggctacgctatccatgaactcccagtcttgcttgctacgagcatggagctggttcatctcaagatttaaccttgtaagattggcaagcttgccaatggaggcaggtacaaccccagtaaagttattttcagatatatcaatcttgaccagattggaagcattcgccaacgaagaagggatgtctccatgaaagaagttgatgccaatggcaatctgcctaagattgggcagcaagctaccgatgcccgatggcagctcaccactgaagctgttcgtgctgaggctaagcgcaaccagcaccgacatgttcaggatcgcctctggaaacccacctaacagccggttgctgctggcgtagaggatctccaccccacttagcgtcgctagctcaccggggatgctgccggtgatgccattgaacgcgaagctgagcttcctcagcgccgtgatgttgctgagcgagggagggattgtcccgacaagtctgttcgacgagagct

SEQ ID NO: 47102 - DNA, 1294 bp, Oryza sativa
gacgtcgagttggagattaccggattagcttagcatcaaaatgaacctgctactactacggctaataaccttaatataaaacgacaaagtcacaaaaactaattacaagaacaagggctttggtgcgtccggcggcaactggcaatggtgttttcttctaccggttgtgtacgtagccgcttcatgtgaaaaactgtcgatggtggttgtttcatggtgttttctcctctttgacaggataatcccagctagggtatggagtttcattttttttaaaaaaatataatggaaagaatttcattaaataaaattacacccggcctctgcatcaaccaggatgtgcacacagcctaaccaggatgtgcacacagcctaaaaagaataaggaaaagactaaggcaaacatgaacatatcatgttgccttctagcaactcacccacacataaccaagacaaacgcatagagtattattcgcctactccctccgtctaaaaaaaaaagacaaatcttgggtttccgtgtctaacgtttgaccgtccgtcttatttggaaaaaatatgaaaaaaattaaaaagacaagtcacgcataaagtattaatcatgttttatcatctaacaacaatgaaaatactaattacaaaaaaatttcatataagacggacagtcaaacattagacacgaaaatctagtctttttttgggatggaggaacggaggaagtagtccacaacaatgcctttaaggacccaacccatatttgccattctcacccaaaaataggggtagattttcatctagaaccttgatatgacaccttcaataaggaggtgacacacagctcaatccaaatgtctagatcagagctttcaccctagagtcattgatgcttgtactttatgtctccgtgtggctaaagcgagcacataggagcaacaaatgcccccccatcttttaaatgacgggtgcccaccaaaaaagatacgctcacgagtagtcatagccgctgagtcgattttagttgtcacctactaatctttccaattaagacagcggtcacaaccagggttttcaatttgatttcggccattttggttcttccaaaatttccaaaatttcggtatttttggaaattttgaaccaaaattttctgaaattttgacataatttaactgaatttgactaaattttgatcaaattcgtaaaaaattgagaaaaaaactgaagattttggctgagataatcacttgttggggggtccaaaatttcaaaccaaaactgcaatcactggtcacta

SEQ ID NO: 47103 - DNA, 13036 bp, Oryza sativa
  unsure (1)..(13036): unsure at all n locations
ttgcccttggaaattgcattgccattatatcatctctggctactccagagcaatcagtggcaataatggatctgattgaggagcggtgggaagagctagttggtgagatgcctctgaagatatgttaccctgcaattgagaaccatgaatggagaataatcactggctgcgacccgaagaacacccggtggagttatcacaatggaggatcatggccaggttaaagttttccttttgcactgtgctaacttgagatgattctgttgctgatccttactatgcattactcttcataaaaattagtcatgtccaatattatggctgatagcttagatgtcaattcatcacacacaataataaataggtaaactaaagtttattctgaaatcgatcacataatactattcaacattcacctcttctgataatgactttgttctaataatttttattaatcaagtcttatactgtaagatccttaatgtcatacagaagctgtaaaaactaactttttgggggtagctaaggtgcttatggctatgaaattttgacttcttcatctgttttcatcaaattgaacagaaccgacagatccctttgagggttgagtgtggcacttttttttttcctaaagttgatccgatcttcgtgttccctagatagttggcgaaatgtgattctgatgttcacaaccaaagtcacctgaatcctcattccaagatcttaacgtttatgtgtgtgttctcccatctgcagttctcctgtggctgctgacagcagcctgcatcaagactgggcgtccgcagatggcgaagcgcgccattgagctcgccgagtccaggctactgaaggacggctggccagagtactacgatggcaagctgggacggttcatcggcaagcaggccaggaagttccagacatggtccatcgctggctacctcgtagcccgtatgatgctggaggacccgtcgacgctgatgatgatctccatggaggaagaccggccggtgaagccgaccatgcgacggtcagcatcatggaatgcctgaaatgttttgatagaatttttttttcccaaagagaggttcaatgtggaaacttataggagttttgtccaaacatgaaaatggggttcaaaatttactgtaactgtactgtcagttaggacagaagtgtatacgatagatccaagtcgtttcagagcaattttgtccaacttttcgtatctggcttcatcaatccaacagagaagaagtttttgttggtgaaacatttttgcaataattaaacagttttgtcttgacatatatactagcatatgtttctgtgatggataattctttgtaatactttgtaggactttctgttaatatactcctcacatattttcattgtggaaggaaacaccaaggacttttgtatgattgtggcgccattgacgtttacgatatcctgtgaacataagtctttcgtgcacacaccaattaacaaataccattgaaaattttagaaaaaaaaatctgtgcatttactttcaatattattacacttttagttgcagattgagaaatacaataagaaataagtggcattacggcattcagtaattcagtaaaaagaaaaaaaaacaacgacaagatcgtcggtttggaaatagggtaatatactggtggcaaacagtaaaaaaatccaaaatattttatagtctaaacaaacggaaggtttcaaaacttcttgaaatttaaaatcaaggatatatatcagatttctgataggacaggactagaggaacaggccggggagcagggttcgatatatcgcaccggcactttctatcggagggcaccgatacgacggaaaaattcggtccgaaataatttgaaatttaaataaaatatggttcaatttgaataattttgctaaattcaaaaaaagaaaaaaatccaaaatttttagccgaactaatttagttccaaataatccgcggggagggggggggggtggcttgccggtgaggcggtaagtattccaaataaactcatctagtttttgtacccatacgtaaataaacacgtgatctccaaaactccgatcgatcggctcgcggcgccgctcatggaaaccctacggccggttgcgacggcgacggcgacgctgccttccggcgttccgccgccggcggcggcggcggcggccagaggctacccagggtgggtgatgctcatgccctacgccacggccgaacgcgaggtcgacgactcggagtactccacctccaactccggtggagccaagatcaccggggcggcctcccgctcctcgtccggccatctcgtccgcgtctccctccgcctcgagtcgccaccggcggcgtcggggctaagcttccactgctcaccgtgcggcggctccggatacggagctcatcattaccggccctcgatgtacgtcgtcgctgcccacggcgactccgtgctcctcgagatgcattaccagaaggaagggtaccaacaatacgggatcgattacttcttctacaatgccggcgacggcgacgaggacccaccacggcggccgccgtcgttgtcgctctcccgacttatcagggtaccaataccaagccgccccggctgcgtggaggtagcaccggcctcctcgtgcgccgctgcggcgacgacgacgacgacgagctcgtggtggcggcgctcctcaccgaggagtaccgcaggcgcgacacgctggagggcgccgagctcgtcgtgctccgctccggcgagtggagcgccacgccgatcgcgccgatcgtccacgacgacggcaagggcgaggagctctcctactgggagaccgacatggccgtccccgtcggcgaccggctgctgtgctacgtcgacctgtaccgcggcgtcatcctctgcggcgacgacctgttcgacgaaattcccccgcggctgcagtacgtgtcgctccccgtggaggcccccgccggcgcgttcgacgaggagcacttcgaccgccagggcgacaactatcggcgttgtctgctcaacactcgaaccgtcgtctgcgccatcgacggcggcggcgccgcgctcaaattcgtcgacatctcctcccgctgctgctgcggcagcctgggcaagcacaccacctgcgaccgttcgagccgcgccttcgtcatcagaacctggacactgaggatcgacggcgacggcgacgacgacatggcgtggaccatggacgccatgatcgacgccgccgagcttggtccctcgacgcctactccgccctcccacggagctttccactacaccccatagtgagcatggatgatccaaatctcgtctgcctcattgtggacgaagaacgcaaacggggtgcacattacgtcgccgaagaggtggtatggaagatcatgatggatacaaggagcaaggcactagtgtcggtttggcgcggcgacggtcggtgccattggcgacagccacatggatacacttgtattcctgtcaaaatccctgactgctttgctacctatgtgagttatagcaaagccacgacaatgttgccagcgatggtcgacaagataccaattgcaacaccaactgcaaccggaactggcactaatttgtcgcaatctttgccatccgagtcatctccccaaagtctgtatgtgttaatggcttctcctggggagatcttggtagcacttgaagagatacctgggttggattgtgatgatttgctaacagcttatagcattctttgtcgtgacaatggccgtctattcaaagcccttatggggctcccaatgagtatgaggaagaaattgttgctgatagaaattaaggcttatctaaactgtcatgtctgctctacatgtacaacatgatcatgatatattggaatgtcttttgtaaattacttttgttggtactaagtatacattgtgtgattaactattggattgtgttgattctggtggattgtttttcttatttttaattcttttacacttggaagaatggtgccaatattatggttcatagcttagatgtccaatattatggttgatagcttgttgacgatccttaaatgttaagtgtgccatccattcctgcagaaaaaaaactaaaatgaaacactgggcatagtggtagagtttattactaactatttccacaggtgttagtgaaatatttgtatgcaggtaattctgtatgaaaactcacctgccatgtgaagaaacattgtatcacaatcacccgctatgcgaagaaacacatatctggccaatcagacgtgaccacacggatttaagggctcataaatcagagtaaaactgatataattaggcttatccaccatgcattgtcataagaacccacatgtcagcctcacagaaaaggtcggtgtcttgaggcggtggaagtggttgggccgaacaaccaacacggccccccgcccccaccttccacatggagagttctcattggctcccaatgatggttatgggtggtaaccgccattcacaaccgtcattaaatgctataaaaggaggagagacactctcactttacatcacacaactcaggcaatgatctttttattttcattcatactagagtcgagctcaccgagtcttgcctactgaaagacggctagctggagtactacgacggcaagctcggacggtcaagtaggctagaaagtttcggacattgtccatcatcggctaccttgtggcatgtatgatgttggaagacccgtcgacgctgataatgacctccatggaggaagactggccagtgaagccgaccatgcgatggtcggcatcatggaatgcctgaatgtttcgatagatttcattttccaaagaaaagtttgatgtggaagcttataggagttgtgtctaccaaacatgaaaaagggttcgaaatttagtgtaattgtactgccagttaggacagaagaagtgtatacgatagatcgatccaagtcgtttcagaccaattttgcccaaccttttggtatatgtggtttcatcgatccaacagagagaaagtttttgttggtgaaacattttgcaataattaaacagttttgtcttgacatacatactatattatatatgttcatgtgatggatatttttttggaataactattttcattttggaatagctaagaattttcatatgattgtttgtggcgctgttaatgtttacggtacttgacatcataggaatctatcgtgtgcacacaccgtatatatatctgccaataaataaacaaatgtcagaaaaaaagtactgctttcaatattattttatttttgagagcggattgagaaatacgacaaagtggcattatgacattcggtcaaaagaaaaaaaaagatgacagatgatcagttgggaaatactagtgaaaacaatcctaaatattttgaagtctttttttgaacggataaatattttgaagtctaaacaaacggaaagttataaatcttcttgaaattaaaatcatctgtatcagatttcgagaaacgtccgggggtcagatttcgagaaacgtccagtgatctttcggctagctccacaagatacatcctgagtttaaagtcccatcttttttatttatttatttaatattagatcctttcttgatattcgtgtttttttatactgtttcagatttcccatagaactagagggcctagaggcacaccggccggggaatattttgcaaataaactcatctgggttttctttgtgtaattaattccataactccgtcgaccactcgagccccattagatcggctcgccgatgctcatggaaaccctaccgccgccggcggcggcggcggccggaggctgcccagggtgggcgatgctcaaccactacgccgaactcgaggtcgagggcgatggcgaggactccacctccaactccggtggagccaagatcaccgaggcggcctcccgctcctcctacggccatctcgtccgcgtctccctccgcctcgaggcgccaccggcggcgtcgcagctaagcttccactgctcgccgtgcagcaagcacagagttcacggaccctcgatcaacgtcgtcgccgcccacggcgactccgtgctcgtcgagatgcattacgagaagggagagaacgacgagcacttcgattacttcgtctacaatgccggcgccgccgccgtcgccgacgaagacggcctaccacgtccgccgccgtccttgtcgctgttcccgacttactgggtcccattgtcagaggttgagaaaacggcgtatcgtccgcatcagagcgccaaggcgcaccagctgcgtgaagggagcaccggcctcctcgtgcgccgcggcggcggcggcgacggcgagctcgtggtggcggagctcctcaccaagaggcgccgcaggcgcgacacgttggagggcgccgagctcgtcgtgctccgctccggcgagtggagcgccacgccgatctcgccgatcgtccacgacgacggcaagggcgaggagctctcctactgggaggccgacatggccgtccccgtcggcgaccggcggctgtgctacgtcgacctgtaccgcggcgtcatcctctgcgacgacgtgttcgacgagcaggcccccctccgccgccggccgcgctacgtgccgctccccgtggaggcccccgccggcgcgttcgacgaggagcacgaccgccgcggcggcaaccggcggcattgcctgctcgacacccgaaccgtctgcgccatcgacggcggagccacgctcaagttcgtcgacatcttcccgcgatgctgctgcggccgccgcggcgcgacgcagtgcgaccattccggcggcgccttcgtcatccacacctggacaatgaggatggacaacgacggcgacatgtcatcatggaccatggacgccatgatcgacgccaccgagctctggtccctcgacgcctaagcggcctcccacacacgaatccacagttacccatcgtgagcatacatgacccaaacctcatctacctcagtgtgcgcggagaacgcaaacggcgtaaacaccgcgtcgacgacgacgacgacgacgacgagacgatgtggaaggtcatgatggacacgaagagcaaggcactagtgtcggttttgcgcgacgatgatattttctcatggctacttccatatggatgcacttatattcctatcaaaatccccgaccacgtagtaagctgtggcgatgtcacaacaatgccgccggcgaacatcgacaagctgccaattacaaccgaaatcagcagtaatttgtcacaatttttagcattggagtcatctcccaaaaatctgcaggtgtcaaggatggcttctcctgaggagatcttggtggcactcgaagagatacctgggttggattgtgatgatttgctgaaagcgtatggcattatttgtcgtgacaatggctgcctgcttagatctcttttggggctcccaatgagtatgaggaagaaatggttgttgatagaaattaaggcttatcaggactgtcctgtctgctatgcatgtacaacagatcacctacaacatgattgattgaaatatctgttgcaaattaattttggtggcactaagcatgcattgttgattctatcaaactgtgatatttatttttagattttctttacatttgtaaaagttgagccaatattatggctaatagcttagatgtcaattcagcacctacactagtaaaaaaaaaaaaggtaaactcaagtttattcttgaattgatctcataatgctattgaacattcacaagagaagaactttctgttggtgaaacattctgcaataatgaaacaatatgtcttaacattaatgcatatgcacatttctctgatggatatttcttaagtaggatttttcattgatttgtggaagcacccaagcctttaagatgaacacaatgaagattgcttgtgttgccacaagcaaggttcacaatttccgaaatttcagttcttttagaggggtccgatggaaatggctaccggtcaaatattttgatcaaaagggtcaaaatcagtcaaaattcttaattcctccctttctcttccctatttgtatcacttgattcacttccctggtcccttgctattgtttcctcacgaggcgacatcttccttgcagctaggcggcgcgccgcagctattcctcggcggcggttggaacggcggaggagcagcctctccggcgaagtcgacgacaggcgccgaggtggggcgggcgctccccacaccgatgcggcgcgcagcggtggagcggacactttggaagacattgatagccacaatctccggcgacatcgacggcaactgctcttcatccgtgtcatgggcgacggcagcccaagctgcaggtgtgttgttcctatggtgtccttttcattgtgaatcatgaatgccctcgtttgttttgttgcagaagttgctagaaatgacggatctcttgtcaaatttcctcattttttctgttcgagagtttaaagtttgtttgaatatttcgttcgaaatatctgaaaaatatccacaatttcatatttttctaaccaccaaaattcccccctttctgatacattgaaccctggcaacaagcttataatattgttcaataaacaatcaatgttagacttttaataacggattgacacataagaataatttcgcaccgtcggccgcccctttcctcctcgtcggggtgctgccgccgccccgctcctcgctacatccagcgggtcgatggctctcggcggcgcggcagggtgatggctccctggtggcatggcgggtcagttgctccttgacgcagcggcttcccggtggcgtggtggttcaggatctagcccctgagctcgggacctccacgggagcgaggcggcgaggtagaggtccagcgaggagcagcggcggcctcccgctcgctccttcctctcctctcatcatctcttgtgttgatattttgtctcttgagttgatattttgtgatgatttcgattttgatttggattttgtttttgggttggattggattgtgtgataatttggggtttgcagaggaggtgcgcgctgggcgacggacgaaaatcctctatggaagccttatgattttttttatgaggtatagatttgcacttcagcattaggttaaaaaaaaacaatgacatatcgtcaggttgaaaatatactgttgacaaacagataataatccaaaatatctaagtctaaacatacatgccaacagaaatatccaaaatatctaaagtctaaacataataatcaacaaaccatcaaaagtgcattcgaggcattaggagctaaagacaaggaaacctcacgaattaatacatatagcagcaaacacattnttgtcacagattagtacaaacatcttgagtcaatgcttttcccccttttcggtggactgaccaaaacatgtagcttttgctatttctcagaccaaattatggctatagccgctagaatcctagttgttcttcaagatcataatgagtcataattgagttgttagatctaaacgtacatcaaaattatttcatggtggtgtcacgaggtacacaaaaggtttaattcaagcggtgaaggatgaacttaacaggaagaccaaaaggattataacacaagttgacacagcattaggtgaggatgtcaactaccgtagaaatttatcacatttatttttctctccaccaaacacgtacggagagtcacatcgcattatcttaagaatcaattctcataatatgtcagaaaaaaagaggataccaataaattactcaatataagcaggcacataataaatgttgatatagctaaaagtagagatacaatctgattcttctctgctgaattaaggctgagtttgttcactggctttcccaactcatcttcatcgtttttcgcgcgtacattttccgaacggttacatggtgattttttctaaaaatattttgatacaaaagttgctttagaaaatcatattattctactttttattttaaaaagctaatacctaattaataatgcggtcgttccgttttatgtatcggagggattagttccaaaaggtagggaacaaacgcagccgtactgcagccgtactgatcgagcgggggtcgttggttcgttgagatttttttttggaataagtccactttgactttcttaactagtgcccgaatctgattcgtatccctacactataataccggatatcttgaccccctaactattaaaatcggtgcaatttgactcctccgacggttttggagaacggtttcgctgacgtggcgtccacgtggcatctcagtcatcaaataaatttaaaaataaagtgaagggcccaccctaaattaaaaaataaagcggcccgcggcgtcggtggcgattacgcgagtggtggccgccagagctgggcggtggcggtgatgctcgtgctgtcatgcgctgagaagaagaaagaaggagagagagaggggaggggggaggatgggagagaggtagaggaagaagatgacaggtggggcccactctatttttaatttatttgatgactgggatgccacatggacgtcatgtggacccccgattttggaaatcggaaatcatctgtgtttatccgtaccaatccctggatcagtagttggtacacacatagttgaatcacaacatatcacgaatgaattcaggctaaaagatttaaatacttacattagggccaggtaggccaacaactatcagagaacaacagcggaagaccaaataatataagggcccggttaacatgccacaggcagtcgactggggaatgagacctagaacaagaccgcactccgatcatcttgttggatacgcaagcgtaccgacaagggcttctcttcaacactctcctaaaagatatataattagcaagggtgagtaccaaccgtactcagcaagccaccacagcaacgatgcatatgatagagggtatttcaaggaatggcttcaggttcttttgcataaagctagttttgcagttcttttcacaagcctaagacctagcatagactgatcaaattttagtaccagtattcacattaaacaacgacggttctgtccactatccattatgatcccaaggatagcttcccgccattgagtcgttatggttttctgaggacgtccacattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatctggtttactcacactgcagtggatgtacactttacccgcactccgcgactgcccaacacatgagcctcgtcccaacacatgagacgcgtcacggcaaagcttttcgataaccttgcattggcagtacccgctccatgaacttaaatcctcatgcactctaggcatccatgtttctagcagtgagaggagttctggcgctcccggggaaagagaagtctcacacgcatattaaattatggttcaagttaagttctctctctcacacactcatggcagtcctaccaatggcaacaccgatgtagggcacgcctctcggccctacctcaacggctgtcccatcgtagcgcacctgcctcactcaggggtgaaccatctatgcagggatactgcctccgctcggctatctaatctgctaggtctatacccattcgagaagtacggttgtacgggagtcgtttcatgcttaacttcatggctcggtccttaattgactggggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaatttttacttgtaaacaaaacaatttcgcaattaggatcaacatgttcgaggaatagtgatgacttgccttgctcaggatagtccttattcttgatataattcttgatcaaccttcacctcctggaagttgctgacattgcctcacgactaaccgatacacaaagtctataatacgcgagaaaaaccaatattcaagcaacaatcaaatatgcacaaacaaaatatatttgttgaggttgaacctaaggttgctcatattattcgcgcttgctaatggtttccaacatgctaagggctaaagtttcttaatctttctgttatcatggtggtctatttaggagctagccaatgtagtatgaatgagatacgtatctggctactatgtggtttagtctagcaaatggctattcatgcatctatctagatagaacggttatacactagaggttttgttgccggatggatttggatcggtcaaataattactgtgaatcatttgtattattattttattgatggaggctttattttaattatgtacatattttacttgtcaaaataaattataaaggttaacaattacccttgctttgtatgttagaattgtttaggttaatcatagtatggttacagattatcccatcacataattttacaatgaataatcctaatttacagttgaactataattataattatatgaggtcaagatttataactagtatttatctaatatacatgtttgtcatacactccctcttaatttcatatatgcaatacgcaaattaatac

SEQ ID NO: 47104 - DNA, 3186 bp, Oryza sativa
ccctgtcttggctccctctctacccggcggcacgacgacaaataggggggcagcggctcaccgacggcggcgacgacggcgcacggcgcggcacactgaggcggcagcgcggcggtcacgaatgcggcggcacgacagcacgagggcggtggcgcggcggcgcgtggagagggggaagagggagaggagggggaagatggagtgaggagaggggagaacggtggctcttataggggagagagggaataaggggaagagggaagagaagggagggggtgacgcgacggcggcgcggcggcgcggggctcgggacggcgcggggctcggcgcgcggtgagggcgacgggcgacacgacgacgacggcggagcgtcgacgggacggcgacacggcgacgggacggcgacgcggcgacgggacggcgcggcacggcacggggctcggcgcgcggcgatggcgacagggcggcgcggggctcgagatgacggcgacacgacggacgcgacgcgcgggcgcaggacggcgtgacagcggcggcgcgcggcgcgaggcagtgacggcgacggcagcgcggggcagggacggcgatggcgacgtcggcgcggtggcaggcgacagagagagggggaaagaggaggggctgggttaggggaccacgtcgaacacctggcggccgatgaatagtgtcttttcctatttaatccccattttagcctattttttgtgtaaatttgattttataaatcctagattttgtataaagaagtttacccaatatttgtgtcattccaaccaatggatttattctagattaatattactcatattttatttatataatttatttgaatttttaattagggttaattcttattattattatatatttttcaaagttttcctatttttcttcttttagggttttggttgatttataaattgagaaaagttgcaaattaaatttgtatttactcccaagcatttaggtgaccgtattaagtgttcaaatgtgaatttttcccaaaatttaatattgtccaatatttaaggtttattaaagattctataattttctaatgagaccgttattaacacaatagcacattagctcaatttatctatatgttagtttattttatatggaggggtttaatatatcaaatttcaatccctaaatgcaattaggaacttggtgcaaaatcgatctacatatcgaattaaatactcccgtaattctattatatatacagagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaatcatatctattgcttaaatgtagttcttttctttactttcttggtgatcatttacggtttggcaagtaatagcaatcataacaaccagcatgatgcaaaagttttaaaaagttcgaaattttcgtgattttcattgtcttgaattttcaggatgttacacgtcacgtcagcgaaaccgctctctaaaactgttgatggagtcaaattgcaactgttttaatagttgggagtcgagatatccggtattatgattcaaggatgcgaatcagatttggcaattagttagagtcaaagtggacttatttctttttttttttgcccccgggccggggttcagagtggattgggccgaaacccctgtcaaacccggcctaactaaaatcaggcagaattccgtggagccccgaacacagccgggtgcgggtgcagagcctctcgccgccgccatcgccgctcatcgaaaccctagagcccttggcgatgccggcggccagagattcaggcctcaggctaccacccacccagggtgggtgatgctcgaggtcgtcgacggcgatggcgccaatcaccgaggcgacctcccgctcctcctccggccatctcgtccgcgtctccttccgccccgagctgacactactacagatccgggcttcagtgacgggtcatctgtgacgggccaacgtaactcgtcaaagatgagtcatctctgacgggccgaaaaaatatcctcttcaatatatggctaccagggaggacccgtcacagatgtaaagtcatctgtgacggcttgcacttgtaacccgtcacagatcgtctgtgacgggtcacaaccatggctcgtcacaaatgacatgtcatttgtgacgggtgtagtattatgaaccatcacaaaagagaccactcatctctgacgggtctttaactaacacacgtcacagataacgttatctctgacgggtggtggttatgacccgtcagtgatgagtgaaaattcaaatttgtaaattttgcaaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatatttttaaaaatgaaattttgaattcttcaaacaacatcggatgaagatattttctatgtaaaagttataaaacacgatgagataactatttagttgataatattttcatttgaagtcatttagggtgttaaatatatgttaaatgattcagacaagcatagacaaaataataacattgggttagtagtcaatatgtgttgagtaggtgagttggtaagagagctctatatggaggttgaggtctgagttcgaatctcacttgtagcatacaagttatattgcgtgaaaaattgtgaatttgtaggtagtgatgtgtaaccatgtataggattgctagtaaaattcaaaatatttttttgaggttttttgttgcgtttaaaattcaaaaattatatttcttactttgtcatcagtgacgggtcgtaagttacaacccgtcagagatgagtcatcagtgacggtcaggtagt

SEQ ID NO: 47105 - DNA, 2050 bp, Oryza sativa
agctcatcaccaccagggagagcgagagcagcaagctggaggaggtcaagctcctcgtgctccgctccggcgagtggagcgtcacgcgggcggagatcatccacgacggcagcaagggcgaggagctctcctactgggagaccgacatggccgtccccgtcggcgaccggcggctctgctgggtcgacctgtaccgcggcgtcatcctctgcggcgacgacctgttcgacgaaattcccccgcggctgcagtacgtgccgctccccgtggaggcccccgccggcgaattcgaggaggacagcgacgacgagagcacgcggagatgcctgatggcgagctcaagttcatcgacgtcttcccccgctgctgctgcggcgaccccggcgccaccctctgcgaccattctcgccacgccttcgtcatcaacatctggacactcaggatcgacggcgacggcgaccacaccatgttgtcatggaccatggacgccatgatcgacgccaccgagctctggtccctcgacgcctacgccggcatcccacgtgtcatcccggagtaccctgtcatcagcacagacgacgctgacgtcatctgcttcctcgtgaccgagccatacaatcacaaacaggggaaaccctatttcgaaagaacgacatgggagatgacgatggacaccaagaacaagacactgctatcagtatgcacatacgatgatgatatttcccaacgagagccatcttatggacacacttacattccaaacaattttgctacaaagccaccaccggccatcatctgcgaggcaacgacgacgatcacaaccgaaatcaacggtaataatctgtcgcaatctttgccatctgccaaacatctgcaggtgtcaaggatggctcctgaggagatattggtagcacttgaagagattcctgagctttctcgcgatgatttgctgaaagcgtatagtattctttgccgtgacaatggccgcctatttaggtctcttcttgggctcccaatgagtctgaggaagaagtggctgttgatagaaattaaggcttgtcgagattgtcccgtctgcagtgcatgtacaactgatggcctataacatgattgattaaaatatttgttatagtggtacttgtatacacttgtgggattaactgtgctaattctgctgaattaagttccttatttgttgtttttattacactttgaaaagaccgatgccaatatttattacgaacttggggttgtcaaggtagaaaaaaactgactgtttattttttttactaactgcttagatataaagtgacctaatattaaggtagaaaaaacatagtgcccgaaaattccattcaaataactattaatcaaagttcagactaaaaaaaaatagtgcagtgacaacatataaatatataattgtcccatgtcccatataggtcatttcaagaaacaaaaatccaatttatcaagatttgcatgatgatacaccgtaatttgcagtcttacatgcatgtatataactagcaaacatacgcccgtgcgttgtaacgggatatctaaattatatataagtattatccaagcgatcagctgaggtaaagcatcaattattgcaggccgtagatacatgttttttttaaaaaaaagaataactctttttttaacagtccatgcatacatttttgtttgccaaatatattaattttctgtaacagtacattaacaatatgaggcaaaacaatcatcagtctaattgtgtaacttaattactggacgaactgatacttcgagatcgtataccggacatatatatgaatctgctccattagaattcagaagagaatctgctggtgacaaacagccctccgaagtccgaacaagggatgcacatcaaacgacaaacgaatccaaagctgccagcacgtcgtaggaaacacttaattagctcgtaatagaaggttgttcaataacagccaataaaattctgaaacgcaacaagtagcatatagaggactctgaccaaaagcaacacaattacttgttt

SEQ ID NO: 47106 - DNA, 5897 bp, Oryza sativa
ccaccctgtgcaaccattctagcaacgccttcgtcatcaacacatggacgctaaggatgaacgacgacgacgacggcatggagtggaccatggacgccattgtcgacgccaccaagctctggtccctcgacgcctacgccagcatcccacgtatcaccccagagcacctatcgtcggcatagacgactctgacgtcatctgcttttctacgtcaacgtgacgatatggaagatcatgatgaacacgaaggacaagacattgctgtcagtatgccgatatgataatgatgtttaccaacaaaagccatcttatggacacacttacattccttgcaagatctccactttatacacaaaccatagtagcaacaatggtgttacaaagccaccagtaggtcgtcagcaagccatcaacaattacaactgaaatcaacggtaatcagtcgcaatttttgtcaccggagtcatctgccaaacatctgcaggtgtcaaggatagcttctcccgaggagatcttggtggcgctcgaagcgattcccgatcatgcttgtgatgatttgctgaaagcgtatatcattctttgccgtgacaatggccgcctatttaggtctcttctcgggctcccaatgggtctaaggaagaaatggttgatgatagaaatcaaggcttatcaaaacatttactctacatgtacaagtacaacaaatgacttacatcatgattgattgaaatatttgatttaaattaactgttggatgcgttggttctgctgaactgtgttccttcactactacaatatcgatttttcattacgtcaacattttttttggcggccacacacgatcaccgccagcgaaaatactccaacggtataggtgggaaaccgtccgctagtctccccgtattgctttacaatctccacacaacgcctatcacctaatagttcttttagcattacactagctcattcatgagcaaggttttaaatctccaactatacctgctatctccccactatctccaggtacaaattgttcaagcaagaactagctatttgttgtcatatgcaatgtaattgctgttaatcaatacagcccactattaattgtatgagagactgatagctaaatgtcgtatcaatcgatttaaaatgctgctcgtgggctaccatattacagtactccttccgtcccaaaataaaccaacttttagtgtttgaaatttgtcctaaaataaaccagcttctaccttcctacctaccatcaatctgtaaatcgagaagctttatctcttcaatacccctcatatacccgctcatcaatataactttgctattaattagggccattttggtcctttgtctctcctcttatatccaccttgggaagctagggttggaatttttgtgggacaaagggagtacgtctcaaggcaacattttgtagtcattatcttggactatatacaaaaataatgtggaaaagttaaacgtgatggagccgcattatttctaggacgtgtctacaacgaggccgtgcgctggattgtcataaccagctatcccaatctcatacctagttgctactagtacacctaaaattgcatgcatttttttcttcttatagaattttctcttgaattacaccattacgttcgttgcaattaaatctttagaacaagatcttatgtgactatatttttataaaagaaatatctatgttgtaaattacttttattatatatgtataagttactttttgattttactaaattacttctcatacattcataatgttgtgagttgtttattttataatcatttttagttaataacataatttgtgctaattaaatttaatttctatatagactcatgtttttaccttcataatagatttacttttaatgtcgtgacaaagttactttctttttgttttaagttacttccataatatatgtaaattacttttaggctttattaaatttatttttatattcaaacatattattaatttaaaaataattcatttaaattgtaaaagtaagttagttatgcaatagaactctctataacattagaagtaagtatattatgactaagttgtagtgagagactgtggagtaaattcataagcagtgtagagaatattttcaagtaaatacatttgtgaaagtaagttcaataaaatctgaaagtaatttacataaatcataaaagtaacttagcataaaatagaagtaagttgttagtacaacattataagtaaatctgttgtagggataaaaatgtgagtctatctaaaaatttaatttaatcaggataaattatggaattgactaaaaacaataataaaggtaatcaactcggagcattacgaatatataagaagtaatttaatcaaatttgaatgtaatttatatatatgataaaagtaacttacatatataataaaaataatttacaaacataaatattttttcatcataatataatcatgtaagatcttgttacgaagatgcaatgagcacaaagatataatcggatcgtagatcaaataagtaatttaagacaatattttataagaagaaaaaaaacatgtatcacttaataacaaaaaaggaagatgtgtagtataacatctctcttttctctctctcctgctcctgctatgtgcatgtgggcctccctgtgataaaaagtagagaaagctacagactagtgaagaagatcgaatggttgtgagtcgtgtcgcgtgataggactaaaacgagagacttctcgatttaaatttcacgttattcctaatcaaactcatttcaggttttttttgttgagtccaaaacgaaacatgtctaggttttataactccgtggatctaccgtgttaattaaggacgaactgcacgcgatctgcgtgactaaccgatcgatcaatctgctcgccgcccatggaaacccaatcgacggcgacaccgtctcctggtgcttcgtcggcgaccggaggcggaggcggcggtgcctacccacggtgggtgatcctcgagcagcgagccgttcacgacgacaaagaggacgacgacggcgaggacgactcccgctgctccgccgccgacgtcaagatcaacaccgaggcagcctgccgctcctccgacggccatctcgtccgcgtctacttccgccgcctcgtggctccgccggcggcgtcgcgcgtatgcttccgctgctccccgccgtgcggcaccggcaccgggagagagagagagccagatgcgacaagccattcttgtgcgtcgtcgccgccgccggcgactccctcctcctccagatgacatacaatggtcagctcgatcgcttcgtctacagcgccgccgactcgccgacgttgacgctgctcccgacccacgcgcggcggcagcactggctggacgtgaaaaccaccggcctcctgcgtcgccgccgccgcgacggcgaactcgtggtggcggagctcaccgtgaagaagggcgacaccgacgacacaccggaggatgccgagctcgtcgtgctccgctctggcgagtggaccgtcacgcgggcgccgatcatccacgacgacggtaaggccgaggaggtgtcccgctggcgaaccgacatggtcgtccccgtgggcgacacgctcctctgctgggtcgacttatgccgtggcgtcatcctcctctccgcctccgacctgttcgacgaaagtcgtccccgccggctaaagtacacgtcactccccgtcgaggctcccgccaagaaattcgacgacgacgacggcggagagtacgcgatcaacccacgaggatacccggagagaaaccggagcgtctgcgtcaccggcggcggcgccgcgctgaagttcatcgacgtctcgccgcgctgctgctgcggcagcccaggcgccaccaccctctgccacaactctagcggcgcgttcgtcatcaagacatggacactcatgatgaacgacgacgacgacacgacgtcgacgacatgggcgatggacgccatggtcaacgccgccgagctctggtccctcgacgcctacgccggcccaccacgcctgagaccagtataccccattgttagcatggacaacccacacatcatttgcttcatggtttgcaaggaacactgggagtcatgcttccactgcgaaaggacaatatggaagatcatcttcgacatgaagagcaagaaactactctcaattcgctactacgatgagtcccagtgtcaaacttggggggtacattatggagatgattaccttcctagcatgatctctgattacttcaattctaatggcaaatatacaagtcataatgcgacaacaagcattaacgatctcatcgtcactaattatttaccgcagtcatctcacaaaggtttgaaggtggtgtcatcagaggtacaagtttctgatgaggagatctttgcggcgcttgaagagatacctgacttgggttgtgatgatttgctgaaggcatatagcattcttagtcatgacattggtcaacaccggtttagatctcttttgggcctcccaatgagtttgaggaagaaatggctattgatagaaatcaagagtagagaagctagttccatctgctctgcatgtgcagcaaacatgcaacatttacatgcttgaaactcttggtgtacaattggagtacttttgctggtggtagtagattaattgtgtgctgaacgtacggttgtattgtgtggaattgtaaattggagtactactacttttgacacttgacacttaacaacgtatattttggtattgaagttgcattcacaaaaccacactatcgacgaatgcatccacatgtgagataacgtaattttttatctacatatatttaggatgtggacgtggcatcgcaaatgtttcacttaggaagaagctcccaaatcaacattctaggaggaacaaccatatcatcttgcgggtggacctgctcattgatagtgtaattttctaaaacttcaatataaaatatactccctccagttttttttgtttgacgttgccgaccggttcgattaaattaaggaagctgtgaattgacttgtttgcccttcacccttatccctttgcactgatacgtttcgtctctgcaggggggagaggggaaatttgcggacgggaggagggcttctgaactgcgagcgtcaaacaaaaaaaaacaccttttgagtatgaactggaacgtcaaacaaaaaaaatagagtatgtagttaagtgtcaagtgtcaaaatgtgttgttttctgcaacttggaccataaaatatgtagctttgtgaaattattctttcatgtgacactaatttatatagttgctaataatataatatgaaatacattaatagttaaaggatatcgctaaagaccgtgtaaaaaggagaaaaaggacaatacgccattccatttggtgggtttcgacgaaataccacccaatacgatgcaaagcataaaatgccactcaataggttatctttaattaggatattttgccactttgagaggttttaaaaccaaccctggagagagaggaagagaggggagggggaggggagcaccggcgaacgttgaaggcggcagcgtccgttctcgtcgccgatgagtgctaagcgcgagcggtcagcacgtgtgggcggtgccggaggcggtgagcgcccgtaggcagcgtggaggcgagctgcgagcacacgcacgggcagcgttggagagccctccccgtcgtcgtcgtcgtcgcctcctcctccctcccgtcggcgttgccctcctcccacatcgccgtcgctgtcctccctgatcagcgccgtcgtcttcctcccccatcgcagtcgccgtcgggctgcaggaat

SEQ ID NO: 47107 - DNA, 6195 bp, Oryza sativa
ggacgagggcggcgacgaccctaactcctgcttcaccgccgacgccgctagcaaggtcaccgacaccgagaccgaggcggcctcccgctcctccgccggaaatcacgtcggcgtctccttcctcctcaaggcgccgccggcggtgtcacgcctacgcttccgttgcgtcccaagcggcagccgcggaggcgatagacggttcccctcgatgcgtgtcgtcgccgtccaccgcgactccctgctcctccggatgcaatatcggaaagggcgcgcctacgacaacgacatcggggtcgactacttcctctacaacgccggcgccgccgccaccgccgttgacccgccacggccgccgtcgttgtcgctgctcccgacttactggtagacattgcaaaaggaagaggatgatgatgaagaagataaggaagatgatggtggagaagaaacttatcgtggtcgtgggtatcggcgtgggcggcccccaagcggtgggtccgcgatctgggtgtcaagaccaccggcatcttgcaccgccgcggcgacggcgacgacggcgatctcgtggtggtggcggagctcatcgcgaaggaggaggacggcgggacgccggaggagctcctggtgctccgctcggacggcgagtggaccctcacgcggccgcccgtcgtccacgacgacggcaaggccgaggaggtgtcccgctggaaatccgacctcgtcgtccccatcggcgacacgatgctctgctgggtcgacctgtatcgcggcatcatcgtatgtgacctgttcgacgaaattccccagctgcgatacgtctccctccccgtcgatgcccccgccgccaaattcgacaacggccgcggcgactactccatcaacccgcggatgtgcccgcggcagaagcgaagcttctgggtctccgacaacggcggcgagctgagattcctcgacgtctcgccccgctgctgctgcggcgatctaggcgccaccacatgcaataacgcccgcaacgccttcgtcatcagctcatggacgctaaagatgaacgatatgagatgggtgatggacgccatggtcgacgccaccgagctctggtccctcgacgcctacactggccatggcctcccgcgcgtcagaccggaataccctctcatgatcatggatgatccgcgcctcgtcttcttcgtggtgcaagaggagtaccaaccggaaatatcattttctgataggggaaagtggagggtcatgttcgatatgaggagcaagaaaatattatcagtgagccagtacgatgagtcagacacgtcgtggcagccatattcttggctcacttatttccccagcaagatctcaaattacttcacttccattggagcttgtagcaatgttgcaaagaggccgctgattgtcactgacaagccggcagtaagttgtatcgtcagtagtaattcattgcgatcttcctcgtcgcgggagtcatctaccaaacattctcagatgtcaaagggagtagtagcttctcctgaggagatcttggcggcgttagaagaggttcctgaattggactgcgatgatatgctaagagcgtatagtattctttgcgatgacattggccgacaccgatttagatcgcttttgggcctcccggtaagtctaaggaagaaatggctattgatcgaaatcaagagtagtgaagattgttctatctgctctctttgcacagcaaacatgcaacgtggttgaacttatttcattgtgatgaattgtacttttgatcaataattaatctatgtttttttcctgggcgtgcttatacttaattaaacacaagacgacggttccttcttaaaggcgttgttttcaactttgtgtttttgtccggtggcttgagttttttttcctcctttttgattgtgtgcatcctgatgtaagcagatctgccagaaaggcagaaacacaaataattttcgtgagtgtggaaaactgtcatgaaaactataaaaaacgctagggatatactttgtgtcggcaagccgccacgctaaaacactcacgagtagagcgacaaggaaaataaattttcttggtggtcagccacccgtgattattttcttggtggaaaccaccgccaaggaaatgatgctattgttaggttcgtgcaacgccacggatataaatgaaaccaccatgttaattctttttcgtgacggtgttaattaagccccctggtttaatccttttcggtatggtgcagatccgccaaagtttattcaatttttcgtcggttcttttttatccctcataaaaatcctacgcactaatgaaaattcaggtttctggtagtggaggctaggttttgtttcatttactaatggcaatcttcccattatccaaaatataatatatgtgatcgaattgtataatatatgtgatcgaattggtagacggatgatgaaataaatatttagagatgttttaattaggattccgagctctgcggctgtgtcactaggttttatacattttaggagaaagtctaaataacccccccccaaaactttggatggaagactgtctagcaccctgaactttgaaatcggatattgagccctctaaactttataataccatttatatatataaccccctaaggttgttttgcatagtgatttttatctaatttgtatataagttggatgagtttgatcacatgacatacacattagacatatatattaaagttctgagttaaatatttctttttactacttgttaactcttattacaaacaagtaccagtataataatagtatgacatcactatataagaataaattgatgactaagcaatagacgcttatttccgtgtgatcagttgataattcctaaaccaacttgtacaggttttgaattccaaaagtacggaacacgtctagattaatttattttggaacatactccctccgtcataaaaaaaacgaatctagaactgaatgtgatacattctagtataataaatttagacaaaggtatctccacattcgtagtaatagaatgtgtcacatcagtactagattagttttttatgggacggagggagtacttggttagtttaattttggaatacggtagtaagtacgagggagagtagtagtattgtatgatcgatccgtatccgattcaccgtcgtctttcctgtgtgttttataaacggaccaacaggtcctctaattaactctctccggcttaacgatagaaccgatccatccatccatcctcctcagcccctccttgtccatggaaacccaaccgacggatggccgtggcgccggcgccggctacccacggtgggtgatcctcgaccgtgaagccgaatacctacacgtcaaccatccctgctccgccgccgcggatgccaagaccgaggcggccacgctctcctccggcggccacaccgtgcgtgtctccctagacctcagggcgccgccggcggcgtcgcgcgtgtgctacacctgctccgttcccgtcgacccggcactagggccaccctacatgagcgtcgccgccgcccatggcgactccctgctcgtgcttgtgtccttcagttaccaagaagggtacgagcaccacacggacacgatagataagtacctctacaacgcaggcgccgccgccgccgccgacccgcctcggccgccgtcgctggtgcatctcccggcttactacaatggagaagagacgacccttccgtcgccgttgccgcacgatcttgatgagaagaccaccggcctcctgcgccgcggcgaggccgaggccgatctggtggtggcagatctcatcgtgaaggatgggggtgaagctgacgcgccgaaggaggccgagctcctcgtgctccgctccggcgagtggagcgtcgtgcgggcgccgatcgtccacgacgacggcaaggccgaggagctgtccttctgggaaaccgacatggtcgtcccagtcggcgaccggcggctgtgctgggtcgacctatgtcgcggcatcatcctctgcgacatgttcgacgacggcgacgagactctccggccgcgatacttctcgctccccattgagccccccgccgacgaccgagaccgacggagatgccagatgtcaaagagaagggtctgcgtcaccaatggcggaaccgtgctgaagctcgtcgacgtctccccgcgctgctgctgcggccgccgcggcgcaacgcagtgcgaccattccagcggtgtcttcgtcatcaacacatggacactacatatggacggcgacgatgatgacatggcagcttattggaccatggacgccatggtcgacgccaccgagctctggtccctcgacgcctacgccggcgtcccacgcatcaatccacaattccccatcgtgagcatggatgaccctgatatcatatgcttccaagtgcccgaagaacacaagattggaagaaaaatgcaatcgtggtacatcatgctcgacacaagcagcaaaacattgatgtcagtctgccgtctcgatgagtcaagctcgcttcaattgtcttatggatatgcttactttgttagcacggtctctcactgctttaattcttctgatgatggggggttcaacaatgatgtaacaaagccggcactgatgatcatcgatgataaggtggcaacaaaaaataatatcatcgctaatgattcattgcaatcttcatgcgagtcatctgccaaaaattccaaggtcaattctcctaaggagattttggctcttctccaagagataccggagttgtctcgtgatgatttgctgagagcgtatagcttgctttgttatgacaataatggccgccggctcagttcacttttggggctcccaatgagtctgaggaagccatggctgttgatggagattaaggctagtgaagcctgttcggtttgttgtgcatgtagagcagacatgcaaaatgtgtgaaatactttttgtagtacattaagtgtgtgactgtgtgcattgctgtttggttgattaattgcgctaaatcgagcagcttaattctcgtataatatagtttttattttaggatattttatgattaattaacgagaaaaaaataacaattgtttgcaatttccatactgtagctattcttttagctaattgtgctaactcatcttcttccacctctgtgagctgaaaacacaaaaaaactaacacatttactataggcgtcggttaaaaaataaaccggcacattccacatataatatagatgaaaaactgacacttataatatattataggtatcggcttttttaaaaataacgccacccttaaatcgagccaagccgaaccgcaccacaccttctcatccaccgcatcctctcctcctcatctcttcctcatccacccttctctcttggctctctctctctctctctaggttcccccctctctctctctttcggcactcttagtcgcaacaacaacggcaatgggaggagaggcggcagtggctggcggcgccaccccctccgccaaatccaatgggaggagatgcgacggcagctacgtgtggcgacaggaggtaggcggcggcaatggcgtgttgcggcgggaggagaggcgacagcgttttgggtggtgccctcccctccgccagatccggcgggaggggagatgacgacagcaacgtgcggcggtaggaggcaggcagcgatagtggtggcggcggcagacgacgccttccaacgtgctgcgggatccgcttctttgtcattgctgatgagctgtgttgctcatctgcagctccatcctctccacggaggctgttgtccatcctctccatcttctttgtgctttgcatttgtgttgatgttcttggatcgatgtttttgaattcttgaagccaattaattctatgaattaaatgttgggtaaaattgggtgaggggggcaccacgattcaagccgatgaattgatccacttttcttttagatttttgggatcttaaaggtgtccgttttagaactgacacctttgatttctatcatctgtgccacttttcaggttatccggcacctagttgggtttccaaccgacacctatctaggtttgtgtagtagtggagttggataccaattgtaggtttgtgtacaccatgtatgacaaaaccgctctggatt

SEQ ID NO: 47108 - DNA, 9298 bp, Oryza sativa
attagaagttgagggtgaacaatgtctgattttcggatttagggggtaattcggtcgaccacgatagttcgggggggggggggtaattcgtactttttccttttgaattcttgaagccaattaattctatgaactaaatgttgggtgaaggggggcgttgcgattcgaaccgatgtattgagccagttttttttttgggatttttaggatctcaaagatgccggttccaaaccggcacctttgatttctatcatctgtgccacttttttagtgtcggttgaaaaatccggcacctagtcgggtttccaaccgatacctatctaggtttgtgtagtagtggaggtggataccaattgtagtccgacccaaccgcgttttttgttttaaaaattaaaaaacggacgaagcaaatctccgtgtacgtgaagatcaaatcgagatcgatatcctctcgatcgccacggtcatggagacccaaccgacggcggaccggcgtcaccgccggcgccggctacccacggtgtgtgatactcagccgcaacggcgacgactcctctccacccttgtccaccccggacgacaagaccgagacgacctccgtctcctccggcggccacctcgtccgtgtctcactcttcctcgatgcgccgccggcttcgtcgcgcgtatgtttcgactgcttcccgcgcatccaccggggcgccagcctgatcgtcgtggctacccacggcgactccgtgctcgtccggttgagctacggaggacgcgggtacggcgatgtcggcgtgctcgattacttcgtctacaacgccggcgccgtcgccgccgacccggccgccacagccgccatcgctgtcgctgctccctgcctacgtcaccaaagcagcggacgatgaagaatgtgaagaatggcaagcatatgaagaagagagtgaaacctggccgcgccaccatcatcagattcatcaccatctggatgagaagaccaccggcctcctacgccgcggcgacgacgacatggtggtggtggatctcgccgtgctagagggccacgggctggaggaggagggggacgccgagctcctcgttctccgctccggcgagtggaccgtcacgcgggcgccggtcgcccacttcgtcggtagagccgacaagccgccgtcgtggatcactgacatggccatccccgtcagcgagcggcggatgtgctgggccgacctgtaccgcggcatcatcctctgcgacgacgtgttcgaccagaatccacagctgcggttcgtgccacttccccccgaggccctcaccgatgaaaccgacgacggctacaagcgggattacgccattacggaccgaagagtttgtgccaccgacggcggcgccgcgctcaagttcatctacatcatctcccgctgttgctgcggcctccccggcacaaccttctgcgacaattccaaggaggccttcatcatcaagacctggatactcaggatggacgacgacgacgacatggtttggacgatggacgccatggtcgacgccaccgagctctggtctctccatgcctgcgctggcctcccacaagccaaaccaatattccccgtcgcaagcatggacgatccccatctcatctgcttcatggtgcaggagcgagaattcgagggaagaagaagaagatactgccacatcaagagaacatggatggtcatgttcgacacaaggagcaagaaactcttgtcagtctgcagctgccgcgatagttggctcatataacgctccgcttttcacgtggcgttaaaaagctaatgtacaaaaatcctaattgcgaaaatttagttctttgagtgttgagtctaagttgtgccatagatctcaatttaaaatccctctcttgtctcaataccctgatatcaaagatcacctcctcaaaatttccgttccaaaataatctcgaagtttgaatccttctattcggatttcactgtagaaaccctaaccacagatatcgcctaattccggaatccaaaaccagactccaaccctaaaacctctccaatcaaattccctccttgagctagctctaacatccaagcgtccccctctcctcgtctccctcgctttatctatcgtattctaccgccacctcctttgtttcaccccgaacattgatttctccttttgattccctctcaaataatccttgagctgccaaatacaaatatatccctaaaatatcaattctcgctttgaacttcaaccacccatcgacatcgaaaatcacgcctcatcgaaattccttcccatttccgaaagtatcgaattcgctctttgaatcccctccttggcttctccatattttgttgagttcaaatatccaatttgaattcaaatccaatgtcaaatgctcctcaaattccttgaagaaattcccttgaaaaagtctatttcacctccctcttggtcgttgggccgtttttcccttttccggcccatcgtctcctctcggccgctcctcctcctccccgcacgcacgtgctctgcacgcgccgagcgagagaagcagcgcctctctcctctccttcctctctctctctctctcgtcgaactcctctccctagcgccgatttccgccgccgccgtttgatttcgcccgtcggtttcccccgcgcgcgcgctcgacgctcggtcgccgccgcgttagcctcgacgccgcccgtgcccgcgctgccgctcggccccgctgctctgcgcgcatgcgtccaagggcgagagccagcgctcggtctcgccctctcttcctccttcacctttttcccaaagcggcatggagcaagctccccttttctccctccttttcccttttttctctcccgaaccgacgtcctgcctccaccgcttggcatctagcgccatggtagcgagtgcccctgacgccgcgcgccaggtcgccatgccccaccttgaccacgccgagccgtgccagcccgtgctcgcggttcgattcccaccgcacgatccaccgcctccactgcccaacgcatccgcgccatccgctgtttcgtgccgcccacgaaaacgccgacgtcgccagtgaacgccggccgagcgccagctcgcatgctcccccgaaccgaccttgacgctcccacaccccctctataaaaaccaccccgtgcttcctcctccccttgcttcgtttcccccaagcggcgaagctctgccgccatgggaactcctggccgccgcgtcgagctccatgtccggaggcatctcgccgtcgagtcgttccatcctcgccgcgtccttctccttccttggccgaacgacggtcgttgccacctcaccgcaaaacccgtctgtgccgccctgccctgtccccatatttccggataccgcgttggtcccgattcgccgccgccttcggaaatcccggccgcactcccccgtcggccttccctctcccaccacaaaatcgccgccgacgtcatttcctcttgccggtgagccccgagcctaaatccttcccctacatcttctagctgctcacctcgccgtggctctattttccgccgctgtcggcctctctctcctctcgccgtaccttgcgccgccaccctccttgagtccccttgagccaccccaaaaccgtcgctccgcccgctggcctcctcttttgctcctgcgccgtgccgtcctttccaccgccgtcgtgcgcacggtcgcgcaccgccgttggcctccctcctctctttgattcccgacgccgccgccatccccgtgacccctgggacctcccagaagtgtcgccgcagtcgctagcctcggcctctgcgcccgcgccgtgccgctcccgccgccggcgccggacgccgtcgccggccccctccgaccccggcgccctaatccgagccgtggaatgagttcaccttctcctccttttgcctccggcgccgtcccctccctctggctcgctgccgctcgctggcgccgttgcgccgccgtgagccgtccgatctccggaagcccttcttcttttccccttttttctggcaggggaccaacactggcacccccgaactagtaccgaacggaacttagcccgggacccttcaaattaacctgttaatcgataccagtcccaagaaacagtgctggtttcacaggaagacggaatatcacagcaccagaggtctctttattatagagtaggaatacagtcatgttgggctggggacagatcctgagctcacaactgcattacaaaagggaaacggaagccaagacttgggccaaacaacacaggcgcgacttgggaactaggccgaaaccctaaaactcatcgtagccggcttgctcctggaagaactccttatcagcaggatccgcttcatcttcttcaccaactgggggggtgattatttatatagagcaagggtgagtacgggagtactcagcaagccatgggaaataagtgtttaatgcaggcttcaaggaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgattcaaggttggcacccggctaacagcttccaaacggccacccgggccaacaactttcaaacggccacccgggcctagctgatcccatcagctgcaggtttttcaaacatcgaacccattccacaacagcaatttcgcaaagcagtagtcaaacaaaactacgctaggaatcacctcacatccgcccatgaccgtgggcacggctgttcgaatagtttgttaacctctgcagagggggtacaatttacccacacgacattactaacccggatcacccagcccgtggggatcagccacgtcgggagacctccaagctttcatgacaaggcatttccaaagcggacacaggtttaccatatgccgacgagaggggtcccagaccaacaacaggttaggtcccagaccatactgtgccaggaagcccaggggtcctccccgacaccaccccggcgaatccacatgtctcccggcatcaaggctcccctgataagctagttactcagccaggggtgtcccattccacccatgtggtcgtacttgtcttatattcggatgaaattccaaggaaacggtccttaggtgcgagagcagaaaaccgtacacccggtacattccccggtccgcggttttggaaattcatttagttcgcaagcaccgacccaggtgtcgggttttccaagtctttagtaaagcaagttttacccaaggagttactcgcacagagtgcacgaatatcgaggcgcaactagatggttacaagggaacatggtatagcaattaacaaaggaagggtcaaatgcaacaaactaggtaggtccaccaatctgccttgcagacgggacaaacagattaagtgcgatcctatcaatgcataatatttttcaagcaacataattaagttcaaatataggctaaagatgttcaaaggtggcttgccttgctcgagatcttgagcttgatcctcgaaatcctcgcactgcgggtcttcgggctccgaaactacacgcgaaacgggacaacttaacaaacagcgaaaataaagccctattaatgacctctaagcgtgacattagatagatctcgagatttgaggaattttggaagttgaacggagtcaaacggatttatggttgggaagatattgaatttctaagattattggatttttggtctaaaggaaaaggatttaattaaatcctttttgaaaaaaaaagaaaagaaaataaaagagggagggaaattagactttcctcgggcggctagggcgcggcccgagagaaatggagcggttcggccgagctaaatgggccggccggcccaaggcggcccaagcacgcgcgcgcgggaggggaggagagagagagccggtggaccaggctcaccacgcgtggtcccgggtgggacccgcttgtcagtgacacggttcaccgtgcggagcgagcacgcggcgcacgcgcgcgggcgggggagggacgcggcgcacgcgcgcggttcgcggtggacacggatgcggcgggcctacgcgcagcctcacggctcgcggtggaacgcgcgcacggggaggggctgaccggggtcggctcgacccggtcttggccgagctggcgccgacgtggcgcctacgtggcgcctacgtggctgccacgcgggccggcgggaggttgacgactacgccggccggaacggacggcggacgacagcggcgagcggcggagcgaaccacggcgatacaggcgaaagcgagcacaccgggtggttgctcaggacgaggggagacgagccaacggctcggattcgccggagggagtgcgtcggcggcggattgcggcggcggcaaccggcggggagggaagagggaaaaggcgacgaggtcacgaggggccgattcccggtggcgagagcatctacgcggctacgggaatccgtcccttgttccggattaggaggaaacgcatcgagggaggccggcgacgagaggcgcttccgagctcgggcggcgacggcggcgagtacacggcgagcgacggcaacggtcggggcggcgccggctagctacggggaggctactcgtgctactactcgagtctaaggggaggagatggaacgaggaggaagaacggagggaggcactaccgtgcgggcgggcgcagtgacgagaagccaacggcgcgggagtaatctctctggcctcgggccggggaagaggaaggagagggcgcgcccggagtccccttccgcgtcctcgctcgtgccggctcctctgacacgcgcaacgacgaacggtgacggcgaaacagaggggcagcaacaatggagtggaggcgatgggacaacgagaggagaagggagggagggcgcctgggctttataggatggcaatgtcggtttgggagaggggaaccgactttggacggtcaagccagcgagctggcgctccggctagcggccaaatcggcgacagggcggagggaggatgacgccggcgggaggaaaaaggggaaaaggagggagagaaagggggctcgcccctttcttctttgggaaaaggaggaggggagcgggggcgacgagccagagggaggagggctctgcctccgtcccttggaggctagcgcgtggagtggcggggccgaggcgatgacgacggcgatgacggcggggcggtttggagcggagcggcgacacgggcgacaggcgcgtgcagaggctgacggcggcggcgaccgggcggtcggccaccacggcacgcgcacacgggttgaaacgggaggcgcggcggtttgagcggcgcggctcgggcacgcgcgctggcttgcggggccgagcggctgcgtggctgcaggcgcggcagggcagcggggccgggcggcgcagacggcgcgacgtgggcgacgaccacgcgggcgcgcgcgcgcgaacaacgacgcgcggggccgatttcgcgggcggggagctcgccagggatggaggcggggagagggaaagcgagggggaggcgctcggcgcggcgcggctcacgcgcacgcgcgcgcggcgcgcgggcggagcggagggggagggagagagggagagagagagatagccggcgagggagggggagatgggccgagagagattcggcccatcgaactcgggggaggcaaaatagacttttgcggaggaattgatttgggaaggattgggattcgggattgaactcgacgatggatcggggatttgagatctgaaatggcacggacactagacaacaagcaaagaaacaaatttcgcaattagggtttttaagagataattttcccgctaggcgccacgacggaacgggcgctacaaccacgtggccaccacctcagccacccggccctgcttgactcggtcagccgcctcttccctctcccgctcgtgagctcggcctaccagccggcccatatcctctctcactctctcccgccaggccatgggccatttccttgcagccacccatgaaccgaagtctatgtttcctccctccaccaaatcacttctcttacacaaaagtccatctatcctccccaccgtttgctggccccacgtgtcaatgagtcaaagatattctagagaatgtcttaatccggagattccaataattcgtcccctcgagcccgcatgtcagtggatgtcaataatattcttgagaatattatttctataaattccataaaccatttcccgtattccagaaaattccgacaaatcatctccttgttcagaaaaattcatttaaacttccaaaattcatatcccttgatccgttcgtccgattgcctccgttccacttccaataattccattaaattgtgatatatctaatggcactattaattagcctaaataggatattttatttggtctttttttaggtttttgattgtttgcgcctagttgcggttactggatatttttcttcaagcggaattctcgaagatttgtgaagcttcgtgaagaccctgagcaaggcaagccacctttgaaaatattgagcctatatttgaacttctattgtaaattattatatcatgttcccttgtaaccatctagttgcgcctcgataattcgtgcactctgtgcgagtatcgacggtcgccttccaacttaaaatttgagtaacttcttgggtaaaacttggtttacaaaagctttggaaaacccgatgcctgagtcggtgccttgtgaaagaaaatgagttttaaaaatgaaactcgcgacacaaggccattcctgggtggaatacttgtgcggtcgcatttaaggaccgattccttcggaattacatccgaccatacaacattgcgaccacatgggtgtaatgggacgcccctggctgagttattagctaatcaggggaaccatgatgccaagagacatgtggattcaacggggtggtgtcggggagaaccctcgggcttcctggcacagtattgtagcgcccgttccgtcgtggcgcctagcgggaaaattatctcttaaaaaccctaattgcaaaatttgtttctttgcttgatgtctagtgtccgtgccatctcaagatctcaaatccccgatctatcgtcgagatcaattccgaatccaaatccttccaaatcaaattcctccgcaaaagtctattttgcctcccccgggttcgatgggccgaat

SEQ ID NO: 47109 - DNA, 1667 bp, Oryza sativa
ccggccggtgtcgtcgtctacctcctgccggcccgcgtggcagccacgtaggcgccacgtcggcgccagctcggccaagaccgggtcgagccgaccccggtcagcccctccccatgcgcgcgttccaccgcgagccgtgaggctgcgcgtgggcccgccgcatccgcgtccaccgcgaaccacgcgcatgcaccgcgtccctcccctgcccgcgcgcgtacgccgcgtgctcgctccgcacggtgagccgtgtcaccgacaagcgggtcccacccgggaccgcgcacggtgagcccggtccaccggttctctctctcctccctcccgcgcgcgcgcgtcttgggccgccttgggccggccggcccatttagctcggccggtccgctccatttcccttgggccgcgccctagccgcccgaggaaagtctatattccctccctcttttctttacttttctttttcttttccaaaaaggatttaattaaatccttttcctttagaccaaaaatccaataatcttagaaattcaatatcttcccaaccgtaaatccgtttgactccgttcaacttccaaaatttctcaaatctcgagatctatctaatggcacgcttagaggtcattaatagggctttattttcaccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttagttatgttgcttgaaaaatattatgcattgataggatcgcacttaatctgttgtcccgtctgcaaggcagattggcggacctacctaatttgttgcatttgatccttcctttgataattgttatatcgtgtccccttgtaaccatctagttgcgtctcgatattcgtgcaccctgtgcgagtatcgacggacgccttcaaacttaaaatctgaaaaacttcttgggtaaaacttgggttttacaaaagacttggaaaacccgacacctgggtcggtgcttgcgaactaaatgaatttccaaaaccgcggaccgggggacgtaccgggtgtacggtttcccgctctcgcacttaaggaccgtttccttggaatttcatccaaacataagacaagtatgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctacagaggttaacaaactgttcgaacagccgtgcccacggtcatgggcggatgtgaggtgattcctagcgtagttttgtttgactactgccttgtgagattgctgttgttgaaaggggttcgatgtttgaaaaatctgctgctgatgggatcagctaggcccaggtggccgttttgaaatttgttggcccg

SEQ ID NO: 47110 - DNA, 6270 bp, Oryza sativa
ccagacgtggatgttctgcacaggctgggtgacccaggttagtaacgtcgtgtgggtaaagtgtaccccctctgcagaggttatcaaactgttcgaacagtcgtgcccatggtcatgggcggatgtgagttgattccttagcgtagtttttgttttaccctgttttatgaaaaggtgttaaggtttgggaaacctaatgcttgggaagcatttagctgtccgggggacagcgggaccgggagtccctggaagtgattggtcgtttggggaccactattatcgggaagtttggaaaattggtttggtttgggaaaaccaaatttgaagccaactctaggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttcccttgaagcttgcattaaccacctaagttcccctggcttgctgagtacgtaagtactcacccttgctctctatataaatatagttctgccagctccaaagatgaagttgaagtgaagtgaagattagggtttcgtcctagttccctgccgttgcctgtggcgtttggtgttagtccgttggttggttctgctgctgctgctgttgttggtgtttgccttgtccgtgtcgccggttgcattctcaggctgtctgagctgcaacctaagttaaggtaaataagtcctctattaattataaggatttgcaatgattcatgtttgtcaccgtgggtaccagcgctatgtcctaggactggtactgagatcgcggtttcgtaggacgcggttcacgccgttttcctacgacacgctcctgtcaggtgccgttgtacggtggtgccagattggggtgtgacagctcactcttcctagcaagatctccagctacttcacttttgatgatccaagttattgtagcaatgctgcgacatcatcagagccacatgtggttgatcatgatactgtcatcgatgagtcggtgcgatcttcttccgagtcatctgctggtggcaaacatctgatcagagtgtcaggagtggcttcccctgatgagatctttgctgcactggaatagataccggagttgtctcgtgatgatttgctcagagcgtatagcttgctttgttctgacaatggtggccgtcgattcaaatctcttttagggctcccaatgaccctgaggaagccatggctgttgatggaaatcaaggccagtgaagctcgttctgtttggtgtgcatgcagagcagagctacaaaatgtatgaaatactagtgtttccagctgtttgattgttctgaattattgtactattgctgcttgttaagaagaggactctagtactctaatagtctactactatccccatcccaaaataaatttacttttagacgtaaatttggacatagcctcgtgtctaaattcaagggttgtcaatttcggttcgaaatttcgccccccagcaagcaattatgtcaaccgaaatttccaaatttaaccaaatttttgagaatttgttttttatgcaaattaaattattttcaaataagcatgtacatgggcacatggatatcgtacccattaaaatatttatttttggttgaataagagagaaaaacagttctaaatatatgcccgtagttctaaatacaaatagaaaagaaaattttctatttgtatttgtattttttaacccaaaactgtgggacccaactaacggccttaaaagtgagggcaaacggtgggttcgttttcaaaaagatggggcaaaattgtaaaccctaaaaagtaggataaaacaacatttggggttcgaagtaagggcatgcatgcacttgtcccatttttaattggtgctatttaatgattcatttattaaatggtgccttttatattagattagcgtaaatccatagaaggaatgtgacgttttggatgaactgtcagagagaaaaagagaggataacaagggaagagggtggcttggctggtctgttgaggttatagaggactaaataggccgcctgggcatgacccagcctaagcacgaccaaggctgcggttggcagccatgcccgctcacgggcttcacttatggcccaataagacttagaccatgttgtgtcagcccaaagtcacgaccaaattattatgctcgtccttagaatatatttactttgcttctcttttcttttcgggtcgtgtcttatattggtagaataacttactaatgatatgttccatataaatctatcttgctaaaaaaaatttcaatttcccctcttagagtgctctaccgtcggccaccggagaacaggtcaattaaggcaaggggaaagaattcaaattatttaatcctaaataaaaagaaaatttaaattgctcttatgaaagacatgtaggagtacgtacaacgaggcggattcctattatacgattcattagtttgtttcataatcaaactcttctatatagtcaaacaccttcttcttttttttcgtaaaccgaggaaccgatctctccgcttacgttacgagacagatcaaatcgtttgttccggcctctcaccggcggcccatggaaacccaacggacggcggaccaaggcggcaacggcggcgccggcgccggcggctacccacggtgggtgatactctgccgctacggcgagtaccagggctacgagcgcgacgactccttcccgcccttctccacaccggacgccaagaccgaggcggcctccgtcttctcctccggcggccaccacgtcctcgctccctctgcctcgacgcgccaccggcgtcgtcgcgcgtatgcttcgacttcttcccgcgcatcggcggggggcggggcgccagcctggccgtcgtggctgcccatggcgactccgtgctcgtccggttgagttaccaaggagaaggataccggtacggcgacgacggcgtgctcgactacttcgtctacaacgccggctccgccgccgcagacccgccacggccgccgtcgctgtcgctgctccctgcctacgtcaccaccgacgcggatgaagaagagagtgaaacctggcggccgcgccacgatctggatgaaaggaccaccggcctcctgcgccgcggcgaagacgacatggtggtggtggatctcgccgtgatggaggagggcgacgagctggaggaggccgagctcctcgttctccgctccggcgagtggaccgtcacacgggcgccggtcgtccacttcgacggtagagccgagaagctgccgtcgtggatcaccgacatggccgtccccgtcggcgagcggcggatgtgctgggccgacctgtaccgcggcatcatcctctgcgacgtcgacgacgtgttcgaccagaatccgcagctgcggttcgtgccacttccccccgaggccctcaccgatgaatccaacgacgacgacgacgactacgacgaccacacgcggaaatacgtcatcgcagagcgaagcgtctgcgtcaccggcggcggcgccgcgctgaagttcatcgacgtcatcccccgctgctgctgcggccgccccggcccgacctactgcggccattctaccggtgccttcatcatcaagacctggatactcagggtagacgacggcagcggcgacatggcctggaccatggacgccatggtcgacgccagcgagctctggtcatcccacgcctacgccggcctcccacacgccattccagaacaccccatcgtgagcatagacgatccccacctcatcagcttcatggtggatgagcgagaatccgaggggagatattgccgcatcaaagaaacatggatgatcctcttcgacacaaggagcaagacactcttgtcagcgatctcctgcagccatggacgcaatttccttcctagcaaggtctccagctacttcacttcctccaatggaagctgcagcaatggcggagcgatgtcagagccagctgtgatcatcgacaaggcgccaacacatgatgccatcatcggtgattcagtgcgaatttcatgtgagtcatctggtgctaaacatttcagagtgtcaggatcagtagcttctcctgatgagatctttgctgccctggaagagataccggagttgtctcgtcatgatttgctaagagcttatagcatgctttgtcatgataatggccgccgattcaaatctcttttggggcttccgatgagcctgaggaagacttggttgttgatggaaattcagacgtgcgaagattgcgctgtctgctgtggttgcatgacagacttgcaaaatgcatgaaatactttgttgtaaacttgctttggtattgatagtatacatgtgcttactgcttaacagtcggattgtgcttaattgtacaattgcttgggtactttaggttttttttttcaatgatcataaacgatttggtaccatgaggtaccggcaccttgagatactttttttttgacttgagcaaatctctaagggcatcaccaatgtatatggtaaagtgatccatatagatgggacccgcataaatagtttatccttatggcaatctccataacgtatacagatacaaggtatcattaggagaagagagaggagatagataatataatttatttcatatgggtagtccatatgcatatgggtatcttttgctattttttctatatggactagttgcacaatggtaataggtggctgaatggaatattatattgcttatgtactacttttacaccacattgtggatgccctaatccataacatgtggcgcatatgtcccgattaatttaaaaacaatccatatggagcttttcccatccatccaaacatccatagaaggctaaaggtaaaaaaagggcacctataaggagactggattttaaacttttgagggaatgtcccctcgttatttgcatgtcacttaaatatttaggaaaaaaaattaagaagatgtatcaatatatgatatatcactccaaaaaaatacaaattaaaatttaacttttacatatcgcaaagaaaaaaaagcaaatttgactagctgtagtttaatttgcattttgttgcaatatgtaaaaaattaatttgaacttgcatgtttatggagtgatataccgcatattaatatattttttcaatttttctcataaccatttgagtgatgtaaacaacgagagaatatcccatcgagagtttagagtagtttccttatatataagtatcaatatgtgctggtcctccataaaaacatatattccatccgtcccaaaatataagcatttttaacatagtgacaagtcaaacagttttaactttgactattaatagaaagaaaaaaagatcaaccatgtaaaattgatgttactagctagattatcattacacaaactataataacatgcaactctttttattcaaaacgtcttactttatatatcgttgaccaaaatagcatctcggagatcgtgttagaatccaaaaatacttatattttaggacggatggagtagtattttctttaagataaaccaacattataacaaactaatttataggtgtcgtgtcgtttttttaaaaaacttgtactcgtaaaccgcaaagccgagtctgagccgggcctcatctgtgaacgtgattagctgatctttgctgacaagctagagaaactaattgacggccggactatccgtgattagctcgtttacactatttgtgagggcatttctgtttctgcaagatcagcttacgatccagctgatccttctccctattattcagattatttccccccataatatcgatccgtaattaagtcagcaattagtagttttttttcattgatgatctgcaagtcatacacgaggttatatttgcaatttaaagaagattactgtccattatatatggcctcagattttgtgtcaccctaagcttccaccagtcgccgccgccatcgccgccgaccatggaaacccaaccgacgccggcgactctccgacgcgtcggctgctacgacccacggtgggctttactcgagcgcgacgtccgacgcaagcacaagaaaggtagcgatgatcagggagaccgggacgactcctccaacccctgctccgccgccggcggcagctgcgccgagaccgaggcgagctgccgcaactccgccggccatgtcgtccgcctct

SEQ ID NO: 47111 - DNA, 3285 bp, Oryza sativa
acttcgtctacagcgccggcgatgccgccgccggtgacccgccatcgttgtcgctgctcccaattcactgggttcactacgggttgagtgacaggacgccgaaccggctggacgacgctagaaccggcctcctgcgcgccgccgccgccgttgcggtgacaacgaccttgtggtgtctaagctcaccgtgacggagggcgacgacggagtggacgccggagctcctggtgtttcgttccggcgagtggagcgtcacgccggcggggatcatccacgactacggcgaggccgacgagctattccattggaagaccgacatggtcgtccccgtcggcgaccggcggttgtgctgggtcgacctgtatggtggcataagactttgcgacatgttcgaccacgatgatcctctccggccgcagtacgtgtgacttcccgtagagccccccgtcggtgaattcgacgacgacgactacggctaccgctactacgagtacgagagcggcggcgacagcgtccgcaaccctcggctttgcctgatgaaagatcgaaccgtctgcgccaccaacggcggcggcggcggcggcgacacgctcaagttcgtcgacatcttcccccgctgctgctgcggaggccccggcgtcaccacctgcgaccattccagctccgccttcgtcatcaacacctggacactgaggacgagcgacatgacatggaccatggacgccatcgtcgacgccaccgagctctggtccctctccctccacgccgacgccggcatcccaccacacaaaagaccgtactaccccgtcgtgagtacacgcgactctcacatcatctgcttcctggtttacgaccacgattactgcgtgaaagagaaattttggaagatcatgcttgacacgacgaacaagacgctgccatcagtctttgcctacaaaaatcagtcttcgccatgtttacggtgcattcccagcgagatctccggttacctcctcacttcatgcagcagcgattcaacaaagccggcagccatcgtcgtcgacgtactacctgcagctgcagcgacgacgacgacgacgactgccgtcatcagtaagaaatcacatgaactgtccaccaatgtgtcagagatggcttctcctgaggagatcttggctgctcttgaagagatacctgatttgggatgtgacgatttgctcgaggcgtatagccttcttattaacgatggcagtggacgccgattcaggtctctcttggtgctgccaatgggtctcaggaagaaatggctgctgattgaagtgaagaatagccaggcttgttccatctgctccgcatgcacaacccaacccacaacatggatgggggctgaagctgaactccaaggctctgatgtgctgagcaaacatctctctcgagttttatgaagactgtacttgatctaaatttgcaagaaaaaggggcaaaagtgtgtgcatgaaattgctgctggactacatgtcttcatctccttaaatttcatgaaatttgcttttgttttattgttcctttagatcgatgcaatgtggttaagtgcctgctcttgtatttgtgctagtggtgggaactggggatggcatcatttttagcataaattagatgagaggaacgtcctggcgccgtaaaacttttgatgtttcgtttgaactctgtagttttgttctctaatggaaacggagaggctttaattacctctttctctgaaaaactaaacatgtacatcgatcaaaggtttagaatttaatttttatttaaaatataggtgccatatattttagtacgaaggaatatattacactgcatttttattgttttctgtaatggcatataccaccatctagctaatgtattttgccagcacgagagatatctcctggagttaaacgtaacgtatggtaatttctagtagacatatttttttgtagttttgttatctcaaggatattgccgtgtcagctacaaactcaagcaggtaatttttttttcaaaaaaaaaaagaaaaaagacacaagctgatccactcatcaggtttattgccacaccctgccttagcaccacctaacaatgacaccggagagggtgcgccacaggaaatcggtgtgaaccgactcccacagaaccacgatgtcgataggcacaagcactagtttcggcagtactgagatgcatcattccaataaataaactatatcttttggaagtcacatattcggaacatgactgcaagctctataatcgataattagagaagtagcagcgaaacttagcgcaactagacctaatccacaagcaaagatttagtattaggaaggaaaccctaaccttcaactttacttttgtcttcccaggggagggggaaaactacaatgggtggttacatgcgagtatgtcggcttcaaaggattgatgggtttgtttcggagacttttgaaaacattttcgaaacactaattttggatcgaggtgattggtaactccgttaacaccgcaaatcattagatgagtttcccggaatgcagaagggagcataaggaaatagattttgtagggaagtaggacataaagtgtttatctatgccaagaaaaggccatttgaagccggcccagagagaaaaaaatggaaaaagtttgtccttttgttctcccaaaaacggcgatcaagtttgagaaggagatagataagttccttgtagtcaaagcttcggaaaacctcatggcggccgaccgacgcggagtgggaacttcactactactgttagccaaaaagacgccaacagaaatactataattacattcaatcgctatttttttttacagtgaaaccaatgtggtgcggatagcctgatgtatagatggccaaagggcccgcctggcacagccctgcccaggcacggctgggcacggcccagaagccatcgggccggcacggcccgataggcacttcgtgccagcccatgggatgcacctcccgcccaggcacggcccgacgtgccatgccggcctgaaggcatgggtggcccatcgttccttttttaaaataagtctaattttcttccctcctctttgggctatttcatatttatagctaaaataagtctattttccgtccctcctctttggtctgacatatgcatagctaaaataagtctatttccgtccctcctcttcggctgacatatgtatagataaaaaaaagtctattttagatccctattctttcatccatggaatataataggctgcaggaat

SEQ ID NO: 47112 - DNA, 2717 bp, Oryza sativa
gtctatttttactcccctattttttgtgtattgggccgagctgccggcccatcgtgccgggccggcccaacgtgccggtggaggggcccaggcacggctcggtggtcaggccgggctagcacggctcgacctccgtcgggccgtgccgtgcttgggccgggccaaaatgccgtgccatgggttgggccatcgggcctcgggccttttggccatttatagcctgacggcaacaattttttttttttttgagaaactgacggcaacaatatgaatgagtgaggagagtggattctaatctcgagggaatatcctctcgttatttgcatatcattcaaatgggttatgatttttgttaaaaaaaatcaaaaaatagattaatatatgataaatcactcaacggcaatgtatttaacctaacatatttgatcggtccaaaatcaaatctgtacggcaaaagccaaaggtgaaaaaatcgtttttaaaaaatcacaagatagatatgtagcaaatttgtgctctaaataggtgtttggatcgttagttttcataataaaattcattggggattggataaaaaaaagaaaataaaagtcctccacaacccacacaaaaaaaaaaaatcgacacaattaacagtaaattcgggctagagtgtttttgatgacacgataggatctctaacgataaacgtgacggttatttataccctgttaaatcttaacagaaaacacagacatacattcatctgttacgatcttttatataactccgataactagagccaaccgcaaggcgcaagcaactaatcaccggcgacgttgatggccaccgccggcggcggcagttacccgcggtgggtgatgcttgagcacaaaggtcacaacgtgaggagcttgaggaagcactccgccgccggctacaccggcgaccccaagacggcggcgagcgcctgcaccttctccggcggcccgtgcgtccgcgtctcgttctgcctcgagccgccaccggcggcgtcgcggatgttcttcgacttggagcaaaaagatctagatgcctccatgtttgtcgccgctgcccacggcgactccgtgctcatcaagatggaatactacgacgagcataacgccgacgacgcgctcgattacttgattacttcgtctacaacgccggcgacgccgcgcggccgccgtcgttgacgctgctgcctcacaactatgtcgatgcgacagagcaggacgagccaaatccagacatggatgtacgtgccaccggcatcctgcgccgtggcgacgacgagctcgtggtggcggagctcatcaccaaggggagcgacgacgacatgccgccgaacgaggccaaactcctcctcctccgctccggcgagtggagcctcaagcgggcaccgatcatccaccgcgacgacagcggcggctagggcgctgagctgtcagcgtgggaaaccgacatggtcgtccccgtcggcgaccggcggctgtgctgggtcgacctgcaccgtggcatcatgctctgcaacccgttcgacgagagcccccgactgcagtacgtgtcgctccccgtcgagccccccaagagcttcgacgacggccgcagggactcgccggcgaccaaacgaagtgtgtgcgccgccgccaccaccaccggcggcggccacgcagatgctagggaaatcattttgctgcttacataattttgtgatgcaacaggcatactgattcgataagtgttccatggattagcctaacaaacatctgttgatacattggcgcattgctagcctgtggcttacttactgctactcctagacaacaatgtaatgccgtgatacgcatatacatatgctgagaaatactccgtataaaaatgttacccccaaacagcccatggcggccaagccatgcggccagcgtccatggagcaaacactggacgccgcgtcatcgtggcggaggatttgattgattcttgtcgccgcgttcgggcgtcacgctagtgctggctgtgctgctgctaccggttcgttggagagaggagacgagccaccgagacggagcccgaggaggaggaggctccctggcgcgttcgcgggttcggtagagatgatgatggcggaggacggcgtgccgttggccgagtccgagtggctgcgtcggtggtggcggcgggactctggcccgctcgaacaccggccggctggtcttgtaggcagatggcctcctatgcacgtatagcaaaggaggaaaatgatgtaatcttgcgcatttgtcacatgtttttcattcagtttgttagctttggattctgcggaatcatcttgggcagactggatctggagagaatttgatgggcaatctttgatgaaaaccttacctctgggccagcactggaactctatgcaaaaactcttacctgcccttcaaaatctgacgagagtaaaggttggagatgggcagatggctcgaggacttctttctggcatgaccgttggctaggtattcagcaacttgcaaacctattcccggcactctactcgcactcaacaagcggtcatgcaaatgtcaaagaagtgcttagcaggggaatcttatcgtttttggtaccaagactatcgcaagcagcccaagctgatcttcataatttagagaatatgcttgcagcttgctttctgaatgaggaacctgacatcaggcaaaatgaggg

SEQ ID NO: 47113 - DNA, 2320 bp, Oryza sativa
tagcttagtttttcagttctgttttcgtagaaaactagtaaggtgcccgtgcattgcaacgggtaattttattaagtgaaaagaaattgagtgaaaatttgttaaactatcagaagcaatctgtcagcacgtacatttgtaatatctccaagcggggctgctcatatccaaacagattagaacgtatttggtacgaaacacctaacaaatttctacatgttaccatattacacatcaacctgaaacagttgaggacacaggagtagccattttggtcgtggaatcttgagatcaatgatctgaaagagttgaattaattcaataataataaggtgttgtgttcaaaaagtccaaattttgataacaatagatgtgttaatttataaaaacctattgattcatccttcctccgctttctggaatcacgtctcttcttgtttccatcttcctttagctcttttgtcaatgatgcgtacctctctctagcacgcttcctttttagttcagccgtactgagattagtaacatcttcatgcatgttgggtgtaccgtacgacaattcggctttgtctgtacatggtagccgcacatgcctaatgacagaagcgttattttcattgcctgcaccacaaaatcagaatgctgatgttagcctaaaacaaatatctcatatattaaaaaaaaaagaaagccaatataagtatgataccaaatccaatagttgaggctctctgaatcttagatgtagagttcttgttgatctgttgatagttctcacggtcttttggaacattgatttcactttggataaccgcggcatgcttatttgtcaacttggcattaatcacattagttatatccacaaaaagacctaaaggaagagtgtacgtaaaattaggaagcaaaaatatatcaattgagcaatggatattaccatggctggatggatgaaacaatgacatgatcttttggacgatattggtgctgaaccgccaccattgttatccattgcagaactaacttgtttagaagttaaccgcaactgtggaaaatcattgttcggtttcaatttagttcttcacaccaaaactggcacctaaaactgaaaatcatacatcatgatgtggggataatgacatgcaaaagctaccagcaaagtagatgagtagactgtactgcagaaaatgaagaaaaaaacacatggtgcatgtactgaaataggtaagatacattgcaagaatgcggatttctgaacttgaactaatgttcagaatgtggttttcaatactacaaaatattcaagataccattcttataatagtattcaaatttaatgtccatggtgttgtgcagcaaattataatgttgtttgagtgtccttaggcaaattagtgcaagatttgcagatccaaaaatgtagaggttaagaagtgcaggccttcaagttagtagtagtagattgcattctgtatctttgctacctaactaaattgtacagataaaccctattcagggtaataggttatttcagaaatacttgccgcaaccaaaattgtagttactcaatccatgatgctaggatgcctagtgatgaaagcaacacagcatgcatggattggggatataacatcagaacttcaaacttattacatttttttttttaaaaaaaagaagagcagagtccagatttgagctgttatctgaacaactccacaaaccataccaaatgtcaagaatggattaaaaaaattaaaaaaaccagagttattcagataaagggatgatggtctggataaaggaaatgtccttcattttgtcatcattttatcaattttaggtcatgttctccaggcaactacacaacattgtagtgcttctatcccgttagaatggctaacggagtaacagtctgaaacccctctaacaaccaaaccacgataaattctgaaccatgatatcttaatagataaagatttgtgatgaacgagagcaattgtttttattctaaattccagcacatgcaaaaaaaaaacaggaaaaatattatcttctcatatcaaccactcaaggaaaacagggaaaaaagagagaagaaactgcttttaccttcaattgaggtaatgatgaaccaaggatgtcgaccggaaacaacaggatatggacacatgagatctctgatctgcggggttatgcatggcgatctgctgaacttgctcaaattagcgaaatttctgagaatcgaaaagaagctaagacgtctattttcagttatttacttagagggtagaaaaggggaatgtaaataaaaatatattagcct

SEQ ID NO: 47114 - DNA, 5478 bp, Oryza sativa
ctagtaatttgttttctcatccttctccaattcatggcgttagtaaatgaagtttatcttccaaaaaaaatattgatcaatggttaattgggccagcttgttaacatgaaatcaagaataaaatgatatgattggccagccttaatacttaccaagaataaattgttatgatttgtgaaatgatccatttcctatgacatttctcaagaatactaatctacaatatggctgccattccatgaaagattggaagtgaggaagcacctagaaagagaaaaaccaaatcatgggacaaactcttagttccaaaaatgcatggttgtaccttcctgatatattttttttgcaggactcttaataggatttgaacaattgaaaagccatgcgtgtacaacaggaaatgtaaattcagtatgaaccccacaatagatacaaaggaagaatctgtactacagaaacacctctgaactttttgaagatacaaacgaaaatatgaattcagtacgaactcagtaatagatcataggttagctcttgcaaagtacaagtacaaagaaaaatcaaaggaacaaagatccctcttggaattcagaagatctactcctatattcagaatgaccaataataattcaaaaggtagatgtcagaatcagctttttgtacaatttataataggggtaaatttgcaattgcccctttataatatcagtaggtttcaataataaattatgaaaagaacatttttttttcaaactaaacagtagaccaccatatttttatccaaactgaacagtagaccaccatatttttatccaaactgaacagtagaccacaatatttccatttcatctttccccgggacagcatatgtttcttaaagatgaagtgatgaaccgacattcatttacacaaatcgcaggtaaaatctaaccccgacacattaacttgcaaataactacaaaaggtgcatgcatgcatgtagattttactctaatctagactacaaaagtgttgcatctgcattttctttcttaaaatgctctatttttcgctgaaatagtagccactggcagtgaggcatgttatgtacactcagccatcaatttcaaccagaaaattatctttctcacaagtacatggactcaattgttacataaaaaatacacaattgactgtacattaacagaataggatggtacttaatcatgcataggtggtacaatagcaaacaacagaaacagatcaataataacataattctgacccatattcttctaaactgtttaactcccttataaaaggaacaacattgcaggaagaaagtgactcaaactttgagctatcattgtgttgttatattgtgatagtatctgtccagccagatggtttatatcgggaacaagatcttcctattaaactttgaggaaaaaaaatcatatattggtacacagaaagttaaacaatttagaaggcaaacacataatacacagatccatgctcacttcaaatatgaatgaatagaattgcccgcatagcaaaacgattcacagaaaaaggcatccaccacaagctttaattttctatgtggagatatacattcgaatgtggcaaggtttaattttgtaattccacaacaagctacagttagatgatcaccttattgataagcccatcgtcgatcacagaaccattaatgctcttgaacagctcgaacaaagcctccacctcactaacgctaactacacatccaagacaactaattcagaattttcagtacgcccatcgagataatcagaccggcggccggcgggcttcgtaaagctttaggcacattacctgaaagggtttgaggcacattacctgaaatccgtcttcggtgggcagggggcgacgggcggatggctaggggaggttggaaggggaggcggccggtgatggttaggggagggatgagagcgcgcggaggagatttgcgagggcggcagcgagggagcgtctggagagtaggccggcggccgtggctgctgaggaggcgatgcggcggcgaggtgaggaggcgacgcagggaggagggcgaaggtggaggatcaatccgatgcgaggtggaggcgcggaggagattggagagggcggcggcgattgcaggtctggagaggaggccggcgggcatggctggtgaggaggcgacgagacggcggggcaaggaggcgacacagggaggagagcgaaggacgcggcgtgggggaaggaggagtgggcgtggggaggagatcgatccgagagaggagcgagcgcgtgatggggagaggagtgatcgcgtgatggataggagatggacgattgacgccgttggatatggcaattggatggttgagattacgcgtgtctgtcagacgcgtctgctatgtcaggaatcaataccaccactacggattttttaagtagtagagagatggagccagaatcggaacgtgggatggtgcggtcagtagtttgatccaataaaattgtgcatgtaacaacctcctagaacctagatggagagaaataaaaagaagaagaacacagaaaatgctgcaattagttcgcagccaaaaaaaaactctgtttttggcactctgtttgttgctctgcattctgcattcagttaactgtttatcatccgaaatattcagagttcttcatattagccactaaaactgtgagtgaaagagagggagtgatttctctaagcgctttctaataaataagcagctaaccatttacacatgcaaagtattttttaagcataggcaagaaagcgcctcagcatgcaagaaaaaatggttgccaaatttgccagatccgcataacgcagaacacttgtcaggcaaaggggccaacactactgctagagcataaaactcatcggctcgacggcgattgccgcggccgcggcagccacccggcgagtagggaagcggagaccgcggaggtggaggcggagcgaggcgcgggctcgtggaagatggagcgaggtgcggtgccggaggagcaggaggccgcggcggctgctctgaccgcgagctccatggatgactgcgacatggaagaagaagtcgaggcaggggttgccagtttgccacttgccagagtcggcgtaggtggcggagtcgttctcggtgcggccttccatggcttcggcttcgatccagaggtcctcccgctcctccgatgcctattagcctatctgtcaccgccaagaagctcgttgacggttgccacagcgcttgcctccaccttcgcgtccattaccgcggcgcccggctccgcctcctccgccagaatcctaatttgttcgcgcgccggcagcgcgcactcccggtccacatggcccacgtagggcgcgcgcgcaatttttttcgctaacctatcgtcgttttctttttttttttctcgcagtttgatgccgtatgggtaggagaaaaaattgtaattagttttagtagtgattagtttcctatttttactagtgattagtttactagtaattttttaatttgaacttaaaaattgttaaatttggacttgaaagttttcaaatctcgagttgaaagtttttaatgtcgagttaaaaatttttaaatctcaagttaaaagttttcaaatttgaacttgaaagttttcgaatcttgagttgaaatttttcaaatctgggttaaaagttttcaaaatctgagttgaaagtttttaaatctaagttgaaagtttttcaaatttaagatgaaaagttgaaagttttcaaattttgacttaaaaaattcaattttcgagttgaaagttttcaaatttgggtttaaaattttgaaaaatttgactacagatataaatttcattttcaatttgttagttaaaaaatctcacgaaaaaaagaaaatcctaactactaccgtcattatctctaactagattagttaactgccttaagtgtggaaaaaaacgtgcgtccctgacgcgtacgcgccgactaggacccccctcctccgcgcccaccgccgtggtgcccgcctacgcctggctcgctgcccgttctttcctgcctcgccctgtcatttttgaaaacaaggagaaaagtgagaaagagagagataggaggaagtgagagaagaggggagagagatgaactgttgaagagaggggggagagaggaggaagaagaggagggttgagaatgacacatggggcttacgtgggccccaccatttatatattttttttgaagctaatatgtgggtcccatgaggtttattattttttcgaatcaaattaccacgtaatcgacatgtcaatgccacattagatgaagaccaaagtcaaattagccacgtcagccaaaaccgctgtccaaaccaccgagtgatctcatctgcactggttttgacagttgagggacccgttgtatctggttttgaaggacgaaaattggattctttgaaggatgaaaattggattcgttaacaagttaagggaccttagatgaacttattcctctggataatgacaaccttacccttacccgattgcatccggcccgttgttcgtatggcgtaatagtccgaaagaccaggctgcagaaggccgtttgttttaatgggccaaaatatatcggcctttttcattcggcccaagaagagagagagcgcgtctaccggtgggtgcccccccgcaccgcaccgaacagcccactctttttttctcttcttcgtcttcgtcttccccgtgccgcataggcatagagaggcttctcccccccagatccgatccccgcacagagcccagatccaccgaccactcccccagatccaccccccaccggcggccgtgcagcggcggcgtcggcggccatggagaagccatgcaccctcctggtccacttcgacaagggctccccctccatggccaacgagatcaaggccgacctcgagggcagcgacgtcgccgccaaggtcgacgccatgaagcgcgccatcatgctgctcctcaacggcgagaccctcccccacctcttcatcaccgtcgtccgctacgtcctcccctccgaggaccacaccatccagaagctcctcctcctctacctcgagatcgtcgacaagcgcgacgtcgcctccggcaaggtactcccggagatgatcctcatctgccagaacctccgcaacaacctccagcaccccaacgagtacatccgcggggtcacgctgcgcttcctctgccgcctcaacgagcccgagctgctcgagccgctcatcccgtccatcctcgccaacctcgaccaccgccaccacttcatccgcaggcacgcgctctccgcgatctccgccatctaccgcctcccgcacggcgaccagctcctccccgacgcgcccgaggtcgtcgagcgcgcgctcaccggggagcaggacgcgtccgcgcgccggaacgggttcctcatgctctgcgcct

SEQ ID NO: 47115 - DNA, 1113 bp, Oryza sativa
tgttattattctggttcaggaatcaaattatccaaatattctgcatgcttttaaaatttaaaggtaataattaagcagaaaacttgattctctgtaagaatatttggataggcttgtgtagactattctgacagaaatgggcatggaacattttgtttgtacagtagagatttaatgttattgtttaatatggtaacacatggactgacgtgttactatgttactgttttttcctgtctagtatttgaaaagatggcctgcggttctttcttcactaaaacatgccattcattcttgcagggaatgagccaacttgagttggaagatgcagtccaagatgatttgaaggctgctactggtgaatttacaaaagatgcagatgacgcaaacagactgaatcgcattcttcaactaacagggttcagtgatcctgtgtatgctgaagcatatgtaactgttcaccactatgatattgtgcttgatgttacagtcataaaccgaacaaaggaaacacttcagaacttgtgcttggagttagcaacaatgggtgatctcaaacttgttgaccgcccccagaattacacgctggctcctgagtcaagcaagcaaattcgggccaacatcaaggtttcatcaacagagacgggagttatattcggtaacattgtttatgagacctcaaatgtaatggagcgatcagtggtggtcctaaacgatattcacattgacatcatggattatatctcacctgctacttgtgccgatgttgctttccggaacatgtgggcagaatttgagtgggaaaacaaggtagggttctttctcaagcttcagcttttgcaaatgcttgttttacaagattctttcatgtattatttgcagctgctagattttcttcttcactgtgatctttttgtctggctcctctttattaacatattcttttacttctgttattagcttgtgaacaccaaaattgtaattcactatttgtgttatgaagaggtaacattgtgggggactggtggtgggttacttctgttttattttggaatgactttgtctagtaattctgactagcggtttgtttatgctggttgttgtcgatttgtt

SEQ ID NO: 47116 - DNA, 728 bp, Oryza sativa
attcctgcagcccatccagacaggttgttgtaagacaagttgagaacttttagagtctttatgttttctagagatgcagggatgcttccactgaaaacgttgtggtccaactctatgtcttccaaactttcagagtcacccaaagtgctaggaatatatccagatatattatttgatgaaagctgaagatatgtgagttgttttgccttgccaatgtcattatggaggggtgcatctagattgttgaaagataagctaatttgcactatggttggaattctgaagatctcctttggtatgctaccatgaagattattgttcgagacaatcaatacttgaaggattgggagggttccaaagcttggtggtaattggccaactaactggtttgagtctaaatatagttctcccaattgagacagatttgagaaagatgatgggatggctccagtaaagaaattgctacccaaagataccttttgcaaagttttgatggttccaagccattctggaagcacacctgtaaatagattagcacccaacgccacaataatcaggttctgaaggtttgctatacctgaaggaaaatcacctgaaagtttactttctgccaagtgtagctcctggagttgatcagaaaggttacccaacgaactaggcacatgcccttgtagacggttcccagtcatggagaaaacttgtagctcagtgcagttgcccaagctttg

SEQ ID NO: 47117 - DNA, 1600 bp, Oryza sativa
tcactgagtctcgaacccgggccggctagcccaccaacttttagtgcaagtgagacatggacgggctcatcttgtacctactacggaataccaatgcttgaaaccagcaaggtatgcattatctaaaaccaaagaaatatgtttgcaacctaatccagtccgcgtgctgagcttagcttttacatccagtccgcgtgctgagcttagttttacttggacatcatagtcaccatccaagagtcaaattcagaggatctcattccgaatttttttcacatgataacctggaaggcatgcttgcattatctaataataaactgattaaacaaaagcttgcaagttgcaaccctgattcaacctgcgtgcttaacctaagtttgttcggactccattgtcgccatctaggagtcaaatttcagagtatcatttcgaatcctctacacatgaagacatattctccaacatataaaatgcactagtttagtcattagcagtgaaatgttgacttgggaggaagaactagaagagaggcacctgttcaccacgatttccggacatttttactcgggtggaataaaataggcttcgcttcttaagcttctccgaaacgcggccatgctcctcctaggttagaacaaatcaccaaattaacaaaattccccaactccaaatcaaccttcgtcctctctttcgctctctctcgctctcaataaaaaaaaaggataagaaactccctgtggtgtgctgcgcgaaccgcgagctggagcaggcggcggacggccggagtccggacggcgcacggcgcgcggcgcgggaagaggccctcatccaggtgggtcgcgtggagcctgaggaatgtaggagaggctgtgtgaggagcagatgaagcaatgtcgaccaggagtggccgcgtggagccaagtactcgactcttgaggcggcggcggcggcggcgggggtttgccggagggcggacgggcgccgccggttgccggagaggaggttgggagggagagcagcgcgatttgacataaacccccatcttctattatataattaaaggaataaaaaaaaaaggagacttcacgttcgctctcgtggcctaaaaattctcatattaatcggagaaaaagaaaatacagagtccatatagaaatacaatttagaaatagcttaaattcgaaattaaaaaaataaggaatattagaagaagagactagagtccatatagaaataccattagaaaataacttgaattcggaattaaaaaaataaggaatattagaagaggagactagagtccctatagaaatacaattagtaaataactgaaattcggaattaaaaataagaaatattagaagtagagtatagagtccatatagaaatacaattaggaaataactgaaattcagaattagaaataaggaatattataagtagatatagagtccatatagaaatacaattaggaaataactgaaattcggaattaaaaataagaaatattagaagtagagtatagagtccatatagaaatacaattagaaaataactgaaattcagaagtaaaaataaggaatattagaagtagagtata

SEQ ID NO: 47118 - DNA, 717 bp, Oryza sativa
tataatggttgatcatttgtccatttattggagcatgtgaaataaactcttcctacatgcaatctgtagaatgtgccggaggtggacaaatttcaactgctgcagatgtatacagcttcggagttgttctcctcgagatattcataaggaggaggcccacagacacatgttcaaggatggattgagcattgcaaagttcacagagatgaacatccctgataagatgctgcagattgttgatcctcagctagtacaggagttgagcctctgcaaagaagattcagtcattaacgatgaaaatggagcacaatgtgttctttctgtgttgaacattggactctgctgcaccgattcagccccaagcaagcgcatcagcatgcaggaggcggccgacaagctacacacaatcagggattcatatctcagaggatactgaagcagtcagtttcagttgctctgctttgtctgaaactcactggagcaatgccttttcagtttcagttgttatgttgtctcaagctctgaacaatcctcagaagacttgatgttcatcatgtagcattgctcaatacttgacgcaatttagttgacatgaatactacttccgacttccaagaaaatgattgctaacctgtttccccacaacaatatcagctccaaaagtgacgttccagtattactgcttcccatgtcaacatttcttgactgctgcaatgt

SEQ ID NO: 47119 - DNA, 1615 bp, Oryza sativa
agttgtggcaaggtgaggcaaattgtggtagtgaaccaaacaacccctactctccggtcaagtaatgccgtcttcaacattttatgactatggactgttgactattgtgatcatcagccacaaaaactgaatcttttttttttcagaaattctgaaccattagcaactgtacagactgaatgtgtcttgcggcgggcggatgttgattaattgttgagtatagtaatccaggtatgttcctcaccgtcttacaatattaatatcatgatcacttaactctgtaatggtgacaaggacgtccagaattaaaaacaatacaatactgcttgattagccaaaaccattaaaaatgagagatttagggatgacgtaggtgatctattagattaaagaagctgataagatgccaatgcattcacactcttatcaatacccataaacgatcatggatgtcattagtaaacactgtaaaacatgatggcatgggtctaaattactacggattataacagagcctgatcgcatatgattactaaaacaaatagcatacgaagatatgtcatcttacattcaccggccggtcggttgcatcagcatcaggaagtccaaatgctagtcattctgtttcagcctaccaaccatgtacttctattaatttaagatacaagtgtttgattgactgacttgaacactgataaattaatggatgctagctgcgtgaatcaggcattctgcccaagctaagctaagtcctgtgacagacatgcgtattgcactattgcgcgttcgccattcatgagagcatatctgcctctgacctatcaggtaagttactggtatagtaagcatcttgttcatcaacatcttgtttagctttaggtgtccatgcagttgataattcatcaaactgatcaaataacttgtactgttgtcagtgtgctgtgtgctccatatttgggtagtttgttgcaatcggtttatttctctgtatctgaccctgtgtcactgatcttgcatattactcaaggctttcacttactctgaatccagctgaagaagaagcagagaagaaagcaatccgttcttcagtaaagtaacagctgaagttcagagaacaacaacccttcaggcttcaggtatcaacagttaataattgccaacatttcatcatcaccatctaaacaataatactcctttgtgtttttatttgtctatacacatgaaccagaaccaaaattggaactagccatgaaagctccttcagttggagagcttctcttggtgttcatagcctgctcttgctgtgcacatgtcgtctgcagctcgttgcctggaaatgagacagacagactgtcactgcttgagttcaagaaggcgatcagtggtgatccacagcaatccctgaattcttggaatgaaagcacccacttctgcagttgagaggacgtcttgtgcagggcgaagctccactccgtgtcacttctctgaacctgacagattgtggtttagcaggcaatatctctccatcaattgccaacctgacattcctaaagtctctttccctgggtaaaaattcattctttggagaaatccctgcatcactgggccacctgca

SEQ ID NO: 47120 - DNA, 1536 bp, Oryza sativa
  unsure (1)..(1536): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacggtagaggtgttccttctttttcgttaggcggaaaagtgctagaaatgtataggcgttcccacttactccatggcatattccaactcttttgagcagccctctattccaaacaacctctgccgcctctgcaattgcctcaaggaatcgttcttctgggaacacctggtaaggatatgacatagtatatgcagaatgtaacagattgccagaacgaaacatgcagccaaagcaggtggttgagatgagatgatctgagaatagaaaacaaacctgtgaagcctttgctaaggtgagggaaatgccaggagccccatggcaccagtgcacaaatcgatcatgcttatcctcctcagtaacagggtaattaccactagggaaccggttctgaatcatgtagcgcaaggttccctttacgcattccgtgtcatctttagtcaagtccatgtccagcaaaacatgcatgatcccagaaagtccatgagcagcaccccaatacttctcaccataccattcatacatcaatgggcagcctatcgtggacagtgttctaccatctctgataatatctctcatgacagtgtcctacaaatagttcaatagaatgatgatgatcatccatcgcatgtgcccagcgatcatccaacaagtatgaatggaagaatgacaaatgaaggcactaaagattgaactgtgtacttactgtagtggttggcggtatagtattatctccaaggtgcttgtttaggaaggtgcatgcccataggtatccagctcttccatatagaagctcatcaggtgatttactatgaattttgatctataccaggataatacatgttatgtcacatgaacatgggccatactaccatagataacatattgctttgtttagatggatgaactttcaagtgagtaaagagacatacttgggactaacattttttttctataaaacagtgcaaccgatcaaacgtaaaattgttattgcatactgtaataaaacagcagtaaaatttctatggttcagtgttgtttgatatgtggcttcttatttagaaacagcaatttcatttcttaggagctcaagccaagtcctgataattaatctatctattatattattaaaaaagctttgaaaggaggcaccacgttcgctgtgagggctagaaattctcacattaatcggagaaaaagaaaaaaaaaagaaaaggagagtccaagtagaaatacaatctaaaaatagctgaaattcggaattaaaaataagcaatattgaaagaagttttcatataagaacccaatacgagatttatcaaaattcaaaataaaaataaaatcaaatccaaaattagaaaaaggaaagaagagtccaagtagaaatacaatttaaaaatagctgaaattcggaattaaaaattagcaatattgaaagaagtt

SEQ ID NO: 47121 - DNA, 1648 bp, Oryza sativa
aataaaatttataaataactaaaatttgtgataaaaataaagactattgaaagaaaagaccatctaaaacacacaacgagataaattaagtaacaggcctataaataagtagagttggtggtggttgatatggtatataaaaattgttaatgaaacaccaaatagaatcctaatgacgattaaaaggagggatgtcaggtaggatgtgaagcaaacaagtaaagcggttgcctagacttctagaaagtaaaaagaaaaaaaaaccacattgataattattttcgatttttaaaatcttaatgacaataaaaaggagaagcagtgggcggggtgtataagagtatagttgcagagcctccgacggttgacggaacttctagaaaataaaaaataaattgcaataatagttatgttcgatttttagaatcacaatgaaaataaagagtaggcggcggacgagagctgcagaggggcatagtggcatcgtttgatgggacttctaaaaattataaaaaataaaactacaagtccaatttttaaaggttcggaacttctaaaaagtaaaaaaaaaacaatgataatcatgttcgattttaaaatcttaatgacaataaagaagggaggcagcgggcgagccgtagaggagcataatggcaaaaccgctgacggtttggcgggacttctagaaagtaaaaatgaacccaaactataattatgttcgatttttaaaatctcaatgacaataaagagaagagatagtggacgggagtataatggcaacgtttgatgggacatctagaaattataaaaacgaaacccaacgtgacaataaactctaaaaactataaaatccaatttttaaaggctccaagaataataaatagaaatagtgatagattgagcaagcaaataaagaaggagatgacataagaggtagcaactggtgtgattttaaaaactatgtaattagaaacacgaggatgataaggtttggtcttttaaagtcttaacattgagatagctctttaataaattttaagtaagattatacttaaaaaaatattatttttttctgctagccgcgtaattgcgcgggctacccagctagtttataataagccaaaatagccaatgctcatttctattgccattccagttttaactgagatgaacctgcacctatagcatcatccaagtcaaactacaaatttatcgagttcagaaggctaatcatcacaatcacgttataggcatcatcagcagcagcattttacgcttaatcacctccttaaacgcgctcaggtaatgagcaacgccagcttcatctccggcgtgtttggccaccaccgcaccgagggcgcagactccagctcgcccacagatgaacgtggcgatcctgcacaaatcccccaaaccccaccgagtcaccaccttaccaaaccaaaccaaatcaaaacgctgctgcgcccgacgaagcggctgaggaacgcgcagattactcggcccccatggatgcggcgtcgcaggcggccacgatctccgcgcacgtggcgaggtccgcgcggtcgccggtgaccaggtaggccctgaagagcaggagcgccgtgccgagcgcgccggtgtacaaggtgaagtcggggctgcagga

SEQ ID NO: 47122 - DNA, 3049 bp, Oryza sativa
gatcccatcaagttcagatgtccagaagacgaacatcaaagaacacgaccattgttcctagagtcccaaccagaaggtatggtttgtagactccgctggaaatctggtttgaagcgattaaaatttgataccgatgacctgtggaaaagaataaatattataaacattggcattgcatgtgcacaaaccaatttagattaaatagaggactaatattgtggagattaaaatcacctttgaaatccagatgatttatgtgcaaagataccaagcatggatttcaaatttcctagagcctcatcagcagcctataaaagaacataatattaagtaaaaaagcagtgcaggaataatgcacaaatgggcgcatacaaagttgtctagtggaagagacaacatctacacaagaaccaagttgagtctgtaaacatttaacatgtgtgcacttttaatattttctagaggcaattgctgcatctaccaacgtagtagtatctttatcattactagaagttttaaataactattatctttgatgttgtcaatgttgtacatgttgtatgttttttcctaaaacaaatacaagagaaaggcagcatcttgctgtacacattgaaaaatgaccctccttataagtcccaaagagaaaagaaaacatttaaatagttactatgagtccaaacagctagtataaagattctttactccacaaatcgaacttagttaaacgaaacaatccctctccctctgctcatagcaaggcagaaactcagacctcagggtttatttgttggttttgaaactttaacaaatgaagtgatcagagtaaatcatttcatctatcttatctatttacaacctgcagcttagcttgttcccatgttgctccaactccttttcccaggatttgaccacctatttcgacctgaaaaaccaaatgcaggtaaacgaaacatgcaaactcaaaaagttctaaaaggataacagctcttgacaagacaacaaaaggaacatcttatactacttccattgtattagtgttaaagggcatcatatcacatcaaatacagattgatcaaagagatcttttgatggcctgtaagttgtaaagttggtgcaattttagttttctaaacaacctactttagaggttaatcatgtaccatatagaagttcgatggacattcattcactgaagtactaacctgagcataagcttctttacctgatgaaccacgaggacgtgatggctgctcttggaaaactaagttgtaaccctcaaccgtacactgcaatgcatcacaacatagttcagtaaataaattgcactcgtctaaaagctgataattaaggcagccacttacaagctctttgagagcagcaacagaaccagcaggttttcttaaagtatcaactctctcgcccatgtatctagactcgtttgaagtgcttgcaactggtgatgtgtcatctctactacctcccgaatatctgaatgagtttgaattactactaaaaccattctccttcagaatcatcatcttatccggatcagacgttagaaatttttctgcaagtgaacatcattggccaatcaggctcaaaatattttacatgggaaagataccaaaacttatataaagctttcatgaggatttctcttggtatagtgttctatattttctatataacaatttgaaaagatcaatcatgaggccaaatggaaattggttaaggacagatatatatacaaataatacaaaggcagaaaataattcaacaacttcagcagagaatagttcagagatgccaagtcagaacaacaatgttttccaatatctcgagacctccatgataccttagaagttgcttaaaacaaaataaccccatgatcaagcaattttcacttgtatcctcgagagtgttctcgtgagatgatctcagtagcggatgcagaaggcagcaaaggggattcgcacacacccggcagccgcacgacccattgcaaccccacccccctagcacctccattgaacgggggctagggtagataatccattatttccagcaaccaagcctattaatccaacaatgaaccaatcccatgaaatccatctgtaagtctgtccatagcaggagacgtgccaggggggcaaggagcagcgtggcacagtgtagcagtatgactttggcaagcaggaagcaattcgtgcttaagcagactcaactcacgcgttaaacatttgccttaattccttaatccaagattccttgtgcaactaattatacacaactgcattataatttctaattcatgtattgactattattgcatttacatttatctattcgtagatttgcaacaattggcgacatcaatattacatagtttgtttccaattaagtctacaagtagtactcctcgtgctaatgataatataagtcaactaataaaagttatggttttaatttcaatggcatcatggcaaaacatataaataccatttactttgatgataatcttgtgtggtagatttaattaactagcacccgctaaattttagtactgtgttcgccattgggtgatcatgtaatttgttggcagcattattgtcagatgtgctatgtgtacctctctgtcttaacaaaattcaacctggacttctctgttgacccaacaaaaatattaaacaccatggccccatactttagttatacatttggcatttgccacgcagaatcaagaaaccaagaagttctcaacgaacttacctgccagatttcttaaggacatattaacagcttggcgttttgctgcttttcttgtttttccaattccttcacctaccttttctcctaaaatcctaacctgaaacatgcacaaagaaagatatgactaaacatgaagcaatcttataagactgcaagaagattagaacaatttgcgtgaagcaacaagttcaaataatttgggaaaaaacaagttcaaataatttgggaaaaaacaagttcaaataatttgggaaaatgtaagttaggccttaagcca

SEQ ID NO: 47123 - DNA, 7762 bp, Oryza sativa
tgcatttagacaggtacacaagtactcaactctagaaatatgcaagacaagagactagtagattggcttatgctaacatcttaagcttaatgcagcgagctcaacgggaagacatagatcatgcactaccctatgcagctagtaatcttcagaagaactttagaaccatcagaggtaaaacaaaacataccaggaaaagatctgtaggctatagatgaacgattcagcatatgatgatcctcactgtgaggcagctgaataaatcaggcatttgtcaacagattgtccagatatacttcattaacaaacatatattaattgaataatcgatctggtggatgaccactgacctgtgaggggtatctatggatccgacggttatatctatcagaagttataagattatcctcatcaggaaaatacggtggattatgtggttgctttttatcataatttatatcatcagattctaaatggaaccctgttgaggtcctatttaggcttcttggattcatctcatcctctacatgtgaccaattcccatgagattgcactggcaatactgaggtctgtacgggtgatcctgcaggacagggtggtgcaggatctctcgtgtcttgaccatgctgtaatatgagaagccttctccttgtgtccggatccaactcagattcaggaacctcaccctcctctctagctggagaactttgcgatggatccacaggagcagattgagcaaccggccagcttgaaggaggctgaggaccttgatcatattcaaaggaatcatgcccaatgatggtgcttctggaacagatgatgtaataagttgctggttaggggccacaggcatcacatcagcattagttggtattggattcacagcttgaacactgcaagacacttcctgaaaatagtgcatatacatacgtaaaaggtaaaaacagtagtcattgctaagaaacatgataatataggcttgtaattgatctcagcattttttttctcacaagacgaccagtcaacccattggagtaacaacatagtcataggggcatagctatagcattcgcaattggctggtccaacgaaaaggattaggataacttaatacaccctcttgttcacttcaaataaataaatgatttatgcagattaagatcatgtaaatagagaaacactatgctgaacagtataatatattaaagtattgaatgagacattagattgatctaatgccccaatagtctattgcaactgcatattcaaacaaaattttataatactgttgaccatgagattttgtgcctagcataattcctaatgaacaaaaaaatacacatgaaatattaaacagtgtattttttttgttccaaaatgcattgtgcaaaacctaaaaaataactagagtatattattaatatgcagcatctaatttaggaaaagtacatcttggtattcagtttctattcacatcaatattaaccaagaagaacagggtagtgaactaatggtttgtagaagtgaacaccttcaatctcctctcaacttctgcatctgccataccatcaaaagcaagaggatctttgtttacattcaaaatggcagcattctcgtcctattgaagagactgagtgtaagttggcagttactagggaatcgaacatgcattttacaaagtttacctcggtaatcaaataattgccaacatcaggagcggacggaaaatcatttatttcgtcctcgtagtgaatctcgcttatccgtggcagaaggacctcatcaaattctctgtcaattaaatcgtaaatttctgtatctcaaaataattcacacttggtctatggcacaataacaagaaaaaaaattgtgtggcagaacggagtatattaaatttagctgggactacaatgagtcatggcaatgaatttacttagatcacataggcaaagatggatatccttacttgaaaaaaccacccctgacattgcatgcaacatttctagcaaagcagagaactggaacagagaagtttgcctgatagttcaagacaaggtaccctcaataaccaatactaaaaaatatatatttgtgttggtgtaaagtacagataaaccttacctctgcctggggagagtaatatggagaaaaggcaggaacaacgtgaaccctacactggtctttctcatcccaaactttcaagcgatcatcaatcactagggccatttctgggtggcaagacccatcatggaatacattcagcagagactttcgagagcctataagagtggtgtagcattaacgtcaaaagatggaaaattccaagacattatgttcatgcacatggaaatttgtatgaaggaaattagacaacacaaaacattgattgcggtgtacaaaatataccaaatgacactatattcctttggtagttgtgttgtttgaaagtaatagtaatgctaacacctaccagatttaacacagacaagtttgtcagtaagttgaacagaatttatcattcttgaatctggatcgagcaacctccacatttccaaagcatagtccctctcagccattgtgcacacatatacctcaaaacgtttgcgacctcttgcaattaagtagctccgaagatcctcccatgcaggcctcaaccgtaccagaacactggtatctcttatctaattaagaaaaagggaaaatcaactaggcagtataacagcatggaaacatggaacatggttgtatcaaagctgaatagacgggaagtgcttagcgctcaaaatatcgcaataggagatcaaattttcagttgccacaccagctaatgcaacttgccctcaacagtaccaaccactaagcaaggcttatttgccaattcaatttgagtcacattaattacatgatttgtaatacattaagaactgacagcaccaaaaccaaaaggttgctatatttttcttttaaaaagcagtgccaaataaaattagtaaaattagagtacaaaatagatttaattgagttatgatggtaaactcaatcaaagcacatgatgcaaaataaagtgaattgtggtatttcatttttatgttaatcaatgtaacagatgtagagacaacagacatctggcatcacatgactctagaaaaaggttgattgaagaaatacataccaatggatttatacgcgtcaggataatatttttctcttgtaatcttatgattggacgtgtcataggctgatgattatcaggtaaaggtgggataacctcagtctgtactttataaaccttgccaccatcaataacctgatcattttctatatactgctttaggatagacttgtcttcttggtacctcttgatctctgccgacataccactaatatgttgaggatcaatctcgttactcaactttctctgaagtgcatcaattctgtcttcaaaggaccgtgtggtattggcgacaagcaatgtttcatcaaggtcaaacacaataccaaggcaacgaagattcaacatgctcaagcaagaattatacaagcccgatggcaccttatagccccaaaaacaagcaagattcggcaagtttctcttggaagtcattgccactaaatggatctcttctgctcctagaggaaaaacagcagtctgcaagcaggagagaatgaaaggaaatgaaaaggattaagaaaaaggagaaatgttcgtcactaatacaaaatgcaatcatgtaaaaggcatggcatctagtacatttgttcacatacctgcatatcagagtaacatccacaaagtagtacagaaaataaaaggtacaacagaaatgcaaaaaaggggatacttgttaaaaaaaaggcatgtgtggattaaaaactctatatccatccaaatcttaaaatagcgaaatcaataccaggaatatttatagcactgtcctgaccacagttaaatgctatttaatccaactatgtaaaggaaatattaggccgaaaatagtgtgtttcttaatatagatgtaattatcaaataattcaagtggaagcaagaaacacattaagttgctagcagatgagttagattaatgcgttcaaattattcaagtaaccttcactcatccctcaaacaatgtctttcaatacgcagagttcagcagttcacggttcatgatcaattgcagcaatgaactcctgatagcaagtgtgtcaagtccaaagtcaagaactattgaagaaaagcaaattcttcgctgcattgggtatgtttcaacaaccattaaaagtgtcacactcaaaaatcaaaacttctccatttctgaaacatgaaatgctgttcctgaaacctctgtcattcaacagcatcaggccagattctgtatttcgattagttcaattattgaaaattgagatagaataaaatcaagtccagtacacacaataatcatgaagaaaagtgaattctggaataggttccagtcagtatcattagtcatgtcaccatcgttgtcaaattacttgtccagagataaattaccaataaatgtttcagggaaaaaaatagactagttctttcatgtgctaaaaaactatttgctgttcgggtaaacttgaccatgtaaaatcaaatgttccattcgttcgttcattcccttcttttattatttgtctgtgggtttcttgttgggagtaattcatgtacctttccgtccctgaggcaagcggcgtgcatggcgacgagcggcggcgggggctcatccgcggtggccgtgggcctggactccatcacgaggcagcgaccgcccgcggcaacggcgtgcagcacggcgagcggcgggcaccgctcgctgggcggcgacaggtggtccacccggatctcccgcgcccacgccgccaccgccaggtccgtcccgcccttgggccacacctccacatgcccaatggaggtgctcccgtaataaaccacggatttgatcatcatcatcaccatgtcctcggatcgaatccggttggggttccagaggcttccaaatccttaggtccaaaaaaaaaatctattccgcgccaccggtcctgactcccggagatccgtaaaaccggtgggatctgttcctgtcaagcgtccgcgcggggatgcgcgtgtgctctttacggtgcctggtttgcttcacatggcgttcaaattcctcgccgattccgggccggaggggggctcggcgccccgggatgcggcaatgacggcggcggggagctcgggtaggaggggagagtgggggagggaggccgtaggggtaaaaaccctaggggtgggcgtttgatacagctctggtctggtgtggtgggggaggggtgggggagtggggaggaagagcagaagcaagacgctttatttagaagctagacgaggcgggtggggagtaacaccagtcagccataacttcggctgtgcttcactggttgttgtcgcttgtactttcagccgttgctgtctccccttctccaccgcttgcgcctggtgctggccgagagtggccgtgagagtggccctcatttttagggtccaaagtccaaatataaacttgtctcctacggagattagcattgtggaagggtgtatgttttgatttttcttttttacttttaatactatataaagcatcatatatattttctataagtatatctttctcgcgttacttacaatcagtctaaggtaggagggactgatgagaaaaatgttaaagcgggatgagcctcttttgaaatgctggtgtaagccatatttaaaatgaaggtaaattgtattggtgataaataaatttattagataatacgattttgtacatgaacctgtaaaatgttcattttgatacacgaacttatccagtgtatcgagccgtggcaaatggcatggcaagattaattttaccaagttggacactaattatgacatttgcatgagacatgttatatttgtaaacttggtttctactccctccgtcccaaaacagtaacttggtgcacaatatagtaatgtgaatttggatggaatgttcttcacatcccatatctagattcatagtattatgttgtgtctaatatatgactaggttttctatatttgggaaggaggaagtacattattcttcttactttctacccttgcattattcattgattttttatgccttctaaaaaaagacatggctatgcggcgtccttgtcacatactcccactgttcaccggcgtccttgtcacatacttccactgttcacgtttgatcgacgcctaagtaaaacgaaatagtcaaaattgatcagcacattatcctcggtggacgcatggttgtttggtttccatgctaatttgttggccattcaattcgcatgcaaagaggctggtttgaataaaaatgggatgctcacatacaatttttttcttactaaattgttattactaacaattatctcaaccgtttgatttaggtagatgggagttatgaaaaatctagatacactcgtagcataacacatcagtgttagtaaaaatttagtaaaaaaaagttagtacatatagtcttttcctttattttgcatgtaagaaactgcagcaaatactcgaggcttctacgatgtggactttaaataacaaccaaggagatttcctttacacttgtcttgcaagattgcattatgctgatcaaactagccatgtcataaccttttaatcttggttcacatgtatcaaagttcgtgtatcaaacaaaacattttacaacattttacaagttcatacgttatattacacccaagtatcaagtttatatactaaattaatataatttactaagtttatgtgctgataatacaatttactcttaaaacaaggagcacccagtcgtcgcatgtatgtttcactgccatgtgttggagtgcttttgcttcttgcagaccatcttgatccttcaaaattgttctctaatttaacaaccgctctgaaaaccatctcttcgctaccagatttttcacagaaatgattagtttcgacatctcatgcctgctgcttttgattcattattacgtgaatacttcccgaaaatgagggacggcttctttttagaccctgtttagatgggattaaaacttttaagttcctatcacatcggatgtttgaacactaattataaatattaaacatagactattaataaaactcatccataatcttagactaattcacgagacgaatctattaagcctaattaatccatgattagactatgtgatgctacagtaaacattctctaattatggattaattaggcttaaaaaatttgtctcgcaaattagcttttatttatgtaattagttttataagtagtctatatttaatactctaaagtagtgtttaaatatagagactaaagttaagtatctgcatccaaacaccaccttagttccgtgacttctggtaccgacgtaccgtggtccgtggtacgcgactccttgagacgcagggggcgtatatgactggatggcgttttcttgcagctacggtctacacacctacacgagaagttgagagcaatacatggcgcacaggcaaagcatatatggcgtacatgattacaaaagataaaagacactgccagaaacagcaaaagaaaatgctgagcagtagacgattgaacattgaacgagagaacatatacaccagaaatgtaactcaactattccagccttgtccatgagcaaggactacaagctc

SEQ ID NO: 47124 - DNA, 959 bp, Oryza sativa
atacggtatacccgcgcgtacacgggtagttcctgtatacgttaaggaaatctattacatgatagaaacagaatccacaaatggaaggagtcctactcggacaatactgggtcgttaccatatcgtgaggggtccgatatctccgagtcctacttggagatcaactgacccgcggtataaaagggaccccttgggcagtatcgaagacatcgaatcttaccgccaacatatccaccacagcctacagagtcggagcttataggagccaagtcgccgggtgatctagtcgaaccaactcgactacggtttcgtcggtatcatcgagttccactattccctttgtaatctatggtttccatcatataatcccataccaactggataagggctattacctaccaaggggcctgaaccagtataatccttatcttttgtttgcttgatgtcgtattacgtagatcctcgttccaacgtactccaataccctctatatccggtctacgggtatcccccgtcgacagagtccaaagtgaaatacacttaaaaatttctgaaattaaaaggagaccccaagtggaaatacaatttaagaaaacaagaaatacatatttaaaaaatagtaaaggaaaggaggaagagtccatgtagaaatacagtttttaaaaattttaaattcaaattaaaaacaaatgataaaatagaagattggatttgtaaatacaatttgaatatctgaaatttagaaaataaaaaaactccatatacaacacaatatgggttgataaaatttggaataaaaatataataaagttactcaatttgatttctgtacaacgtcatacctaaattagtcaatcacaaaattttagaataaaataaacagatatgcaaataagtgtccatgcaaaatttatacaataaaaggcctgtcgacgtttgatgtcgcgattttggtattt

SEQ ID NO: 47125 - DNA, 15596 bp, Oryza sativa
  unsure (1)..(15596): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagttaagtgcaagttaaaaacttaaaaaaaaactgatggaatttcctttccagagaagaagtttgaagctatagctactactgcatgcgtaccttgtctgcgagaggcatcctttcataaggggaatcacattcaaagtactgaaaacatggccctccattcattgacctcgggctgtcatacctcgctaatgatgttgttgcatactgaccattccagttatctgccgcactgcaccagccgtagttgttcgcatcaaacaagttattgccgaccattatctcgctgtcaccacgcccagttcagacaaaaagaaccatgtaaaactctcaaactcttcatgcatctgatggccaattatacacaaagaaactgacatatatatacttacttgcatgaagtgaagtctgagatggtgtgcaactgaatggctgaaagatacggcacaaagtactgctcaatttcctgaccggaagggagacgaaccggagtaccgacaccataggcgctcaacgggtagaagtggttccaaaggtctacaaggaagaagcatctacctaactcgggcactctaccagaatagccgcctggctgcagacacagatcataattatgattatttaattcaggccagtagatagcaataaaactaaaactaaggactactgaaaacatgttggatattgaggaacttagtatcaatgtatttaagaaagataggagagggggtgaggaactttggttcaaacccaagtcgttgagcatctcctggcagcaccctaccagccaagtactctacgttctcaactaaagcactacttaagaacaaaataaaaatcctccctataataagcaattcatcctgtaaagttgctgccagcggagcttaaaaaaacacagttccaccacgtggccaccaaccccaatcaccatcatcactaaaatcaaagaggaggcgttgacctggatcaaggcgggagtcgcaaaactcgctgagtcaaccctgataggagagccaacgtagtttctccttttgtgggctctgtttttttttcggcagggccctgtaaataacttgtttggttgtttgattgttttttctcctgctctattaatatatacgagacaaaacttttgccttcttaaaaaaaatatgggacactaaggaggagcttcgtgtcatttatttagaaggaagggagcgtgtcacatggaattgaactcgggatgtcgagtagtatgaaacgactgctcttgccatatgtgcagtttcctatattagtcctatgatttggtcctacttaataagtgccaatacaatctatataagtcctctatatttaattaatacattctatcattggatgaccatatcaaaagttgtggagatgttaaatacaaaagtcaacatgaaggtggttgtgtgcaaatgtaactaataaagattacatctacgcacccaaatatgaaaataaattaaatgtttactgttgtgcacaggattctaaccaataggttagcacttggtgaagcatgcatgtttgcgcataaaaggctaaatttgttaggaggtaatgataaccacaaggtgtggcaaaataaaaggtttatggatgaaaggatcaccattttagacatccatttcatatggtgattttccatgttaaatggttattctacaattctatcccacatagaatcttcgtaaagatgctatcaatctgaccatttttcatgtataaacccagaaaaaaaaatagagaaatgacctcacttaaatacaaactaatagtaattgatcccatagggttaaattcctggctccgccactgaatctgacacgtgtctcgcacgtgccaaaagcaaatgtttgacttgagtgatacgttacaatatgggtgtttcgcgccaaaagttcgcacgaagacaccatgcatgtctcgcgccaaaaagtattttgaatccatgccactttacatacgcgtggaataacaaagaaggatgacatagacaaagacaccaatccacaagtaataaatcttactgcaaaacaagttagtatgatcatacatagcttaacatctcccagcgagaagataccaagcattctataggggaagaagtaaacaacctagaaaaggatatgagtttttcctggttcttggaaactcgtgataatgttaaggcatctacatcttagtagatgtattataaaccatcaagaaaattaatggaaaaccaccatatcaagggaaaatgggccaataacataggccaacaataaaaacaaagatgaagaaagaagggaaacatatgtagataacaagatatattttccccccaaattcatgtgaaaatcccaccttctaaagtagatctcaaaagggaaataatgacaaaccatgagaaaaagaatttaactagcaaaacaagaaaccattctatgaaggggggaaaaaagaggaaagctggagatgcatatccttttcatcaaaaagatagagaagatcgcatagacaagcagtctcggagccaactcccaggctaatcaaatagcctcataggcttgatgcctttgtattccatggatataactactccaataacctaggtgtccattcaaatgggatttttcatttcttgtaatttctatggaaacataactgattcatacagaaatcaaaggagaaaagaatttgacaagcagaagcacagcctttctttttcttaaaagatagcatgatggtttgtaccttggcaacggtgtagggctccaaagttggcgtaacactgtgaaggaaggacctcagattcgaattgatacaagcttcaaaaagcttaataccagatctggaatcagcagtagcacttcccatatctcaaatctctatgttgcttctaatctgaaacatctactccaaaacaagtaagccgatgttgaggtgggctacctagctagctagatgtgtggtctggttcttttctcagggaagagaagcatatatagcctgttttaacttatcagccatctaggagatatgatcttaattacattcctacttggtacagtctctgacatttataactggttgtcttgggggtttgggtcgtatgaatcatcacttgtcaggtggagatatcgctgaggtggccttttggacttatcttcccattttagtttctgcctttttttcctttttaccatttagtgctctatgtgtgcgatgtggaagctagtttgtgcgtgcatcttgtacaaaacttcaagctatacatatgacaggatgagataaacctttattcagatggaaaatatgtgctgccggcgaggccatgtcatgcgatggattaagaagcattctttaatttggcttattttgcctgcatggtatatttctgtcaacccgttagcttgtgcatctatatatgatatgttgcgtggtactatatcacacccataagctttacttgtcattgctttcaggagaaagacacataatagtttctgaaaaaacagaatgaactagctttttctcgtgtagcgagctagctagaataaaaatgctttgctagctttttctgaaatttctttttcacttttttcccactgttgctcatgatcaaatctggcgtacgttaccgttttactagattaatccttggttcatgaagccagttactgcttctatccatcagtccagcttaagcttaattatcactcaaaacgggacaggggaaatgcgtgagcacttgaagtctatctctaccctctacctcactacctgtggtcaggcaccactaagcggaacggagaagcaggagtcaacagtacacgacatgcatgtcgtcgacatgtacatatctcatgcagcctctagctagcctagcccagcctggagagattgctcctctcctcgatcgtcatgcgaggaacaagctggactcctggagagagaagtaggtaactgacaaaccgacgcgtgcttgctgacacgaaaaaacagcagcagcaataaaccacaaaggaacaccaaaaaaaaaaaaacggagatcgatccaacaagtctgatatgagcgaggtgagaatagctcgtagacggtagatcgacgtatttgtgcatctctgccggagaggagatcgatccgaccggaggcatccatgtagtcgccggcgacctcaccgacggccgccacgagcgtctctgagctgtttcaatctccgccgcgcagataggatcggacggctcaggcgagccttgcgtatgctctcgcagtctcgctgacgtaaacaggtgacagcccgtgcaagtgcaactcggctccggctctccagtacggcccacccacactttacactccatgggcctcacgtaggtcacaatcccattccggcccatattatacgggccgcatgtcagcggaatcccgtttcggcccagcctgagcccatctagcgcgtacacggcatcgaggaaaaaaatcctccgcctccggcaaacctcgcggcgtggcgaacactcgaggcgttatccatggccgccgtgcttcctccgctgtactcctcctcccaaactcgcgagctcccgccgcggtaaagcgctgcgcttggagcaggaacgctcgtgtgatcaggcgagagggtttgaccttgtactgattgcttcttcgtttttttttttttgtagctgtcgcggaggagggctccggttccgaggaggggcttcgttgttgggttcgaggggcggagtaggaggggagccgcggggaccgtgcgagcttgcttcaatcctcccggggacgaacgcatcctccgggaggccttgaaggtgtgtatcgtccccgactcttccagttctttttttccgatccagtgttagttgtaggcttatagcatgaattaattcgatgtgtcgaggtcaagctgtaaaatctctagttgtaaattctgaaacaacacacccttttgtgaggttcctgacgaatccatgggagttttaggtttacccaacaattgagttacattttacatatagctatttcagcgttctaaacaggaattggtccataggagttgattcttaagctgcagatgctcaatattcccatcagtgcaagggaattgcctttaattttcgtaggctcttcccaaagccagaacatgtactgatggagtgatggtttgcgtgcctcttgtgtaggagccagttgcattcatgggtggtgtgtttgctggcctattgaggcttgacctgaatgaggatcctctcaaggaatggatcactaggacggtagaggcttctggagttgctgaggatagccgaaccgatgaatcaagtgagggatctcaaaatgatgcgccccaacaaattgagattgagtgaggtgcattagttgactttgccatcttttacggtcttgtaatttataccgaatatttgtaatatttatgtaataaaaatgcttctcccagttttgaattttctttgtctttgtgttgtaacttgaagtaaaaaaaatcggtctgtcattgatttttttaagctgtattttccttagtgggtaaaagcaccactaataggttactatggaaaatgttaattcaagtgcaaaagaaagtcttagaccatatataactcatatgtgtacgttttgttatattaatgttgttccaggaatttccgagcatttagctaaccatctagacttccgtttatttcattttacggcctgatggccttttctgaccgtttgtaggaactgtacacctgtcaatttttggttatctcttttactttgttctgtcaatttttgcattttttgggcgtatactcctattgttatttctctatatcctgtagatccttttcagttgggttctcccctattgttctcaacagaccatcctttcatacaacctgtcagatgcttcttatttccgagccataaaattcagcactcattcttcagcaacaacaatttaaaagaactgcataatctgctttccgacatctattgatggttagttgaacataaatcattgcatggccttgatatgctgagaaatatgccctttcaagttcaaccttgcttgcttggtaaataacatgacgtggtgtttaaaatctagaaaagtcgcattgcttgttgtcaagcctgatttgcaacatagcgtatttatcatccacctgtgggcatttcatggtgttcccctgatatgaaaatgcatatcgtttgcctcatctcatgaacctgtggttttgataaatgcgttagcctgagtatctatccatcagttgccatttgccaagggaagaacatcttgtatggggattttttttccgaattagattgtatgggagttttcagttggatgtgatttaatgataactctttcaacatgttgtgtactcttgtttaggtaattacaccctattagaaacatagtgctttggttcatggcatacatatgcattcaacaattgtttctggggactgaactgcaaatggaaatgttgcagtctatcgtatcaacttctcttccaaatgatgaaagttagttttttacctttttagagccaaggaaccactttggaagatcattgctcatgaacatagttttactatgcagaaaataatatccccacaaatttacttatgagcttcaaagttggattaaataaatacttaataactacagttctatgtttgaataaaccctgtgaacacctaaatcttgaattgagaaaacagttccttagccagaatgtttcatgtctcatgtaactctaggttcaaagttgttgtggacttatggtcactcttggttaaatttaggtagtatgatgtgttgcaataaagtaacttatattcttaccagacaaacatccatgtttgattattctcgttctcatttgttccaaaataaatagggcttatatttcttggttaaattactacatttgcttatctgaaatactcatgccgaaggagttctataactgtagaatcatagtattctgtcgcactactgttaatgcataaaggttataggggatttctgggtttggaactcatttttgcacttcttaggtttataataagaactttataatttgttaaaatctatccaaattgcttatcttctgtgctccctctttcatgagcataaaaaaggtgtcattccaatgagcttctatttccatatttcgtcggcgtggagtatattgggttgattgctttatttttggaggggccagttctcttttgtgtcctaatcatgattgaattagaaattaggtgaccatatttctctatataagtatgtaacatgctactattttgcttttcttgtcaacggtttgtgtcaggtgatcaacgtattaaccccatcatggatagttggatactacagcagtacagcagtacagtacagtggtgtttgttatatgtctgctgggagatttgtggctactaatttaatgttggggggtctagtgtcatttaacatggggggttggacaggttgctttattctcaatgtatagattctccacatgcaaaactctgataaaaaggaaaactttattagtcggtaccattttgagttcttcattcaagtctaaccttcagtttgaactaacgtactcttcctctactctctagctgatcatgctcgtttatagtctcttattttcttccgctcaaccatgcaggggctaagcaggttgttgggaggtgctttccaactatcttaatcagtaatgatggatagcaagactggtctgcagaatatcctttgcctgtaagtttcatgattccatcttgcaggttgttatggaccttaaggtatgaaatacttcatccgtttcacaatataagactttgtagcattggctacattcatatagatgctaatgaatctaggcatacatatgtgtctagattcattaacatctatatgaatatggctaatgcaaagtaatatgaaacggagggagtagctgagtagctggcaatccagaaccgtaagctgttattgctgatttgaatccaaagccactgacgtgacacaagtaatgaatcaatgcagctgctaactacttgatgatgacttccccttgttggaaaaagttttgtctttgaatgctgacgaaatgtggggaattcacctccataacctttcactgaaaaatggaattatcatgtgaactcagtttagtgtcagtcaaaaattggagaattgtgtgggtttaagtgatgaaaataagacttatcttgccttggagaaactatgccatcaagtgcaaaggtgcttgcttaaggataacaagtagaaataaaacatttgcagaatgatttaagtgagcggcttaaattttattatcgcttcaccaatttcgtatccaatttaaatttattatagcaggtaacatggtttggctttcttgccttcctgatgaagcttgcttctggaatccggacatgctgattaaatgcataccttttcttatatacatttatgtatgaatatgactgaaagctatcctagtcctacaatcctatgcatgagtgtggttgaatgatctcggtagcagggtttaccttaccgcgcggttaccgggcttaccacggtaacctccttaaattcaaataaattttaaaaataatttgaatttttgataaattttgcacggtttttcacggttaccgcggttatcgtgcttaccgccggggcgcggtaaccccggccccggcggtttaggaaaccctgctcggtagttgtagaattagaacgaactcaatgaatatattacctatttgcattttgcttgctctaaagaaccacactataatataaaacccacactcttcaggatagatgaaataagttgtcctagttaaaactgtgtatataatgaaccaggtgtcttgacatgcctctttctgtacacctgtcttttactggcgtatgaaaagaaaattgtactacaatcaagcaaacaacttgaccaggcggcgatgcacccttctctagccgacgttcacatcagcaagcatgccggaactattacaaggaaaggcaggccgattaattgctaagctgttccgtccatggttcacacttcacacctgggctgcctgttcatcatcacgcgtttgatgttcactgcaaattaggtagttcatgcaaatgcttccatgccttcgtttgatcgctgcaatgaccctcctatataagagggtaacagtattcacatgagaactcatgtgtaccgctgtaacatcacgaggtgtgacagccatgacgagatcatgcttcctgatagtgctcctgctcgccgttgccatgggtggtagcaagctctcgctcgccgccggcgagagcggcggtggcggcatcccgaccaccctcggccgcgagctcagggagctcatctccaaggccagcgacttcctcggcgcggcgccgcgccgggccggagcggacgggtggcacgccgccgcggccaccggcgacggcgccgacgcgatcagggcgtccctgaggagcacggcgagggggaggccggcgaggaagtccgccgcgaactgcatccccgccgacatgtgccggaagaagaaggtgctgtgcggcaagaggtgctacaggtcgagctccagtagcagcctcagccacatcccgtccaccaagtgcgttgtcaagtgcaagaaatgcgtgcccacctgctagattttcctcccttgtaccgagattccattccgcgggttgccccggggcctcacctcacgatcgatacccattcctgttcctcgtcgtgatgttaactctccacaatttactttcctatatatatagattcagttgaataagcaggcaagtctcatgcacgaggtagataggcaggagttatagaatttgctaagtcggatataatttttcgccctcgtactatgtttcttccacgtgaatgatcgatgaactgcacgagctactactataccagtacttttagtactacccctatatgtactgatccgtcatccgtgtacttaatggtagtagtgcagttgtaggggatcgatggcactttcaggtttttgacgatagacgagagacaccatccaacaaactactgttaatctctacgtacagaatcatcacgtatgtggcttggatggtgaacttcaccgcaactatataggagtaagtacgccagtttggacctaacatcatcatatcacatcctagataggtggtactattaagctagctagtatgcatagctatctagtatctacaagtgaacagtaccgatactacgtaacatttgacgtcctattacaagggctctctcaataccgatcactgttacagtcgttgtactgcattgagtagcgccgcgtgtggtttgcagttgaggaattgacaccctgaatggcatatacgccgaacggttacaggtgcgctacatgtacagtgacagatcgacagagaaccttcccctcccacgcggaaatctccccgttcccatccgtgatccaaccgtgtcctcaccgcgcgcgcgtcggagaaatccccacacggatcggcgtggcagcggctacactgtacttgcaccgcgcgctgcgtgctgggcggcggcctcgaccgacgcacgcacggcagcgcgcgtcgccgtcaccgcggttgagagtatatggcttttccggtcaggtgagacctagagggatgggaggcgggtggggcgcgcggggacggaaacggattacggatcggaacgagatagtagtaatgataaaagcgcgcggttggagctgcacgcggcgcgacctcattacggccagaatcggacgtccaacggcgtagcgtacgtgcgtaagttagccgggcggtttgcccgactgatcgaatcgcgcgcgcgcgcgcgagtgccccgacgagcaacgctactggatggcggctctgcctctacctgcccgctgcctcccaacgcctcgttgactactactctgcctctcccgcgccgaagcggacagctttgacgtttgaccgtcgactcctctatctcgttggggagatggtaggtgagacgcgcgccacagtgtcagtactacgtattaccagatgggctagtagcgctcgccgcccagccgcgcaggtatggtgctgaccgcgactcgatcgctcgctagctagctcgatctcgcggcgccgacgccgacgagcaactggactccattgatctggaagcggacacgcccacgagccccggtgatgacgcctaaagttgccatgtatatgggcgcgtacgtcaccgcaaaagtcgaagcaaatttggctagctagctactagcggcaatacgctagggtgcttcttccagttcggtcctaggtatatgcatgatggatcgatcatggactaattatcgtcttgcaccgcgatggagggaaataccgctggcctgtgactatgcggtgatggtggtccagaaagagaatttcgaaatgtaagacggggcgagggtcgagattaaatgaagggaatcagcaaccgagaattattatcgggatgaagggagagtagtagaggaggagagggagggagagaaagaaggctggcttggctgggctggccgggcaggcaataaaagtacgacaccaacgtctaccagtaccctattaatgcacctgctcgctgctgccggatctcgtctcgtcatgtgctctgtgtgcgtgtgtggacatggtatcacacgccgtaacgtgttgctgcttcgccagccagcccctaattaaattgactagtgctcttttaattccctcccatctacaacaacatgtagttgtggtggtgtggagtgtattatttttgccactggagacgtcatgtaaaaccatgcactgtttttgttctacccgtgtacgtacgacctgtgaattggcattgcgcggcatatacgtgtgcatgtattatttgttattggatatttttgttaataaaaaaataattaatctagataaaataaattgataccatcatcgagggttgtaagaatgtgttagtctagctaggaagagtcaaaatgtttaaggactttcacgcacagctattattatagtacaacttacaatttgatcggtaattgatcacttataatcgaagtacatattatacccctattttgaatgatgatcaaaattgatcagaaactgtgacgcatgtcatcgtctctcgcaggcgcacaaataagatccagcgactgcaccggcaccatcgagcataaattagactggatcaagtctcaaccatgaaattatttaaaaccctttctaactttcataaaatttttaattcgtccattcgttgctagtatatagtgacagtatattgtacttatgggttctctaattatttgatgctagcacgctctgtagatattttatctgtacagaatactgatcacgggatgttacattaaactacctgggattaatgatgaaaattacaccttataatccaacaaaactagtactgtacgtaccaacagtattttccatttctaagacacgacacttcgtcgaaaaaaaaaaactgtgttccatacttgggtaccacacgttgcatgtagaacaggagtggtgactagtgatcgattcgagtaggagtaagggctcatctgcctgccagccaaagcctaaaagaagacattttggttggcggtttgttaagtagtggccctcccatggttgctctctctgattgctccatccatccattaacttcccttctttattatgcttgcatgcttttcacctttataactcctcccttgctgcctctcccctctagcaaaacagccattgcatctctctctctctctctctctctctctctctcgtgttcgtgttcgcttgccatcgcgtcgtcgctcacagctagctagctgatcggtcgctgcgagctagagcgcgccatgagagcgggaggaggaggaggaggggacacgaggaggacggcggccgggcaggccatggtggagctgcaggcgaacgcgtcgtcggcgggcggcgggatggtggtggggctgagcccgctgagcgagacgctgtggcgggacagcaaggcgatgcccggggcggcggcggcgctcatcggcgacgtgtcggcgaggctgacgtggaaggacctctcggtcaccgtggcgctcggccccggcaagacgcagaccgtgctcgacgagctcaccggctacgccgagccgggctcgctcaccgccctcatggggccctccggctccggcaagtccaccctcctcgacgccctcgccggccgcctcgccgccaacgccttcctctccggcaacgtcctcctcaacggccgcaaggccaagctctccttcggcgccgcggtacgcatacaaaaatcatatactcatgtagtactccatacctagcttcttgcttcacttgttttatccaacaaaatctccatttctaggaatcaaaattgtctcgtaccacagcccttgctatactttactgtctccttagctagataagttcagtcatcatccataataagtatccatcccgtttcagcattaatagtcaagctaactaacgaactagctagccctagcctgtgttgatggcgccatgtgcataaacacacagtcacactcccatcaagtggcgttttacgagtaggcgaccacggtccgatcgaccggctaattatcgtcgccatcaaaacatactggacaaacgcaacgcgtacctacgtccgctcgttgatccagcgggttgcagggcttaattacttttgtcatctgccatgtccccgatggcgaaaggctgtaaatataaccccccaacgaagcataagtgcacataacgtgtactgctgcttgttaggtgcagcaatcaattcgatctgttttctctcttcgatctctgattccattcatttggggcgtagtacgcgagatttttttttctcttttctcttttttttataagagatggagaactagtgggagtagtttcgaaagacgagatttagaggttgtggtgcggcgacctacatagcataaatacagacagttggatatacttggatttgttcgtgatcgaacctgtggggaatttatggtgacatgaaccattcagctgcagtgaccgcgtggtttgtcctaccaacgattatactacaggagtaatggaaggaaggagggggacttttctgcatacaaaaaaaatagtattacaaatctgatggtttatcctcatagagcgagacaacttgggccgtttaatttgctggtcgttttcaaatttcaatgccttaataactgaccaaacctgtaggctcaaagctgtaaccaagctcgcccagcatgaaaaaaaagtatcagctcatttctgaatctacgtttttcttttcaggcgggtcttttaatttacagtgtacacaccattattacatgtaccaaaactacggcgccgttttgtaccgtcacatttacgtattatatactcatttaaatgactctactagcggtgccatctcatcactgctctttaaagttattattacaaattgtcctcagatattttctaatatatatactccaatatttagtttccaaaaagtgaataccaataaccaaacaagcagggccggccctgagacagtgcggacggtgcgactgcactgggcctctaaaaattaggggcctccaaaaaatgtatactatggtatcagatctgatagggttagaggaaagatagaaaaccgatcggcgatcgagcatatcgtgacttcttgattgtattttaaactgattagtgtgaaattcattaatgacaatgagtttttaaatattatcttgtatttttatggtgaatgggggccttcattttttttccgtaccgggccactgaaaagtcagggccggccctgcaaacaagcgagaacctattcgaaaaaaaatatttatctatgacatatgataagtgtattttcatttatctatagcaaagcaagtgcatttagcggtgaaacacgaggtttacggagggtttttttttaggcgtacgtgacgcaggacgacaacttgatcgggacgctgacggtgcgggagacgatcgggtactcggcgatgctgcggctgccggacaagatgccccgggaggacaagcgcgccctggtggagggcaccatcgtggagatgggcctccaggactgcgccgacaccgtcatcggcaactggcacctccgcggcgtcagcggcggcgagaagcgccgcgtcagcatcgccctcgagctcctcatgcgcccccgcctcctcttcctcgacgagcccaccagcggcctcgacaggtacgcgtcctccctgcatccagtcacagctgagctgactgatggtgtgcgctggactgaccgcggcgatgtgatgccggcttgatcatgcgcgcagctcgt

SEQ ID NO: 47126 - DNA, 9070 bp, Oryza sativa
gtaagtcatctcaccagtcaccagattcagaaagcaaccagtatatatatatatctgtcaccactatcattcgccatggtttctaacgtgaccatcttgtgctcgtgcttgcagttcttcgcccagaccggcttcccgtgcccgccactgagaaatccatcggatcatttcctgagatgcgtcaactccgacttcgacaaggtgaaggccaccctgaaaggttccatgaaggcaagggtaagaagagatcaagacacaccaatgttcatagctgatctgctcaaacttgttcgtgtcacgatgcacttaaaatgatctaatttttgggcattctcattgaagatcgagaggtcggacgatcctctggacaggatgaccacatctgaagccatcagaaagttggttgcatcctacagcaggtcccagtactactacgctgcaagggagagagttaatgacatctcacgactggtacgtgttcttggcgaccctaatacagcagcgcgtattgatatcactctttttcctctctgttttttttttcttgcgcccccacgtatagttaagactgcatccaggacaggcaataacaggatgaacactaacacacccatgttattcgttgcagaaaggaactgtgctggattcaggaggaagccaggctagcttcttgatgcaggcaggcacactgaccaagcgctccttcatcaacatgtcaagggacttcgggtattactggctgaggctcctcatctatctcctcgtgaccgtctgcattggcaccatctactatgacgtcggcaccaagtacacatccatcctggtaagaaatgaaggaactgataagcgattcttatgactggaatgctgtaatagaagtttatattaaaaaaaacatagtcagatgagtaatctgtcatgaatccattaattggctggttctgatgtgttttggtttacactctgaacaggctagggctgcctgtaccgcattcgtcttcggattcgtcactttcatgtcaattggagggttcccttcatttgttgaagaaatgaaggtgaattccaagcaaacggtttcatctggatgctagaattaccatgccaaatttgctcagttttcccttgttcattgacaggttttccaaagggagcggctgaatgggcattacggtgtcgcggcttttgtcatcagcaacacaatctcggcgctgccattcttggtcctgatatgcttcttgtcagggaccatatgctacttcatggtgcgccttcacccaggtttctcccactacatcttcttcgttctcaacctctacgccagcgtcactgtggttgagagcttgatgatggccattgcaagtgtcatccctaatttcctcatggggatcattataggagctgggattcaggtacatctttatgcttctttcataagctttcttaacctatatctcttggtttattgttgaagtaatggatgttcatttaggtctatctttaaagtactatcatgttaacaatcatattaattaggaccaaatgtattaaatatagtgctatagaaagattggatcgaaacaccgaactcggttgttcccgtctggtacagttcttaagtctgtttttttttccatggcattgtcccagaggatcatgtggcatttaagatatgttcatgaatgagagcttacaaaactttgaaaggttctaatataatctgatatgagtcaaataaaccagcaagcttgacaaagaaataaatgctggacagcacaactttaccgtacgctacccagcattactgtacactactcccatcccagtttaaagacagcttgaggtcgttcaagatcttattcctatgttttgttcttctaactgctgatcctatcctttagtggccgcattacattgctgccttacaaaggaaacgctttttctttcaattaaaatttcagaacttcataactcagtaaacataactcgtcttactttttttttcctagggaatatttatgcttgtctctggatactttagacttccttacgacattccgaagcctgtttggagataccccatgcagtacatcagcttccattactgggcgctgcaggtaaattaaatcccactctttgacaggggaaacacactaaatttttatcttgaagaaaatttgacaccaaacttttatcaacctgacaggggcaatgccagaatgacatggatggtctcgtatttgacaaccagtacccagaccaaccgaagatccctggagacttcattctgaagtacatattccagatcaacgtgcaccggtcaaagtggattgatctctcagtaattttcagcatgatcttcatctaccgcattctgttcttcctcatgatcaaggtaaatgaggatgcactgccatggattcgggggtacattgcaaggaaaaggcttcaaaagaaggaacctcttggcaagacaccctccctcagaggctacgttgtggatccagagcttggtcctaacgaaagctagaatataaactgttagcagatataggcccatttcttgccggttcttggtggaatatgtatctaagatcagagaaactggtatttatacgttttgaaactgaagctcaagctgatcggaatacaggtatatacagacatgtaatgtgtgaaaaatggcatcagagatgcagagttgacacatagctggtggttcagaatttacctgtctcttcttttacagataatttacagttctacattcagtaaaaaaaatccttcctctagaatggcagtaccgcaatattaacaatgaaagaaatggttggggccctaaaggcgaaagcaccgttcaaaatacgcactacaccatcacattgattctgctcgcttgccgaaagatcagtaccaaagttgtaacgtttagatagataaacttgtttcaaacaaacatttggcatggaaacatggaatatttcaagttttatttgtattttgtaaaaaccaacacttttttttgttaaattactgttagtactgcataaaaaaactgttcgtaggattatacgttccatacatgtaagagcgtcgaggtggctagtacaggacgcgtgtacaggaagattaatgattccagtgattttggtccctcttatgccagaccaaggacatggggctcaagagtatacatttgccccatgcaatcattgataaaaaaatgtttcatttgctccaaaaatgattactatcttcatacactcaaaagggaagtactgaaaattttgtactcggttaataaaaaacataattccgtaattatcatttaccgtaaatctggtttccttttatttttctatgatactgagatctggatgtttgaagcagtgggattgtaaatagtagttaggaaatagatcgcatgcataggagactggctcaacttggaacgaagtgatatcacaacaacaatgagtggaagcagttcagttttgcaggtatcgataataaaaatgctatgttccaaaatagcgaattattgctgagccaacatatattgagtccacaagcaagtcataacacataagatagtaagatattgaacagaaaggtacagtagctaagctaatagtattgcatatccttagatgatatcagaagcaagtcagtaattaccacgctgtaatatgtttaactgccagggtcaaggactggaagcctgcagtagaagctaatggacttgtccgtcagtctagttcctggaatgaaatactggaatatcacagtcaagcaagcaccaccaggagaaatacctgtgccattaaaaaggacagtatttaagcaaaaagtgactctccaacacaaatttggaacttgtcagtaagattacagaaatagctggaaagcacaccatagaaggtacagtcgggcttagccaaatgacattgtagacttttagctaggtgcttcatattcacttgctgtaaaaacacagaaagacagaaacttgtgaacagctgcatgaaaaatggtaaaaaaaaaaaacgtgaagctcttaggagtaataccactgagagcgcctcccctctctcaattgccatattggtacgagtggaagcactcaaattttgatcaccaacaggtgcggttgctgaaatgcagaaaattcatataaaaatatggataagataagtaatttcattcacgttaaaacaaaaaggtaatttcaacataatgacagcactgctaaaaagacattattgacacttgctttggaatgtagagcagcttaccacgaacaccaaggatacgaagtttcctgaattctgaaccaacagtaacaagagaagtggcaacgtgtagatgtaagtcaccatattgagtaacagctactgtcagaagatcgccgacattttttagacgatcgaccaaactctgcaactgtggcagatctggaacctgaactagagtctacagaaagaacagaaaccaagtatcaacatgacaacatccattaggatttagggctacaatttttgcaaagaagaataaatttagagattagaatcatcgaaatagaagatacttttagttgtctgtgattcttgacgtttatattaaatcaacataaacctccctgagtgaatacacaattccccaggaaaacttagttggggtgtctaatttagtctccttgacatggtattataaagaagcatgactaagatttcaggacgaaaataaaacatgaatggcagttccagactagtatacttgctattctacattttgcttctgtaatactaacttagtgtgtaccgcctgtgatcggtgatcctgagtcttgttggctatttataaattttctcaaggtacaaacaaataatgcagttagtttcttatgactgaaataaactggactagtgcttttgctatagtgaactatgagtatgtcacgtgaggtttcaagtttcaatttgataaggcagcccaagttgaatccaactcatcactaattccatagttcaagctttcgaatgagaaaagcctacactaagggatgtacatttgatgcctccatctaaagccaaaataatcccagcagagattgttcagtgaaaacctattcaactttgattaactagttccacatttgggcgtccaaatccgactccgaggaaatctataatctaatgaaatatcacgagcatttcagtaaaatgcatcgcacctgagggagctcttgggcggagtcgagggcagcctgcagccgctcgacgtcggagcgtgaaaggggccgcgagatgggcacgtcctgcacgacagcagagcgggctcccttggtctcgaaagtgaggaacggcgaggcagaccgggacccggccggcagcttgttgacgagcttcacctgtatcgcggctgaggcgtccccggcggccggcgactgggcgtggacggcgagcgcgctgcggagggcgcggtggagcagcgcgacgtcgacggcgaaggccacgcggttgccgttccgcgacgacacgctgtactcccggaagaggaggtccttggcgaactgcgcgacgcactgcggccctccgccgtcgggccccgtccccgtgggtccgaggaggttgtggaggagcatggcgtgcgtgggcgtgaggtagacgtggcacaggcggcccaccttgtccatcgccggcaggaaccctgcgggggcagacaagacggcgcgacgcgcgtgaggtgctcgacgaattgcggggtagagagagagagattgggatcggcggaggaaaagtcgtgccccccgagggccttacgcttgtcgaggagagcgatgccgtcgtcggtgaagaaggccttgaacttcatggcttgccctccgctacggcgtcggcgggcggcgaagctgctgctgctggcggtgggtgcgccgctggaagttccccaggggactttttgcgcgcctgggagttcgaggggacttcgcgagtgaaggacaagggttgatccgttgatgtgtagcagcagttccgcagttcgggtccttctttgtcacgcctcgcttgggcctagatgtaatgggccgtcttccttctagagagaaacatgggctatggtctcggcctatcggaaatttaggccctttgggtcggatgcggctgacatgggctatggttttggtcctaatcacccgcagccttttcctttcatcttctcccttctttacaggccatggtacttggtacatgtcagagaataaatattggaggaatcatctccatcgaaaacgaaaatggagatttcattctcccctccaatctcttgcaatcctgagtgatttctgttgggcgctttactttgtgagtgatttttgtctatcgtttcagcgaggaacacgaaccaaagccgctgaaagtacacaacggcaaagcaactcgggaagaaaaatgattccagatggaaccacctatgcatctgtcgggtgattttttctcaaaaatcatccagatttttccttgcccttagattttcatccaatagagttaaaaaaaaaccgaacagacagccaaaaaaggccaaaaatgactgggccaacacactaaaaaaacagataaaacatgggctgcaatctggcccaaacaacaaattagaaaaataaatcaaacaaagaacatatctgagaggcccaaagaagtaaagtcaaccctgtccaaaagcatcaacttggctgccaagaaagctaaaagaaaaaggacaaacacaaatccaaattaacacaccagatccaaaaaagcaacaccacgcacaccatggagaacgagtaggagagaaagaagagaaaaaaggttgaaccaaagcaaaattcttcaaatcaaagtgaaatcacaggggagaaacaggaaataaggaagaaatccaaattaggtatgttccataaacctgtgctcatcctcaaaattgtctacaaatcttagatcatagcaccatacgtgcccccatcccatatgcataaggagtgttttgaacaaaatacagggcacagttcatacactgaaagtaaaacttacagtgcatttgcactaaaattacatttgtaaaaacagtatatatgacatgtaagtgcactgtaagtttagtacaaatgcactgtaaaattatcaatcaatcaaacaagtagaccatacagaacaacttctgttgtttactacctaaaaattgaatacatctattcaaacatgaactcaggagttccagcaccaaatacatcatatattccaaaacatatatgtatcagttgggcagcacaaaaaagaaaataaaaccacaatagtgagtagtatggtgatatgggttagagacaactaacctgcatgatggctgctgggtttggtcttgatgctggataggatagttgagatccatggagtcagaaccaaactaaaattaagagaacacaagcatgaattaggacatgttccacagtaaacttcagttacaaaccaattggtatagggcacaatccatatgaaaaacaaatatatgcacaagggataaataatgaaaaacaagttcagaaactaaaaaacaacccaccaaaccaatttcacattcatatatgctcaaaagtagaaatttacattgcatttgcactaaaattacatttgtaaaaacagtacatatggcatgtaagtgcactgtaattttagtacaattgcactgtaaatttgggtaacataattttttgcattattgaagtgtaattgataaaatgatgcttgattagtaatctgtcatacagaacacctgcatatttcactcctcaatactaggtattcactcatttaagacaaatggctggataaaattttagtgatttccaatttggaactagcaaaatagattcatagttctctatatatttggcttagaatatagaccatagatcacatttaatactcttatatagaacattcaggaattatataggagcagtaccttccaataatccattcaaatcaaatctaggattaaaagaatatcactccaagaacatcatagtaaacaatctagggtactcaatatcttggaaatgtgtgatgactcgatctgccatataaacaatcttagtacatgcagagcccgatccacaatattttagtacttatttaactaatacaactacaagtatatatacattatgcaacagttacatcatcattgagaatcatttatgcacatcaaatctatatctctagatcaggatagattcattagatcaacatgactagatgatacacatggaatacaaaaattactgtcctacataactaaaattacatttgtaaattcaggtcattgtgtatgtaagtgtactgtaatttttatacatttgttgtgtaagttataatgtattactctatgatgtattgctgtattctaatacattcaataaaattttgcagaaatgaagtcatatgcagatcctgtcaaaattagcatcaggtagaacaaggaatctggggagacaaacaaggaaaaactacaattaggtattttcttttaaaaaaatcacatactatgttgatctgaacatcatgtagaaatttaaaaaaaatatcatagtacaactttgaaaaaaaatcacaggaaaatgttcagctgcagggtgaaggatgcaaaatattaaaaaatacattaagggttaaacactactactttcacaccattgttatcaaaactagaaaagggttaaacactcaaaacacattaacatagcacccaatcttaaatagcactatccatgctgccatacatatgcaaaatcaaacactggaagtagaaattacagtgatttgaaattaaaattaaaattagaaattacagttgtaaaaacaatttatattgcgtgtaacttcactgtaatttttgtgaataagctatgtaaataaatatgtaatacttaacattctagtaagatggtttcagtggacatgtatactaatttattccatgaattttgcaggaatcaaatttactgaaccagtcaaggttggatccatggaga

SEQ ID NO: 47127 - DNA, 1954 bp, Oryza sativa
agccagcggttaaatttgggctaaaattaggtattttggttaaaattaggtatacgaccaatcgacctgaaaaatgattggtcacaaaaaccaatgttttgatcgatgactgatcttttgtatacttcggattctatctaccttttgttggtttttttctcgcccatatcactttgtgcgttaaacccaatacttgaccgcccaaattattataagacggtaagctgaaacgcactacatcaataaatcttaaaatgagatagttacactatctattaacttattaaagtaattcaaaaaggagcctccacgtttactcgcatgacctagaaattctcacattaatcgggaaaaaaagaaaagtagagtccataaagaaatacaattttaaaataataaaaacttgaaactaaaaaaaatataggaagaggagactagagtccatacaagtatacaatttagaaataattgaaatttggaattaaaaaaaagaaaactaaattagaagtcagagtcccacaatttaaaaatatctaaaattgaaataaaaaataagaaatatttgaagaagattctatagcccatatagaatataatttagaaaagctgaaattagtagttaaaaataaagaatattaaaatatgagcttagagtccatgtagaaatacaattagaaacaatggagattcggaattaaaaaataggaatattgaaagaaaagtctagagtatgtgtaggaatttagaacaaattgaaagtcgaaattaagaaaaacaaatagagtttagagtccaagtagaaatacattttagaaataactaaaattcaaaattagaaaataagtaatattgggagaagagactagagtccaattaagcatataatttattttggaattaaaaaaattaatattggaaaaaaacttagagtctacatcggaatacaatttataataatggaaattcggaattagaaataagaatattggaagaagagtataatgttcatataggaatttagaactaactgaaaatcagaataaaaatttaaaaaataaaagtagaatttagagtccatataaaaatacaatttataaataactaaaattcaaattttgaaaaataagcaagattggaagaagagtgagtccatataggaatataatttagaaataagtaaaattcgaaactagaaaacaattaataactataagtacaatacaaaattcaaaattatgttgctatttttaatatattttaataataaaatatgaaaatatttaagctattatatgaaaaatatatataacgatgctagccgcataatctgtgcaggccaccatactagttgcacataaaactaattatatgcagtaaagtttattagcgataaaaaataatttatggataaaaccttttacatgtgtgttcttacctatttaaaagtcgtgctggaaatacgatacatcaaaatcaactcaactctaaaattacatttagattttagctatgactgataatttgaaaagcaaacaatagtgttgtctaggacagtgagttttgacggttaactttgtctcatggaattctttggactaattgcactacatcttttacggacagctagcgaatgtaaatatataataaaggaatgataattgtgccgaccattttttttgtcttttataggtgtgttggatcattttttttaaaaaaaacaaatatgtaccgggccaattgacagagaatgcgcctaattaaacatcaggtgcactgcattccgatggatcatcaccaccaacctccaatagcgcgtgcacacatcgaattctgctttcccggctctcgcggtctcctccgccacaagcaaatggcgctgtggtttgattcgatcgaatccttccgctgctgctcatcaacggagaccgtggcgtcctgtcttcccccccccccc

SEQ ID NO: 47128 - DNA, 5205 bp, Oryza sativa
ttcctgcagccccgcgttgtaatcggctaattagcttcaactaaaaagcccgatgcgagctattcccccatcggttatctaaagaagaaagctattctcccacatgcaagtgagaataccgtcatggccacgccgcatcgggcaaaatcgacaagcgagcaagacagggccatgtccaatcggttaaagctacgggacacatatgggatacagtggacgtgtaccatcgctcagcgcatgcagcagcagccggagcagccggccgattgacggcagattgaggcgctagtatactactactaggtgctgggaacctgtccgtgtcacgcatcacaagtctcgtctcgcagcgccacgcaatagccaccagactgacaaccggagacggaatatgcgtcaggccgtgcatccatcgtgaatagggaaaagggggcggaaaggagcacagtgaacagattgtcggctcccggaggaccatggccagccacagcgatcacatactccctccacaaaaattaaaaaaaaaacttgttttctgtatctaacgttttgaccgttcgtcttatttaaaaaaattattaaaaaaattaaaaagacaagtcacgtataaaatattaatcatgttttatcatctaacaataataaaaatataaattataaacaaaattcatataagacggacagtcaaaattggacacgaaaacccatagtttatcttttttaggatggagggagtagatcagtaacatgggacaacgccccagtttcgagtgaactaccaaagcaatgtagggctggattaatttgaggcctaaattagacttaccaaaattaatcatgtcaaaacttaccaaaatttaacattgacaaaatttagtaaggcttatttagaccacaaaacaaaccaaaccaaccagtcatatcccaaagcctttgattactgattaggtgctacgacgatgaaaacaacacgttcatacgcaactgcacatccctcgaagcctcaaactagcccttgagctactactaataagccacgaaaaaaaatagcaaagtaaaaataattatggatatcttttttctccgtgttttgggacaaacaaaatagggatagatggagaataggtttctcaagctcaatgcctaacggtgattattaatagagttattatctcatttctcattgataatagccgagcagtaaataggaaagttacaagcatattcttaaaaacggaaacccgaggataatcccaaacttcacattttgaggccattaaggttagttgttccttctattcacgatcagagtaaattaattagctcacggccagtagtatattcacttagtgtaagttagaagtatacaagagtgtatactccacccgatttactgtactctcaatccactcatatgtttttcttcccgattcatctgacactcattcccacaagttatatagtttttctatcatcggtttgtaacccccccagagtcactattttctcccagtccctgatagtccccccccaaaaatctctgtagtcagtcccggtgtcatcaaccgggactaaagagagggtagcggcagtccatcagctggtccttgtttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgattcatagattcattcacagatcaaaacatccaaaccacaaattaaaaaaaatcaaaaaaaaatcgactcaccggccggcctcccatcccgccgccggccggccacccatctcaccgcttcccctccggccggatctgggggaggggagggcgaggccgccggtgaccggcctccatcccgccggcccgcgccgggccgccgccggccgtcctccatcccgccgcttcccctccggccggatctggaggaggggagggcgaggctgccggcgaccggcctccatcccgccggcccacgccgggccgccgccggccgtcctccatcctgctggcccgcgcccggccgccatcccgccgccgccggccggccgccgccagccccaacccgtgcctggcccccaccagcccgcgcccggccgcctccatcctgccaccgccggccggccaccgccagcccgcgcccgtcccccatcccgccgtcgtcggctgcctctgcaagaggaagagggggaggggaggaggagagggggtgagagaagaggaaggggagaggatggagataaggaaggaaaagaaaaagatataaggatgggagatagagagagagagggggggctacgcatgcgcttgtgcgtgggctggtgcgtacgctttattcccggttgatattatcaaccgggagtaaagatccctgggatctttagtcccagttgaccaaccgggactaaagatcctatctttagtcccagttggtgttatcaaccgggactaaagatatcggggggcctgacaaggcctgacagatttagaaccgggactaaagatcatttttagtcccggttggtacaccaaccgagactaaagatcaaatatgcccgctgtagccaccaaccgggactaaagatcatctttagtcccggtttttagtggaaccgagactattgtggatttcgggcgaccgaccaaagatggtttctccaccagtgatatattcgtataatactcctttatttttcatattcctgtattttcttagtcttacgtttcaaaggtaccatataagtatacgctgaaaagtagactacgataaaaacaacctaatcctaaaatcaactttataattaagtgttaaatcttttgttggctgattagctatgaacggatgagagtgcagatccattcatcagttgcacttgaagcatgaggccgggtccggattggacgtgcgctcgtgtgtgaaggtgatcgtgcatgcgagggcccaatcgaaacaaactgactatcctggaattgcgatttgtgggtgcgcggttgcatcggcagctggcggcctggcgatatatcgatcatcatcagggcgggttagcacatgatcgaggcatctcgttgctcccaattatatgcgtgaagctccttttaggaacacaaacaggagcctagatatacaagatatccaatgcggcaaaagctcttgctcttttctgtgtagaccggttacttgattagggaggtcgtaatagtcaaaagagggattagttggcaccagcttgttttggtacaagtttatcctagtttagtaacgactcgccaaatcaggagggaagggcatcgaccccctcgtgctctctagttctcattgacacaggaagctagattccaccaacttaggttattgttttatcggaattgctaaatatttgttgacatatttttatggctaaatctttcactttctaaaccgttggatgtgtcctaaattcatactaacagtttaatacgcatcaagatatgtacttttaggaagaaaaacaaaatcatatttaggaatcgatcatgtgacctcatgggatgaaggcgtgactgccccattgggctactatatttttatgatctagattaaacttacatcttacttatactataattacatgcgagtttatatatgtaattatagtacaaatatagtgtaattatgaaaattacatatgtaattatagtataaatatagtgtaattataaaaaatatattgtaattatgttacaattacatttgacagatttttgggctaatttttagtcgaatgttgtatagatagtcccttgttttatttgagctataaggacgcgtgcttggttgatagtttaacaacacgtacatatataggccatatagtaatgcagccgtggtgatgcatcgcagcttgtccctccaaaaagtccacgaatcccctggatgcgtacaatgcatgtggcgaatggcgatccatctgatctgtaatgttctgcatacttctcaatcatcacacgtacaccaaccacgcaaatcgatctgataaaaaatatactcctactcgtaagatccgctcagtggcattctgcacacgtacggctactttaagctagggctacagttaattaggtatggatgtttgtcccctgcaggctgcagcatctgcattactgcttgaacgtcgagctgcgtgttatcgtcccgtccaagcagcacatgcgcacagtgattcagtgtgcgatactgggtgtgagctgggtggcgcctgtccggtataactttgccgatgcgattgtcctcgtagcgtagcacattccttcatcttctgaacatgttttgtacaaatgcgaaccgtacactacctatcagccttccgatattaattgctgccatgcaattcacctatcagccctaagggcagtagcagcgcgtcttgagattttaccgaacctcacccgtcaactagataaaaactatataagcaacatacttcacgatgcaaagttaccttatagtggatcccaccggtaccgtatttttcccttttcatctcccaatctctctcctcttgttcttttctcacgggaatccgaggccgatttccggctcggcccaggcggctccggcgccaggcagcacggcggtcgagtagcaacagcgtcaggcggccgggcgacctgagcggtgacggcgtcgggcagcccgagtgacggggcggtcaagcggcgacggtgccgagtggatctagctgctccacgacgccctccttctttgctaaactccttcacggccgtgcgagctcgggggatctggcagcgagcccgatgaagctagcaacatcctcacctcccttagccccctcccatcctcctcttcttcggcggctgtcgagcatgaaccttgacggagcggatgaagctacctcaccagacgatagcaccgccgagcttgccagatccgccggctctagccttgggcgtcggcggcagtagctagaccgtcgccatcttccctttctcccttttcatcatctggcacgcgtaaagtttaggcagctctgacaaacactga

SEQ ID NO: 47129 - DNA, 7837 bp, Oryza sativa
ttcctgcaccccacgacgtcactgcacatcactcatggagatcggagtagagtagagtagactggcagagcaggtacgtacagcctgtgggcaatggcctttaagggccttgtgtagttgtaaagctgctgatcatggagtatagtacgagtactctaggcgcacttctgaccatgttagctctgaccgacgagggggggtgttaatgcgatcgatgcgtacgtacgcctgccggtgtgggcgcgccaccggccacccgacccacggccacggggcacgggctcgatcggatcgcgtagctacctagcgtgcattgctccagcattcggatttttcgtcgtgcgacgcatgcgcatacatacctatatctgcacgcacccgtgtcacccgcgtgctgccgtgcgagacgtcacgtggaaaaccgccaatcgccatcatcctcttgccgtgccgtgcccccgtgccccgcggcccgcgcgctatgccgctatcgagaagcaatggccgcgaagccggcgtacatagctactgtagtagctagctttcagttggtgctttcgccgcgcgcacggggcaaacgggcaaaccggcgaactgttcgggcgatctccgggtgatggccctgatggggatgggtacctatggtggtgggttttggaacaaagctagcgatcgagaccgggtcatggggggaattattggcggagtggcgcgccggtcgatcggtcgatccattgttccttctttatgagcacggtacgtgatgccctgatggtacaataatgcatggtcgtcgtgggctgaattgtggtggaacaccgcggagcgcattagctggagcccgtggacacggtaagtaaacccgtccagaattggtccgtttcatacgattttttctgcagagtccatgtcacattattctcctcaatcggacttcgattacagctaagcatactgatactaaatttaagagcgacatttcactgcggatatatataccaacgagaagctaattaaccagttttattagtagcggcatgctaatacttttctaagagagggggagagaaagagagtaaaaaagaaaaagctgggacagtacgaaagacctaaacccaccacacactgactgcatccgatgtttcctactgtttgcacacagaagctctctgcaggagttcacgtactacgagccagatccctgtgacgtgcaggatgcatcaacggtattggttgcataaagatccacagcctaggcgtggaggacgactcttggtctttgcaaacttctgcgctggtgcgtacaggaattttgtacagttgtactgttggaggctagaatgactctgcctgcaggagggtccaagcttaagcaatgttcacttccattattagagttgatctattattaacagaagggacagcataggtgacagccacgtaccgctgtggttatatgttggtttcattgtttcacgatatatatgcatgcagctaatgtttcgtgttccggctttccggagatccgccactacgtttttatgatcgcttgctgagttcgggagcacgaaaaatggtgttacccattaacacatgattaattaaatattagcctaaaaacttaaaaatagattaatatgatttttaaagtaattttcctgtaatttattttcaaaaaacacactgtttaactgtttgaaagcgtgtgcggaaaaaaaaagaggtgagttaggaaaagaggggaaataacacaacctaagtgtgtttctaatttcatcgtaaatcaggtttgaacgagtctatacaaatagaaaagtaatattaacatctactgcatactttctatgtctctaaaagtctcaaaccctaacatcccaataagactttaagaagagaaatagaagatcataatacccttaattaatgtgaaagttatattagcggatatgtaggagaagggtattgaagtaatagaatttctcattttgcggattggtggtaggtaagaaggtagaaacttgtttattttgggataatttttaaactctagaagttgatttattttgggatggatggagtatcaaaatgaataaataaattataaacatacattttataatagacttaattatgctcatttgatatcataaatattagtattcaatgaatttaatcagaattacaatagtttgacttagaacaaaactagcaatacacttacattttggagtggagggagtgggacctagctacaacatgcacaagtataccaaaaatatgtaactaaaagttaaattcactaatttaaagaattgtgctctgtgagggctatcttactctatattttatttacatggccaggcaaaaaaaaacttttatgtacacaataatattttgcatataataaaattttaaagtaaaactagagttaattaatatatgcaactcctagattatgtatgttttcaaagatacaatatataaattacaccgtcataatctagactcatcattatctacttatattcatcctaaaatataaaatattttatatgagtaaaattcgttatattatgatgtagtaataaagtaagtattttttttaattaacatggtttttttatttaatctttgcggcaaatatagattaagtataccatcgttaatacttcataagtctcaaaataagttgtttttagagtctaatcatattgtcccaaaatcagttaatttttcatctttatctaccttttctcataaatcgagaacttttttccattcaatatgttatctatccatctaccaatagtattttttcattaataacggtattttgatcttctctccaaaaactaaatttttgttgggatactagggaacgaacaaacgagatttggagggacactaggaatctatttattttgagaatccatacatgcaacctaattaaatagcaccatacactatgtatatgtatggatctacgtactgaagcagggccatcgctcatacagtaataatttgctcgtacgcactcaaacaatgaaggagacaataaaccaaagcagcagggtcaccgtgacaccaacccatgttctcagctcactggagtactggatgcttggatcccttaatgccactgtcatggtccaactaattcccggacatagcaaatgcgtgtcctacattgtacctatcacatctctaactccgcagtttcgcgtgcagctagctgcatgcatgcctagctttgtcagccttcttccagaggtgaagccaggataaaattatagtggggctcctcagccttctgagccttataacaatctcagacaaagtctattttagccctcttgtaataaatatatggatttaaattttagggggggtcttaataggggctctaatagtttattagggggtagggggatctaaagaccccccgcccccacacactgcctccaccactgccttcacccctttctcactaggagtgtgtttagttcacgctaaaattgaaagtttgattgaaattgaaacgatcggacggaaaagttaaaagtttgtgtatgtaagaaagttttgatgtgatagaaaaattagaagtttaaagaaaaagttgggaactaaaccaggcctcggtcgatctgcaagactgcaagggtacacacggtaggtgagagctacaaggaaaccgtcctggccgccggcacgagcacggttgcgtgaccgagataagagaaacgcttgactactcgcgcgtgcaacacgcacaaccggttgaagaaaagaatggcgggacgccggccagcacacgcggtcgtcgtacgagagctctcgtgctcccgcagcgtcttcctcgcggtcgcggagtatacaatatacgtggaccggcacgataggccgggttcgttccagatctcgatccactgcaggcaggacggccgtaagctagctacaagaacatgtgtcgaccgatcggaggtagggtgtcaatttgcactgcggggaaggcgattgacatcaacggcaacgcggtgtgttcgatcgccaacttggttgacataagaaccaggcggcggttcgcaggctgctgcctaattaacgttctgccggagaggaggcatatgcatgcatgcaaggccccatgattttgttgggcgcgacgaggatgtcaatcagagcatgatatgatgatgaccaatatgcatgtgagaatagtggttccgccaacgagattttttattagataatgaaataaaacatcccggcctttactcatcagagttacagccaattgttacaaaagtaacacccaatcactgagtgtagtttaaatgaattaaacacacacccaacaaaataaaaaatcaaactaagataaggagagcacatttattcaagtctatttgtgaatctccatccatagtttgcaaagagttgcatgaccgttgtctcaagcctacgacatgcaaccttcataagctctcgatcatcttcatacatttgcagctgtgcccaaaatcggagccaatatgttgccctgaaaattacatacatatatgagatagatggtaatttgtcagaaaccatatcattcctagtcaaccacagagcccaacatatggcagaagctcctacaagtatgagtttactcttcttcttgtctaccccaaaagccaaccatcaaacatattagatatggtagtaggaaggtataaaccaagagagaactgtactgctctccaaacaaattttgtataatgacactctataaaaagatgttgaatagtctcatttttcatacaaaaacaacatcttaaactgccattccaatttcgtcttgccaaattatccttggttagcacaacccctttaagcaagtaccacataaaaatcttaatcttaagtggcatcttaagcttctaaataatcttgtttctctcaatataaccattattaattaaagctagatacatcgacctaacagaaaatattccattctgatgatattttagctaataaacgaaatatcatatttgcaaacgaaaacagtggttccgcctaccacgacttctgtttaaggttttggagtagcagtacatgagcaatattccaaatttaaaacataagatgccattctatttaaggtaacgagatgatccgtcgtagtagagtgtacaaggactacggatgtctcaagacacatcctaagttaggccgtgtttagtttgtgtgctaaaatttttataagtatagggacacacatttaaaatattaaatgtagactaataataaaacaaattacagattccgtatgtaaactgcaagatgaatttattaaacctaattaatctatcattagcaaatgtttactgtagcaccacattgttaaatcatagtgtaattagactcaaaagatttatctcctaatttacatataaactgtgcaattagcttttttcttcatatttaatgttttatatatatgttaaatatttgatgtaatgaaatttttaaaaattcgaaggaaactgcaacattgccttagctagctggagtagtatttggagaagaacgagaacgacagaagtacagaaccaagcgaccggccattccctccctacagtggaggctgtctgttttgcatggctcaacgcgcatctccacagtgctacggagcatacgctatagtatagcctataggcaacggatggtcctatgcaaaaaagaaatgcgtagtctggatctggccaagtgtccaaaaaataacaatgcatctatccgtcacatgcggagaaagctgtcgcgtacattggaggccatcaagctatacaaccagttaggggtgtctagatagatacatataaagttttggcgtgtcacatcggatattatataaattattatatgaggtgttcggacactaataaaaaaactaattacagaatccgtcagtaaactgtaagacaaatttattaaacctaattaatctatcattagcaaatatttattgtagcaccacattgtcaaattatggagcaattaggtttaaaagatttgtctcgcaaattagtcgtaatctgtataattagttattttttcagtctatatttaatactttatatatgtgttcaaatatttgatgtgacatgatgtaaaatttttatgtgcgatctaaacaggacctaaaattttagcataataccatatcaaatcaatgtgtttttgctgagaccagcacttttcctacagtaagtttccccgcggagtaatcaataaactcccggtgcctaatgccctaatctcatagtggggcccatatggcagcgccctgcactgacgtactgacagctcccagtgccccgaactctcgcaaactgccgccgtctcacacacaaacgtggccacacccccacacgccagtacgccacccacgccacttcactgcccttttggcccgaggccgagggcgtggatcgacgcctacgtgccgcctgccgccgccaccgccgtctgggaggatacggcacagtgcatactggattattaccgggtactttggtagagtggtgcaacttagagcaggtacaatagcagattataaaagctataaatatattttaaagagataaaagaaaagagaagagcaacgggctacagatctatagccagctacagcacggactgcaaaacgtaatgtgtgtgtgacagtgggaccagatattaattgtatagtaagcaactattgtatggattggctattacattggttatagatgagcaagtttaatagtatagcccgctagtagctccaattcatctatagccgatctaatagccaattcatacaataggtgcttattatactataaacatatggttccacctgtcatacacacattgcgtcttgaagtccatgctgcagctggctacagatctgtagcccactgctattctctcatcttttatctcattaaaatatgtttatagctagctaatagtttactattgtgcatgctcttagggcagtcccaaccctccacataggatggtgtatatggcattaactacattgctatgtaggacttttagcttatgtggcactatattaattaagagagagagtgaaaagaggaagaaactgggtctcatgcaagacagtttcaacacgagaacctatgcactagacactatcaggttttgtattgggagagaatagtgtcttcataataaatgaagaataaatatgattggtagagaagagagatgatgtatttattaatagcccactttaagaaccatgagttatagaatgtagtttctattgtgatgtcttattgacatggtactataaacactatttatataccctatgggttgagactgtctacgccgaaggatgcctcctgttcggggacaacgaaatcggcgacggtcttgagaaggcagcaggcatacctcggagagctacacacgtttcatctcgcatttatggttttacttatctcaaaaatgatgattgttggtcgggcgagtagcattttcttttccgagaaaattgatatcttgccattttcaaaatagagtttcgcttgaatgtcattctcaaaagtggtttcgctaaaatgacacctttaattagggacaacacgttataatgccatttcatctatttcttctcattttaatgattttttaatgttttttcttgctgagacagaccaaaatacccttggatagtctcatctctccctctatctcttccttctatccgttgcaaatggtgggtagcgccggcggcggcgcggctggggacgaggacggcggcggcggc

SEQ ID NO: 47130 - DNA, 7452 bp, Oryza sativa
tcctgctgctttgcttcctagcttgtagctctcgtaggcatgaagcatgtgaaggaagcagaagctaaagccacgttagatgtgcatgtttcattgaatcaattggcagctagctgggaggaatcgttgaaggttctgatagatgcgtggatttggggattaattttttcacctgtttttctgtttcttttttccttattgatgtatgcaagttgttcattaaaaaaactgtgtactacattgatttctttggaggagtgataaaaaagccaaagatttgtcatccactacattgatttcattccaaaccgagtggcgctggcaccggcgccggcgctgcccaccaactacaacggataggaggaagagatagagggagaaatgagataggatccaagggtattttggtcatctcagcaagaaaaaacattacaaaaattattaaagtgagaagaaatggatgaaatggcattacaacgtgcacgttgcccctgattgaaggtggcattttagcgaaatcacttttggcagtggcatttcagcaaaaccctgtttagataatggcaaaatgttaattttctcttcttttccggacaggtacctttttagaaaaagcacaactgtgatatgcggaaaacattcacgcccctatatctgttgctgaatttgccccgttgtttactgcctacttcccccgtgggccccgtccaaagcaaaacgtttctggtagtactcactccatcccaaactagtacagtataaactataaaaagtttctggtagttgtgattagtgaaatactgacaaatcattcagtggagaaaataaataagatattgttgcaattagttgatatggatagtaggcacagggtaacaccgtttaaaatgcatgattgaaaaaacacataaatagaaaaaaaaacacaaatgaataggataaaaatacatatgcaaaacaaagaattggagaagaataaattttatgggaataaacataaaaatatgttaattggattattagagtttaggatcccttcaaatcaagactatttgtggaagaaagtttcctacatttttctcttgctcatttatacaaataaaaaacaacgagttagtcacaataatttgaatcattggctgttgctgtgtgatgactgaaataatggtaataatttcgattagtgagagcctagctgtgtaggatcgaacacaagcaaccaagcctatcagagggggatgaatggtagggaaaaccaaaaacccaaaaacttttagcggaaataaaagttaccctcaaatcgatggaaatctcgacgtagtcctatcgccgccggtcagactgctcgcacgccaccggttagatcgccgccctgccacctgaaaccgaagaaacacaaatcgaagaactctcaaagtagatgacaactttattgcttctctatgtgtttacaaagtgcaacaacatcactccttacaaaaatctcgagtaaactcgaaaccctaactaaactatcaactccacgctctgaaaaacgatacaggaagcctcacgctccctctctatttataccacgaaaaacctcctactcaaagtaagtgtagaactcctattcatgctgctgccaaccatcggcatacatacatacatgcatcagcatccatacaccacacatgcatcgctacatatatgcatacacgtcacgctacagtacccagagtactgtagcacatatacttatcctccaagaatcctgactcagtcaccttctcagatggtatcccgaccgcaatagacctttgctccttcctgagtatagtcccggtcctcaccattgaccaaggctgacctcaagttacctgcacacaatcagacaaaacaatcgtttctgggcacagatatcacaacctaacccacattagtcacacgcactcacaccaacatccacacatcttttcaaaccaattcgttgattaaatcatttgcaaagccaattgttcatcacaaatattaaccatgacaatgatttcacaagctgaaattaaatttcagtgttggtcatttttgctcacttctagttgtggaagagtagaattgacgtgtcaggctggtcgatgtttctccaagcagaagtatgttgaaaaacctaatcaaatttgctaaatggcactcaatagaaatttggtatgaaatcttatggattttagaccatcggatgcatgcccatgcttcttctcatccaactctaacaagcatgttctcttctccagcgcctgtggggcacaaactctaacagaagacatacaagtcagagtttgggataggggttggagtaagaggggttaggggagggaggggatggggctttctctaaaacatagagggatggcagcgagcaggatatgggcgggtggtgagatgccggtggcggcgcggagccacaggggtggtagctgggaatggattggtgttgggggcggggggtgaacaacacagccatgttagtggtgaggaggcgatggcttgtggtggcggatgcaacggtagggggcacctcgctaccgctagcttgaagataaggacatgtgagaatgaggagggggacgacgtcaccaagagaggggctcaccaacgctattcacgccttccgattaactgatgaggtgggggttaatgtgataggcggggaatgcggcggctaaacgacgatcttccgctcactcactcgcgtgcgagcggggaagaagggagagagggaggataagattacttatgtgcatgaatcacaaagcccacattaaatggtcaataatctatcaacatattaaagtaataaaaaaagaagcctccatgttcactctcacgcattagaaaatttcatattaatcagagaaaaggaaaaaaatagagtctttatagaaatacaatttaaaaaagcttaaatttaaaattaaaaaataacaaatattgggagaggagactagagtccatacagatatacaatctagaactatctgaattcggaattaaaaaaaataaaagtagagcttatagtctatatagaaatacaacttagaaataactaaaatttaaaatttaaaagtatgaaatattgaaaaaagagtttagagtttatatatgaatataatttagaattaattgaaattataaattaaaaaataggaacattgaaagatgagtttagagttcgtatggaaatacaattagaaatattgaaaattcataattaaaaaataaggaatattagaagaaaagtctagtgtccatgtagaaatttagaaccaattgaataaaaagtaaaataaaagtagagtttaaagtctatatagaaatatcatttataaataactaaaagttaaaataaaaaagaaagaaagattggaagaagagtctatatttcatatagaaatacaatttagaaaatagctagaattaagaactactccctccgtttcaggttataagacgttttgactttagtaaaagtcaatctgttttaagtttaactaagtttatagacaagtattgtaatatttataatactaaattagtttcatcaaattaataattgaatatattttcataataaatttgtcttggattgaaaatgctatacttttttctccaaacttagtcaaacttaaagcaatttgactttgactaaagtcaaaacgtcttataacctgaaacggagggagtaaaaaaataaggaatattagaataagagtgtagtggaatacaattataaaataattaaaatttgaaatttaaaaatattaaaagaggagagtagtgtccatatataaatgcaatttataaataaaaaatattgaaagaagggcttagagttcatataggaatataatttataaatagcaaaactttaaaattaaaaacaaggaatattaaaagaggggtctagagtttatatatgaatacaatttagaaataattaaaactcaaaatttaaaaataatacaatataaaaattacccattggttagtttggttagtttagtacaaaattttaaattatgttaccatttcgatatattttattaataaaatataaaaatatatatgctattacgtgagagaaaatatataataatgctaatcgtatagtttgcatagactatcatgctgcaggtacacatgatataagaaggattcgtgtcgtaagttaatcaggcagtctcaaacctaattgtaaccagtcaatggttgggagaagtcgaaagcaagatatacagagacgtgcaactattttccaagatagcaacaggtcatctggcagcactttacatgtggtgcttccattgcagcaataagccatggccatggtaaattcatgggcatgcattgatggggacacatgtttttagtgatccttttcagccttttccacccagtaccaccctcaccctatgcagctagtaggtaggctttccccgatctaccttcctctctgactctctactttcaccgaaaccaaagaattgcttagaactaagctgttggttagcgagttaattaatcaggatcctagtgctgttgctatgtacggagtagatgtatacttatcttatccattaccttcccttgcaatcctggcaactcttgttcacatgtcatcacaccgtgcctttccactcttgccactgggattggacttgattagagtaaagttaattcgtgctcgcactgcaaatcctggtcctcatccaccttattagtcaaactcctgtgggtgtaaaattattatcccaggcttagagctaaaaaggtatctacctagctctttggaggcttgctttgcgactactaatatactattcgccaatgtcttcctcatgtgcgcgatttgatgcattgttaaatgcggctaattagcatccctaatcctacttcacgtggctaatgtaggtttggggtggcaattgttggtggcttggtgctgactttgtagcagagcacaactcagcaagtatgtatgtacagcggaagggcagtctgagccaggttaggagcggattacggatgtgcatcaagttgcaccaatatactagtaattatcatgtaagaagcgtaacgtctggctgcagctgcttaccaaattcgcctactaccggagatttttaattacttggtaagaagaacaaacaactcgcaaaatacaggcctactcggtcgctgttctaaagaaactcagttgctgttctatcggtccttttcaggatctgtataatccataaaagaggacgaaaaacccttgatcaaaaggcatgggctttgctttgttgaccccgcaataattcgccacctctatatcgatgggtcggtggctcggtgcgtagccatccatcgcaaggagaccgcactggacggtcatggcgtcaaaaacgacaggggcatgaatcgcaaaagcaataaaaacaggggcatgtacaggcagacaatccagtggtagttaacctcgttttcatcgcatcatttccctcaattccaagctccggcggatcgatgcacaccacaactccacaaggagacgcataacgtgaaaccgatcgctcgctattttactctgcaaattatctcggccattcatgagcacgcggtgttcagtacgttcgagacactgagacagcgacaatgtgttttgtgtctatatagaaacagatcgatcgcacagtaacacagacgtcgaataagtaaacggatatactactactacacggctgtaccgcatatacttggagtgatccgtcccgattaaacggacaacttaatcccttattaatcagctagtggcacgtactagcaaggagaatctcataggagcagtaacaatccagctgcaaactataggagctactactacctctggctgacaggggcagaaaaatggacggggcccggccggaccatgggtggtccgcggcctgcgtctcgatgaaagccggcttgattagcgcacgagacaccacagctactcgaccgggtggtttgtgcttgcgctttgtgctttgcttaatcatgccgcgcccgcccgagcgggccgacggcttatgcaccgctcgcgcgcgcaggggccaaaggaggcagagcgacatcagatgcgtgcgtgccgccgtgccgtgctcctctgcacgccacggggaccgcgcgctctgcgtcgctcgatcgggccgagggggttttcctctgcttttctctgaggccttcacgtatacgggggcgcaagcgcaacgcgggcaccactgagagctctcggccgtggtgatgccggcttgggcatcggatgccgttgtcggtatagagggggagagctttgatggagtactgcgccagtgtgccgggcgcgtgatggtcctggccctgtgcatgtggtgctaccctggtatagcctgggaggtgtatccgttctttttacgtgcttgggtttagcatctcctcttttctttccacctttctttctttcggtttatcaaatgcatctgcgcaacgaaacttcaaatcgtgcacaccgctgcaggtcgtctattggaaaaaaaaaaggcttaacagatgctgagtggagatttcgttggcatactcaggggtaggagtactattctagggtagtacgctgaaacgaagagaggacaaatggcaccatcaaacagtgccaacaagtcaatggtatgtgcatactccaaaggacgcgtcgtcggctgctggtgacgggaaaccgaaaagtaaaaccaaacgacggcgcgccacctcctctccgtttccaaaatcgcattgcctgcctagtccacttccccgaaacggcacgagcggttaacactgcctcgcgccgcggccgggcacaacccgctgaagcctgggcccccgcggtcgcggaattttaactccctctaccccctccatccccaaggacaagagaggagaggagaaggagaggccgcgcccccgaaaggccaaggacgagcgtaccaccaggtcaccaacccgacagtaaacagtaacccccggtggtaacaaaaccgacgatgacgacgacgcgaggcgggcagagaggggggaggggaggggaggcgttggcatcaccgcaataacaacgacgacggcaccagcaccaaccaccagtcgcgcagacaggcagcagctgacgcgcgcgcgggggcgagggcaggaacccgtcgcgattgggcggacgacgaaccggtcgcgcgcgggcgcgttcgggaatcgtggtggatctgacgccaccaccgccgccgccgccgccgctcggttgctcctctcctcgccgcgccgtcgcgtgcgtcgccgtcgcctccttgcccctagcgggcggccgggcaattccccgcgcgcctgctcgatctgcctcggtggtcaatgcgggcgaggagatgagcggcgccgaggaggaggaggagg

SEQ ID NO: 47131 - DNA, 3243 bp, Oryza sativa
tgggtcgatcggcctcctacgacgggcccatccggccggagacggtgtcgcccatctcccgatccagatcggatggcagcgtgccggcctccgccaccaagcccccgctcgcggcccggtcgcgccaaacatcgtccgactcctccgaggccacgccagggggagatgacgcggaccccaggtgcctaatccgaaacctcgacgacggcagcgagttcgtggtgaaggaggagtccgcgctccgcgaggtgggcacggggaggcagctcaccatggaggagttcgacctctgcgtcggtcgctcccccatcgtccaggagctcatgcgccgccagaacgtggcaagctccggttcgagcaacggagcgtccgctctcatccagaggtccagctctgattcaagcaacggcgcgacgcgccacaggcggcgcggcagctggctccggagcatccgcaacgtcgctggctccatggtggtcggctcccgcgaccgccgaagcagcgacgagaaggacacctcctcggaaaagggagggcgtcggtccagctcagccacagacgacagccaggaaagtgccagcgccgtgcgccgtggcccggagcgtgtcaaggtacggcagtacgggaagacatgcaaggagctcagtgggctgttcatgaaccaggatatacaggcgcacaacgggtccatctggagcataaagtttagtcacgacgggcggtacctcgcgagtgctggggaggattgcgtgatccatgtctgggaggtgtcggagcttgagaggaaacgggagggaaatggggtgtgcaatcaacttgttgccgtcgtgtgcaatggttcgccggagccgatattggcattggcaagtgttgatggaagctgttgggagaagaagcatcgggctagaatcttggaaactcggaagtctgcgagctctgaccggttgatgtttccagagcatgtgttcgcactatcagaaaaaccggtcaaaacttttgaggggcattcggaggatgtgcttgatctctgctggtctaaatctcaggtaatgttacaaggtttctgttcattcaaaattcctccactgttgatgctccttgaatactcctataaaggaaaaagggtgaaggttgaacataatctcacaacctaaattccactaaaatttagtagtgacagagtgtgcttcttaactctcagttaatttcaactatagtcttaacatctatggtgaaacctcgaagtgcattgttttccatcaaaccatctttgtcataactgttagtccaactgtgtcagaacaagacactggcatcgagtagtcaagggctggtacagttcaatccttatcacactttggtgtagttcttctgaaacatggagcatattgatgcaaattggtgtcctttagctctgaactaatccttctttgttcattggaaggaaggttagaagtgcataagcagcaatctggcgaattgcctgcctatcgattgcatcatatagaagaggcactgcccaaattctgccatagactagttacttaccatgtccaagctcatcaattctattatatctgttacatgatgtgacatgaatactcctgtttttcatttagtgactaaattttagaaatgattcactaataagatacacaggaatgctatgatctacctttcagcatgctgtaatccctaaaatggcgataatgtaacaattagaaaaataagtttgttggattatgtcctatgaatcaatgtaaaatatgttgttctgcaaaatccatttagccttaatataatctcccatactagtactagtagataatataaatatatttgaggagtttcagccttcttttggtactacgttacaggttatttcatttattcatgtttaagatggatataggtttcaataaaggtcccgatgcatgactctggtgactcctgtatacatagatgaagttaacttggtaccatgttatatcattatttgtccaaagtaggactgtcaggaaatccttctagcatgtttcatattcagcatggcatgctgcataacatggatgacatatgttgcttgaccaattgactttgaatttcatgcgcatcagtaacttatggagttatggtctagaaaccaggactcgcatcatcaactatgtattgaaatttcagatgtctattgagagaatgttagttcatcctactagcagttcattgccctttgaaagtccaaatgcatgatcagatgctcctaatttgttgggcccttgttgtaagaagatgttagtatctaattggctttacattgtgtttggctggagaagataggaacttctcccaatgcatgcaaaacggagcggctcattagcacatgattaattaagtattagcttaaaaatgaaaaatggattaatatgatatttaaattaactttttttttttgcaaaaaaccacaccatttagtagtccgggaagcatgctcatggaaaacgagaaagtagaagatgggaagagggagtattgaacacacccagagggtagttaccttttgcagctagttatacatatatggtttctatataccttatgtggctagttacatatccagacttcacatttgtcaacaacagttacatgcttccagcaatgcatccccaaattatgattgctacaattccatgaatcttgtagtggtattcttatggttttgtagctattccagattttaatttctttctttttcaaacatcgtgcagtacttactttcatcttcaatggataaaacagtgaagttatggcatatgtcaagaacttcatgtttgaaaacattttcacatagtgactatggtaagatctcgagttgacattagcagttttgcgtgttctctctctcccccaagcacatatgacgtttctcactctgcgaacatactctaaattttcctttgctgctttgcgtttcagtgacatgcatccaattcaaccctgttgatgatagatacttcattagtggttctctggatgaaaaggttcgcatatggagcattccgggacgtgaaattgttgattggaatgatctgcatgaaatggtcactgctgcttgctatacacctgatggacaggtttctacactatatactgatgtatgtgaccgaaaaggtctttttgtatgttagctctaataccttgtctcatattttctgaagagagcattagtcggttcccacaagggca

SEQ ID NO: 47132 - DNA, 1429 bp, Oryza sativa
attcctgcacccccgacctatttccgtggcgtgtcgtctgctgctacgtctcgtcgcttgttatggtgtgctaccgaggttccttcttttattgcgccaccacctattgcacctcaccattgtcgctgttgtgcttttgtaccttgcctgtgataatatatcgtccggtgtaacaaatttaggtaggttagtcaaacgaaagaccaaactatcgatttaattaaactattggttagttgttttattttacaagttcggtttctcattttctgaagaccgaaaattttaaagaatgaagtcgccggaccaattttttggttaagaccaaatgccaacctctagataggaatattgtagcatgcacaaccttatgtgactttcatacagcaaacgtgatatggtcgcagggtgtgttcaatgattggacggccatgttgtcaagagaggggtttggacgggctgtgacaaaagatctgcaagcgtaattgcacaggtgcacatagggatattattagatatagattcacattcacaggtcagctgtagcctataggtttgtttatttggttagttataggccgttggttagctttttaaggtttagctaggctagttgcgtcatgtgtttggaggcttttgagaaccagtgtcatgcatgtgttgctgtgatgtcatcaaagtcatccggttcttcagttgtgattgacaaatgacaacatcgtagaatctgatgggctgttgtggagcaggcaattggcctgtcgcttggatccgagtgttcagtgatcatggccaaatcaaataggagtgtactgtgcggaccagtcgcaaggggccttgccgactgcgggttgaattctttgcataaaactcgaatggcgtatatatcaaccgaaatcgcagtataacaaggttttgaattgtttaatgtgggatttttgacgaggcgaaaggaataaagcaggaggagttttcaaacaaacattacatctaccgtccctcaactttacaccgaatttgtctaacatctcttatcctcagtaccagaaatcttcacccctaaactatacaaaacctcccaatctagatcctatagcagtatagacacctggtttcgctgacgtgacatcctagccagcaaaaataaataaataaagtatatgtggcccacatgtaagtgagagaaaatgatgtgggccccacatctctcgctcagcatcaccctgcccatcacggccagtcgtcgcctacccgctgaagaagatgagagaagaaaataagagagaaaagagaagaaaaatggaagaatgaaaatatgtggggctcacattattttctctcacttacgtgtgggccccatatactttaattatttatttttgctgactaggatgtcacgtcagcgaaaccaggtgtctatactgcttta

SEQ ID NO: 47133 - DNA, 5562 bp, Oryza sativa
actaaattctcattgtagcgatttgttgagcgaagacttaatttagccatgcgtacatactacgtaatccaaagagtttaggtgaaactgaaaggccttttttattcccttgtgaagtacatatgttttatatttgaagatgtcattaccacggaatttgttatcactgtcggttttccgtctggattaggccgtcgacaatgttaaatgagagcaacatcattagttttagaaccgatgtatcattgccagttcatggcgtaattatatggcaataagtgaagtatcactaccagtttgtggagcatattgcaagtgaaatatggacaatcattgctggtctcctcgtgaaccgtttgtgttatcggctcatagcaagtttttatagtggaggtgatagccacctctaaatttatacacatcatctagtttttaattaagaagtaatgcatacaacatgatacttcaatcacacttaccccaatacaacatgataattttacttctcttaatctattggtctatttgtttcatctcccttggagtacatagctcagacagtctgcacaatggtgtaccttagtcctgtcgatattatcactgtcggctggtggcaagaagtgacagtgttgtaccactatcggtttgtgccgtggggcaagcagtgatcgagagtgttccattgtcttttcgtggcacaaccgactatgatactaagggcctatttggcacagctctagctccagctccacccctcctggagctagagctcagccaaatggtttcagctccaccaaaaagggagtggagtcgagtggagctctctcacaaaataaactagagttgtggagctgggtttagacagctccacaactccactctagacctaactcgatcctagagttaaatttaggagttggagctgtaccaaacatgccctctgacgtttagtgccactaacctagaaataatgagtgtcactgccgacttgccggtttgggcaggaaatcgtgagaaactgtggtaaatgggcaatggtagaaccggaagtgatgattgtttctgtgatagtgtgccaacaataaacattttttctctggtcataaatatttaacaagattttatcattttctattgaaattttgaccaccaatatataaattcttaaatatgtactttgtttaaaaaattgtataggtagattggtactggagagtagcatcataataattatgaccgtatgaagtatgtatatatagggcgtgggtcaatggcggtgggtgacgtgtaaacgtgctatgctttctctcacaaagcttacgagagcatacaatgcgcatttgcccccaaaattagtttgatatagtactatagccaagcctcacattgagtactcgttgtgcgcgcgagctaaatagttgcaagcaacgcgtatttttcgtaccttgcaagagtgtgaaagttggacgcgacagaatcatctcaccttcgatggagactggggagtaagtggtgaccagtacgtagtaatatacctgctcctcaacgcaatctatatgtggcgtgtactaagttgtggctagtcaaaaccacttgtacaatttcggactcgatcgataaatatcccaacgcggcagcctacggcagcacgcctcgagtgctaatgactttgcgcggtggcggcgcgtgcagcttgacgtcgcgctgctataaaaagggaaggaaaaaaaaaagaagtcatcgcgcgcactacttacatgcggcaaggtcagcgccggagctgccaatgcacgcgatccatcgagcaataagctagccctgcacggaattgaaaccacacaacgccagcttggtcggtcgcggctgacggcgccggcgcccacaccaccgttgcaacggccccggccacgcgcgcgcgcccggcgcacgcacagcacatacatgggcttagccacaagcgcacgtagctactcgtacgtcgcggccggtgctccgttgggagtgggtggggttgggcggctgtccaccgtcacgcggggcggccgacgtgggtggtggtggccgcgcgggccagcagcctgcagcttcgatgccctgccgtattttgtactagtagatttttgtgtggcagtgtggcacactggcacgtacgcgcgcggacttttttccgtgctggcagggtgtgtttagtttctgaaagaagttggaagttggaagaaagttggaagtttgaaaaaaaaagttgaaagtttatatgtgtaggaaaatttttatgtgatatgatgtgatggaaagttgagaataggagggaaactaaacacggcctatatagtagagattactagagattaggccatgtttagttcccaaaaacttttcgcaaaaacatcacatcaaatctttgaacacatgtatgtagcattaaatatagataaaaaaaattacacattttgtatgtaaatcgcgagacggatctgttgagcctaattagttcataattagtcataagtgctacagtaacccacatatactaatgacggcttaattagtctcaaaatattcgtctcgcagtttccagccgagttatgaaattagttttttcattcgtgtcaaaaaaaattcttccgatatccggtcaaacgtccgatgtgacacccaaaaatttttatttcagcaactaaacagcccctaatgcctgtgccgctcttgccgaaagcgatgcgagatcggcgccggccccggccccggccggctgctgcgagagttaggtatctgggcaggatgtacgtactcacgcacgcgtgccccaagatgcgcccaaaaagaaagctggggagcggtcgcgaaccaacggccactagctgcctcgatctcggtcgatcgatctggctagctcctcctttttgtcacatatctccccggggaatctgaacttggtcgatggaagtggaccggcaatcacacaatgccttgatgcatccatggcttgatctttcgagaatcaagtgacagcgttgcctgcggcgccaatcgatcgctatacgagtagccggagaagatcgatgcgtgctttcctcggaggctttaaactcaccggttttcggtaccgtcagatggcgatcgagcagccagagaagatcagatatgcgtgcattcccggggagctttaattcactggttctctgtaccgtgagatggcgacttaccatgagagctttgtgctcgtcgtggtctcagtctcgttcggcctttcacagatgggagaataacaataatcgttgctagtattgactattttacttcgttttcagtttcatcatagtactaattgaagttcataaggacctacaaggcctacgtaccctttcatcaacgttaccccgatatggcagctgaccctcgtatcagtatctgatacgcgcccggatacggatacgtgcgggatacggccggatacatatcccatacgtatccctcatttttctctttttcagataattaaaaaaataccgatactccttcgatacggcgggatacgtacatgatacggggagccctaaatcacacagaacaaaacgcatctcccgttctccccctccaaacgcgccgccgcttgcaaaacccaatccccatcgcagcgccacccggccgccccgaccacgccgtcgctgcgtcgcctcgccgccggcctgccctacgccttcgctgcgctgccttgccgccggcccgccgccagcgaccggcgccgcaccgcgccgtgcgcgcctatgccgtcgctacgccgcctcgccagcgccgcgccgcgccgcggcctatagccttctccgcgccccctcctctgcactctcctccaggagctccagactcctccacgaggcattgcgccgctgcctctgatcaatcctgcatcacctccaacgacaacgacgttgaggacttgaggtaaatcctgcatcatctactatgtgaacaatgttgcctaatgtctaccatctatttgaagaactatgttattttcatgatttcatctactgtatagtcttgcacttatttatgcatgcctcttcaataaatggtgacttggtgagatgctgtgagcctgtgaatctgtcgtactgagatatcatatatatgatgattggtgcattggtggtttgatgctgtttgcttcctattttttcagtctatattccacactcaattttttatatatatatatatatatattcgcgtatccccgtatccatatttttaggaagatggtgtatcccggtatcgccgtgtcgcgtattcgtatcagcgtatcggggtaacgtagcctttcataaccgcgattgttccaaagaaaacagcagagtttacatcagtagatatacagctcgtaaaatagcaagctaacctcaccgtgatgatgcagtgcatgtagcaagtgaccgcaaggtgatcaggagaggaagccaacaggcgtgcttaattagcctctgagagaaaaggagagagatatatcgctagccctgatcgagaaattcacgccgatggatcgtccagacaaatcacgtggtgaggtgcctaattaagcagctaacagtacgacaaaagaagctctgattatgttagcctgttaataatttatgcgacaaagcttatcacttcccttaactaattcggggagataagatattatacagttctaacagttcgatatgatttaattaatccattccccttctggcatgccgctagaacatgccaatcgcgaagccctacaagccgggttgtcatatgtcattaagaaaactaatctccctaggcccttcgtcacctactgaatatgttattaacacggtccaacaggattcaggaacatcagaattttcctctcttttttcttaaacatgaaactaacaaagcaattattggcagcgtgatcggattggcggaaaactcataaactcgagtataaaaacgagccactaagctagtcctctcgagagattggagtacaaggaaagcaatgggaggggtcaatctagcaaagcccacattgacaagtatttctttccagatcagtaccgtccacgcagccgtgacagcaacagaaagacgccatgtcgcgatcctgacatcgtccttgagattcgtgctcccgtgacgtgtcggcatcggagggcccctcgtcggggtcaatgggcggtggggccagaccaccgaccgggatctttttcctggcgcgcagaaccgtttgtttccgccctctcttttttcacaggagcaccggtctctggcttttctctcgacctttttataagcgcgggggttatcggtcgcacgcgtcgcggaatcagaaccaaaccccaccaccacacaaacgcatgcgcgcgcgctcccccgcgcgcgccgcaccggtcgcccactcgcccgcggacgccaagcgatcgtctcgtctcgcactgtttcaccggtcgcccaatcgccaccgcgcccgtacgtctatacagcgtggcaagaggtgcaagttggtgtcaggatcagtttaattacaaagttgtctgatctatatat

SEQ ID NO: 47134 - DNA, 4490 bp, Oryza sativa
gtcctcgtcggctccgccttcgcctcgctcttcttcggcttccgatgctccagtccgcgtcatctcgtcgtcgccgtcgtcgccctcgccaccgtcggcgcgacacatcttccccttcgcgtacgaggcctccacgacgacggtgggtgggagcccaaggctccacccgctgtcgtggcagcaatccagcatgtcccagcccgcgtcgccacagcaacagcagcagcagccgttgcagcaccagcagatgatatcgttcggcgcgtcgcctccgtgctcgacgacgcagttcgtcgtcccggagaacgcgcagcagcagcagatgctgctgcggtactggagcgaggcgctgaacctgagcccgcgcggtggccccggtggcgtgccaccgtggctgtaccagcagctgctccgggtcccgccaccgccgcagaagctttaccgcggcgtgcggcagaggcactgggggaagtgggtcgcggagatccgcctgccacggaaccgcacgcggctgtggcttggcaccttcgacaccgccgaggacgccgccatggcgtacgaccgcgaggccttcaagctccgcggcgagaacgcgcggctcaactttccggaccggttccttgggaagggccgcgccggcgggaaaggccgcaccagcgtaagctcctcggccgctgccgccgcgtcgtgctcgtcgtcgtcgctatcgccaccggagacacctgacgacgcaaacacgcagcaacaagctcctcagcagcgagaccagcgggacacggcaggagtgtccatggagaagaaacaaccacagcctccagctccaacctctcgtcaagaagggtgctctggcggcgacgcagctgcgccgtacccggccgaaatgcttcacgcgccggcggcgtgcggcggcatgtgggttgctcccgacgagtcatggttcagcacgtggggccctggcagctccttctgggacgactacgacatggacagcgctcgcggcctcttcctccaccctcgcttcaccggtgacgaaactagcatggatcattccggcacgcaagcaaccgtgccggcagtggcagcaacagcggcagggatgagcatgccatgcgatgatgttccggtaacctcttcttcttcagatctccctccccaagggacacctcagactcctaccttcatgtggaaggaggactaagcatgcatgcacacagccacgcacctcgacgagacgactatctcttccatctcccatcgacttcgacgatctctttcattactcatcgacttcaaccacaaaggtatgattagggtagagatgcttgcagattgcagttttaaagacaattttgcagcatcacacagctctacgtacaacagccacacctatatcaattctcaagacttctaaaccacaagggaacccctgttctaggctgcgatttttaggtcagcttgttggggtgaccacagtacaattccctttatttcgtatcttcccaagattgtgtgtgtcagatattcgttgaactcgacttcaaaagatttgaagtattcatgttttcttttactcatgcgatggctttgtcgatctaactaggtattgattcttggggagattaattactacttcagttaatttactagctactagaatatttcatgcatgtatgtgttcaggtgatgattagttttacttatatttaattatcctgtaccctccgttttctggaacatctctggcattccactgtttttgtgtatactctggggaggtgattagtaacttcatactatttgcttctcgagatatttagtgcagatagttcagagcaaacgatgccaaactgttgcgaatcgtgtactaaaggcaagcacattataactctcgtaagttcgagcgagcagagcagccggggagttcttgtcaactacacaactcacaacgtatgtacgtgacagcgtgcgcaactgaatcacacggcaaaataatcaaggcatggcgcaacttgactatggcagcgtcaccacgataggtggccaaccacttatatcagatgcaaccctgcaagtggtagtccgacactccgactgataagaacgtgcgctgccatatgccgccatgtatatgtaaccgtgaacttaacttacgtgcctttagtgctgtacgtgcagggaaacacgcgagtctccgatcgaccaatcgacgacctcagagcatctccaacagtctccccatctcactctccaagctaaattttagctattctagcaaaaaaaaaaaaacgtgctccaacagcctctctaaccctaaaccctatccggctggccaaaacctcccctccactagccaaatttggctagccacaaatcacttgccaatcgtgggccccacacagattctccaccaccccccatctccttcgtctctccagcggtccagccacgactcgacgccgccgccgccgtgcacagccacgatctcaacgccaccgccggcgcagccacgacctcctcgatgcggcgcagaagggcgggccggcggcggagagaacaacggcgcgcgtcttgaacccacgccaaagcgccaccatcgtcgtcgaggtcgccagccgctgtcgccgtcgtctgcaccgtcgccagtcgtcgccatccaccgctgtcgtccccgaggttgccgttgccgtcgtttggatccggatatgcccgacctccgttgcctccggcgtgacgtgggttcagggcggcgcggcgtggattcgggaggagggggcaacctctgtcgcgcggcctccgccgcctccgcctacacctccccggcgctgcgagtgcggctcgggagggcggcgaggaggcaggcttcgccctgcacgccatcgccgtcgttgaagctggaggtggcggcggcggcgggtcccggatgcgcaggagcaggatggccctcgccttcggcggcaacagcggtggtgggctggacggcgccggcggcgtctcgcttcgttgtggtggtggcagcggcgccccccggcctgcgtcagccttgagaaggggaaaaaaggagagaggggctgacgtgtgggtcccatggctaaaatagagaggatgaatggagagactgttggagtgaaaggcaaatttgactctctaattttttagatggatgatcaaatgagtatttggagagctcaaaatagccaatctgttagagatgctctcactcacgccgccacgcgagcgctcgttaaattcgtcgtcacccagctgcaggtgtagccgtgtaggagtcccagcaccacgcccgccgcagtctgtgttgtgtgttcctcctgggtgggtggcgatcgagtttgatcggcggcatgccgcatgcctcccacggacatgtgcggttgtgcgcgctgccgtcggtgtccgcggatccaatctgctgatgccgtgccgtgacttgtgaggtagtaggagagtactgtggacatgcatcctggacctggactactggagttctagcggtctactagtggatatgcatgttgccgcagattaggcctagataatcatggcctctgggccctggggtccaaaaaaagctttacgtttagatttgtgaaggacttgataggcccatggtatggaagtggttgaatccttcggaccactttaatgggccgaacagtcaataggcctctccggcgagaatgctaattagcgcagacgtgctaattagatatctccggcccagttagtcgcgtgcggttccagccgacccaccagtgaaaaagaagtcctacttttccaagcaaaaaaaaaaaaaaaacgttgggagcacatgctgacgcgctattggaggaaaaatcgcattccataataaccgtattaattaatcttttctttttttattgcaaatttgaaaattacgtgaaattttaaacatttaatgcagatttgaaaacctttccactcaaaatttgaattttttgaagtcaaaatttgaaaactttcaacttttcatttaaaatttgaaaacttttgatctagatttgaaaacttcaagtcaaatttgaaaactttcaacacaagattgaaaactttcaacttgaaatttaaatttttcgaaatcaaattttgaaaactttccacttttcatctcaaatttgaaaaactttcaactcaaatttaaaactttcaatccatatttgaaaactttcaacccagatttgaaaactttcaagtcaaatttgaaaactttcaattctatatttgtaaagaggtatgcgaaagattgaaaaaaataggaagaaatgaaaaaacgcgtcgagaaaaattacaaaaaaagaaaaaaaaagggcgcgtgggggcccagctgacgcgcgcaccagctaaattgctggcgcgtacgcgcgcgctaggagccccccttctccagagtcctgaacctactccgttgcgtctgttgtctcgtccacgatttcgggggttcagggctgcaggaa

SEQ ID NO: 47135 - DNA, 11574 bp, Oryza sativa
aagaaatatatatatatatatatatatatatatatatagatatatatatatgctattatataagagaaatataagaatgctagccaccatgctagtgttaaagaaaaggggatcagattattgcaaatttgaatacaatttgctagaaaaaaaatcttaatctcaaggatgcatgaaattcggcttctttaaactggttggctcggaggaccaaatgacccttgggatggtcgcaggtcagtgtagacatccacctcgccaatcgccatccacccccaaccttcagctggctcggcaatcggcatctcttatcctcacgtgcgcaccacctgctcgatgaaattccccacacggccaccaaccgtgccgatggcacccgccaccgccaccgccgtggcgtccccctccacctcctcccggctcctacaccgcagcctcctctcgccaacacccacggccgctcgctgcctccggccgccgctgtgccgcgggcgcctccgcaccgttcgccaggttgtcgccaacggcgacgtctcctcgccgtcctcggacgtggccgccgaggagtccgcggcggcccccaagatcggcaagcgcgtgcgcgtcacggcgccggtacgcgtccaccacgtctccaaggcgccggacctggacatctgtggcatggagggtgtggtcaagcagtacgtcggcatctggaagggcaaacgcatcacggccaatctccccttcaaggtggagttcgagctcagggtggatgggcaggacaaaccggtccggttcttcgcccaccttcgagaggacgaattcgagctcgtcgaagacgaatagctgaataggtctcttttacagaataatgtgctctcgtcgtctgcagtctgcagatgcagtatctgtatattagaagagaagattgaagagggtgcgaggagatcgcaagtaagttgttgtttgtttacttgtcgcgtgctcttcctcactcttttgtagttctgttaaacaccaacattttgagatttgagaaactgagaacggttcggattatgacaattatgaatgaaagtggttatactgatggttctgttgttggctgtattcagtagtattttttccagttatcttttcaagagaattcgctgcttataagaatatgttactcatcaggatggaaatcaatctctctgactagcgtaaccttttagcatttgattggaatatcggatcgtatttatctattggtctgttcacttgaacatttatcccacagtcccaatttcaattgttatgagcttatttagttgctgcagtaatagcattgagaacttggctcagggttgctagccaactaaactagacatgttaattcttagtagcacaattggtttctcaagacctcggttattgttggtggctcggtttactccacaaactagtaaattaccagtagtgttcaccaggattttaccgtaggcttgtttcgtccctctgcccatcaaatgtggccttgctgagttagccttccatgtttccaattgagttacatggtttgaaatgtattcactgttctggttgaattcccttgaatcttgatctgtcgagtgagagccatgctttaggtttggcctgtgcacatacatatttggacctgaccaaacatagatggcacatgaactggattgtggagggtatttaagctactgtagtttgcctcaactttagaccttgtgattaggtcctgtgtgaaggtaaagtgcacatagttatttatagcacatgttggtggtgattctctccagatatattacaccaggtcattaatgctggaaaacttacttatgtggatatactttctcctcgtcctctacggtgcttgatggagtgcttacttataagcaatagcttgatgaagggactattactttttaagtctataatatggatgatctgaatatattctttgtaggtgataaagggatcttgcatattatcttatccaaggagatgagtgttatattgcagtatatctttcaagtctggtttgatctagaaattagacatttgcttctctatgctttcaggtgctagaaaaatagcgtaagttctttcttttaatttttttctagttcattcacaaagttagtacacatcaccataggttgctaacctgctattgcaccagaattgctgctaacaaattttatgatatgacgctagtctggatgtgatcaagagtgagagtttgtcttggggccttatcgattgccctatggcttatattaattttaagccaaagccaaaattttaattttgaaacttgattttgaaattgactttgatgttttttcaacatagttatttttttcaagtttggcttttaagtcgataagaacatttatacaaaagttttactcacatatcattttttaattgctaataagccgttatgacttataataacccgtaagcaaccgatggggaccttgctgtgagacctttatttttgttgattggggggggggggggggtagattctttttattgtgcaagaaattatcacaactctttttctttaccggtaaatacatgggaaatcctatatgttttcttttcccatttataatgagaatatgcaagggaattatataaagaaaagtaaatcgtcaattttctctatttttttacaaaccttcaacaaggaccaataagtgtttttttaagactatctatcattcatctttaaacggatacttccaattgtgaaaactcattcttaaaagtataaacgaacttttgattttgcatgattgtgacgtgaatcataccttgatgagggtcaaattcaagctgagttcaaccattcctaatgttctttttagtttgcatgctggtggtgatatactgattctgtggaggcaatttactgtgggagatgatagtaacaaattctagagattcaagctgagttcaaccattcctaatgttctttttagtttgcatgctggtggtgatatactgattctgtggaggcaatttactgtgggagatgatagtaacaaattctagaggtctgacataatgttcattcgaaggaaaatattttcttcatttcctttatgttgaacaaaatatattgaaagaagagtaatcaggttttgtccctttatttccgaacagatgtttttgtggttcattggtatggatttctgaaagaacatgcatctgttctggcatgatctatcacatcctgcattatttgttgatcataaggtctcaacttgtggatttggtttccccttctgctggatcctgagtttctgttggaacgtgttcacattctgaaacattgttcatttatcatatttctgttgaaggttacacttcaacatagtaactgacagtatgctgcatttttcttccattctctggatgtatagttaatcaggtcaatatacacgtagaaattagagaaaaatctttatttatcgttgcataatggaaattaatgcttacattaccacatggaacttggtcattctctgaatcgacggaattgcatcagatattccaaaaggtcttatctgaacaaagctttcttcttttattttacactatcgcactatattaatatgctttggtcatgagactgtcttccaaatgaggcatgtgatatgtcttttattcgttttaggcgctcgtacaaattacaatcatgtgttccatgtctcccattaatacgtaggaatgtaggattatgttgacagttgtgatcatcaaaagttgggtgtgatgagggtagagaatgagacatgaggtagcagtgcattgtacttctagcgggtaagcgttttgtttactttgctagatcctgttttcgttcagcttttcagcttttgtgaatgcgccaactttgtacagtaaacgtcagcttgggttctgctgaaaactttggattctattattacgaagtgaaagaaagttggtgatttatctctcaggccatcaccaatgtggtgcttcggaccgtgcccctagcgacagctgttcgcttttccgtcggcgtcgtctccttgcgatggaacgcgtcgctctggtaggggacgcggctctctccgcgcctcaccagcttttcatgggagacgcagccaggcgccacgctgagcgcgtatggagctcgtgggtacggcatcgtccccccaaatttccccttgcaccctcgcctcactctcgctctcccctcggtctcgtcgtgtcgcgcccgacatcgccggtgccacgtccaccaccgccgggaccgccaccgtcgatgcattgctgatggccttagagagagagagagagagaagaaagaggcgatggcgacgacgacgacggatccacgacggcgatgaccagatatggccaccgagcgccgcagcagccgtcggccactagccggcgacgggcggagacggcttcgaggagcccgtgctcaccgcctcgcgcgccttgcccggcctcctccgccggcgccttgcccgtcctcgccggcgctgcggggggcccagatccgcccactacggcgccggatctggcgcccccgaccggccacagcgcgaggcggaggatgccggggaggacgccgatgggatagagggagagagaggggcgacggtggatgcccgcaacgggagaggtggccctcctcgtcgtcctcgccgacgctcccgtggcgccccgtgacgccgctccccgggtccgacgaggccaaggaccgcgccatcgccgagcaaggggatgtggggcacgcctcgcatctccggtgagcagcggcgcgctggatctagcgcggtgtggcgtgagatcggagggggggcgtgggtctggcgacagcgggagcacggagcggcggtggaaaaacgggagaaggggtagagacgggcgacaggcagaggagagtggcgagcggcggcagtgcgagggagagtgagagagagagacgagcggcggaggggaggaggcgagcacgcgtggaggcagaggggaggaggcgcgccggtaaatgaggggaagagagagagggggggagaagagaggggtagtatagtaaaatacctacatgggctctttgggttagggacactcgttgggctactagtggtatcctctattgtaaggggagtttcccagagagcgccctcagtaagtgagggcacctatagagtgtccctgattgtagatgccctcagcccattcgatgtgttggaaaataatgctatgcaatcgactttcgagtgcccttctacagttgtactcacctgacgtgaatggtccacttgcgagttaacccttgatgcatggttgatggccgttgccgttagagcaatcctaacccaggaactatgaagtcggagccattgtttcgacatatttgcaaatgaaaaataatttgtgaataaaatttttatatacgtgttattagcgatctaaaagcaaatgctgaaaaataaacttcgatgaaaataccataaaatcagcttcaattttaaagttgaaaatttaaattttggcgcataagcataagcataagtgaaaagatgagaccatatagcttcttcgtttgccccagttcacatgtgagagttgctagtaggcatggtaatgaaatgttcagatgcacgtactccctccgtctaaaaaaaataaatctaggataagatatgacacattctagtacaataaatctgggctaaggtcacatacaatactaggtttgttttttatgggaatgaggaagcactgcgtgagctgaagttttatccggctggttggaggaggtaagcgtacttgaaattcagtgggatactccaatccggtcaaattgataagagaatgtcaacgaatcaagggtgacggaatcgtcttctaccccaggaactgaaacatcagctgcgaattcccatcacgtgaaaaactgagatgctctccaaacaaagctcggcgagtcgctccaagccaccaatggtttgcttgtttgcaagcgacgaatgtactgtacaggattacaacggtcgacccattcaagttcaaaataatacaaagaactagctgggtagcccacgcaattatgcggctagcagaaaaaaatcatatattttttaagtataattttacttaaaatttattaaagagctatctcaatgttaagactttgaaagaccaaaccttatcatcctcgtgtttctaattacatagtttttaaaatcacaccagttgctacctcttatgtcatctccttctttatttgcttgctcgatctatcactatttctatttattattcttagagcctttaaaaattggattttatagtttttagagtttattgtcacgtttgggtttcgtttttataatttctagatgtcccgtcaaacgttgccattatactcctgtccactatctcttctctttattgttattgagattttaaaaatcgaacataattatagtttgggttcatttttactttctagaagttccgccataccgtcagcggttttgccattatgctcctctacggctcgcccgctgcctcccttctttattgtcattgagattttaaaatcgaacatgattattattggtttttttttttactttttagaagttccgaacctttaaaaattggacttttagttttattttttataatttttagaagtcccatcaaacgatgccactatgcccctctgcagccctcgtctgccgcctactcttaccccgcccgctgcttctccttttcattgtcattaagattttaaaaatcgaaaataattatcaatgtggttttttttctttttactttctagaagtcccagcaaccgctttacttgtttgtttcacgtcctacctgacgtccctccttttaatcgtcattaggattctatttagtgtttcattaacaatttttatatgccatatcaaccgccaccaactctacttatttataggcctgttacttaatttatttcgtcgtgtgttttagatggtcttttttttcaatagtctttatttttatcactaattttagttatttataaattttattcctaattgaaatctttttttttctaatttcagaatttattttttctaaaaaaattagttaataccatattgtgttcttttaatgtttttatttcttattttcaacttcagttgtttcaaaattgtatttatacttgaactctcttttagtttttctaattttggatattattatatttttatttgaaattttaattaatctcgtattgggtccttatatggattcttctttcaatattgcttatttttaattcggaattttaattaattttaaattgtattcctacttgaactcttctttattttcttttgccttaatttcggatttatttttctttttattccaaattttaattaatctcatattgagttcttatatggactgttcttttaatattcattatttttaattccgaatttcagctatttttaaattgtattcctacttggactcgtgtttccttttctaattttggcttttaatttatttttatttcgaattttgattaatctcgtattgggtttttatatggaaacttctttcaatattgctaatttttaattccgaattttagctatttttaaattgtatttctacttgggataaatctcgtattgagtttttatatggaaacttctttcaatattgcttattttttaatttcgaatttcagctatttttagattgtatttctattggactctccttttcttttttttcttttttccgattaatgtgggaatttctagccctcacagcgaacgtggtgtctccttttaaagttattttaataatataatagatataatagttagatagatagatagatgcgagatggtccatcggcatctatctatcacccggccttctctcagaacagtgaagtaccccagtagagtatatactatcatacggcatcgtatcttattacggcttgatacaggactcaattttgaatccactcaatagctgatacagtactcctactagctggttgaacggtaggactacacacacagtacagtgtgcttccttccagatgcatcaacgcgtgcctctgccaccttgggaccagacagctgagtaattatggtgtattttgcagtaaagaactcctttttgggaaattatcagcacaaatccctgggattagtatggacccaaattctccctgggggagtagatgacgagaaccgtagctactgtaaatttggaggtagcacttgtaacttcaagcttgttgagtgagttgtactgttactgttactgttactgttactgtacgccgtgccaaagcatactctgtcaccccaacggctttctcctgtggagcacgcgcgtcgtgcgccgctgcggccgcgcacgaaccccgacgacgcaacagaaaaatttgaaatccacccacccctcccccctcccccctccctcctccgtccaccgcagctggcttcaccttttcctcggttgctacagacgccacggttcaaaacacactctccaacgcacaaaaaaccctcccctaatcatccacgcctcaccggagccaaacaccgccaccacccatgggtctctgtttcagcaagaagcagcaagtgaggcggcggcgagaggagcagcagcagccgccgtgccatgaggccaggaaggccggcggcggcaagaaagctggtgctaaggaggtcgcgatagtcccggaggcggccaagaaggcgccgccgcccaggaaggctgttcccaaggcggaggagccggcggccgacaagaggacggtgttcgtcgtcaaggcggccgcggccgcggctgctgccgaggtcgccgcctcggcgagcggcgaggcggcggatgaggaggcgaagaggcccgccccggaggaggaggaggcgaagcccgtcgtcgtcagcagggtgccggtgcggacctcgagctgcaccaaggaagaggtggacgccatcctgatccagtgcggccggctcagccggagctcgtcgtcgtcggggaaggtggcgtcgggtgagggcggcggcgggcaccggaggtactctggatctaagaggagctacgatttcgaccgcgagaggaggggcggcggcggcggcggcgtggacgacgactgcgactgggagaggcagggcgccgccgtgtccaggccgtcgccgcgccggaggacgccggagcggaagcggtcggggagccacgagaggagcggcggaagtggaagcaggagagtgagccgttcgccagggaggcgcgcggacagcgtccccgcgacggcgagcggcgagcgggcctcgcggcagcagccggggaagatggtgtcggtcccggccagggagaaggggcgggcgccgtcgcccgtgccggccgcgtccgggaagaggtacccgtcgcccaggtccaactccccggcgagggcgggggccgcgggtaatgagaacgccgccgcgcagctggcgcacgggccgtctctgagccggagctcgtcgcggaaggccgagcactcgccgtaccgtcgcaaccccatggcggagctcgacgagaacacgctcggcaaccaccacagttgcaacaacaatggcaggccccaaaaggtaacagacgcatgaaagcttcacacttcagttcacccaatctgagccatcatttctcctcgccgaattactcaaaccatcgaaatgcattgcagaaacctacggagagtggcggcgccctgccgcagaaggtggcggagtgggctaaagatcaggtagccgcaagccggacggcggcgaaggagaagcaggagatcgtggaggtgcccgtggcatcatcagacaccaaaggggggaattccgggaggatgaaggcgacgcactcggtgagcattgtggccgagagcgtcgtcaaccagaagggccggtcgtcgaggagatcttcccacgacttcgacaacaatggcaactcgtacgcatccctgctcctcgaggacatccagaactaccaccagcagagcaccggctccgccgccgccccggcgccagcgttctcgctcccggcctgcgtgtccaaggcctgctccatcctcgaggcggtcgcggacctcaactcctcgtcgtcggagaacaagagcttcgagctggaccggtcggccaacgacaagtgctcggcaaacgggaggtacggcgacggcaaggtcgccggcggcggcacgctcgtcgtcgagtcggaggttgttgtgaaggacgacctgatggagccgagcctgcacaagtacgtctccgtgcgtgacatccgaggcgaggcggagccgcaggaatccgccgggagcaacagctttgccggcaacgcgtggacgccctcgtgggagcccagttccgtcgattccaccgaccggacatggacagcgtcgcagtccaacaacggcgacgaggtggagcagctcagcagcggcgcggtcagcccactggagctgtcgtggcagggcaagcagaagctcccgtcgcaggagccaagtggtggtggccgttcgcgggtgggtccaactggcaatgctcaacgcggacgcagcgctcatcgtggcggcggaggcgctgtcaatgcgcgatccgatgttcgtgctgctccggtgagctcatcgattgcttaacaatgtcaggtggagattgtagtcaggttctcatctttgtaggggcaagataggttgccgtttcagctttgagtttgcgttctttctggtgatgatacattgtttaggatgtaaccatggcggtgacatttgcaatgtatactttgttgttcatttcgctgagctttggtgatcgatttcattatgatttggtgatcggtggttgatctcctgataattttattgatctttggatgaatttcttgtcaggaatagaatgctgtaatttctgatgctgatttgcagagtactatgcatgactgctagggctgctgtaaccattttggtactgcgacagccatgaggaacgcatcagttatccagttactccagtcagttcgagttgggctgacagatcagtcctgaattcagttctcaatgaaaaccatctcagtgtttagacgtatgtatgcagcatcaaatgtagatgagaaaaaaccaattgcacaatccaactgtaaaattgcgagacgaatcttttgggcgtaattacaccatgatttgacaatatagtgttacagtaaacatttgctaatgacggattaattaggctcaaaaggttcatctcatagtttacaggcggaatctgtactttgttttgttatatacttcaaatatgtatccgtatacttaaaaaaaatttggcacacgaactaagcgcagccttagtttacatttcctcatagctacagacgaaaatcaaatgtaaattcaaggaaggaaataaaaaattggcggtcctaattgctatacgaatttgtcaatttggatttgactatctggtgacatgctaccatgaaatttgcaccaggttccagcccaaggggatg

SEQ ID NO: 47136 - DNA, 1461 bp, Oryza sativa
ggcgagatttagtgtttagattttttttgttcgatttgattcagtccaggtccgattcaaattgtgttcgggttcaatctcggttttagttgttttttttgttcgatttgattcagtgtaggtccgatttgctcaccggaaaggttggtcgctggcaagatttagtgtctagatttttttttgttcgatttcattcagtctaggtccgattcaaattgtgttcgggttcaatctcggttttagttgtttttgttcgatttgattcagtgtaggtccgattcaaattgtgttagggttcaatctcggctttagttgtttttgaatcgatgtaatacgatggagagctcgccggagacgttggttgccgtagttttgtttagtttgtctcatcatttttgtgtggcatccaatgttttttggtcggtgaaatcgtgatgctgctgctgcttcgccaagttgcgcttccaggtttggagatttgttcttcctgggctgtgggaagcgttcacggaatggatctgagattttgttgtttttgttgctgcaaagcgttgcttttgagttggggaatggttgtttagcccgcggattcgggggttttaggggaggcttttgattttaggggtgctttttgcttagcaaatccagtttctgtttttgtgcttgttgatgtgtgatttagtggcaaattctaggcgtgaagcaatttttcagaatcatgacatggctttttgttatgtttgtattagtgaatttttttactgaattactgaatttggtagccagcaaatacatgatgtgttcattactttgtaaagcttcacagtgattatattttttatgtcaatgtaaatggatctggatgttgtacttgtgctaaagtgaagtttctacatgattgtgttttttatgtatgatttttgttgtaaagtgaagtttgtattgtttgttcattttaactcatgtccaagctgatgtttatttattgttctttcagatgcctcgtgtccaaacatcaaggttgggtaaaaatcccattgaagttgattctgatggaggtgaagattttcatgttgattatgaagttggtaatgatgtaagttatattttaaatttttattattgtattatgctgtttaagtttacctttaatttggtattacattatttttcttttttttaggttgatgaaggtcctgaacatggtgaaattgatggtttactctctgttgtgtcaggaaaatggtatgtgaatattttttttgttgagttgtgttaatttaattttatattgtttaatgggttgctcaatttcatatttgtagattgttcaagaagtgaaaaagaatttggttgacacttcttctgtcaattttcacaatcccattgtatgtatcttttttttattagcatattttattatgcatggcattttatttgttctattttattgggtttctt

SEQ ID NO: 47137 - DNA, 1228 bp, Oryza sativa
caatttctactaaaattacagtacacttacatgctatatgcattgaatttacaattgtaattttaatttcaaatcactgtaatttctacttctagtgtttgattttgcatatgtatggcagcatggatggtgctattaagattgggtgctatctcaagtatatctgttttgatgtgtgattttgtgttagtttgcttggattagtttcctactagtaaggtttcagatatattatgattttaaatgttaggctatacagccgggaccaaattttatatgtttctgttcatgagtgtatatggttgcctcttaggctttatatggttaccccctcactccctacctccctatgatttcttttgtttttattcatgctaatgtactgttctggtatatgtaattgtaattattatttctttctcttttagcttttaaatattataatttagtaaataagtttttaacacacttctacacttgttttttaggataaaaaaaaatctaaagttcattcgaagactgagccctcatatagcagattctcaacaaaatatttctcaacagttctatcttctttatctcctgatcagaagcgtattattggtgactatggttttaattctttgctgatgtttgacaatgcttatgtcccaaacaaatttgcttcttggattgcaaatcatgttgatgtgaagtcttctcaaattgttttaaaagataaagtcattgcaattaataaagaatgtgttcatcatattttgggtctgcctattggtggtatggagttcccaactgattgtgatgctggaaagtcttttattctttcaaagtttggcaagagcgctcttccatctgtgagattctttggtgataagttcatctgaaaggaaactctctctgatgatgaagttattacttcatttttgattgttgcaatggcttgttttctttgtccaaactcttctttggtccctagcaccaagtatttgactgtgtttgagaatgttgatgagcttcggtcatatgattggtcaaaatttgtgtacgaatggatgatgacttccatcaaaaagatccaaaagtttagtaccttgggtggatgctggtttctctgggcagtaagttattaatttttttttccattctctttgttccatattattattgttatttacttaatttttctttgctttttcatattttattttgctaggtggctgcaggaatt

SEQ ID NO: 47138 - DNA, 725 bp, Oryza sativa
ttcctgcagccccagaggaaagcaaaaatgatgcaatgcagattgaaggaagcaaaagaaacatcaacatggctccaggtcagaaaatatatttgaataaattttgctctaagaataaataaaggtaactacaattatgtttgttgattctaacatatgctctaatgatttatataaattttacagggaggctggcatatgcaagaagtcctaatatctacaatttgcaagagggtgaaggaagcagcagcaaaatgccccatttaggtactaactaagtttctaaactaccaagtcgacaagctccaacaaaacaattgcaacatacactgatctaatattctgatctttatctttttcaaaatgcaggatgcaggaaaatacaacacgtaggaaaaaacttcaattcaccagaattaagcaataccataggaacaattgcatcagaagttgtcaattatggaggacaaatgctatatgatcaattcacattgctaaacttagacccaagacaggtacactaatcaaaaagcatagatgtagcatataaaactattttatacatgcagttataaactaataaacatataactgtgcaggaaggacagttgagctacactaacctcatacaccaaataattcatagtccaactgtcaccatacagcaacaaacagtaagcatatcaacttacattatatacctgacaaaaaaaagagaaaataat

SEQ ID NO: 47139 - DNA, 938 bp, Oryza sativa
atactgacatgaatcaagtgatggaatatctaaggcaaaaagaagcaaaagatcctggctactattacaagctgactctagatgagaataacaaagttaagagcatgttctggactgatgggaggtcaacacaactctatgagcaatatggtgaatttgtgagtttcgacacaacttacaaaactaacagatataatatgccatttgctccaatagttggtgttacaggccatggaaacatatgcatttttgcatgtgcatttttaggagatgaaactacagaaactttcaaatgggtttttgaaacgttcctaacagccatgggaggaaaacatccagaaacaattataacagatcaagacttggcaatgagggcagctatacgtcaagtatttccaaacagcaaacatagaaattgtttgttccacattttgaagaaatgtagagaaaggtcaggaaatacattttcagacaagagaaggaaagatctctatgcagaatttaatgacattgtgcacaatagcttgacaagagctgaatttgaaagcctatggttgcaaatgattgcacagtacaacttgaaaaatatcaaatatctggaaataatgtggagaacaaggaagaattttataccggtgtattccaaaacagatttttgcccatttatacatagcacagcacttagtgagggcacaaatgcaaggtttaaaaggggagttggcccaacacatagtgtcatgacttttctactggaatatgaaacaatcaatgacatcatcttcgacactgagtatgggaaagattatgaatccagaaacaagaagccaaagtctttttggtcaaattacatgatagaagaacaagcagcagacctatacaaccatgggatatttgataagtttcaagatgaattgaagggaacactaaatctagaagtg

SEQ ID NO: 47140 - DNA, 884 bp, Oryza sativa
agcttatacggggacatgttatcaatgggttgagaattaaaactggttaaatgactgcttcctttatttcaatcaattaaatgtgtgttgcctcttgctcgctcaatgttgcccgcccccagtatcatgaatgacccctcttaaacttcaactttaggctttcactttagagcatcttaaactttccatggataaaaaaagtatcattttaaactgtctgctgtctgctatgtgaaggagaggacatgggaaaccgatttggtccttcgaatcatagaagcagtaaaatagaaccaggacaccagtttgtacaaaacgcagagacctcagctggtgtgttggaggaaattgcagtggaatgtgggtttaaggtagtttggatgtgaaataacagtattattatcttcttcctgtattactttgctgttgatgtatttattcattcatttttaggtggagtaccaatcaactttgtgtagtactgcagagttgcaattctccattgaggtaaagtaaaaacttctgcgaattccactctcctttattaccacataaatctctattattataaaaattgaagatgtttttaccggtatttttggtacgccatccgtatttgagtcggtttttaagttcgttcgcttttggaaatacagattcgtgtttgagtcggatcttaagttcgtttgcttttgaaaatataaaaggagtcgtataagaaatctttttaaaaatactcgcatgctaacttgagatgaaagtcagactcctaattgtagcttataatcttctaaaaaaatatccaagcgaattcccacagtgaatttcatcatggctaaaccatataccaataataagattaaaatagcattcacccgttgcaa

SEQ ID NO: 47141 - DNA, 4949 bp, Oryza sativa
taatttgctttcgtactatgttcctgaaacagtgtctgtcctgcgacccttgttcggaaaaccggatcttgccgtaccaaaatcagaaatcttaggattcatttcagaatccaatagaatattgctgagcttaaggtccctgtggataatctttagccccgagtgcaagtgaaggtacacaatcccttgagctataccttcaattatcgcaaacaacctatcccagtagagagaccaatcggttcttgggcctgataaatgtgtttaacagaatggtgattatgagatcagggtacaaattaaatcatttatagacttagttatttaagaacataatcctctggggacttgtcaaaacataccaaatatgaatttatcgaggcttttgttttgcatatactcgtaaaccaagatcctttcttttccttcgatgcagtatcccttgagcgtcacgatgtttctatgttggagcctaggaatgaatttaatctcgttttcaaagtcagacagacgctctgggctcgattccacgaagcatctcttgacagcaactggaagtccattcagttgtccctgataagtgatcaaatagaggaaagtaaaccatatgaaatatagaaggcatgctccaagtggtcttagagcaaacttatagtcttgatgtagtaattgtcaaaaatcaataaagccttctttattaaaaaaggaatacggaaggctatgcattggggaaggcatgcagcatgctaccaatctggattaagattaattgtggtgattgcatatatattataagcgagtacatagctaggctccgatcctacagttacgctaaactctgtgaattgggtagatgatcgtttatggatgtgctcgtctgctcgcatccgctcagacttcagagcaagcctgttctataaatcccacagacgacctactaaaaaaaatatagaggcaatcgctcattcaaccctattctaaagcttaactaacaattttatcctaccttctcaagttggcttatttgatcctttttcaaaattgaatgagataacagtgaagacaagataacagtgttaagtaattaagggcagtggagtgtaggcattggtgtcaactaacaccaattacttcttgctaatctctttgctaatacactttggaaacaagaattactctcttatatatgcattggcaccaccatatttgagtaatgaccccaatgactatatttcctgtacccgcccctgactaaggggcaaattatcttttttgcacttactcatttcatcgtgcttcttttttttatccaaacttttgacatatttgtaaccaatttagcatagttttaatagattcgagacaaatttaatagttttggcttgaaattgacaaatttgataaaatcaaattaacaaaatttgacatatttatggctgaacatttaaaatattttaacagcatattggtcttttttttcaatcccaaattgcatccaataaaaaaatacacagaaaaagtagaacacaagatagccatgcgccgtcgtcgcccctgctgcccaccgtcgccaccactgccactgttcccaccgcgcgccaccttggtcgcccctgctccaacggctcgccgacaccgtcgccgctcccaccgctggccgacgcctccgtcactcccgccggcacccctactcttcaccgtcacagctgccactcccaccgtgcatcgccgcggctgcccttgctcctactgctgccgccactcttaccgcaggctgatgccttcgctgctgccaccatcacccctgctccccgttgtcgccatcgccgctgccaccgttccccgcctcggtaatatccgccacacgagtatccagacatgaatggaggagaaggaattcggggatatagtattgttgtgttcttatgtgtatttttgttagtttggcatataaatacatttctttcaatcttttataaattgaaccctaacggtgttatggaaacagggtcaaatgacaactccgattttgaaagacggggtcaaatgagcaattgtcccaaaaaatatatgttgtttagttaaacccacaagaacattggcatatttctatgggtttctcttgaacaaaatgaaattttgctactttcgtggtggtcaaactcacgaaaaataaagtagctggtgtaccgtataaaaaagtcgagcaaccaacccccaaaacctagtttgtcatcccccgttcccagtctatcaagcaccacctccgccactcgattcacccagatccccatcgaaccagtaggcgagtgggcacaaagaatagggaggcaaaatagacttattatatggcacggctcaaagagtaggaacataatagacttattttagctatatatatatatatatatatatatatatatgtgtgtgtgtgtgtgtgtgtgtgtgtgtgttacagcctaaagaggagggaggataaatagacttattttaaagaaggcacgataggccacccgtgccttcgggctgacacggtgggttgtgcctgggcctgaggtgcggcacgtgggccggcatggcacggtccgaagtgccgaccgtgccgtgccagcccgatggccatgggccgtgcctagcccgtgtctaggtcgggctgtgccgagcgggtcttatagtcatctataccatgcatgcacgctggtccgatcgacctgcctgcgataccagctgccacgagctcacgggctccagatcaggacagcccaagccccaagctcagggactgtgtgaatcaagtcgtcctgagtttgggtgctccagattaggaggcccccaccatcctgctgctaccgcctagtcatccactagttgattctgaaatgtgtgtgattctccttttttatgacacaagtatgcatagatatagttaccttgtaaacacgaccaaacccaccctcgccgatcttgttttccagcgagaagttatctgtagcatccactatccgaaataagtcgaacaatgaaaaccctgcggctgtaagaaaataaattactcatgaattaagtgaggttagagaagggttttcaccctagccatcagcaaaccagaaactaatgttgcttcaaaactacttaatatttttttcttaattcattatttacatctatttcttaaatatgtagaagtttaagaattaaattaaccttggtgggctggtgtcaataggtgtccaatatcatcattgcttgaagatgccttatcgactccatctttgttcaagttatgatgacctgcatgcaagggtaatcttatatttgtatgtaattatatgtatctgtaccatgcatggtcgcgataaaatagaagaaaatttctcaaacggataatatagggacagaattattagagaagtcaactctaatcgtcctttcatatcaatttatctagatccgactttctcggaggagatttgctctggttcaataaaaagtatctcgagagactggtaccttacagtaccaaatcgttttttattgttggatttaaacaatgcttacgctgcccaactagatccaatgatcgaaaacgattcagtaccctaaggtaccagtacctcgtggtactttttgttggaccgaagaaaatctctccccgggtcttcttccgcttcggcaagtcttcgggcatcgccggcggtggagtacggcggctaaaaacaaagggccaaaccggtgttgtggtggattgttgtgtaatctggcatcaaagggccaaaccgacttaaaaatatgcacatgaacaaaacccctccagctaaggctttgttccaaaacacactctcagcctcatcgtttggccgatacgaggaaatactaaaacggtatatttgcaaatgaaaaacaatttatgaataaaacttttatatacgtgtttttaatgatctaaaaacaaaggttgaaacatagactatgaagaaaaaaatcccaattacctccaaatttaagtttgaaaattgaaattttggctaataagtataagtataagaaaaaaatgagggcgtttggaatgaccttctaagccccacgagctagctcatgagctttcttacgataaatgagagtagcctaaacctaaaccatattgtgctgtttggtctggtttaaccgttgaagcatttttctttttggaaatggtgtttatgtatattgggtgttataggagccaatttggagttgaggggttatttagacccttgggatgctttgagggtgtaatatcgactaactccttgtgagaattactttctttctcgagggttcttacatgtaaattgatggattaaaaacaaatagaggacaaatgtagacatgatttattaacttgaagccacttgccaacttgggagaacaaaattttacacaaaactacaggtattttgcataatttatcacaaaactacatatctaagagtttgtttcacaaatctacatattttgtgtctctgtttatcacaaaactacatgtactttgtacagtctattataaaactatagatttaaaaacttgtttcataaaaattatacatttagtgtattcattcatcataaaactacacaattagtatctttaatatttattaattacaaaactacatatttagtttctccattatcataaaactgcaggttttaacaatgctaaaacctgcagttttgtgataatgaagtcactaaacctatagttttgtgataaatgaagatattaaatctgtagtgttgtgaaacaagttctcaaatctgtagttttatgatatattgtgcaaagtacctgtagttttgtgataagcgaatgcactgaatctttagttttgtaaaacaagttcttaaatctatagttttgtgatacatcgtgcaaagtatttgtagttctaggagtgcgacatggctgt

SEQ ID NO: 47142 - DNA, 8613 bp, Oryza sativa
aatatgcccctaagggcagtcccaacccatagtgtctataagcagtgtctatggtgacatgtcaattagacatcacaatagaaactacactctacaacccatggtttcttaaagtgggccattaataaatacatcatctctcttctctaccaatcatatttattctccatctattatgaagacactattctctcccaatgcaaaacttgatggtgtctagtgcataggttctagtgttgaagctgtgtcttgtatgagacccggtttcttcctctcttcactctctctcttaattaatatagtgccacgtaagctaaaagtcttacatgacaatgtagttaataccatagacactatcctagatggagggttgggactgccctaatgtaagagaaagcatggacacaagaaacacaagagatatttgcatgcaagagcatgtaaatattgctctatactttattcaatgaatggcaagctttgccgtcgttaaaaaaaaaacttgcatacaagagggggcggatcccaaaaaaatacttcctctaatcataaatatttatatttagaacataatttggttttttttaaacaaaaactgaagttactatatattttcttatagatatatacttagttcagaaaatgatgtatttgtttcttgaaaatgacaatcattatatcgtaaacctatatagattttatgaacttgtttttctaataaaacatttatgcttaatgtttggcactactaattaggaacaaagtgcatgcgcacctgatttatcctctctagttgcaactgcaataggctcggttctggcttgcggtctttcagaatatgtgtaatcttcatctccgttagaccaactgcaatcagatacatcgttagcacagtatttactaacgatattgttgtttattgtttgcagtaattagcttaaatttgtaataacaataatgaacaacacaagtggtatgtgtttctagaatatacttgataggtgttgctataacatcaacatatttaccttgatatgtaattaacaatattatgatcatagattataatttactatgctttcacgcgatcacttgtgtctttgttaaatttttaaatgtgtcatttactaatctgaattaaacaatattatcgatacagcaaataattaaccatgattatatcgaccttgtaaaatgtattatgaagcttatatacttatgtgttgaggcaaattaatttacttatagaagatatatatactacatacacgcatatcatcgccatatgaaatttataatgcatgtgttatattaaattcaaatttactactccccgtttcaattgtcattttagcaaatctcatactaaactaagaggtgtgacaaattatattgatacactcattagttacgttcaagtcatctttcccaaagcatacattaaaattgcttgtgaggactactactgtggttgtattgataaaaagtacaaaagaaaagacatctctagaacacaaaattcctaacgatttttgagtaaatatgtactccatccgtcccatcgaaaaccaacctagtatcagatgtgacacatcctaatactatgaatctgtacatatctctgtctatattcgtagtacttgctaaaataattctaagttgattttttatgtgacggaaggagtatagtgtaataaatagaccaaaatcgaagtgcgtacctcaatcccaaaatataataacttaaattttagctatatacctagacaagcatgtgtctacatatatatagacaaaaaattatattgttatatttttgaaacggtgagagtattttttttcttgtttagaggaccctagaataaaagatatatgtaggtgtgaatgtgtaaaagtggcatgataatttgtcagctctagaagacaaaacgcgtgttgggatttttatatagctataggggaatgtgtacgaactcgtcattttggtattttcaattattcataatggttgacttcaagtcttcgacgacgtatccaaaaaaataaaaagtgctagataatgatgcgatcgactgaccgtgatgctcgtgccgaacgattggacggggagctccgcaaattctgaacatatgatataccatcatatagtacatacatgtgtgagaaaataatgagagagagagagagagagtatggtatagtaaattgggggtaatggtatatcgatcgatcgtatctacgtacctgcgtgtgaggtgctgagtcaagacgccgggagaagacgctggtggtgtagatgcaggtgatgacggggaagagctggagcctggaggtagaagtcgatcttctccttgatgcgctggaactgctcggcgatcttggcgccgcggaagaagcggcggaagtagctgctggcctcgcaggaggagacgagcacgacggcctcccggagcgtcccctccagcttctccagcggggcggcgatccgcgggtcgtccctctccacgtgatgcaggagccccccgaccgtttccacgtgctccgccagctgccggcactcgtacttgttgcgccgcaccttctccgcccgctccgtcaccatgctgatcagaccgtaggcgtccacgccggcgatctgggccacagtcgccaccgggtccacactgctccatatcggcatcgtctaggtaagctagtagctctccctcaccggacaccaccctctcaagctctcatctgcatctgcctagctgcctgcagactgcgcctgtctcctggctgctctctgcttatatatatatgtaggtctgcttacacggaaccacaatggaagcatcgtccatgaaagaaactgcaggttgtgttaattgcgaattctgcggggtgacgaccaataaaatagtcagacgcggggtgacgacctgctgctgctgaaggatggaatgctcgctacgtatatcgttttattttccacatttataatttagttatttctgagatttttgtttacttcaattagccgatcgatctatgtacgtataaatgaatcgtaggattaggttgattagattaattagcgcctaaggaacgagtctagaagaattggtgtgtgattaattagggtcaactactataactgttagacgacgtacgacacttcaacggatctcggtcgatcggtgtcgcccatatggcggaagcggtcaatttctacttcatgtattattgaggcaacaactagacgtccggcgttgggcgtaacataagacactagtgcagaatagattatccatgttgggggtaggaacccttatatatatcggcgggggtcttatcacggattagtggttactgatgtgaaaactcatagctgttgaacaagcagtcatcaccgataggataatctttaaataaaatccaatcaccgatatataacgtttaacccagcacacgaggcatcctacaacccgtcaattaggttcttttctttagacttatagccaacttataacccaaaaagtttaagtctaaataaacaagtaccacctctattttttaatatatgacgctgttgactttttttcacatatttgaccattcgtcttattcaaaaaatttacgtaattataatttattttgttatgagttgttttatcactcataatactttaagtgtgatttatatcttatacatttacataaaattttttaataagacaaatggtcaaacatgtgagaaaaagtcaacggtgtcaactattaaaaaacggagggagtatttttttttcgtttcaaagccaaaagctattacaatgttaaatcaaaagcaggttagagaagattttttggcttatttgaagtggggatgtaactccacattaaactttatgtttaaaaccgttggcttataaaacatatatataagttaaaatgtaagcttaaaatctaaaccaataagtctaacccaaaataaagaagcctgttatgaatgacttatcagtgatggcttctcgtttagaatcgacgaccatgttgctcatccgtgacatttctttttctaaagaaatcgttttattggccagcctaaggtattcactacaagaaaaaacagaatatccttggcggccagaatatggagtccccccccacccaacatacttttctcctttgtcttataatacatttccttttcttgtcaaagcctctatgtatgtccttcaccatgtcgaccaccttttctctagttacatccgatggaattgggagaagttctctcttattgttaaaatttttgttcattcttctatacgagtgacgtagcgggagccgacttctatggcctatttaaactatctttcgcgacttatttagccacttactgtgtgtattttccaaatagtccgagcaagctttattttctttcacagggcctcatcttttctcttatacatatgcttatccgtcaaaatttgaattttcaactttaaatttagagttgattttgaggttttttcatcgaagtttatttttcagcatttgcttttagatcactaagaacacgtatataaaagtcttattcacaaattactttgcatttgcaaatatgtcatttcgcttattctacgatgggtctgatagtttgtcccgaaaggttaccaagtgtcaggtagtcgttaatggagcaaaataatagggtacgtagattgaagttctccctactaattaaatacatcccaagtatgtacacagtctcaccatagcgtttctaggtcatcgattacaagctccagtaatacatcaatatcattactagattgtttcagtacttggattagcaagcaaaatataatgcgcttccttttgaaacacaactatggtggtaggttataatttgctataagaactagctaagtgctttgacaactgcataaatctccgaaaggattcatgcaaatccgtatataaacatagctttcaatctgtggcataagcttaccattggtccttcaatccgtggcatgcaaatatactaactctactttcttggaattggcaaagatatcttggaacgatcgatgataggtagatacctcacaaccttcgccggaccacccactttaactttttcccccttcgtcagaacttgtctatcacttgtatcaagaagtcttgcacacaagacaagactctaagtcggcgtattccttatagtacaatatgcagttgtttgggcaagcataaattctatgaacctctatccctaagagacacaaaagctattttgcttcatttttcgtcttaggtaatgtgttctcctctggaagtaggtccttcaacaaacttccatccactactcatgtgttttgccttgcatctagcgtatagaggtgtttgtcaatcactgaccaacctggcgaacttcatgaaatctttcttgtcgtaatctggctcctcaccatcacgcaacattgcttccagagaagttattgacatcaaccattctgtcgcccaatggagttcagcttcatcttcctgattttgtccaccgctcgtttcatctgcaatattgattgattcttgctctccatgcttggtccaacatgtgcagccctttataaatcctcgacatattagatgaaaagtatatctactcttctggcaagcatctcctcatttttgcaatctacacatggacaagtcatataatcattgttccttcttttcttccccttttccgcgacatttataaaatttgcaacgttctttgatatgtcgatcaattccatacatccaacttctacccatctctgcaaatgcgaacaaatattagatatatttttttatgatatatactacaaaatttatagagatggtttacttattaattggatccatgccactacaaatgtggcactacaaatgtggatccacataaatgaagtgttaggctgtgttcggcagcctgggttgggaacccatgtcccatgcacggaaaacggagtggtccattagcacgtaattaattaagtattagctaatctttgtttcaaaaatgaatcagtatgatttttttaaagtaactttcgtatataaacattttaaaaaactcaccgtttagcagtttgaaaagcatgtgcgcggagaacgagagggggagttgggaacaggggcaacgaacacagccttagaccctatttggatcagggactaaagttttactccctgtcatgtttggacactaattagaagtattaaactgttgatgtaaaaacacgaggcctgggagatctgcttaactccagtgcaggtccaaaacttgcctttgggtatgtgagcgtgccagttgatttgatcttgcaattaacaagaaacaaagacaaagaaaccgcggttaaatccataaacgatagccgatcggctaggtgccgatgacatatcatttatcgttgagccgatgtcatatatgcattgatcggtagtcattaataagtaagacagaactaaatatactcgaccggctgtagatattaacagtatgtaatccttatgtcgatatacacttaaatcaagtgattgggatagatcggtcgccatgccgagacagtataaatcacttagatcgaaatatatactaacaacaagatagatctagcatgtatcggctaatactccaataccactctatattaagatattaaagcaagtaaaatatatcaaacaaaaaacctaatatatctaaatgtgacaagatcttaacataaagggcacatttaatatatcagtaaagcatacaagataaatgtatttaaataaggtaagatcggctgaaaccccgatgctaccctaatcggcaaccaaagacaggctagagattgagattctaatcacgactaataagatcaaactcaactgatgcagctataagtatgaaaagaaagacaatatctagacaatcaagccgttggatgtttcatagagtggtagatatcttatataatctaagtcaacgtcggtatttaacttaatcggctgccttctactaacagacattagccgattaagggttaaatagcgatattgccggagattatataagatatatgataactcgacgaattatataaacaagattagagtatcataaaaatggaagcactaatcccgagaacgcaagcggccataacaagttttacctcttgttgaagatcgaaaccgatgcagctcaacccgaaagcaagaactcgtcttgacaaaacgaaagtaaaaagggtggtgatgcgccgagattgtattgagcgtgtgttagtttgattacatggggctcgggtctatttatactcgagaattacaaaatatgtccatatcggacacgactcttatctctaacaaactctaagaaactataagtctttgcggcagacttttgcccaaacatatctctaaagaaattacataaaatatcctaattaatagatataattgccttctcaggactctatccatgcgtagcaatcatcatgaagcacatcaacctaacccgacaacatacgcaatgttatactatcggattcggctcgatcagctaaccccatccgactcaaactctgccgatcttagttgtagccgattcggactccagccgatcttcactctgttttcaggacgatctccatctcgaactccatctcgatttcttcttcatctccgattcttggattaccaaatttggttgttaacataaacgtagactgatgacaaaacccattccataaccctggactaattcgcgagacgaatctattaagcctaattaatccatgattagtctatgtgatgctacagtaaatatgtgctaattatggattaattaggcttaaaaattttgtctcgcgaattagctctcatttatgcaattagtctatgtttaattaatacttcgaattagcgtcaaacattcgatgtgacaagactaaatttttatccctggtccaaacaccaccttacgctagacaggccattatatgcaccgacatgcaacacttacgacgggcccacatatatatgcctttcgtccatcgcgcaaatgcaatgacgcggatttagagcaagtattacaacaggctgtaagcatactaatctctacgtggaggagggagaaacgaagagagagatctggacgggcgactcgcgacgcgcctgcttgaggccggcggatacgcgctacggccgctgctattggcttaggctcgtttatgtgcattaaatactagcgggtccgtcaccaccgcgtggtgatctggcgcgtgttacagccatagttattgggaccggaccggtggtccgaccggagaaaaccggaaccagccggtcaggtccagctaaaggaccaggcgtgcaatcaaacctgagaaaaccaattaaaccgtcggttttttttgaagaagtcggtggaaaaccgggaaccgggggcgctggtggggacctgaggagaaggggcgctggtgggatggagagaagaaagtacatagtaaaatgttgtggggtgggattcgaaccctcaacctcatccttccctaccaggaaccccaccaatgagctatgttggacgtagtg

SEQ ID NO: 47143 - DNA, 2145 bp, Oryza sativa
ccaaactcccgcgtccgtctcgctgttgggtttcgtgcatgccgtgtgtacgcgctcgagcctcgagagaagtggagagccccatgtgctcccgcggcccacgcatacctggccggcctccaagccaactcacgcgtatgcgcacgcgtccctgcaatctccatgacatgttttgactccgtctagcacgtccccgtttacgttacgactgcgagattgcggtcggcttatgctcacgagatagaagtgaatcgggcttcattcagctggagattttggatgggaaaaatcgatcggtagttcagatttgaggccgtacgtcattttgaaacaggtcaaagaagatggaaaacactggcgagtgattaaccacatgctggcaatttggttgggtcgggatagttcgaacagttaatttgcacacaggtcgtgttagttggctcgtttgggctggttatgttgtttagacacaatcctgtatttcatggtcttgctatatggaggactctgtctgagtctaccattgctctgtgtaaaaaagaataaaaaatattctctgctatgcatttccatggtctactactgagcttattcaatcaagactcagcagcaatatcactgcaccaaataccacaatgctaaaaaaatggaaaacaaaagtcattggctatatgcatgttttggatataatactccgagcaaaataatattaagttttaagtggcatttctcacttgattctgaccacggatatttttcgtccaagtggcagcaatccaaaatctatcagtataagataacatgcaaaggaaaatcgacaataatcaacaaaatctttcttccacataaaaccttaagcaagtattttctatagatcttgccatcaggttaggtttgctgagatggtatacacatgttatgtttcactaggaaggaatcctacgcatatacgcaagtaaattatttataaaagattgctaaaagaagttatattttaccatattagtatccgcatatttattatttataaaaaaatactaaagaaattctatcgcaccatattcgctataaagacggtagattaccttataattatataaaaaatatatgtgctatagattttgatataccaaatgataataatatctgtcatactcaaacagaaattactttatcctggttatatgtaaacccacctaacaccgctatgtgttatcgttgttttgaaagctggtgcatttttaatagatggaattgcatccataccaaaacaaacctaatacatcattaatacaatgaaaatttaataataacaatatagattttatcatcgcacataacttaataataattaaattagatctacaatcataaaagtaaaatgaacttaatgttcccaaaatatattacttagaaagcaaaatttatgctaaaaaatgagatcatacaactaatatttgatacatttatgtctttggattattttatgtttaaagatccatattcactacaattctgtcgagggtgtagatcctgaccacggtatttgtagagcatggggattcttggtgccaaggtatacgcgagattgaggtaaaagaaaagggagacatggattttatataggttcgatactgttaactgataggtaacagcgctactcctgttggccgaagccagcgttgcctttatatatcaacatcacattagtacaatagttaggatgatctaatatagtctttatcgacttggaggcatggagctctcacacgtagttgacggctggaatagtattcattattgacgagattggaggtagcgctaggcccttcatatcggctttatggctctagattgggtttgtctaggcttgcctttctgttcatctagatttgtattggtttgtattctaacttggcatgtctagatctatttagatgtgttggcatattacctctctaattaactaggcttgtccctcctcctactaggggttcttgtatttataccctcgggtgcccccttgtccaagtagaactagggaggtaagtatggatacgatccgaatagtccttgttgtacccgagtagaactttgtttatcctttcatatcggaacaccttccatatatgaggcatgtgttgg

SEQ ID NO: 47144 - DNA, 27569 bp, Oryza sativa
atactagaataggaagagagtagagtagaaggagtcggaagaattccggagttgtcggtaatcttcttctatttcttttattgtgtttattactctgtattcaatataatattcttcttgagtaatttagatttatcttgtgagaattatctcttggttagttcctaaatagcatacgggattattgttcactataatcaactaaaatatagtaattgctttggtgagttataaacactaaagtagatattaattgcttagacgtggtgtttaggtaattattatccagtaattgctacgtatcccacagtacgtttgaggtgggcgcagaggtggtgacagccctcgagatcactgaagtcctccttgtccgggtatgtagttgagcgacatctgggaatagcaggttgccagtgcctgaagtattgcgttaggattaaaattaagctttccctagacattgtttctcactagtaaatcctctctatcctggcctatcttttgcttggtgtccttggatgaaccggaggaagatctgaccacacacgttcccttggattcgatacccatggaatactccgtaggggaagtgctactttggtatatccgtgtgtttgcggattttatctgtaactgtatcaaataccaacaagtatttctggcgccgttgccggggaacggttgctgatcatttccgaacccagttcatcctcatatcctttttcatattttattctaccttcacccctgctatcctagagaagtattcctgtcaaacccttctcaaccatggagcaacctcgttttgaactatctgctcctcgggacgaattctacgagccacctccttcatcggaacccatttatacaactggttatgaaattcgtcccgaactaatcagtatggttagggaaaattccttttctagctttgatctagaaaatccctaccatcatctgtgagactttgaacaagtctgctcatgccttaagattcgtggcatgagacaagaacctgtgcggtggaaattgtttccgttctctcttcaagggagagcaaagcaatggtacacctctaccgttggatgtgtaaacagtagctgggaaaagttgcgagacagattctatcttgccttcttcccagttactcgtattactacccttcgagttgaaattctcagtttcaagcagatcgaaaacgaatcaattggtgcagcttggtccagattcactaatttagtgcagttcggaccaaccctgtccttacctgtgtatgtgcttctccaacatttccatacgggtttggataaggaatctgcattctatctggacataaccgctggaggatcgttcatgcataaaacgccgtcagaaggaaaaacgatcttggatcgtattctagaaaggcaaaatttgctacaggacactcaaaaaacgtgtaattggctgggagacaccgtaaaaacgtgacacggctgatggacaccacaaaaattgtgtaattagctataggacactggtcgcattattttattatttccggatcaaaatagttgagaaatttttcaaaatggcgagattgcgcctggcgccattgttgtgctccggcggcagtggagtcctatctgtaagccttcaactagctaaggtggctattaatgagtgagagcttaacgctgctttattagtttaattaataatcatcgtgttcacgtagattaattaactgactgattaaggaacttgaagaggcacgcgatgggcaggctgcgcgggaaggtgttcccggcgtgcttcgcgttcaacgcggcgtgcacggcggcgttcgtgtggctccaccgcccaccgtggccgccggccgagcgccagcagctcgcggtcctcctcatcgccgccgggttcgacctcaccaacctgctcgtcttcagtcttcacccctaggacactcgaggtacatatggctccattcttttcagatcgagacatgaatgaaggccaccgaggacactcgaggtaagatcaccgccacgtatacccagcacattccgcacggcaacgtccttggcgaacgcgctcagtagctcgctgagccgcatgacgccaccgctcgccgccacctccactagctggaggagctcccctacctcctcctcccgcacggcgcggtagccccggaccctggccgggccgagcaggtggagcacgctcgccctgcgtgcggcgcgccagtacgcaccatgtggcgcaaaggcaatgtcggtgcagccgtacaggaggcggcgaggcacggtgagccgggggcggctagcgaaggcgctgtcctggtcgcgcatcacctcgcgcgccgcgtcggcagtggagatgacgacggtgttcactcggccgagccggagcatcaccatgggccggctggcggcgagcgcacgcagggagctgtgcgggagcgtgcgggaaagctgttgcagattgccaaggaagggaagggcaatccagacatgtggcaaaatatctcacctcttttgacctagaaataataaaataatgtgaccggtgtcctacggccaattacacattttttgtagtgtccatcagccgtgtcacgtttttgcgatgtctcccagccaattacacgttttttgcgtgtcctgtggcaaattttgccttctagaaaatacttccttcatgacgcagtccaatgaaccccagccggaggcatccgtgtccaagatagagaaacctctaacgatcgagccacttgctgaaccatccacttccgctagctcgattgatgagaaggttcctgagcagccgtccgtcgagaatgaagaaattcagactccggattgtgccgcaattatgttcagggaaggttttgacgaagattactgcaataccctcaactattttagcaagaggaaaccatccgttcctttgtcacctcccaatcctatggaacttgggttcctacgagaaattgtccgggaattgacatccataatgagcgacgaatggctaagggaggcagagctttcatccgaagtaattcggataaataccgcaccccgaatcattccttgccatctggaagggaacgatgtcggtattccctacagtccaactgtcggggccaacctcgtctctgagtcttttgcattcgcttatttaagcgataaggcagtgaccccgacaaacaaattcttcaagcatccgaacgaaaatatcatcgaaggatttgggtttgtgcaagatgtgcatgtctgctttgaagacaaggaggcgatcttggatttccacgtctttgaaatccaagactttgatatcctaatcggtctgcccattgagcaacttctcattaacacaccccgattaggtagcctcaaaataacactgggagagaatgaatctcaattccattctcgcgggcaaggatcaccttgaccgaccctctcctagaaattgagtcagcgaaagaggttaccgcagttcctcctcatgagtctcccgaggcccttctggaagatgaggtccccgacttcatcaaggaagaagcagatcccggtgagactctcgacttgccaatcatggaaccaccacctcaacctccgctagagcttaaacctctacctccaggcctacgatatgccatcctacacaataacagagaggctcctatcataatcagtgacaagctctctgaagacgagactcaacgtcttctcaccgtgttagaaaagcatcgttctgttcttagctactcgcttcaggatcttagggggattaatcccgcgctttgcactcatcgtattcctattgaccccgagagtactccctctagggaacctcaacgacggctcaataatgcaatgtgagaggttgtaaagaaagaggtcttgaaactcctgcatgccgggattatctatccgtaccatacagtgagtgggttagcccagtccaggttgtgccgaagaagggaggaatgacggtcgttgcaaatgctcaaaatgaactaattctcaacgaactgtaaccggatgaaggatgtgtatcgattacatgaatcttaacaaggctacaaaaaaggatcatttcccgctacccttcattgatgaattgttggaacagctggcgaatcattccttcttctatttccttgatgggtattccggatatcatcaaattcccatccatccggaggaccagagtaagactacgttcacatgtccgtatggcacctatgcataccgtaggatgtccttcggactgtgcaacgctcctgcaacttttcagagatgtatgatgtctattttctcggacatgatcgaagatatcatggaagtcttcatggatgatttctcagtttatggaaagactttcggtcattgtctgcagaatctagacaaagtcttacaacgatgccaagagaaggacctggtgctcaactgggaaaagtgccattttatggcccgtgaagggatagttcttgggcatcaagtgtccgaacgaggaatcgaagttgatcgtgctaaaatcgatgttatagatcaacttcctcctcctgtgaacatcaaaggaatccgcagcttcttgggacatgccggcttttatagaaggttcatcaaggacttttctacaatcgccagatccctgaccaatctgctagccaaggatgtgccctttgagttcgatgatgcatgcctaaaatcttttgaagttctcaaaaaggcactcgtctctgctccaatcattcaacctcctgattggactctgcccttcgagatcatgtgtgatgcaagtgactttgttgttggtgcggtcttgggccaaaccaaagataaaaagcatcatgcaatctgttacgctagcaaaactctaaccagagcccagttgaattacgcaactactgaaaaagaactgctcacggttgtttttgctatcgacaagtttagatcttacttagtaggagccaaggtaataatttatactgatcatgctgctttgaaatacctgctcactaagaaagatgctaaacctcgtctctcaagatggattttgctgctccaagaatttgacttagaaattaaagataaaaagggaatagaaaattccgtagcagatcatttgtccaggctgcagatcactaacatgcaggaacagccgatcaatgatttcttaagggatgacatgctgatgatggttagcgactccaacccgtggtatgccaacatcgtaaactacatggtatccaagtacgtaccacctggggaaaatcaacgaaaactgaagtatgaaagtcgccgtcacatatgggatgagccatacctgtatcgagtctactccgatggcttactacgaagatgtgtgccaactgaagaaggatttaagatcatagaacgatgccatgcctcaccctatggtggccattacggtgcattccgcacccaggctaagatttggcaaagcggcttcttctagccaacaatgtatgaagactcaaaagaatttgtcagaagatgcaccagctgccagaggcaaggaggaattactgcacgcgatgcaatgcccctcacatacaatttgcaagtcgagatatttgatgtttggggtatagacttcatgggacttttccctaagtctcacaactgtgagtacattctggtggcagtcgactatgtctccaagtgggttgaggctatgccgtgcagcgctgtggatgcgaggcatgccaagaagatgttcacagaaatcatcttcccaagatttggtacccccagaatggtcataagtgatggaggttctcactttattgacaaaaccttccgagacctcctacgagaaatgagagccaaacacaatgtggccactccttaccatccacagaccagtggacaagcagaaacatcaaacaaacaaatcaagaatattctgcaaaagatggtcaacaaaatgggaacaggatggaaggacagattgccggacgcactgtgggcataccgaacagcatacaagacacccattggaatgtccccatatccgatagtccacgagaagccatgccgactacccgtagaaattgagcacagagcatactgggccatcaggaattggaacatggattttgagggagcaggagaatggagaaaaatgcagatcgctgaacttgaggaatggagagaataggcttaccacaatgcaaagatatacaaagaaatgacgaagcgctggcatgacaaaagaataaagatcaagaaattcaagccaggagacaaagtactgatgttcaactccagagttaatcttttcggccacggaaaactgcgcagcaaataggaaggaccgttcgacgtcatcgacacctcttcgcacggggcaatcacactccgcgacgaatcaggtaacatatttaaggtaaacggtcaacgcctaaagattttccttgagccaaacaaaactttagatgaagaagtggacattattgattgattgattatgaacaatgatgatctcagctaatgcgtgcttaaaaccctgtatagttgtcatttttgtgcttagaataggttttagtgggccttggaagaaaattggcggccagccaatggttcggccgaaccagggcggcgcccgatcggccccaaattcgaatgatagtctcccccgctcgtccttagtccgtttagatgcgcgtttgaaggtagaacgttcggatcacaccagaacacttcgtcttcctcctttcctccacctttgcacactctcctctccaattcaacccaattcctcaaatttccactcatacccaccaatggctggcaaatccctaatcccattcatcggctcctcctccaattccacatgcaacctcgacggagagccgacaccagcaaatcaattgataccggtggaggattacacgatggaaggggtgaacgcactatgggcgcagcccctcgcagcagtgacgggctcccctgcgaatccggagcccatcggcgaactcccttgttcggccgaaccaggggttcggccgaacccttctcggccccccattcggcagcgcgatccctctcccctcgccatgttacaagaacaaaaatccgggggagggggggattcgcctgcacgacggccgacaacgggagagctcggtctcttgaaggcacgacgcctttttcaagatgacgggaaggccgcgccgccgagcgctatgtggacaccctcttcaccaaggcaagggatgaggtgctccacaagtacaccacacccaccgctactccatctactccgaaggaggagcgattccgtattcagggagtgcgaactcccggcggtgggtatggtaagggtttactccggcctttaacagcatcggagaaggagggggcagcggagtcccgtaggtgaagcgtcatttgacaccccctccaatttgagggctcccggccaattccaaaaggatgaggtgaaatcgccggagccctcgatccacaagctcgccgctaaagtgaagaaacttcgcaaggagaacatagagcttacggatcgcaatgcggagctaggggtagaacttgctgaaattagaaataattttgatacccttagtcgcggtttgtgcgctaagatcaagcgtgcattcatagagatggggaagaaaaataagtattatgctaactagatgtttcctttcccatgaataaaatagtagtaggtgcttggttttatttttcaatcatgtaagcacttgctataaataatgtggctcattggtgttaaccccaatgtttgccaaagtttgtttttgttttaagttcaataaagttcagcttttgaataagtgtgggggagacatcccagcttctgacgtgcatatactctaaaaattaatgaaatctctgaacacctagaagcactgaactctgcagaaagttgcaaagggatcaggcgccagagtggttcggccgaaccagtgttggccccaatccctctcaactttcacaggtaagcaggtgagcacgtcttttatctgtatatctccaccatggtatagtactagagctgaaaattcagaaaacaattgcttcaagcataagtaagagataaaatttccaactaatgaaattcttcatgtgattgatcttgtatattcattattctcagctgaatttgtgcttgtgaacaaccatccatgattagggaaccttatgcatctaagtaattgctttatgtgagatgattaagacgaaaggaatccttgcaacttggttatgactcttgggaatttgttttcaaaataaaaattgttttaagaaggctcaatcctctaattgactttaccttatacctaccaaggccatatgcaagtatatcattgatgaaccttatcatgcatatgactgcttgacattatattgagctttgtcaaatttgtgtgacttgtgttagatatctttcatacaacatatttcacttttccccttgtcaaatttgtgcaaagaaaatatagccatgccccttccataatcatgccaagagaaccaattggagagaaagtataggaaaaagggagaatcatttctttattccaccattccacaacatatttcacttttccacttttcaccataaataaagacccttgatctaggagtatgattgatgatcttcttgagtccatatttttggcttggaaatatatatgatgcaggtatgtcccagttatccctaccaagctccacatatcagccgtagaatagggatcagttctggcacattttgccttggtgacgatccaaagaaaatatacatccttgagagaccagagagaaagtcaatatgaggaaaagagctagtttgcgaaaattcataaaaaatcccatgagtctggtagagaagcaagaaggactggaatcaagatcgttccatttatcaattactcaagatggtaagatagccactgaaaaagttcacaggtgcaggtatggttgtgaatgatttatatgcttgattcatcttttgaagaaattcattctacactaacctttactcagggacgagcaaagggctaagtgtggggggttttgttggcggctgttaaatgccgattctataccgccaacatctgcataaagattagataataaaacatctaacatagtgataggtgcttatctcacgtattccacaagtgttgatatatatttgtatgcaggtaataaaccccggtgcgggaggaaatctagactaaagtgaggagaattctgtatccatacaaggatgggttgtgaacttcatcgaaacatcagtaaatcagcccaaaataccaagaaatggatagaggaggaccaggggaggacttgggccaaaggccaagccagatgggtccagcccaggttcggccgaaccccctggttcggccgaaccacaatcttagccatctaggctggggtttggcgtggacgtcccagatgcatccctgatggcggttggagggcacttcggacatttccccttcgcctaccgtcatacctacccctatataagaacatcatctcattcacttctacacacacttccaagcttgagctgaattataagaggctctattgtactatattgtatactagaataggaagagagtagagtagaaggagtcggaagaattccggagttgtcggtaatcttctcctatttcttttattctgtttattactctgaattcaatataatattcttcttgagtaatttagatttatcttgtgagaattatctcttggttagtacctaaatagcatacgggattattgttcactataatcaattaaaatatagtgattgctttggtgagttataaacactaaagtagatattaattgcctagatgtggtgtttaggtaattattatccagtaattgttgcgtatcccacagtacgtttgaggtgggtgtagaggtggtgacagccctcgagatcactaaagtcctccttgtccgggtacgtagtagagtgacatctgggaacagtgggttgccagtgcctgaagtattgcgttaggattaaaattaagctttccctagacactgtttctcactagtaaatcctctctatcctggcctatctttttcttggtgtccttggataaaccggaggatgatctgaccacacacgttcccttggattcgatacccttggaatactccgtaggggaggtgctacttcggtatatccatgcgcttgcggattttatctgtaactgtatcaaataccaacagcatgattccatagaagacttggtatatggtggcacttaagaccatcaacaacacccccacacttattatttactcgtccatgagtaaagctcatgaatccgctagagtaatgactttgtgcttaatgcttaatgatatgacataccaaatatcctgagacatacttgagtctgtgaatcttgatgtgtctaccatgtcatattgagcgatcgaaaaacggaaccgtcctcgaagtcacctttattccttctgatgaattaccttggggttttctttgatgcccaataaaacatactcccttcgtcccaaaatataacaacttttagcactcaggatttgttctaaaatatattaacttctccaccaaacattcccttccctaccaatcacaatcctccatcattcacttttctcacatacctccacttctcaaagtgtttattcctcaccaaggcattgatgttgcattgtctaatcctacctttctaataaagcttatgtggagcttatggtagggaataagaaatgatcatatacttgcatcagatatattgtaaagtcaaatagaggattcaagaagatatccaatcatataactatgactaatcttgtgcacctatatatatatggccatatgggtggaaatggaaaggtggaaaagaatttaaaaaatgggatggtgactcacttttttttgtatgattctcctccatgctcttttattttagagaacatggctatactttttctttccatcatgttcgagaacattttgcatcattcacttttgacgtagtatttatttggtggatgctgactctcgacgtagaagcttagcatatggaaatggatgaaatgtttttgataatcctccattgtagagaaagagtaatatttttttgtggctaagtgcacaagattttggtcatcagaatatgaaaagaatctagcaagggttgcaaccatttagcaaaactcaaaatggtagcaagcagcatatgtaaaaggttttatcattaaaatcaacatatggctttggtaggaagggaacatcaataaggagtatgtaaagttatttattttccttttataaaattcccaagggttcaacatcaagagcaaggttcatatcattgggctatttctcattaataaataacatagataacatatggtcctatgaatatgattcacaagcaacaggtgtgtgtgttgactttttttgtggtcaacacagaatcacctaacgatatgcagtgtaaacaaagtcgccaaaatcgatatatcaaaaccgtctagcggaaccggttcaaaattaattcacttttgcggaatcaaatgactaatttacaagcaaattaattagcaaagaagataaatatcatacttacgtgacgacgaacgactagtttccgagcaaactagcaaaggataaccttctcgttttcgtggagaagcacaaccatttttcagcgcaaaagagcaaagatgaactaaattctagggtcgctagaactcagccatgaaaacaaaatagaaaagaacttaaaaagtaaaagagatgaatagtagattgaaattgttcgggtgtctctaacctgatcgaccatcaccagtatatatactgggcaaggtagacgatcctttagcaagtctgatgatatcggtcccacacaaaataaaagaaagattaaccgaaaaggaaacaaactaatcctaacaaagaagtttatctatcttctagtccggcacgcgttaaccaatctgcctcattgcatgcaaaccgacaccaaatctccatgcctcatgcgacgcacgcataaaccagttgcatattcatctcggtcaccagtgcaaacccaacgtgaaatcctcatgtgcgcttggctcatgcttctcctctctgacctccatccaaagccgtacgtcaagcaaatatcagctcaaatcagccatcaagcaacaactgaagataaagcatcatcgattctccatctgcatgcatccagtcccagtccaggactccaaatacagagctactcctttctcgattgcagcactgtagcccaactgacatgcacacatatctccacacgacacatgcatgatcaaatgatcgaataaccctgcaatttacatggatagccacccaatgtatcacaaattcctgcacatgtaaactgagctgatcttccaagcaaatcatcagtccattacaccaattattctaaaataatctggcttgcacaaataaactaactataagccaaattatgccacaaacagtgtgtagggaattagaagttgttggcggttattaaatgccaattctatacagccaacatatgcataaagtccatataataaaacatccaacatagtgttggtgtatatttgtgtgcagatgataaaccctgaagttgggagggtaatcagactaaagtgagggaaaacatgtatccatacaaggataggttgtgaactttatcaaaataccagagaatcagcccaagactccgataaatgaataaagcaaagcagagggagtccacaggccgaaggccaggccgggagggcccagcccaagttcggccaaccctggtgatcaccgttgatcctggggtttggcgtggatcctccagatcactccctgatggcggttgcggggcagttcggacatttccccttctcacagcctataaaaggagcttcactgcttcactctcacacacacttccaagcttgagctgaattataagaagctctattgtactatattgtatactagaataggaggagagtagagtagaagaagtcggaattctggagttgtcggtaatcttctcccatttcttttattctgtttattactctaatttcaatataattatcttcctgagtcatttagatttatcttgtgagaattatcttttggttagttcctaaatagcatacaggattattgttcactataatcaactaaaatatagtgattactttggtgagttataagcactaaagtaaatattaattgcttagacatggtgtttaggtagttgttatccagtaattgctgtgtatcccacagtacgtttgaggtaggtgtagaggtggtgacagccctcaagatcacttatgtcctccctgtccgggtacgtagtagagcgacaactaggaacagcgggttgccagtgcctgaagtattgtattaggattaaacttaagctttccctagacactgtttctcactagcaaatcctctctatcctagcctattctttgcttagtgtccttggatgaaccgggggaagatctgaccacacacgttcccttggattcgataccctttggaatactccgtaggggaagtgctacatcggtatatccgtgcgcttgcggattttatctgtgaccgtaagaattaccaacagaaggtatgtaagttattttaacaggcaagtcagaaactctagttgatcatgtcaatactccttgaccttgattcgcctataatgtcatactttggtttgtttcttgcacattctgttattgtgatagaatgtgtctctccattcctccagttctgacaggtgcatatgttggtgccgtccgacttgtcccaaatccatattctaagtccggatggcccagtgcgccctatgttccagctcaacaggcaggtggcaagtcttttcatagacaagctagtatggtgacattccgatggacgtcttgtatgcggttctacatgcccaaagagcatcaggtagcttatgcttccatgttttcccctctcattgacggctttctgcggaatattcttgatttgcttattgtatgtttctactttaccacctgtttgggggcggtatggagttgcaatgttgtgttgtgctccaagctcttgtaagaagttcttggaggtcttatcgataaaatgagaccctcagttagtaatcaccatccacggtgttccaaaccgagggaagatgaccttgtggaacatcttgcgggcgtgtttgacgtcgacatgaaattgcttccacccacttggacacatagtcgacggccaccaggatgtgctcgcagtcatgggactttgggaaggggcatttaactttttgccacttttaaaatgttgcaattaaggatttgccactcatagtctatgacatgtgggccctcatgtgtctatggcatataggtccagtgacaaatccttaattgtcatttgtaagagtggcaaatagttaaacatgtcctttgggaagggtttcatgtagttgataccccatacattaaagagttccacttgaatattgtatgttaggggcatcgcatcgcgagcggtgatacctacatgcttctggcaccttgcacatctttgaatgaattcttttgtatcttcatacattgtaggccaaaaggatccattctgccagatctttgattggctgaagagacaaaaaaaaggaggagaaaatgccagccgtccaaataaggaatgggaagcaaaagggcctatagcctagtggctacaagagcctcagtagcatcataggtcatgtgttcgactctctatgagagtgaatttttcagaatttgatggctatgtgctttcagtggtaggcgacgtacccgtcaataacaggggtagggtttgcgtgcgttttatagggtgagtgtgtgtgcgttgtgacttcgtctatctccaggatggatttgccggcccagtcttcgaagatgctcataggggtagggtttacgtgcgtgcgttcatagggtgagagtgcgtgcgttgtgagtgtctgcattgtactgtctaattctcaaaagaaaaaggaatgagaaaaaaatatataaatacgacgtctaagctcatctgctcatggagtggccggattggtcctccctcaatctctaaattttgaggaaagtctaaaattcattcactaactttggaaatatcttatatccccgaaccatatatctatgaagttcacttttcatcctttgactggagcgaaaagtctgaattacacccctaaattttaggtgagtacgaattacccccttaaacccgaaaaccagacatctttcactctcaattattaataccggatgaaaaaccccctcgaacagctttgcaagcggttttgatcctatgtggcagttcagtcaacaattattttattaaaaaattgatgggccgacttgtcagatctctcctctgtctctctctctcgtcaaaatgccatggaggaggcgcgccagcggctgcatgcgtctcgcagcggaggccgaggacgagttgcctccaccccccgcccccattggccactgccctcggctccccctccgccaccccgcccccgttggtcgccgacgtcgactcccccttcgatgctgtgagctgcctccgcccccgcatctgccctccgccatccttggctcctcctccgtcgccccgactgcctccgccctcgcccccttcggccaccgttgtaggctccccctccggcgctcccctcctcggtgataagagagagatggaggtgaggggagggaaaagagagagatgattagggagagagagagaggggggaggggaaagagatacagatggtgagagactgacaggtgggaccaccgatttaaaaaaagtgctaactggactgccttataggaccaaaaccactctggtttgagttaaggggataattcgttcggtattcgtagttgaggatgaaagatatctaattttcgggttagggggtaattcgtattcaccaatagttcaggggtgtaattcggacttttcccttaggctgtgtttgatttggcggggtggccgagcttttcaatgatcataacatgagaaaagttatggctaattaagttacaaacataaaaaatatatttatttatttttaaaatgaattttctatatacatatttttaaaaagcatataatgtttaacaattcaaaaaacttatgtaaaaagaggtactagcctaatggagaagctgattgaaactcaacctcaaattaggttgatgacatagcactaatgtgacaatgtggcgtaatgttgaaaatatatattaattaaaaatcactaaatgatcttgaaaattctaaaaaagattatccccttatccatgaaacatttttaaaagaaatatttttacaagcaagatacatataacttgcttgtcgaaagtagtgctaaaacatgacaaaaaatataataaaattaagctttatttcattttggacaaaatttatgtaagttctaatccgtccaatttgtaagcgtatttccttttcaaaagatcttttcaattcagctactaatttaaaatttaaaataccaaccgatggatggtattatattacatttaaaattttaaaattgataatttactttaaagagtatagaaaatgtgggttacacatttgtgcatattaaacctatataaatcggacttgttacaaaacaaaggattattccaagaaacaaaatgattttgtacggatcatagaactattttctgcaggcaaactattatatacacaactcaagaaaaaacaatctaggtcagtacataatcgtatataacaagtgatggtttttaaataaaatttgcatttatgtacattttttaaatttaaaagcattttcagccttaaaatgaactgttgatgtcatccaatatctctttgaatcattgaaaggatgagatgtgactgtatagaaagttaagggtgtagcaaatgttcaattttttggacattgataaaagttccttttttcttgaaaagtcaaattgggcgtttgttgcgcacctgaggccctacatcctgtttttctgagacgagatcacgagaggcagagtccacgaggccacgaaagcgctccaccgaccaggcgcccaccacctgttcgatcgaatgccgccgccggccaccgcgcgcggcgcccgctccgccgcctcctccaccccgttaggcgccgccggtggcggccgacgagggcccctccccgaccccttggcgcatccgctcccgacgcccttaccaacctctccggctacgccttccgccccgacctccgggctcctccatcctctcgcaccagcgcgccgccctcgcgccgcctcgggcgcccccgttccaggaccgcgtcgtccatgcgctcctcctcctgctcctcgagcccgcaggccccaaacctttcgctcccaccgccacccgttccgtccgctcccacttcgccgctctaccctttggttcatctctgccgacctcaccggcggtggccgacgcgctctcgccggatactttctactttcctgttgtccagaagaccgtctctgaccgcaatgcccatgtctgggctgtgtttgtgccaccatgataggagcttgatggtctagctaagagaagaggctgaaaaggaaggtgctcaggaagaacagaatgtgcccccctgagttcctgacccatattgattgaggttaatacttcggaagttcggatttaccctggaacaggcgtgtcatgtgccgaattgtgggcattatggtatacttagccattttgcctgccaatgtgtgccttaacaaactcaattggtggatggagggaaagatgcatgagtacttctggccaggcatgattcgattgggaaggaggtgggtgactacggatgcgagaaacgcccagggtcttctggcttagctccacaaggtggtgggctagacgacctaggttcgaagcctcaccccttctaattatttgatattaggtccttccctaatattcgcatttttggtgaccagggatgtccgcctggcctgagtttgtcccatgaagtgggaaggagtaaaacaagtaagatggattacctaagatgtggtggttcccatgctcttattgggatcaggggtccaagggaggacacagttgaggtaaaggatgatggagttctgcaagagcacttttggtttgaggcctgagaaagtgagatatcaatggttgggattgagcacatgaatcaatcaagttcttggatcacgtgatcacccgctgggttatctaccaaccttacaatatactgctaatggaggaaacattgtgagtgacaagggtgttggaacactcttatagcaaagccttcagaggtgggaggtgcataaggcatttaaggagtcttgaagttgttgccacgttcaccaatgctgtactctgggcaggcacgcacaatcctcagatgacaaatttctcgagaccatgtctgattagtacatgtacacagacaaccggaagaagattgtaggttctgttgttatgaaactagtagcactaacagtacaaacaatttttaaatgtttattaaactatagaattttaacacgcattatattgcttttaggcttaaggatattaactgaaagtcatgatgcttatttacccattgcaataggactatacatttattccgcatgtactctactgtctttccctaagctaccagaagtaggagtatgtgattactgttttgttctttttgctcttgtagaattccactaggtgtgatactgaattatctattgctgctctttttttgtttcttgcatttcaaacagaacaaccttgaataaaatctatagtaaacgaactagcaaacaagaacaagagaatttcacatttattgatcaaatctaaattgatgtgagttctgtagtccttgatggacatgcaagttgcttatcctcacttttcagaacaaataatctcatatatgatatagttcctgcattttctaaagattcactaatctttcttctcttttttctttaggaacagttctattggagcaatgttccttgactcaatgatagcagttggaattatttgcatgtactgcttggaggtggcagaccactggctatcagatgcttcctgcagaggtaatgtctgggtatcaaggctccaccaccgttaggaccagccaggtttgatcttgagctggtgctgactgggagatttgatagatattcttgttgtgaggctgattgttttcaattctcttataagttacaatcgatgcattgagtgattaagaacttaatctactgccaactacagtttaagatttacccagtcactgggcttcagatgaaatatagagctatctcccattaaaattaaaatagaaaaatatttccaggataactattcaggttatgcttggaagttaggtttctctgtctgtttaacctaccatttctgcatggatggagaaaatcattgatgttgtttagtatgacttaatatgtatactatcatgggcatgattagatgactgatgactctaggggcctaactcccaagcggtacaaccacaatgataactgttgcccatgccacaagtggcatggaagatagactaggaacttttcttactcctaccaatggtagcatatgcgactccttttcctacaaaatctagtttctgtaagctcaacctaattgcttttaacaaataaagataacattgaggcagctaagatcctatcctaaaataacttgatagttaagaaatcataggtgtacctagctagtgtggctgttgctgcttgcctcttttatgctgcagcatctcattatggtaaccatgaaaagagtaatggaccttaatggtctggagtctggacatatgcagcagaaaaatatgaatagggaagggcagaagagggagggaggtagattacgcttgatttgttcctctgtacaagtctctttaaataaagagagggctcagcacggcaataatcaaatcttaaacatggggaacaatctgtagtttgatggaaacaattaatgaagtaattgcttatttcatagccttatttcctaacacatgatcccacctgccaaacagttccctctcgtgcacccacaggacagattagaaattactctttgccataattacggatttagttcaactcttctgtatttagtaatgttgtagtggcaatggaacgagtgaatttatgcttaacaatgtataactctgtttccagcaacatgggcataagactatgatcagtgatcaccgccatcttaaaggtgattctttcctgctgctggttgtagttacctgttctgttctattattatggatagcaattttttacatgttccagtttatgcatagaacaacctaatatgtgaccaaaaagtatgtcatcctcattagtttctgactttaataataatagacccagtattctctgcattccacatgaacaaaagtgaacttttgaaaagggcaaaagaaaaagaaatccaaaagttcaattacttagtgttttgttgcataataatgcatgacaatcaagcattagtttgaatcaaccctacatcatcagcattctctgtacgtcacatataataaacaattgggaagggtaaaagcctgatctgtgatgaatctgatgatcaattttcttattttcttaatgaggggtagtgtattgcatattgctcaagagttcactttgagggagatgactggtggactttgtaaaacctgtttgagtggtgatgtaaggagcccctggaaagtgactttaccttgttttgtcatattaaccaattggctgaagttcttagtgacgtcattgatgatttcatgttgatattgatatctggttcccagcttaacttagtaggtactatgtagtacaaaaatattagtgaatagtgagctgcagctgtatgtttgtacaactgtattgctgtaggacatggaattattatttcatggtctaaccttgcttttgatatttgtagttgtacttatgtttgcattttgtatggtgtctatttatcatttattttgttagatgttccatcatgcggatgagcgtatagcatttttattatgttaaatcctggctgccacatttgtgcccaccttactgtacgaggtttcggtgggccccttcatttgaactaagtcaaaggggacgtccttcccccttgatcgaaaaaaagatgttccatcatgtgagcataggctgtaggtgtacatatggtacatatatgtatagctcttcacctggtggaaagtgttaaatcagaatagtataaaattttagtccatgcattctaagatgcttcagtttaaacatatatgtttattaccagatctaggaaattatgtgctcctgcaacttccatttttttgtaattcaaactgatatttccatttttgtttcgtggtgcagtaataattattttattggcaaaaggaaggaaaatttaatttggttttttactagtatggatgtgatgtttctgaaacataattttgccacacattgttggtgtaacatacagattgaggtattgagtggtacaatatatataatatatccaatatgcgaggagccaactgatatcaatccatcaggtttcgcagtgttagaacattggtccgtgattcattaatgccgctatggttaaatgtcatataatttggtttgttttacttgaaacagtaattgttggaatttagtcaccctggttcacccccatggtattttaccatgatgctattttgcacgctagaaaaccagcccttccccctatgagagaatgcatactcttaagttttgttacatcaatcagccctctatctgtacgatccagtacaatttttggctaaagttggctgtcctgcctcctgaggcaaaattatacagcattcgtttgctagttgtcacatgtttggttttggtggatcttttcggttggggaaacccatttgtgaattttacatattcgctgttcagcataggtgcacttgtcaattccgaatgtcagactgataaattttcacttcgattaagctaagtatgaggttatgagtatacaaaggaaccatttattttgttctctttgtattgcccaaaacacaatatccctttatggcttgtatgtggggctttgatttttgtatctattgtaatctacgggacccagcaacaaattcatgttggacctcctttcgtgctttaccagtgcttcattttttcacaaccacataatccctctatggcctacgtcaacttggagtggggttgggttaattatctagtagcactgatggaatgattttttgtggggttcacacctttcccttttgtgggccactgttgtaatgcagaaagtgttatggtgaggacggctcgttggttcacagggtcaccagcctatgataccatgggcaggagggaagtcatacagatgacctaccgtgtttatgatctattaacaccatattcatcagaaaataagtgtatatgttcttgtcattgcttttcttttgcaggatgaccaatcctggagtacattttgttttaaaaatttcacagtatatccttttatcctttctggaggttacagtatcttatggacagttggctttcaggtatgtcatgggtatcctgtgtgcattatcttacaactttataagcacccagaaaactaatctcgatcagtgttgttcatatgcagacttgctagattaaaatttactctcatgacctaaatgcaagttaggaggtcactgatataagattagattaatctgatctttttatctctttcagttacacataacgaacgatttccttccccaatgtgaggcatcatcctgtccctgttgctaaatcgtgtcagattaacttttcatacaggatcacagttagaagttgagaagccattttcacatgatggaaccctttgtatagtagtgtataatgtctgcattagatatctggcccctttcaattattcgtattggatttctgcactacccaaacccaaacttgcctggataacgactgctctcaacaaaagccttatcattctggtttgtttgttcttccatatcttgcgtgacacaccatgccgtttgttgttcttgttttcttcttttgtgcagctctcctttgcgtcatgggatttgtttctctatcctatcctatgtgctgtacaccatcccgttttgcgcaaatcctttttttgtgtgttgggccgcttcggctgctgcggttcagtccttttcgttgcagcaacaatgagttctgtcaaaaatgaataaagttgtggcatatgttctgaagaatataatatattccctgtgtgtgagagagaaaaaagggcctcatcttttgttttgtccctttgatgacagctctggattcttcagtttggtctactgggatcatgatggtgatgatatcctgcagggcaaccatatcaccgtggggcagcgcagaaagaaagaaacaggtagaaaggtagaaacaacgttcgagcagcttctctctgttatgtttttcagattggagaatggaagaaatgcagaattattctccattctgcgttgctgaactttttttttctctgaaatgaattcaggtcagaggcattgacattgaccaggaagaggattctttgttcctcctatgttgtttgatgtgattcgtgctgtttatcagatgaacttgactgtaattaacagtggagaattctttctggtgaaattttcacaggaggaatcagtctctcgtcttggtggcggttcttgatccgcagaaaattgaccggactgctgaactaacgaactgccattattatacagtaccccgtgtgcttttcccgtttctatcgtctcctaagccattgaccaaaatttattgtactttaactacggatttactcctaattgaatacaggcgtacgcgttgccgagtcccgtgtgtcacctctcctgtcccgttcacgtttcgtcgaattatattattctgaaaattgtagtccgttttattcacgtttcgtcgaattatattattatggaaattatactccgttttttttatataacgccattaacctttatacgtttgatcattcgtcttattaaaaaatatataattttttttcaacttaatttatcatcaaatgtcctttaagtatgatttaatttttcttatatttacataaaaattaaataagataaatggctaaacgtttataaaaaaatcaacaatatgatacattaaaaacgaaggttgtataaataaaaagggtactgcctttttgcccaagaaaaaaaataaaggagaagagaagattaggtagagtatactcggggttttttttttaatcttttgtcgacgtgcgaaattcacgcatgcccttttctttccctgagctcacgtgcgtcagctctgagccgcccgagacgttgagatcccctgaggctgctggattttataatcctagttgtggcagcgttacacgtgatgatcgcgccaaggcagcatgggacaaagcgaaccggctaagttaaatccttgttgctgcggtgatgatttctgtgcacgagaaacggaatctgtgtgtattattgttttctggatttcgttgtgtacttgtgtaactgtgcacttgtatatactacgtaaactattacttaagttcagttgaaaattcggttcgattaggatatgttttaagttgtgtagaattgtgaaatatttcttatttaccttattattaataattatattattttctataagaagctttgttaattccattgcgcattaattttacttagagaaactataaattatgattagtatatatgatgatgcagaccctcatggtttttaaaaaataatacatccgtcctaaaatattgataactaaatagcaatactctaggtaacaatactttgagacagaggtactatgtttgttctaactagtataagcacttatcgtgaaaataagataccacatatattagctaaacttttaaaaataactcttaaatgaaaattcgatgaaagttctgacatatagaacaaaatatgttaaacttactattatttcgattatcttcgttgagaaactaaatctctctcactattacataaggtagggtttttttttcttgttctttttctatttaactcggtcaagtttatcactgtgatatttaaaaggtttagcatggtatttttaaatcctatattttttcattgctactatgtacgagtactatgttttaattttattttaattttagtttaagtagattgtgttttgttcaaccgcactcccactacaattttggctggatgcaactcaaaccagccacagaagatcggtctagcccgtgccaacgtgctgctcatcccaatgctgccgtgccatgccacgcaactaacaccatttccaattttccacccgcaatctatttaggatttgtttagtttcattttttttctaaaaacatactccctccgtactcgcaaaaaaagttaattagaacaacgacacggtctccaaaacacaactttaatttcttgtttctataaaaatatttattgaaaagtgatatatgtatacttttatgaaagtatttttttaagataaatctattcatataatttttacattttcaaactcaacaacttgatagttattcatgatttatattcctaatgtttgacttaaacattatcctaaacgacttcctttacgagtacggagggagtatatcatatcattcgacacatgcatgaatcattaaatatagataaaataaaaactaattgcacagtttgtatgaaaaatcacgagacgaatcttctgagcctaattaatccatgattagccataactgctacggtacttacatgtgctaatgacggattaattaggcttaataaactgggttaataaattcgtctcgcggtttctatgagttatgaaactagttttttcattcgtatccgaaaacccctttgacatccggtcaaacgttcgattggacacccaaaaattttcttttcacgaattaaacacacctttatcacttctatttcgaaaattcatttttagaaatgcaaacaaaatatatactccaactgtttcattataagtcatgactttttttttcaaaattctttatgtttaaccaaatttataaaaatattagcaacacctacacaaaattagtttcattatatttaacattatatatatatattaatgtattttaattaaaaatattattatattttttataaacttgaagcttgaaaaaaaagtcaaatgacttaaattacgaaacacggatagatgtatacaagaggaaaatatatctcatatttcgaaaatctatttttcgaaatgaatagagagaaaaaaaaaacagaaagaggcttcgctttgggctcctactactacttatagccaacttccccgaaagcgatccctcctgctcgcgtcgcaacctcgccttattatttttccactcctcacctcgaattattccaataataaaaattccacccaaatttcctcgattcgattcttccagcgagctccgttctctcctctcccccctcctcctctcgcgtggttgcgcgtgcgatcggaggcggccgggctcgatcgatccgcgccgagatggttgccgtggcggcggaggccccgatccgcgccgacgccgtgcccgcggcggcggcggcggctgctgcggccgcgccggatgccgccccaggtgagggggcggatgcggccgcggcggtggaggcggaggcggcggggaaggatggcggggaggaggtgagggagtacaagagcgacgcgaggaagctggaggagctgttcaagaagctgaacccgtcggccgaggagttcgtgccgctggcgcgccgccgcggcggcggggacggcgcgcgccggctgtcggcggacgcgcccgtgttcgtgtcccccgcgatcgacttctactcgcaacacccggtgcagcagccgccgccgatccaggtgctccccgtggtggtgggcggtggcgggggcgcgggattggactccagcagcgacggatccaccaacggccagccgaatcgtcgggtaatcgatcgcctaatcgcgctgctgggttcggtgcgattagtttcgctgtggggggtttggcgtagattcattgtggcatgatcgatctctatcgatcgatcgatcgatcgattgggatttggggtttagggtgatgttgttgtcttcattgccggagttttggtctctgacgcgatcattccagaatgttgattcatgggcgaggggggtttagttctagttaggttatgatatttatgtgatcaatttaagacgaattttcctcgaggaccaattgattt

SEQ ID NO: 47145 - DNA, 3463 bp, Oryza sativa
  unsure (1)..(3463): unsure at all n locations
atttttgctggttgtattttgatcgagttattttttcttctggttttttatgttgacgtttttgttagagaaattgcttgccacgatctgtacagttctatagtcactctagtgggctttacgttttttctttgttgataattataagatgtattttgttacagagaaggagtagcttcaaccaagggaggaggaggatgggaggccgaccaaggcgaactgatagggaggatagtgtgcggcgaactgtctatgtatctgacattgatcagcatgtgagaatatagtagagaatgagctgttacatttgctttgacatttattttcctgactgactgacctgaagcttgatccattcgtttacaggtgactgaacagaagcttgctgaagttttctcaaattgcggacaagtatgtttctgatattttaatattaattacatttgtgagaaaacggactttctcttttcttatatcttgaaaacaaacaagcaaagttggttgtcttgtctgacttaataatttgcaagtgaagagaatattactgttatcatcatcaacaccaacaatagccattagtttcaatcaagttgaagtaggctagagatgaaaaccaagtcaaaccgcatgaaccaaaaggtatatttgtactaaaaatataatagagattctgacagatattctgtagtaaaatactttgatgacttatgcatatttcaagctagaaaactaacatatatgtatagtattttgcagagtagatttaaattcattttggttaatactttataacaccagagtgacaaagagtgattttgcattgtaagtatggagcacaacttttctctatggtaaatgactaaatgcagttgggtgcaaccctaaagttatgattcagttgaatgccactctagaacaagtacagcagttactttcgacagctgcttgttttagattgtgaccttgcccggcctgaatggattgtgacttagcacctagacaagaccaacttgtcagaagaatttattattggcaggaggtaatagtttcggaaaaaaagggagatcacaagatgagaaatggaagaaacttgcaggaaagcaacagttaatattttagttgactagcatttgatagagccaatattctgtagttccattttcctgaaatgtttacttcagtatgctggtaatggtgttcgcttttttgtaatgtaaactgaatgcaattgctaggccaaaaaccgagttgtattgttttgtttgattaacatcatgtaaggtaattgcattagatgtttatgcttatgaaatagtaacatgatgtaaggtatctccaagttaattatggttgattgttaatggaagtcaaaatatgagtaaattgcgctcgtggtacatgaacttgcttggtgggtgcaaataggtacaacaacttgtaaattgctcgttttggtacaataacttgcctagtttgtgcgaacctagtacaaaacaacacacacatgcaaaattgatctaatgtgtagtaccagataaccagagtgagacatatgcacgctagcaattgtttgtagttgtgcagtcccaatcacactagcttaattttgaacatatcagtcaacaacaataattactatattgcaatctcttgtaggctgcttgcactactagagtacggattttatttttcaaaacaaaacaactactagcgcgcaaagatcaattttacttgtgtggattattttggcccatgttcgcacaaactagtcaagttattgtaccaacatgagcaatttacaagttgttgtacctatttgcacccacatcacaagttcatgtaccacgagcgcaatttactctcaaaatattgtgtgctcagattagtaaacatgagttgtataccctatttggcccatctacaataaaatgcaggaacttgacatcatgcgtactgagtgatgagctgagcaaagttcagtcacaaaacagtattgtttctgtactttttatagactttttcttaaatgaaattgatgcctcaaagttaaagttgtgctccgttgaactttcaagttctatttctttctaggaaatccagtaaactgatccttttgacggtagcactagtactacttttgtgggataactgctcactttcacttcctttttttttttttttgcatgtttcagtttctaaagtgtcaaccaagtccaattactggttatgacgtatagatatttggtagtaaggctttaataacacgcaactaataagactatatttcttcatccctgcatgcaaatggtgtgcctaatgtttgattcttagcagactggacttaatttcacaccatcctaattgacacacccattaatgaccgtcagtaggtgcctttcaagaaacataaggatgatgtttgaagccatatggtgtaaataggtagtttggcataaatatttcgcgtgccagttcatccacctaaaaattcctgaatctgcccctcttatgtgatgtttctgcatgggtaacacttcatgctaccttttgcctcatttgtcaatactacatctgttttcttacaaccatcttctgcacttataggtggtagattgccgtatatgtggtgacccaaattcagtgctgcgttttgcctttatcgagtttgccgatgatggtaattcaacgcaaaattcatctcgcatgctcatttgttgcaagaagcaatcctgaatgaagttccctttttcctgcagttggtgcaagagcagctttaacacttggtggaaccgtgcttggttattaccctgtgagagttctgccatctaagaccgcgattttgccggtgaaccctaaatttttacctcgagtaagtaaacagattcgggtattttgatattatactaattgatttactctgtagtgtaataattattgtactagttgatttccgagatctgtagtgtaataattaattggcataatttcgtttctctctcgcagacagaggacgagaaagaaatggtgtcaaggactgtgtattgtactaacatcgataagaatgtaagctgatctctctatcatttctgttatgcttataattgcacgtatgtattaaaccacatctaaaagtttggcctacaagatttagttcaattccctttgaatgaatgaactagctgaaggctcacaatatgtcattgttgtccaaatcacttcctaagtaacctgacatgctacaagcacttggcaactgaatgaatgtgataccagtgcattaagaaaatatcatatgtcagaaatacatattgttttgtttgcactgagaaatagtaattgtaaaccttttctgcagtcatttatgagctcatctttctttgaaaatgcaaattcttgatccatgattnnnnnnnnnnnnnnnnnnnnnnnnnnnnnnnnnnnnnnnnnnnnnnnnnnnnnnnnn

SEQ ID NO: 47146 - DNA, 14144 bp, Oryza sativa
  unsure (1)..(14144): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatagattgactgcatcgacaatatagcaataggaaagggtcttaagcccttatggcatacttatatattatgagagtggttcttaattatagtagtcctttggatgagctaccgtatgcctaaggactaaccaccaggggtggataacgagctagcttggctcgttaagtctcggttcatttgagttcgttatctttaacgagttagcttgtcttggttcggttcgttaaggttaacgagctaaaagcctagccctgctcggaagctagcttgttaatcatcaggcttgtttaagtatttatatcatctttataatttttaatatactactttaccaactaatcgattcattaaacataaatagtttggatggaattaaaggacagatcactagttaattaagaaacactaagtatgtgaacataatgttgatcttttgaactaacgagctaaacgagtagctgtgagttgactcgttaagctcctgagctaaatgcttagcttggcttgacttattaagactacgagttcgagtcgatctgagccgagctcgctacagccgattcaagccacgagatttgagctttttgtccactataactaaccataaggaatacattaaggttatctctctctcccctttgccacccccctcgctttcttgtgtctttacttactgttacttttttatgtcttaataggtctcatgtctaaagtgcatctagagctcaccattatagcaacaaaaataactgaagaccattattatggggcctacccataaggacaatatccatacacattacccttagtgcccttaaattccatataggaaactaagcaatgagttcaaacctcgttttacttttcctttgaaaagcccaaccggcaaccatcttctctctctgtttcctcttatcccacttggaggattaacaaaatccccatgttaaatgatctctgaagaatatatgcataaggagagattatgtgtcgcgagtttcttactagtgataacttgcgactttgtgataacaacgaacctgacgttggaggaaagttttgaattcaacgaattatatcatgtttgtttatggctttatttgagaatcaagatagcttatacggtcgagtacggtactagttgactttagcaaaccgccaaacgtcgtaggtatggtgagcagaatgtcaacgaagcttgcttccgtaggttacatggaagttaaaagggagctaattaattaatcttcaccgccaaacgaaaaaaaagatctaattaattttgttgttattggagaaaaaagaactataatttcacgcaatgtcaaatctgtatgccaatggaccacatttcagatgataaacaacagttaaactaaatgtctgcctgtttcaagcagaaaaaactgcatgaccccatagaactaattcatgccatttgctcttggatcgattcatgatccattttgtagaaatcagaggacgcgcaaagaagactgcagtcggagtgacgctgctaagaagttgtaacaagactctgttagaatctactgtctttcgttaatgaaatgggagagggctagctccctctctttctaaaaagaaaatcttggaaattctataacatattttactggaatctttaatttctcagtgttctttaattacaaagctgtaccaaagtatacttgccaatctagattaaggttcaaatcaagaaatgacatgcaagtggccccatcgtatatgaactaatactaaccatgatatatactcctatatgtgatgtgatgatgatggagatctagttagctagcacagagctagctacaccggtggcagcgcctccgtcggcgacgactcatctgccgccggcgcaggtcggccgccgccgtcccccggcggcggctcgacctccgtccggcagagcgggcacgtggcgtgcgaggccagccacatgtcgatgcactccacgtggtacaggtgcttgcacgccggcagccgccgcaccgcctcgccgccctgcaccgcgccgaggcacaccgagcactcgccgccgccgccgtgcctcgccgaccccgcgtacgcgaactccgggatcttggccgccacgtcagcgacgccacgcagtacgtcgtcctctcgcccgccggcgccgccggcgccctcggcggctacgactggcgcacgcctccggacgtggcggttgcagtagaagacgacgacggcgacgagcgcgacgcccgtgaggccgacgcaggtgtagctgaagatggccgtccctttgccaacggactggttctcctgcggcaccggcggcggcatactcatcgtcgtcgagccggaacgcgaacccatggcgatggcgatggcgatggcaatggcggtgatttgagctttgtccgtggaggaatgagccgcggcatcgggtgatcggggagagataaggactgtggtgttgactaagtggagaacattattttttaaccagcgttgagaattgagattgcacaggtgtgtttgcagtgaacttcctccgttaaaaaaaaaaaaacctgagtttccatgtccaatgtatgactgtccgtcttatatgaattttttataattaatattttcattgttgttagatgataaaacataattaatattttatgcgtgacttatctttttaatttttttcataattttttcaaataagacggacggttaaacgttggatacggaaacccagtgtttgtcttttttaggacggagggagtacctctcctgaatgctgatcagattcagagaatcagagtggtatattatcttcgccccaaaacacttgtcattttgagttttttttaacgtttgactattcatcttatttaaaaggtaatagaattattatttattttgtttgtcaaaatacttttaagtatgacttatcattttctatatttacactaactttttaaataaaaacgaacggttaaacattaaaaaaacaaaacaacatctaatttggaatacagggagtacttatcacggacgagaagcgcttaattactagcgcgaaagtgacgcgttattaataaacttgttttgcaagtaactaatagttctccggtcaaaatagaaataacatattactttgactctatgaaatggttagttagggagggaggactatagcaaaatacacatattactaccgagattgctaatgggtgattgatcgcccctagtgatcagctcgtgccctctcccctccatccacctggtttttttttttggcaccgtattacttttctaatttagtaaatttatgcacagtttgtacacctcaagtttacatatctaaagtttagggacccaaagtttataagtcaaatttatatatccgattcaaatttaaatttgaattcaaatattttttatatatagtattttctatacatctaaagtttatacacctaaagtttatagacacaaagtttataagtcaaaagtttacatacccgttcaaatttgaatttgaattcaaatattagtttatagaccaaaagtttataagtcaaaagtttacatacccgttcaaatttgaatttgaattcaaatattagtttatagacccaaagtttataagtcaaaagtttacatatccgtttcaaatttgaatttgaattcaaatattttttatatatagtatttctatacataattttttccaactttgtttttttatttttttaaatttttatggtgtactatagtaggaagagaagaatgggaggaggaagggggagagaagggagcgtatagggaggggcggacgatcacccgcccattagccttaccctattactaccaacaatatgtgtaccgtgattcatttattgatggttgtttgaccattcatcttattattttaaaacagtgtaattattatttattttgttatgacttataccattaaaggtatttgaaccatgacttatatttctgatatttacaataaattttcatgacttatattttttatatttacacaatttttaattaggacaacacataaaagaaaaactacatgtactactagtagtaaggtaaataagggaatacaaataaataatggtaggaattatttttcttatattctcctatctccatgccttattaagacactctttggtattttctttctattttaggagctacagagataattctaaaaatacaaagattattttagcaattattctaaatacataagcaaatccttccgttggagttgggttgatttcagcctactttcttccccgtccaccgttgagagagaaggaaattggcaaaaatcagtagactgtacactgctacggaaatttatctagacgagactccctttagttagtttgccgatggaccataactacttccacctacaaaatttgatctctagagcacgttttaaggaccgcatacgaaaatcaattttcgcagacgccccccttaacatgcccgcatgcaagacctcttaagaagccacatacaaaaataccccactctttttactcccgttccctctctctcccactaaggcctcgtttagttcccaaattttttttcctaaaaacatcacattgaatctttggacacatgcatggagtattaaatatagattaaaaaaactaattgcacagttagggaggaaatcgtgagacgaatcttctgagcctaattagtccattattagccataagtgctacagtaacccacatgtgctaatgacggattaattaggctcaaaagattcgtcttgcggtttccaggcgagttatgaaattagttttctcatttgtgtctgaaaaccccttccgacttccggtcaaacatccgatgtgatacccaaaaattttcttttcacgaattaaacaggccttaagtctctccactccacttctatgttttttctctcccgtccaccactcctgtcccttctctctctccctttggactccctcgccttcccccccaccccctcctctcctgtctcctcccacttcctctcctctcgacgaggcagcaacgggctcaggctttggcggcggcggtcttgagctcgagcttgggcgtcagtagtgggcaaggatgagagcggcaggctcagggggaggaatcccactaccggcggcgacgggaagggcagaacctgtgcccctccccctcttgcacggatcccgcagcctctctgcccccacgagcgcagatctgccgcggggcgatgacgatgatggtggcggcggcgatggcttctggtttctagggttagagttccgaggctaggtttctattttcagaatttttttttgcgatttttcattttcgtagtcggacggcttaagcgcccacatgagaaaatcagattttcacgtggggttgctctattcccatgcaaaaatatgatttttgcagacacctggtgcatgtggataacacactctcgtgcgaatatcgattttgaccgcatggaaaaaaatgattctgtagtggtggtagacacacataggccgaccagttgtaattttgtctttttttagcaaaatacatcgtattatctaaaagaaaaccatcaatagatgtgtagacttcatgaaaggtttgtacaacagtttcactatatcacaaaccgtagctcgaagttgttaaaaacatttcacattttgagtaaatgatgtaaaaccgtactcgattttcttacaaaaccatatatatactagtactgtctatattggtggcttcacattaaaaaaagtcaaattgtttttataatgtgaactcctaatagagactcgcacaagtacttagaaaaacggaacaaatgatatgagcttaccaagttcctttaaactagcttattaagtcgcgttttcgtgcgactatatataacctatctcgctgttaaatatgtttacatgttatttatggttgtggatttatcttgatttatccttatgtgtgaataagtgtttgtagagcattaacgggattaataatattcatccaaaaagggagtaacaatattatcatatatcaaatatttaccgtaggtacatacaaaattagtatttgaacaataggcttgtagtttgaaacagctaacacatattttgacggaataaaatgatgagtgtaagaatcaaggttagggtttttattggtcttatctgctggtatttctccttcctatctttgcatctataaccgtcttctcttctatgtttcttgagttgtgtccttcccttatatatatcctcctttatatctccgcttatggtacatatatttttgtaaattcatttttgtttgagatgctaaataggtgttcaaagaggaattttagttataaataaatagatatatcttctaataagtaaatcttaccacgaaccaaaatcagagaattttgcttactgtctcatgaaatttcctaaattatgtgcccgcctgccaagaaatggaatgatctagtataagataattacgtagccgcttgccatgctctagtattcattgtaggtttcgaaaaaaggtgccaagcaaaatcacatatgtaaagtgcaatacacaatggagtaaattcaaaatttataaggtccttgatgtaaaaaggtgagtaataatatgggagcatttgctaaagtacttttaattttcaggggagcataggataaaatatactaaagatgaaaatgaaagaaaagttccaagagtcagatgtcacgaacaggtggcattaggacttgagagctagctgtgagctgcacaaccctctttctatctctctccctctctcattttctccgtttgccttgttaccgacgaggtttctctagttctctctgactctctctcattctctagctgctggtctccaatggacgagctaggcccgacggaaggtggacatggaagccaagaagacttcactcatctttcccttgttgtgctcccacagtccctctacgtctcatcgcttcctctcctgttaattgctgtcgtgagccgacaatgtcaatgatgcagcagtgagttagcgacgttgcaggtgaccacttgagcactggcggagcggctggatggtggcggcgatgatagcacaacagtggggactggtcctctctctctctctctctttttttttttgattttactaaacttttccagattcttctttgccccaagattattttcagaccatttatcttatcctatggctatgatatatactttctccctatattatcgttgtttgaatcagacggtcctatattatcgttgtttgaatcagacggtcattattttgttgcttgcgtggctcatcctcgtttcatattgagatttacccgttcatttgtttagttttggtccctatgccctttttccatagaaaaccaagcaatgagctagctcaaacattacttttatttcccttttaaaagccaaatacttctccctttggttctcttttcactcttagcttggagcatcaataaaattcctatgttaattgatcaatagagaagatatctctatctctactacttcaaaaatccatagtggtggtcttgattcctaacagagcagacgcatctgatagacacacgtaatctcaaccatccgaatgccatatccaacagcgtcaatctcctcccccatcacgcgatcgctcatctcctctctcggattgatctcctccccacgccgctgcgtcgcctcctcgccccgccgccgcgtcgcctcctcgccccgccgccgcgtcgcctcctccacgcccgtcggcctcctctccagacccgcgatcgccgccgccctctccaatctcctccgcgcctccacctcgcatcggattgatcctacaccttcgccctcctccctgtgtcgcctcctcacctcgtagccgcatcgcctcatcagcagccacggctgccggcctcctctccagacgctccctcgccgccgccctcgcaaatctcctctgccactacatgataattgagctattgccaccaaattattacaacaaaaaataatacgtagcaatatattatactattacaatgataatttttctgtggcaaataattattttttattgcaacgatctacaatcgttgttttatttagtacttttgttgcaatataaaatgagatatcgccataaaaaatcgtactgttgtaaaaaacatgttctatcgccacaattttaatttttgtggcaatttatatagtacatggtacttttcactattttttgttgccacgatcaacaaattcattgcaataaaaaaattgtcgtctcataatttaacttaattttttcatatggacacggattgagacaaattttatatggaaattatagctctcgacgagatctacaattttgtaggtgataactttttcatttgaaatcttttagatattcaaatctatgattcaaatcttagttagctaggctcaaatggaacgatatgcattttccaacagaattgatgcgtaggtgagttggtaaaggagagcacgcgtgaaggataggtcttaggttcgaatcctagccaagacacaaaatcaaaaaaataagtagataaatagataggatgatagattaatatttgaacttttaatttggtacgtaacactaatgccacatatggagtggtggcaataatttttattacaacgatgtaaagtgttgcaatatgactttttgccacatccattccgtggcaacatctaaatttattaccacaaaataaaaatcattgcaataacctattaccacgctgtctattaacacggctagcaacgattttacaattgtggtaacatgtatgtattgccacaatttaagtattgatgccacgatttttttcgtggcaacaaatgatttttctagtagtgtgcgcgctctcatccctcccttaaccatcaccggccgctctcatctctcgccaggtcgtccaccagcccgcggcgatctctcccgccggcgtcactatcgacgccttcctcgccgatctcctccgcgccctcgccgcccccgatctccgcctgggtgcccgcctccacgcctcccccaatccgcgcctccagatcaccgttgcccggagtctcatctagccgtctgcaatgggcaggcacgatggatcagtgtttggttctttttatggggtatcatcctgcatgtgcagaaaagtaaaggtgaaacacatcaatcctaactgctttttcagtttttagctctccttcgtggatttagtgttctgatagatggaagtgctgtttcagtttttagctctgtatttcatgggtttagggttctaatgagtggaattcctcccgttgccacagaacaagcgagcctagatgatggagaaggagaaccggtttggacaggatcaatccaattactaatgggcgtgcaactactactgcgacagcacagggaagtgtatgcatatgtttaggttttcagattaaaattttgattttacaaatgtttcagtacttcgactcaatgccctgcaaccaatcttgtattcaatccaatttaataatttacccaattgagtttaggatagtttaacaaatcaatcgggagttcaactatgaattgtttcgctgtttcaggtcttcagacttaactgaagtttcaatgtcgccgccagatcaccattgttttcggtgttttaggtctgactaataatttcttttgctgatcagacatggattgatgacctccacataaaaatgcatacaagtctaggctttatgtggagggctccatggatactaataactccaatgctaacatatcttctgaagaatgaggatgatggttttttgaaaggtaaggtatatttctgtctccttagctttccgagatatgctgtatggcacagcgaaaaacatctgattctttccgtcaatatttaattgacaaatatatgaatttcccctatttgttggactaatatgtgtggtgcaatatttacaactgttagataaattcccaggtaacatatgagtgtagctttcataaagctcacttcagattgtttattttcaagatagctgaacgtctgaaccgtcaacttgtctcaagtatgagtctgtagtaggtttcaaatgtgaaggttttactatagactaggaagatctaattcctattttccagtattctgctttgattgctatttgtcttccaatgcaacagaaaagtgcctcaagccacaatgtgttttgtatatatatagctacaactttgatttgagacatcggagagtcatcatagtttgatcatttaccacactttataaatgtaaaatgtaaaagagtaaagtgcacatgcggttcttaaacttgtaggggtgttttatctaagtccctaaactctaaaaatgcagatccaaatctcagaatttgtcaaagtgtgttgcttaggtcccaatttgtcatagcccctctaagatcctatgtggtgttgacgtggtatgccacaaacacggacgtgacatggcatcatcttgactgacaaatgggaccgacttaaaattcattttccttttttcttctttccttctcatttttctctctctttttttctttttttctcctttctctgtgacccgagcaccccgtgcggcggtggcctacagttgtagatagagaaaggagtataaagggaaaaaaagagaagaatgagaatgagaaggagaaggaaaagaaaaagaagaaggaaaaggaaaatttttaagtgagtcctatttatcagtcaatattatgtcacgtcacattcgcgtggcatatgccacatcagcactttatcttcaagtaagaaatggacaatattctttttttttgtctaaatacaaataataactagagtgacaatatacattttggttgttttgtagccctgtccagataatcaggaccacatgaagcgaaatggatggtttaagtcaagctaattttagatatttattattttgtgtatttgataggagcaatacatgtactttatagcaaagcttgttcctagatgatgttgtggatacatgttgattgatatttttctaatatctctttatcgtttttttagcttagctatatgttttatgtaccattgtcaaagcatattgtatcgctgtcatttggttgtttcatttgcaatattaattgtcaccgtttcagtaaaaaaaaatattaattgtcaccgtagcgttagcacgggcacactactagtatatgagatattgtgtttgcgagttttctgttctctctcttgtgatagcaacgaacgagaagaaagttttgaattcaacgaaatatcatgcatgtttgtttatggctttatgtgagaatcaaggtagcttatacggctgagtacggcactattgttttttttcttctgaaaactagtacggtactagttgactaaagaaaataaaaaaagggctaattttgttgctattggaaaaaaataaataaaattaaccacacgcaatttcaaatctgtacggcaaattaaggaccaatttttttagataataaacaacaattaaacccaggtaaaaacagaaaaaatgttgccctgaaatcctgtgatttcaaaaccaagaacgtatatattttacagcaatctttctcagtgttctttaattacaaatacaaagctgaaccaaagcacatacatgccaagctagattaaggttcaaatcaagaaatgatatgcccaaaacgtatgaattaactaatcatgatgtgatgtgatgtgatgactatggacggacctagctagctagctacagtgctacaccggtggcagcgcctccgtcggcgacgactcacccgccgccggcgcaggtcggccgccgtcgtcccccggcggcggctcgacctccgtccggcagagcgggcacgtggcgtgcgaggccagccacatgtcgatgcactccacgtggtacaggtgcttgcacgccggcagccgccgcaccatctcgccgccccgcaccgctccgaggcacaccgagcactgcgccgccccctcgccgccgctcgccgacccggtgtacgcgaactccgggatcttggccgccacgccagcgacgctgcgcacgtcgtcgtcctctcgcccgccgccgccggcgacgacgacatgcgcgcgcctccggacgtggcggttgcagtagaagacgacgacggcgacgagcgcgacgcccgtgacgaggccagcgcaggtgtagctgaagatcgccggccctttgaccaccggcggccggttctcatccggcgccactggcggcgtactcgtcgtcgtcgacgagccggaacgcgaacccatggtgtggtggcggtgatggtggcctagcttgagctggcccttaattatccggtgatcggtgagagagaaggattatggtgttgatgactaatttctagcgcggaagtgattgacgttattaatactaatagacttgtattgcaagtaactatagttctccggtcaaaatactatattactttgactcgatgaaatgagggtgtagttgccgataggactatagcgcaatacacataaattattataaatcagcctacagactccaatttcctcggggctgcctgcgagtaccgctttaaccaaatgatttggaataattaaatttaaaaatatactgttcattcaattttgtctcataaatattcgggatgaaaaaacctgtgcagaaatataccatcggtgttgcacttccgttgcacgaaaatgacgtggggatgacatcgcgcgcggacagtatcacgcggcgaaagaccatgcggtctcacgcggtaacggagtgagaccgtgcggtctcgcggaatggaagagcgagaccgaacggtctcgcagaagccatcagcgacactgtctaatgggtccatttgattagtgattaagtacctaattaataattaactaatactaattagtgattaattatcctaattagcgattaattaattattaactaatcgctaatgaggataattaaccgctaattaaatcggcaaggcatggtatcgctctttgcttaagcgatagcgttgattgcttgagcggtatcgctgtttgcttgagcgagaccgcgtggtctcgcgcaggaaccacgcaaggtcgttcggtctcgcattttcactgcgcgataccggtcgcaacgtcattttcacgtcattttcacgcaatcgttatgagaccgatggtatatttgtgcaaaagattttgcatcccgaatatttctaacaaaaaaattgaataaactgtatattttcaaatttaattctgatttggaagtcatgggcgtctctcaagtgtaaattcactgctacacaaagcgtttccccaggcgatcaatcgaatttttgcgtgcggagctttggcccgtctggaacaaatcgtctgggaaaatcacgattttcacgtgcgggtggcgcgccagcacacgaaaatcagattttcgcgtgcggtgcttatgccgcccgcacgaaaaaacaaaaaaccgaaaaaaaaattcaaaaaaaaagagaaaaccctagatcgggtcgtcgccaccgccctcgcctcgtcggcggcggcggcatcgccggtcccgcctcgtcatcatcagcgccgcctcctgccggcctcccgcgccggatccgtgatagggggagagcggccagtcgccggatctgggcagggacggccactgccaccggatccgtgcgcggacggccgcgggccgcccgtcgtcgcccgcccacgcgctcccgtcgccgcctgggaggggaggggaggagccgtggcagctcgtcgtccgcgcgctcccgtctgccggggaggggaggggagggcagccggttcccgcgccggatccggggcggggggagggcgg

SEQ ID NO: 47147 - DNA, 30489 bp, Oryza sativa
agcagatgaactgttgacatcaaccgtaccgcataacgggcaaaccttttggttttgccatccttctttttacaatctgtccgccgttcatactctattttgaataactagccaggagaaaaatcactactacactacagattttcctagacaccaaactagtttgtttccaggcggcccataagtgcaatcgtatagaaaaatgaaaaaaggggcatcaggacatcacccgcacacgaaaatagattttcctgtgcgggtgatgtcctgatgccccttttttcatttttctatacgattgcacttatgggccgcctggaaacaaactagtttggtgtctaggaaaatctgtagtgtagtagtgatttttctcctggctagttattcaaaatagagtatgaacggcggacagattgtaaaaagaaggatggcaaaaccaaaaggtttgcccgttatgcggtacggttgatgtcaacagttcatctgctagctaaatgctaaatgtagggttacaaagatagtgtggtcagagatttagagatggactagcaaggaccttcagacagccaaatagaaagattgttactcagtcaagcactggtggaaccttgtgctggaatcccccgacaaccttcgcaaacccctcaaaaccctggtgatcctagtttcctaagaaatttggtgtgagcgaatgcaagaacttttcgccacgaatgatgaggacataactagctcgaatataaccatgactaccttatctattcatcaaacaaaggtgcataagttctatattagatttacttgttatatatttgaacaaacattgccacacaataagtttaattagtgtattttcgtttgcaaagatacttacttagttgaaggaaaagagaccgagcgtaaggaatacatggatgatcaaagaagttgattgggaaccaaaccaagaccttctccaagtccactcctacctgtctatgtcacttttggtctatagaagacaagaaataaagttctacacattttgggttcggatccgggtctcctgatagcatcaacttcaaacggacctagcagctgacctagaaagaattttggggcccatgagtacttgttggaaagcttatagagtctactttcaaatggtttggtcccacgtcataattaccactgagctgtcgggaatttgcaaaacaagccacgtacctcatccagtccgaatctgattagggtctagggccttgtaattgtgtcgtgggctaagtctaaaggtgtgcaccctagggcaaccctaggacgtcctaaatcatatttattccgtagccgtcatagtttagaatcggactttgcttacattatttgtgccattacagtttcgccggtaaatcggtttgttgaactccaaattcgagtgcttaattattcatatgcaattgagttgctatctaccttgttcttgcttgtgttctttgattcgcatgtagggattagccttctcggcgaggtcaactgggcagtgtactgctgataaccagaggagatgtggtgctatgattgtagggctcggatcgtgtgtgtcaagtttccaccaaatcgacagttatcaatatctattggaagatcggaacctagtttcctcatcaacaaagcagcaacgccggcctcaatactagccaagatcaaggaagaagtggcagcatgggtgaaagcaggagccgttaggctccgggagttcgaaattttgggagatattgcctaggggcctattttcggcctcatctattttgataggccctgtacatatctttgtttgtcttttgtataattttctccttctcaattaatatacgaggcaaagcttttgctgtccctcgaaaaaactatataccgcgatattttattaaaacaactatacaattacaatttattttgttatgccgacttatttcatcattaattttatttgacccacgacttatattcttcatatttacataaatttttttattaagattaatgatcaaatgttatgttcataagtcaacagtgtcattcattttaaaatagaatgaataacaatccactgtagtattctagaggattgtatctcttaattaacttaacatactctagaggattttatctcttaattaacttaacattattaaattgtctcacaacatataatgtttcaatatttcatcaaaaacaaaatatatttttccaagttatcaatcgacccaaactgatattacgtttagaatgctttgtatttgggaacataatttccattttccaacaatctagtatccaagtcaattcctagggatttgttctcatccaaaagagttcataaataggaagcggcattttatcccttgagaatgtgtccccttgtgtactgtacttttcaaattcactatgaaaagttatagcaaaattaacaataatgtagagtagtgtgacacctacttccacaaatataaaatccaaatttgatctatagagcaacaaagacaaacatgacagtgaataatgtgtctaccactactagaaaaaagatttttcatagcgttaccctatcattttcgctggtggtcatacgcgaaaaccgctagcaaaaacgtaacgagaggtggggggctatggactgccaacgaaaacaaatctttgttggcggccgagttaagcgggccgctagtgaagatgtagctattttccttgacggcccacttaatgcaccgattttcactagcggatggtaaagagcaacgctgcgaaaaatccaccgcccaccaataattttcacgcttctccgcctctcctcccaccattctccttcctttctccatctctccatccggccgcctgccgggcctcgggagctacgacgatgaagctcgtggcgcgcggtggcttggtcgacgggcggagcttcggtgactcgcgaggcggcggatccggtggcaacgaggcgtgctgacggcggaaccgacaacggcaaggcctgcagacggcggatccgccggctaggcacgcggagggcggactcgcgagacggtgggtcttgtggggccggtggatggctcgttgccgaggaagacgagcggcagcggcgcggctcagtgacaaggaggaggggcggctcagtgacgaggactttcggtggccgggctcgatggcggcgacccacctcctcgtcgacctctgccctccttgtcgccggcgatggaggatgggcacgctggcgattttcaaattttttttttcaaaatctggattccgattttctttttttttttaatccaaaaaatattttcactagcgggtatctttatcttccgccagcgaaaatattatttgtgctagctgttgtcttagccagccaccagcgaagacgattttcgccggcggttgccttaattaagccggccgccagcgaaaatcaatcttctctagtggtttaaccgttcatagttagtacatatttttctttttttctttttttaaacgaacaaccgcttattatgtgccaatttcattgaatatagtaggaaaaaattgtacaagagtagctctatacaggtttcaaagaaaaaagagggctctaaggcactatgttacatttatcttttattttcctctcctcaatgtatggatcgaatttaaactttgaattttccagtacagtatagctagatattcactaatgtcatcaaattcttcagaattttacatagctatttacatgtatttttagaaaaaaaaaagaggacatcccctaaagacaaagcaccatatgcatgcccctctagaaaagaaagaattaatacatgttgcacattgagatcagcttaaaccggcaactgatcaggcggattcttgcccgggtcaagctcacgccggcacagcgggcacgtccggtgagcggcgagccaccggtcgatgcagtcggcgtggtacacgtgctcgcacgccggcagccgccgcaccatctccccctcccgcaccgctcccaggcacaccgcgcactcccgcccgccgcccccgctcgccgccgtcgcgccaccatcctcggagcttccaactacataagcgtaggccggggggagggcctcgacggggaacggggcaatggtaccgccgccacgcgcgcgctcggcggcggcgccggtgtcgtcgtcgtccgagcggacgcggtctctgcacaggaggcagcagtagacggagaccgccatggcgaggaggaaggtggagaagaagatggacatgaagatggccgtcgacgcgatccatccgcccggcgaagcgctggccgcaggcggcggcggcggctgctggtagccggtcggagcaaagccgttcatgcctgtgcgcgctgccaagaaatggtgttcagaggggagctcgagactggaatttgagagtccattggaattttggctgcaaaaatttaaagttatttgcaaaagatcagtgaaagactactggattttatcctattattatcaagtaaagtcagaagagggatcgatagatgtatctttcatcttccattatatatatcttaaaaataaagacaagcgaattaagctagtagagaattagagattcgtcatgtctgacctaatccgtgactacatcttttgtgtaatgtaatgtaatgtagcttggcagagagaacatgagctgatgatctcaattagcacaattcgtaaatctctaatctcttacgtccctttcgtgattcatattttcaaactgaaacttacatatatatgttgtccaaacgtttcttatatgcacaggaaaattctcatgtttgtgggtcaaacctgttaataaaatcagctagtagcttgatgcccaagaatatatgtatcgacattcgacaaacgtaatttgttttttattattaggatactaataattgacaacgggagagtaataatgcatagggatgacagtcgacaaaagacacacggccaagaatgctaggctaccaaccacatagatggtggaactgtacaagtattaataaagacattaactaaatctcatcaaaaggcaaagaggtcaactgtatttaggaccccagagaaatctaaaagaaattgaaaaccaaccgcagactattatagctttagattattttttgagaagcgcttctatgcttctcaaataaaaaccagcacgaaaactaaagcgcatcaatggcgaggattagaagtagattataacagagtgatccctattagcgagaggcaattttgtccttgcagaaaaactgagcccatatcctatctgtgggagaattcgactcaacgcgatagattagattgatcacggagcaaatacatatataggcaacatccttccctatccactcaactgacttatagcaacagaatcgagagaatagggaggagtgccgagagatggatatatatggcacaatatgcactaaacccccccctcccgcacagtcgcaacgtcgataggacgaacggtgttactggagtgaaactcggtgaagacaggcgtcggtagacccttggtgaaggtgtaagcatattggcaggaggtaggaacgtggagaacacgtatggcaccgaccgctaccttctcccggacaaagtgtagatcaatctccacatgtttagtgcgttggtgctgcacgtgattagaggagagatagacatcattgacattgtcacaatacaccaaggttgctttggggagtggcgtgtgaaggtctaggaggagttggtgaatctagcttgcttctgcaacaacatttgcaatagccccgtattctgcttcggggctggagtgggaaacggtgttttgcctcttggaagaccaagacaccaagttttcgccgaggaaggatagcatacccggatgtggacttccgtgtgttaggacatccaacccaatcaacattggagtagacaacaaggtcattgtagggagactgctagatgtgtatgccgaagtctgagagtctcgcgaacgtagcgcaatatcctcttgaggcgcagtgaggtgaggatcgcgagggttatgcatatgaaggcacacctgttggacaacataggagatgtcacggcgagtgaaagtgaggtgtgctattgaatctgacaaccacggtcctgggacaaagatccttcatagtaaagccaaagaggtcaaactcgatggagcaccaattatcaataacaaagcgacggacataaataagattcttaatgataactagggagtcaagaatatctttaagagtaaaggaacggttagggtgatgaagattagtttgaacaatagaagtgataggtatagtagagccgttgccgacaactatgtgggagggatcatgagaggtgggtgggtgggtgaaggagaggctatcggcgtccgaaatcatgtgtgcggtggcacccgtatccatatacaattcattcgtcggtggttgttgcagcatggtggtgttgaaggcactggttgggaagcctggtcccattgggagggggcccctgggaacgaactcgtgggctgaattgtcggtggagcctggactgcttggcacatgccgacgtgctgcacagggtagtgcaccggctgaaaagtccgctgcacagggaggcctagaggcggcctagtgagaatggcgcccgcaaacggcgaggtaggctgtgggccgagcaggccacgacccagaggctccagccacatttgaattatgacggcccatggattgtgcagggagggcactcttgcaccgagctggcctgggaggcaccaagtttgaaccgacatatataggtgtacatggggaagagataagaaatgattacatatatggaagaagtccacacaaatcaatcatatcctaatatgactctagttaccatatactctaacatccccccacaatccaagcatgagcatcgcggacagttggaatggagaagaaacggacaagagtgctcaacacaaatgatactagatgggtaccccacgcgttgcagcgggagaattgtgtgataatatagtagatatgagttctctttcttacctactatacgattttttttcatgtgtttatatattttgtatctttatcaattatcctaaggatataaatggtttggttgtatggtgtgccttttggggggaagagatgcaatttacactcttgatgaatcatccaaaggctaaaaacaattgaggtgatgtggcttcatgagagaagagagaattagcattaactacacttagtggggatgaactttatagatatataggattcctttgtgccgtagtcgatgtagccaaagcgatggatgcgaggggcctgtgatcgatgtagccaaagttggagagtcgatgatgtcgaggtagcctagccgtggggcgcgcatggggtgtcgtagagtggtcgtgggtgaggatgcactgaagacgatgacggtgacgcgatcgcgacagtcattgaggaagatcacaccggagatgtcacgcaggtttgccagacccggagacaactctggacaaacgcgcgcaacgatgttgccaatactgcgcaggtgttgacggtcgttatagaccaatttcgactgccaatatatctagaataaaggagaactagcaatgcttgcatgcatatttgtttaagaatagtctatttccacttgtacttcgaacattatttgtatacagtagatcttcacataaatggtggagaaaacgatggaaaataaccgaacaattaatcgaagtccaacggatggcagacttatggatggatgggcttacaaacccattaaaacagctgcaattgggcctaatcaccatgcctatggacttaggatctatcaagcaaagtctacgcaaaagagccagattggccagcccaggttcagctgaacctagggttcggccgaaccgccactgtggctgttcgtcctggccttccacgtggacgtccaagatggcctcccaatgacagttgcatgtcatttccgacaattccaaccgtcattgacagcgtatttaaggacttaactctctccattccaaagtgcaccaagaaggatcaaatccaagaagcttctagtttatttacattattttagtgctagtggagtagaaatagaatagtttctttgctcttcaagtcttctggagattttgggtatgactctagtagctcttctttcttttgtaagactttactcattaatgaaatattcttctttatgtagtttcggtctgttacttcactcatataattattcgagtaccgactttagttcatattttatctcgtaataattatgtagctagcttactggagatatgcaatggtgttggtttaatgtttatttatatgattgttctatgtcacctgcagagatgtggagcactatttagtaatgtaagcacgatgcttagattattagataccattaaatggtgttatatgtcacgggtctgtagaggtaggtcgctgatgatgacagctcagtacgggtattcctccacgtgcgtatataggactaagagaattccctattgtgggtactactccgtagtgattacaggttggatggccatgacgggttgttgtaagaaactcggcaaccaggggtcgtttctcgatacaccaggagggcatagttaggggtattggccgtatgattgtatactacgaagtgtagactaaaatgactatatactagaagtacataaatgattcttttcttattctttctccacttagcttagattatattttaatgagagtattctggttagttccttctgtgtgccaactcattctacccttaaatttattaacccttgcatagactttgatttatacaagtgatatagattattagcatagtaatctcttatcatatcttcccttgggattaaataaatactcccgggtgaaatgctacaacggtatatccgtgcgcttgcggatgtatctgtaaccgcaaagtatatcgagaatatttcggcgccattgtagggaattatatttctagtgaagtcattaagaaatatcaacacagtcataggtgctggcattgggaaaccctgactttgactctgatatagattctagagtttgcacttgttgctggtggtacagctactgcatctgttgcatccggtgttgcgttgcatctgttgcatcaacggggccattgtctgagtctgattagccatgacttggggtacagacggatttccgagaggttgaggtggaaagctcataggattgtgctaagttactccacgaaactgtctggatcctcatctacttacactgtccctgatgctgaccatctgttgttggtagaagagagagacgagatgagagagattactaaagataagaccataacccacttgactactgatctgttgtgactagacttttattgttcaagttgattaagcaaacaacctagtatagtcacatcctcaccaccgatacaaaccatacccctacacacaagcaaacaacacacgttctagcagctaccgacactactcttcagggaaggattgggttcaggttagctccgggaaaacttcacttgatccacgcggaacaacgactctggactgatcttctcgctcgttgctgcatgaatcttgaggcttgacttaactttcaggagtagatttgtaactgacggtttatcttccaagtttgataactaaaagagttggagaggaaatgaggaaaattcgataaaccgttttgcaaataaatgccgaatggtgagaagatacatttttcaaataggattttttttgagggaatcacaatggaggaggcctccacagtatagattattattaaaaagaagagttatttacaagagacaaaagaaggagaaaagaacaaaaggacaaaattacagaaggtcaatccatgattgaactagaggatgatgagtttccttgagcctaggtaaatgtaaactcaaatctagctttaaactccttttccaggaaagaaccccaagctgaattccattgaaaattaggttatttctctccttccaaatattccaagtagccaaaagcaaaagctctataaaacagggactagagatagaagcactctatgattgaatcatacgatgaaacccctgggaagtgctccaattccaacccagcacactccaacactgcatactaaagctgcaagtaaagaaaagatgttcccttgtttcccttatattctgagagcagcaggtacaatagatagttgcattatcaggaacacattgctttctatctaggagatcacttgtattaactctatccaaaaagaagagctagcgaaagacctttattttcatattaagtctacttttctagatccaaccaaacgtaactggggagtcagtgaccgaaagttaagcttataaataggattttcagaaaactagcccttagggttttaccatttgcctcaccctacagtcgagttggctctgataccattttgtcatgcccagaaatttaacccaaattttcagactgttttgtgcataaatccttgtccaagaatcaagccagggtacaaaaaaacaacaagtaaatatacagatccaaacataaataaagtgtaaatacatataaaagaggcacttagtcctcacataaaaaagaaagcagcagcagcagaaaaggcgatcctaaaggggcttaaactacacaccacaggcaaaaactcaactggggtataagcctcggtcctctaacttcgtcttcagctcaaaagcactacacttatgaaaagtgggaataaaagtaaggctgagtacaaccaccgtacttagcaagccacaccaatgatacattcgtggaaggggagacaaagggaggtttgtggctatttgcataaaggcagttgtaaacattttagttgaaaacaataaaactgtcaaataattaaggcaagattaaatctccagtgaacaacgttgcaccacgttgaacaggcccaaccaaaccgcctgaactacagcagttcattaagtcaggttactaaaggtgtgagactaatcacggcgaagctgatcgattgcccataaccgtgggcacggctattcgaatagttttactctgcccagaggtgcacaactgaaccaacaagacacatcccaccatcttgttactgtgccatgcatgacacgtgaccatgacgagtgattgtgacaagaccctttgcataactccccttagccaaacgaatcacactgcaggttttgcccctactcttaaaataggggtaggcagccccctcttgtgttgcggtgaatctgaaagccaatcaacacttaaaacctgggctgacccaactccatcacgcttaccctcgcctaggaaagtcggaaagggaagtgctatactacaggtccagaagttaccctttcttgcttggggtaagcacggtaagtcttccaggttttcccgtgaaccagtctttaattgccatgggtgcaactagcaaaaccatgcacccacatccctccataaagcaatattttagctggataattatgtccaataaaacatggctagatgtctcgagctcggagctcaaccagatactagagcaaataatgtgattatcccatcaagtgagctagtggtaattaagcatggctaagcatatgtaattctagctagttcaacaagagtaacacaagctagtcaaattatcacccaaggtttgacaaagattggatatgaaataaatatggcacaagcgagcagataggtaatcccatgtaattagcaaaacctgcaatttatttgcaaatagtaaaacattttataaattgggctcaacatgctcaaggggaatgtgtgactttccttgcttctttaaacgatcttctgaactctttcctcacggccgcgatcttccgaaacgacggattctacacgttggcacacaaaacaagagaaaactctaacaaaccaaataaacagtgcatgaaatgtaaacaaacatgtagagctaacttttagatgaattttgcaagttgaatggctcaatttggagttcgcatgaattagttatgaattttagaagttttgagccatttaaattaatttctggaattattctcaatttattgcactaataccatttatggcatcagccgaagggggagccggtgtgacatgtgggtcccacacgtgggtgactcaaggaggggcgggtgcacggtggagcgggtccacatgcgcactgttcacgggcgcaccatgtggcacacacgttgcggccacagcgaacaagcaggcggaggagaaggaggaaggggggggagggctctcactctgccctctcaacggcgagaaggcaacgggaaggcggccgacggcgaggaacagcagcagcgggctcctcaggaaggaagccggacagtgctcctgtggtggttagcgaggacgaagggcgaacgaggtcgccatcgacctgcagaaggagaagaaggggttagggaggggagaaccagcgcggagcggctagaaatgatggccgacgaaggaagcacggggtggagctcaccttgtgtgatgacgacggggtttcggcggcttctgacagcggggaaatgacagccgaggtgcggcataatgctgtggagctggtggaggaaacagcgtggcttggggtggctctggtcgacggctatcgccggttggacgtggcgaatgcggtggcggcctcggtagcatgggaaagaggatgactaggtggcgatttgaggaatttgaatggcggctgtggttgtgtttgggatggcgaagctagcggtggtggcgcagcacggcggtgacgcgcgaccggagatctccaacgagcggcatgcggagcacgggaaagagggggaacatggagaggcagcgcggggagcatttttatagaccgatgggtgacgaggaggatggggagaggccggaaaaggcgggtagagtggggctccggcgacgtgggggaatggtggccctaaccggccctgatttgcagggaaagcgagggagagaaggtgtgttgatgcgaaaaacacgaggcctagaagatctgcttaacttcagtgcatgtccaaaaatcttgcctttaggttcctgagcgtgccagttgatttgatcctgcaatcaataagaaataaagacaaaaaaatagcggttaaatctataaacgatagccgatcggccagccgccgatgacgtaacatttatctttaagccgatgtcatatttaaatcgatcggcagtcatgaataagtaagaaagaactaaatctatttgatcggctgaagatattaatagcatataatgcttctgtcgatatatacctaaatcaagtgattgggatagatcggtcaccgtgccgagacagtataaatcacttagatcaaaatatatattaacaaggagattataagcattcgtagcatagccgatcagatagatctaacatgtatcggctaataccccgataccactctttattaagatattaaagcaaggaaaatatattagacaaagcttaatatacctaaatgcgacaagatcttaacataaagggcggatttaacttgtcaatcaagcatataagatataatgtagttaaatcaggtaagatcggttgaaaccccgatactaccctaatcggcaaccaaaaagcaggctagagattgagattctaatcacgacttataaggtcaaactcaactgatgtagctataagtatgaaaagaaggacgatatctagacaatcaagccgttgggtttcatagggcggtagatatcctatataatctaagtcaacattgatatttaacctaatcgactgccttccaataatggacgttagccgattgaagattagataacaatattgtcgaagattatataagatatatgataactcgatgaattacataaacaagattagagtatcataaagatggaaacactaatcccgagaacacaagccgccataacaagttttacctctagttgaagatcgaaaccgatgcagctcaacccgaaagcaagaactcgtcgaaagtaaacgaaagtaaaagggtggcgatgcaacgagattgtattgaacgtgtgttttttgattacataggttcgggtcatatttatacccgagatacaaaatatgtccttgtcggacacgactcttatctttaacaaactctaagataccataagtctttgctgcagacttttgcccaaacttatctctaaggaaactacataaaatatcctaattaatagatacaattgccttttcaggactcaatccgtgcatggcaattcatatgaagcacattaacacaacccgacaacgcataccgagccacattgtcggaatcggctcaatcggctatctagtccgactcgaactctgccgatcctgattgtagccgatttggactttagccgattcttgctctgtttccggaactatctctatcttggattccacttcggttttatctcgatctccgatacttgaattaccaaatttggttgttaacaaggtggaggtggtggagggtaacgagtccacgcggttgggcgtgagcgttggatcgggagtccacgcggttgggcgtgagcgttggatcgggagacacgcgggagaagtgacgacgtgagcaaagtgggaggccatggcagttgctgtcccgaggtggctggaggttggggatggagttgacgggtgggactatcggagagagaagggtgaaccaagtaaggggtaggtaaagcgaactttggtgagggaaggggcgagcgggctgagtagcgagctgggccggggagagagaagaggggatggcggcccgaggtgagggagcgggccgtgcgggaaggggcaatggacttcgcgcaggcatgtaaagtaggttatgcttgagtaacatgtaaggtggaatatcaatcggatggtacctgctacgcttgaaaagtactatttctttataaattttcttcattgacattgcttagataattttttacaagatatttgtaaggtttgaactatataatatttaattcattactataagcaattaccaatgatcttctttattttctaaaataaagagtgagtccgtaaatacgtaggagacatatatattgtgcgcgtcgttttcctattatatatgtgatttatggtgttctttaaaaaaataactagccaacgtgagtcctaaatttaaagttgatagtagcatatatatatatatatatatatatatatatatatatatatatatatatatatatatatatatatatatatatatatatatatatatatatatacctttttaaccaaactaagtacttctacgtcattgctaccatagtatgtcttatatatgcaataaatatgagaaactcataataccacgatataggatagatggaaggccattaatatctaagcactcaaacatggttatggcaatagaacatacgatggttgttccaattttttattttttgcaaatgtattagattctctctaattgatttaattcaatctctattgacatttttttctacttttctattttattttatacaagtcttattttaggttaaaaatataggcattatggatcaggaattgttggtttaattatttaataggagaaaattccctgtgtacccttgaaacttcacccaatcctttctatgcccctgagatttgctcattcccttccatgcccctaaatttcagtttggatcccttctatacccattccattagttgactgttaattgaccactaaatttctaccataaagtccattttgccctttgctatcaagaaaataacaatttatgaagtatattgatgaagtgtataaatttattgtatgtgactattatatgcatgagtttattttgtgagatattatttaacaaaagtaatattttagtttcgcctcgcgaagggaaaacaaaaataatttttatccatgacaaccctttggtatcaagaaaatataaatttatgaagtatattaatggagtgtataaatttattgcatgtgactatcatatttatgagtttattttgtgagatatttttaacaaaaataatattttagtttcgccttgcgaatggaaaacaaaataatttttatctacggcaaaatttattttatttaaaacaaaaaaataatatttttttaccattaaaaactgcatattttgttagagtagtacggaattttttataagataaatcttgttatgcgagataaaaaatatttttgttaaataatatctcacaaaataaactcataaatataatagtcgtatacaataaatttatacactccattaatataattcataaatttatattttcttgataccaaagggtaaaatggactttatgatatgaatttaacggtcaactaatggtcaactgacggaaggggtatagaagggattggatgaattttcaggggtacagagggaattttctcatttaatagagcaataattagattagaaatttgatgtatatcttaaaaatatggtcttttcagtattattcatagtctggtttgatagctaaaaagtagaaagggggaggaagaatggagagcggagagcgtgagccaaggttgaaggggaccagtagtgttgtttgcatgtgccggggggatgaggtttggggaatttatttttctaattttttttataaataatttaagtaaaccgatgatcatatgttttttcttataatttgtaaggttttttgtaattttgatgactgttaaaatcatatatgaatgtcccctttaatgggtgaagccgacaatatcagtcgaggctttatttctccactgcctttaaacataggtcctgagtcgacatagtcatgccccgcaatgccagcatgaaacataattttaatgtctagttaactatcagcactctcatagagaattgcatcaataattacaaagttaagcactattgtcaatagtggcctctgctggggtggcttcaactcaaccatatgtatgacccttgctataccttgctatacttgtggtagcatagcatgcttggtgccctttaaggaaaaaaaagagggaatgtaggcgacgaaaatatttttccgatgaattttgtgtagacaaaaatttttatggtattaaccagtaatgtttaattttttattgtttagatacaatattctattttgaaaagagcaaggttgataaaaaaagatatagctaaacggatatacgaccgtgacaatcttggagtaccatatcattctttatattttgactaagatatatactggagcatttggtgtctcgtcatctcatctcgtctccgatcactctcctcgtcttcgtttgtcctggtcttcgctctcgctcgctagctcgcttgctcgctggttgagctgtggtacgctcgccatggcgtcgtcgacggggggttggaccacaggctcatgttcacgccgccgccattcaattgagctgctgtcgggaggcggcggggacatgctcgccgccggcgccagcggtgaggcgcggtcgccgtgggggttctccagaggcggagcaagggtgggcggcgggttgcccaatttcaagtccgcgcagccaccgagcctaccactctcgccgccaccggtatcgccgtcgtccgactttgccatcccgccgaggctcggccccaccgagctgctcgactccgccggggatagagagaagagagatggaagatatgacatatgggtccaagggcattttagaactttcacgcgatttctctctcctcttattttaatcggcgtggtgtccattggcaaattaccacgtttatggagtgttttcctccaaaagtgagttcagatagtgtcctaaggctaaaaccatgaaattggagtgtcctatagcaaaaattgcctttatttaattaaagaaatataaaggattataagttagatatatatttgaaaaagaatttaaaatatgaacatttaaagacagctgatttggtgctttatattaatctagtttaaccgtgcaaatttgcggagtaataaattttatttataatataggaaatcctattttaaagaccctatcgttcttacagcgtacatataggttttttttggcttttttatcttcctacataaggatatctgtttgtttttttaagagaacaatacataaggtctatatccctggccgtttttttttgacaaattggcccttttcataaacttatagcgaaactagcccgtgcaaaaaacttcaaccaaaaataggccgcggggtcaacgccaagcctcctggcactcgctggccaagctagcgccaaccgctttggcgctgaggcctgcaagcgcggcggcccatcttttcccccatgctgacgtggcggcagtctcagtgccaaccgccttggcgctgaggtggccaagctcagcgccagccccgttggcgctgaggtagcggcatatatgccgcggtcgcgccgcccctgcccgagccctgcttctttccccccacacagagctagggttcttccccccgcgtcaccctctctcctcccctctaaaaatcccctcaaatccacctcaaatcgaaggctatttagtgggcattgttttcgatattggtttgcaaagtaaatcccctctaaaaaccctaatttcccccaaagttttccctcattttcgtagagtattttggttgaaatcgtgggttgttaaatgttgctcgggttgtgttgtggattaggaaatgtgggtaaggatgcgacgttatagttgtatattgatagtacagaggattcataccatttttgtatgttatgcactattttggtaagggtgaagttgagatggatgtgtagagctgttgtattatgaatattttggggattcatattgattaatgttgatattgaagggcatagatcgtaggaacattgtaaccggtggttaatcgatagaatttttaaaaaatattttatttaggtctggagtacccatgttatgtttctatttttatagcgacgtattataatagaataatgcacatatttcatcggtaatttgatgtagatggatagattggtacgactccattttgatggcagtgtggtagatgaaagtactggtggtagccaatttgaggggatgtctgtcaggcagttagtgttttgcgccaaacccacatttgaggagttaatttcacgcacgaaggatgaattggattggagtgatgagtctgttggtatacaagggagatacgatgtaggtaccggtgcagtgtcgcataagtacatattagatttgaatggagaggtggaatgagaaacatatctggaaatagtcttgggttcacagttcaaatcgcttgaggtgtttgcttggaagaaagagcgtagggaatggaaggaagaattgtttgatctcaatgaaagtccgcacatagaatccctggtctattgtcatgaactgaagaccgatgtgcttgtggtggatcgaaagaagaattaattgaggacgatgtgcaggtaggggtggaaaaacaggttgaggaggatgtggatataggtgaggagaggcaccgggatgtggaagatggggaggtagagaagaaaatttcagatggtggtatggatgtgaatcaagcagataatgagaatattgatgaacttgagaagaggcggttgattttattcattagagaattccttgctgatgaaatttacactcgcgaggagtgtgaggaatctatgatatttaatggattaaacccgaatttgttgtatgctgatttggacaatgaagttgatgagtttgcatctgactctgatgacgatcgtccagtgggcaagatgtcagacgaggagagcactatgtttgagaaaatcattggtcgaaatccggaaataactcaattcgaggaccttagcaatggaagccttgctgttgcagatggtgatccacaatgcgatggagccttcgatgcaatgggggaggaaccgaggaagggattagaattttgatccatggatgagttgaaaatatggttgcagagctactctatccgggtgcaccgcccattccatgttaaggagtccaatgcatctgttaagtacactgtggcttgccttgatcgttactacgaatggcagattcgtgcaagaaagagcgctctagtgtggaagcaactggcaagcacttgcagctaacctcgaggtttataggtaacagattgcaggcatttgttagagcggaaccaacattgtctcctgcagctattgtagaggcagttgagcacatatggcactatcggcctacgtatggcaaagcttggcatgctaagcaagttgctatgaaggtcatatggggagattgggacgaggcataccatcgcttgcctatactactgaatgccatcaaaagtaagaacccaagcatgtatttccttgttgagtctcaaggggagaaatcaagaacggttgatggagtccataggcgtgtttttggtcgtgcttcatggatatttgggctgtcagtggaggcattcaagcattcgaggccagtgttagcaattgatgggaccttcttgatcggtaaatttagaggtgcattgctcacagcaattgggattgacgcagggttacaccttgttcctttggtgtttgccctggtagagagggagaacacgtccaattgggagtggttcattgacatagtgagacgacgtctgattggaccgaatagaaaagtgtgtataatatctgatagtcacgttggcatattgaactccatcaagaatgagattccaagccaccgacttattcaccacagatggtgcatgaggcatttttgtgctaacttttataccgcaagagctactcaggatcaaatgaaggacctcgagcgcatatgtcaaatcaacgagaaagttctattcattagcgagatcaagcgtctcatgggttttcttggggaaggtcctaagaagtggctaacggataatatggcattcaaggctaaatgggccagatcatttgataccaatggacgtcggtacagctttatgactagtaatatggccgagagtttcaacaatgtcttgagaggaattcgaaaactgcccgtgacagctattgtggcgtacacattctcaaagtgcaatagttggttcgtcgatagacataaagatgcttgtgcacaaatcaagagtagacacaagtggctagaaaaaattaatgatatccttgaggagcagaaaaagcgaactttgggacaacggaccacacaattcgattttccatccacgaagtaagaggtcaccgagcaaggtggagtcatggcagctggtgttcaatggggcggacgtcactatgtcatggttgcaagagataacacatgtacttgccaattcccttaagtccaccacatgccatgctcacacatgataaccgtttgtaggctccgaggtttgaatatagaggtgcccccacggatgtgttatgaagcttccaatgaggctatacaacacacctactccccgaggtttgagccctaccaagatccgtctcagtggccaagttatgacggtgaattattcgttcccgacttgtcgttgaagaacgacactcgaggaagacgaaggacaaagagattcaaaaatgacatgggtaaagggtataaaggtgcaggcaaacgacgactagtgaagccaaacaatacaaattccgagccatccaatcaaaatagatgttctatatgccaccaaccagaacataagaaaacccgtgtccgaatcgagacaaaccaaaggatagaccgaagaaacgccgtaggacggggggaggtgatgggtctagaacacgggttgttttttgttgtacatgttcacatgttttaatataaatatttattacaattgtttctttcatatgttttctcaattatgcatattacaattgtaccatttactaatgacttaatgtttaattgcaggatggcgcagtttccgggtctggaggattactacgaggagaggcaccgggctcccaagatagcgagcagagaggttatgcaatacccttttatttgtatgacaatttgtttctattctgcaataatttactaacacttgcattttttttagtctattgatgcaacgcctcaagacccttcgagtcagaggcaacacagcgcacatgtcgttcgacgaccgatacattccgtacctacgtcgggcgaagctgttggcgttcatcaccatggcgcagtggcccatgcctctgtacaacgccgcggcactgacggctcttgtggaccgatggcgcccagagactcacaccttccacctgccaagcggagagctgacggtgacactcgaggatgttgccatgatcctggctcttccaatgcggggccaggcaatagccggtgacaccgcttccggtaactggagggcacgggtggttcagtaccttggtgttgagcctcctgaggctcctgacgggcagaggttgacgaagacctccggagttcctcgtagttggctgcgtgccaacttctcacagtgccctcctaacgctgaccaggcgacggttcagcggtactgcagggcatatgtgttgtacatattcggcagtgtccttttccctgactctggaggagacatggcttcttggatgtggctgccattgctagctgattgggatgaggcgggtacctacagttggggttctggagctcttgagtggttgtataggcagttgtgtgatgcttgccgaaggtctagtgcagatgccaacttggcaggatgtgtttggctgctacaggtaggaggcagtttgtatgatgtgtttcatttgttactctcaagctataaatcctaacgagctacatcttgcaggtttggatgtggatttgcttaccggttggtcgtcctacatggaggcaacatccggcatggccattcgaggatgaggatcgacgccccacagttgctttcctttgggaagtgacaccgtcgcctgtagtaggccctagaaacttggcctattacaactacaccaatgagatggattacctccagcccgagcatgtgagtagtcaattataatatcatcaaccatttgggatttgatagctgtactaactcaaaatttgtttcacaacataggtggaatggatgccctacgagtcacaggagatagctgaacttggaattaatgccatgtgcaacatagagtggaagatgaatacactacggtgccctctcatatgcttctacgcagttgagtactagctttgccaccgggtgatgaggcgttcgggaggcggcaaacgatcccgcaaagattctctacaagcatcaatatccataagtaagtcaatttgcatccgaccatttccattaaaccactgtccattaatttatataactgtattgcgtgtagggtggacaaaaggaaaaacaagaagaccaccggttggattgcttatcatcatacacacattgatcgatgggaccagtttgaagccaaccgcgtggcggatagcgcaatgcacaacaggcaagagttcgacgcatacttagcctagcttgtgaggaactaccgcctcgccctacgtccggcttggacgctagtcgacatagcggacgacccgactaaggtggaggagcagaacgagtacgatacaagtactcgtagaggtagcacgttcgagacgggtccggttcgagaaagagtggtgagtatgggttctttttacttgttttccaatttccgtactttgtgtttataacttctcctacaggcacgagagctagtcagggcagtgaacgatgcgggcgtggcatttggcacgccccctggctcgcaacaagagagcagcgttctttggaatgccttataggtagatttgtaaaattcatgcaccatacacataattggaactaactccttccttctgttggtactagactctacgacagcgttgcaggaagttggcggcacggctgggatgcagggtcgacaatgtcgtcgaaccacctcgacgggccgagcaggggacaagtcgaggagtggctcaagagggtgaacaagaggaagagggagaggaagagggagaggaggagggagaggaggaggaagagcaagtggagctcggtccctcccagctgcaggacgctccatagtcatcacaggggccatctcgaccacagcgcaagagagctcctgtttccgactagaggtacactcccgatcagcctcgcgctccaaggggtaggaagaagtaggttttatttggttgggtttagttcggtaacttgtgtactttatgaaacccacaactatattgcgacttgaaatcttatattttgatgaacccacaactatggttgtgtttaggcttaagtctgtggatggatgtggttgtgatggaactggatgtgtatggatttttgatgtttggatggttatgtttatggatggatggatgtatatgtctgtgaatggatggatgtatttgtgttgatggatgtatatgtgtgtgaatggatggatgtatatgtgtgaaaatctttattggcacatctatattatgctgtgcatatagttaacctgagatggacacattctcctgatggcaaataagtgtcacacggttaaaatggctattttttccagctgatgtattcaccatgtgaccttgatcaaggtgacacaccttttctaatctgtattccttctcttttttcagcttttcctgtcccatgaatcaattgtgatgcaaccatagtaaagtttcaagggtgatcatgtgcttatgttactagtgatgagctgctgtttattgctttgaaaatcatattgttcatggccatttgtattttatatacatgactgactgttatgttagtgttatacaggttcaggctgttctattggtttagtaagcatggctgtacctctattggtttagtaagcatggctgtacctaccacattcgatgaaaaggtatccatgttctgtagaatctctacacaaaggttgtttgaatgcatatgcacttttaaatggcattcctgtcttgtatatgtgtgtgatgtttgtgaatggatgtatatgctgcgacagtggcagtggctgtatgccagcggctgatgaaacacctcagcgctgaggttaaatacatcagcgccattacagctggcgctgagatcccctccgggccacacagagtagctgcttcggcgagcccggctcgggtggctaagtgccgaagctggcgctgagatccccgacccggccgcacagaggggatgcttgggtgagcacggcatgggcggctatctcaacgccagggcactaagcgctgaaattgaatgtctcagcgctattatagctggcgttgagatccccgacccgaccgcacagaggggatgcttgggcgagcccggcacaggcggctatctcagcgccagtgtacttggcgctgaaatccccgacctggccgcacagagcgattgcttgggcgagcctggcgcgggcggctaaaggccgaagctcagcacaaaaggaaatggcgctgaggttggccatcttagcgccaatgtaggtggcgctgagatccatgccacgtaggcgtgggggaaaagctgggccgccacactggcaaggctcagcgccatggtatttggcgctgttctggccaagctcagcgccagtgtaacatcccagcctagggcttaataggattaatagaatactcatatcaacaagttgcaacttcttttccggaagccgatttccaaagaactcaagggttaagcgtgcttggcctggagcaatttaggatgtgtgaccgaccaggaaattcttcccgggtgcgcacgagtgaagacaaagtgtgcagaattcttcccgggtgcgcacgagtgaggacaaagtgtgcaggaaagacatgtgttggtctgtgagggcagtctatgacctataaaagctatcagatgtaagcgggcccggcctgggggaaggcggtttcacgggcgcgtgggtcgcagttgcgcaggcatggtgcgcatggctggtgtggatccgaagtggtcacacagcatggcacatgcgctggcactggacacacggacgtggccaagaggggacgttcctggcctagggttgatcgacgggggcgtcgatctctcttaagggggtgaggatgtaacatcccagcctagggcttaataggattaatagaatactcatatcaacaagttgcaacttcttttccggaagccgatttccaaagaactccagggttaagtgtgattggcctagagcaatttgggatgggtgaccgaccgggaaattcttcccgggtgcgcacgagtgatgacaaagtgtgcagcaaagacatgtgttggtctgtgagggcagtctatgacctataaaagctatcagatgtaagcgggcccggcctgggggaaggcgggacgttacagccaggatacttggcgctgagtccgcagtctatttttggttgaagttttttgaacgggctagtttcgcaagatgtttttgaaaagggacaatttgtcaaaaaaaaaagggtatccccagtatgtacgttaatttttctagtaaataatttctatgaagctgagacttttttaaatagatctaatctaatggtccaaaatagcaggcccaccaatttaagtgaaaatcgacagttagattaaaaagtgccatgtggcagtttaggagcgtttgtaggagtaccacgtggtggcttaggagcgtttataggaagtttcatggacgacttttagtagataacagatttaattaattgactaaatgaactttgtgatattaaaattatttcttgagctccaaaaattcacatgaaattttagagagtattttatagcacggaaaatattataaaaatatttctagccatgattttttaaaggaaatttttaattttctgataaattgacttgattaaattgctttgacttttaatataaatttaggaatacattactaagagatttttaatcccgactgaaaattggtcgtgacgaccatccgcctccttcgcaaccacctcaaacaacccgaaaggccgaaacatctcctccctccccttcaaaacgcagcgtacctatcctcctccaccgccacctctgtcgatcatgcccgtagcacgagatggtggatctgaagccagctaaggggcggtggtggcggcagcactgcagtagaagggagatggcgtcagcgcggtccccggaagggggtgatgggggagggggggtgcaaggtgtgatgcgggcggctacggaaaaggcgaatcctggagcaggaggtggcgaggtgctcttccaccatgactacgatgacgacctaagacagcaaaaatgacagcgatgttggctaaccgatgattcggctcctctcacacgagcacacaagcgagaatgaaaaacataaacacactggactagagaattttttttgctgcacacctgcacaccacagcactcacaagcgcactgctattaatcacaccacaaaacacaagctaatacactgcttaaatagcacacattaagccatgttctggccgcactacccagccaaacactgcatggtttatccactaatcacttccctacatgcaggccacatctccttgcatatagaacaccacactcacacgttcagttgcaggtatctaatccgccgatgcatgcgtccatgcaaaacagactatgacctcttcctgctcctaaactgtagacccccgtttttataacaggaatcaatcgtgtaaatagtaccatttccctggatcaagtagtctggtacacacgagttcatagctgtaataccaaatgctcatacacgagagtctagtgcgaattattacaacataagcccgcaggcattgtcttaaatcatcggaccgagcggtccggaatacatccaaaagcagaaatagataaggtagcggaattaaggcagcggcatgccatcgccacaggcaacgaccgtactaagacctattgagcgccatcgtcttcatctccctcctggtagtaggcatagggatcctctaaagcttcatctcccgcttctgattaattttatattcgcaagggtgagtaccaaccgtactcagcaagccaccacagcaacaatacatatgaaaggggtatttcaaaggatggctagggttcttttgcgcaaagcaagttttgtaattcttttcacaagcctaagacctagcattgactgatcaaattttagtaccagtgtttgtatttaaacaacgacggttctgtccaccatccattgtgatcccaaggatagcttcccgccattgaatcgttatggttttctgaggacgcccaccttccctcttcttaggaagtggctacatcagcataaaaaaaattcatcatgcaacaacccatcccacacaagttaataatttagagactagccaagtgtaatacatgtcccggtgctcaataaccgcgagtacggctattcgaatagatttggtttactcacactgcagtggatgtacactttacccacaccccgcgactgcccaacacatgagccttgtctcaacacatgagacgcgtcacggcaaagcttttcgataacctcgcattggcagtacccgctccatgaacttttcatcctcatgcactctaggcgtacacagtttctagcagtgagaggagttctggcgtacccgggaagggaagattcacacccatgtatttaagttataactaggttcaactcaacactcgacagtcctagcaatggcgacaccattgtagagcccctgccttacacatgagaaaccactatgcatggatactgcctccgcttggctatttactccgctaggtctatccccattcgagaaatgtggttgtacggtgtcgtttcatgcttaacttcatggcttggtctttaattgaccagggacggtactagcctttcccggataccacccaaatccaccgtccgccccggtctaaaacaaaggtttttaattcctttcatgtcatcattatcatggcaatgtggtgctcatatctccacatgccgcatcttaattaccttcacaaaggtaattgcccaagcatataatatttgataaacatgagtatgcaagattctaaagtagcatttctaagcaagtgtcatagttgactagggactcatacgtaatcaaggttacaaagatttaagggtaaacaataatcaaggcatggcataatcacaagtaggatgttcatcattgcatgcaatcttatttgtaaataaaaattgatttcgcaattgggatcaacgtgatcaaagaatagtgatgacttgccttgctcgaggtcttgcgggtcttggccttcacccggatccacggctccctcggtccctatagttacgtgcgtaagaacaatttgaattcgattagaattcaaacaaaatccaaataatgaccgaattgaaaaacgagcgcgggaggtgaattctatataggctactttattcgcgaagtggaattattcttctccctaagatatcttgtaatttatagtcatgtcctaagacacatcgaattattgagttcttaatcacatgtaaattattaccgcgaaattgattccctatggagattactaaaaataatctataacaatccataaggattcatctaattgtttagttcttaaataattaattctataatcaaattctagtactttaggtatttaaatagtaggaattcatctagctatattttcattaatcctataattaaattctaatatttttaaatattttaaatctccccctaatttttccctttttcttttctctctctctcttttcttttctcttcctattttcttttctctctcttttcctttctttttcttttctctctcttttcctttctcctcccggctcctcccttcctctccctctcttggcttcttgctctcccggcggagtcggcgatgaacgcaagggggggggcggggcggcggcttccgatggcggctacggcgacggcggcgacggtggctcgaagcggcagcgtggcgacctaatgcggcggcgcggcgacctaatgcggcggcgcggcggcgtggaggtggtggcgcggcgacggcggcacgtggggaaagcgaagggggaggggaagatgggggatgtgtgtgtggggaggcttggggatagagggaggggcttatatagggcgcgggaggggggcggcggcctcatggcgtcagcagggtggcgcggcgcggggctcggcgcggcgat

SEQ ID NO: 47148 - DNA, 5305 bp, Oryza sativa
cggcgcggcagcggcgacacgacggcggcgcggggcttgaggcggccgggcgtgcgcggcaaaggggggggttagggctagggaacctcgttgaacacctagagtgcaatgaacagtgctagcctaatttaacctattctttataaatctaaatcttgtcctttaattcctaattttccacaaatgacgtttacatatacttgtgttcattctaatcgaaaaattcactctagattgatagcacccatattttatttttatataattttcttgaatttaattagagttatttcttattccgtcacttttaaatttaattaatacaaatatagtcgtaataatattttactcatttctatcctcactaattcttattttaaattgcactttaattatttactttgtcaatttacttcttagggcttatacctaactaattatccattattcacgatttataaattccaaaatcaaaatccaataaaacaatcgaacaaaatcggcatgatgcaatttgtttaaaaagtttttgaaggcccatatttttggagtttagatttttattggtcgaattttcagggtgttacgtaaacttgcgccatgactcgatcgaccaaacacttggccacacacacatgcaaaactaattctaacacacacgtacatacacatcatgccaccactcttggccaccaccacgcagcatgatgagaacgtataccactaactacagtttaacagttatacaacaagattaatttctaacaatcaccccctaatcttgttggctttatttgtgaacacctgtcaccggcttcaaagtaatgttggctcatcatcagcatctgcaattgcaagctgcgccactgccttagtcatcttccgaggctcgtcacactcatcagcgaagtgtccaaacttgccacacctgcagcactcaatcttcgacttgtcgaacttgctgcgaaacttcttcgtgacactgccagaggcctcgtagctcttcttctcttcagcaacaatggcctcccactcagcgcgtgtgagccgttgctcagcccctgcaataagcagctgctcctcccctgcgttttcacgacgtcgccccttggaggacacctcgaacgcccgcaaacatccaattgtctccgtcaccgtcatctccgacacatcccccactgctcgatggtgcttatgagggattggaacttgtcgggaacggaatgcaagagcctctccacgacggtggtctcctccactttcgtgccgagagaacgaatctcattcatgatcgtggtaaccttcaaagcaaaatcattaattttctcactatcaccctcacccatgtacataccatcaagcactctcttgagagtttgtactcgggccttcttgacacgctcttcacccatgttcatctgcttgagggcatcccacgcctccctcgccatttccttctcggatatgaccatcaccatggcctccggcacagcttggacaatggtggcgagagccatttgatccatcttctctcatcggctgcgttgccctccacggcagtccacacaccttgtgcgcacatgaaaattttcattttcaccgcccaaacgctgtagttgttctccccgagcatcgggtagcgtaacgtcacccccgcctcattcacttgctgcacgacgagctcatggccgcctaggctgccatccccgccgttgccgccgctgctgcgacggatcggcggcggcgtgtacacaccatctccagacatggcacctgagctctgataccactgttggctaaccgatgattcggctcctcttacacaagcacacacgctagaatgaaaaacacaaacacactggactaaagaatttttttgtgctgcacaccagcacaccacagcactcacaagcgcactgctattaatcacaccacaaaacacaagctaatacattgcctaaatagcacacattaagccatgttctggccgcactacccagccaaacattgcatggcttatccactaatcacttccctacatatgcatgccacatctccttgcatatagaacaccacactcacacgttcagttgcaggtatctaatccgccgatgcatgcatccatgcaaaacagactatgacttcttcctgctcctaaacttgcgcaatgactcgatcgaccaaacacctggccacacacacatgcaaaactaattctaacacacacgtacatacacatcatgccaccactcttggccaccaccacgcaccacgatgagaccactaactacagtttaacacataaacaacaagattaatttctaacaagcgagggctgtaacagtgacgacaatggcaacgaccatggtgggtagggctcacccttactggtctcagcggcgatggttccggcgaagtcatgctcgggatccggtgaccgcgacaaccaccaccactacgacacacacccgttgaggtgaagatgacctggtgactgctagctccttgactcccgctactttgcctcatgcagatttggagacgagaggcggacctggtgaccacgacgatgatgatttgtgaatgtgaatactctgtgaatttgtgaatgtcaatgctatgcattttctggcctggattggactttcgtgggtcctattgagattagcaggcggcgctaggcgaggagcggtgttggctatgattttttttagcaccgaaaaggattttcgcaggtgcccggacggctgcgatattttttagcgttggaaaagatttttgtaggccaatgacttaagaggttgtctgcgaaaaaacatgaaatttacagtcctttaatgccaggaggaatgccgtcagcatgtgtatatcaattttggccacctgggaaaatatttgtagtagtgatattataagatattttatcctctccatcccatatgtagattcaataagacaaattttactacaggacatcgtgacttcgcggttttagatataggacaccgcacgaagtgacttttaggggaagacactcccaaaagtgatatttgctggtggacacggtatgcattaaagtaataatttctggtttaagaggagagataaatcacatgaaatgtcagaaatgctcttgggctcacatatcagttcttctctctatcccacatgctagcgatgacggtgggcaggtgaggtccggtggcagcggcggcggcgggagggcgaggttagagcggacgcgactagcggcacgcggaggagcgccggcgccagcgcttatggacagcggcggcggccggacaacaggcaaggttcggcggtggcaggtgcgtctggtggagtggcagtgcggctggacggcaacggctgcagcgcgcggagtgaggagggaggggcgccgtcggtggccggcaccgctgtccgggcaccctcccgtcgccacagccaaacctcacttgcccaccgtcgtcgtcctcatgtggcgagcgagagagaagaggagggaaagagaagagagataggagagctgatatgtgagtctaagggcattttgatatttcacacgatttctctctccccttcaaccgtgcggtgtccatcagcgaatattcaacttttgggagtgttttcccccaaaagtcatttcgtgcggtatcctatagctaaaaccgcgaagttatagtgtcctatagtaaaatttgccattcaataacgttcatatgaatttagatataaatcaagcatttacatgtatctataaataaatctatccaaagcctaaagcggcttacaatacattggtttttttaaaccaaaaccaacaacaacgtccgttcaaaccgctcaactttagctaggagtacactcagtatttcatagtattaattttcattggctgaatcgatgaacaaataggaagtggattggcttatatatatatatatatatatatatatatatatatatatatatatatatatatatatatatatatatatatatatatatatatatatacggtgacgctacacagcgccacccacaggcgctgcgcgccacgaaacaaaatggtgccagacacaaacgagtagaggtcagcccaccaccgacaaaatcccaccaacgaggcatccaacccacccgcggagttaaaatttaacttagatacagttggtggtggtggtgcggtgatatcgttgaggagttaatattatgcgatgattcagttggtctgagttaaagtttaacttagatacagctggatggtggggtaaaaccagcggagttaaattttaacttagatacagttaggtggtgggtgcgatgacgtcgttgaggagttaatattatacatggtttcagttgatatgagttaaagtttaacttacatacaattgggtggtgggatgcgatgacatggttttggagttaaaaaattacttgttgttgttcaattctggatgatatgtgattgagtctggtcgctgctgagttaaaaattaactcgcgatacaaaactgcaggacatcgttgtagagttaactcagattgtatgagctaaattttaacttgtgtacaacaagattttaactcaacatatgcgtcctcacaatctataagcgtaagttaattttttgtcagcacttgctccggacatcaacggcggagcgtcatggaggtgtccgccgctgctcctccatgtccttcggtgttcgaactcgccgccgcagaggtcgccgccatgtgcgtggggcgcggaacggcggcccgatccgccgccgccacggctgtagcccgcagtcaccccgtcacgggatccgccgtcgagccgcctgcatccacgcctgacacgcaccaccgcagccggatccgtgtacgtggggcgtggagcggcggccggatgcgccaccccctcgcctcgccatgccatgttggatccgccgacgccgcgccttcccgtgcaggattatccccggatccatcatcgtgccggatacgccctaccatggccagatccacgcgcgtggggcgcagatcggtggccgggtgcgccgcctcgtcgcctcctacacaccgtcaaccgtcgccttcacgcctgcagccgtgccgtaccggatccgccgacgtcgcgcccgccgctgctcggcagaggaggtggtgctcgacgtcgcgccgccagccgtgccatgccggatctgcccaatgccgccaccgctcaccgccacacccgctcgccgctctcatctccgaaaaaataggatctagatatgtggttggttacggggtggatgtccaacactgg

SEQ ID NO: 47149 - DNA, 2683 bp, Oryza sativa
aaaaggggaggggaggagcgcgcctggaggaggggagggagcgaaaaaaaaaaagaaaaagggagaggaggggcgcgccaggagggagaggggaggatggcgcacgtaggtggtgcgggaccgggggagggagggagggaggggtacagaatagttattctatagggggtgtagaatagtcttaccctatatatatatatatatatatatatatatatatatatatatatatatatatatatatatatatatatatatatataggcaatgtatcctatgcacatacctatcttggtgcactcatgcactcggccactgtcggccctttgattctaatccaaaggctaaaaacgtaggtacggcatttttacagaaagccgcctgcaacacctgtgtatgtttgcagaaaacccctcagttcccttcatcttctctcgtccaaacctcctcgatccaagtcgatccccaaatctgctctatcaccttcggtcggggccggcaggactcgtcgtcggcgcctgcagcatggctgttggtgattttgtgtccatctacgcgcagctgaacatcgagctggccgagcaagcagcacagtggcccgtttggccgtcaagcagcgacatgactggggagcatcgtggtgttcaatcgagtaaaaatggcagcgaggctgccatatcaataattaaaataggccatgtccaaccaggagaaaaacaagaagagaaatcaacaaataaacatggacattatagctgaagaatcgagagaaaaaacacgaagagactcgccggaacgacggcctccatggctccatgcggacactatagatggagacgaaccattcagcgagcagctggacagccacgccggctgtgaaggacagcgccgaggcagccgcagcctggcgtgtcggccgatgctagccctagcagcaggattcaatgaaaatcgagatgaatcgtcgttctgttcagccccatcgcacggagatgagatctggatcgaggaggtttggacgagagaagacgaaggaagtgaggggttttctgcaaacatacacaggtgttgcgggcggctttctgcaaaaatgccgcacctgcgtttttagcctttggattagaattgaagggccgacagtggccgagtgcatgagtgcaccaagataggtgtgtgcataggatacgctgccccacatatatatatatatatatatatatatatatatatatatatatgacactcatatggggcaccatggtgcccgggcaacatggtatgaaatacacaaattcatccaaatttttcaaaattttcaaattgtgagtatatacctagttataagtattcaattcatacctatacctagcaacaaaacaactcaaatttaactttatttcacaatcgaatgttgcataactaactaattatatgtttggatgcaatatacctataatcaaaatataacaaaaacaagttcaaattcagttcaaacttgctttgaactagttagtaaagtagttaatgttaatacctaaatattttaaaaaatttcatactcttttgaattgggtatatactcaatttcaacaatggtgcccgggcaccatggagcaccaaacaaatttacataggaatatatatatatatatatatatatatatatatatatatatatatatatatactattctatacccgcctccctcccatgggctaaactcacctctcctcccttccaagaggcaaaaacccacctcccacctcagtcaaaggtcagtcaaaacgcccccacatcggtcaaacccgtgggacttcctccacaacccacctcttctcagcactcgtcatgcaggaattatgcagtaacgtgacagtcattgtgcagtaacaccatgtattacttgcagtaacgacgttaaaatatagttcaaatatagtcatgatggatctagttttgataagcacttttttttacaacattatggtgaaaacggtttttaaaaataatgcatatcttgtgagatattactcttcaaaaattgacattttaaagtttatcctccacatgcagtaacactatagcattactgttactaccgcatcttccgtgttactgcaagagtacagtaacgactgcatgttttacagtaacatagtgtgttactataattgcttaataaagttactgcatgaacatagtaacaaccaataagttatcgatgtttttttcaaggagaaaaagacattgcatgagaggttgtttaagccctattacatacatattttcttacttggagccttcgagagataatggtgattgttttggagtgctttgtgaagaattgggggagcaacgattcgggagaagagggatgattagtcagtctacaacttattgactcttaatagcaaatctacaacccgtctgctgactccccccaccacccaccttttcttagctctcgtctcacaagagtgcagtaacaagacgtccattatatagtaatatcatgtcttacgtgtagtaacaacgatcaaatatagtcatgatggatctacttttgatatgcactttttttaatatcatgctgcaaacggttttaaaaatagtacatcacattagagatattgctcttcaaagattagtcttttgaaatttaactcttcacaagtagtaata

SEQ ID NO: 47150 - DNA, 5953 bp, Oryza sativa
attcctgcagcccatatatagatatatatatatagacacacactatactatactatactacaggggtgcgttgtattaaaacgcaacccaccccaccccctccccataggcttaacgtactaccgcaccgaactaaatcaccagtaatctatttacttagctattatgcgtatattcatattaggatacaaccaaccaaccatcgatcctattttcctggatctgataccatccacttccacgttgtttttcccggatcgagcaagagggagagagcacgggcgaaggttggcggcggcggcatcctccagtggcgggttatgggtgaaatcggtcggagacagcggcgcatctacggtcaatggcgatggcgaacaggttccctccctgtttgttcccccttcccatctcttccccccttcggtctcttctttctcctctgatcctctcccatcctggcaccgacgttcacttgctgaaggtggcacacgacggcatagggcagcggcgcatgagaaaggaggaggcagcgacgcatggtggtggttgtgtcgatcttctccattgtgcgatgcatgaggaaggaggaggcagcggtccgtgcaacatgccaagaaattgccgtgatggacatcgatttaagaaccaggcccgtcgctgacccaagctccttcactccgatgaaaaggtaatggatcttagactaggctttgccatgccgatctgatcctctttctcgtgctttttttttaccttcctttccatgcttatggatttttcccttgctcctgttttcatgtgcatatattcagaatgcaaacgaaagtgcacccaaaatttattgtttccatagatttgcaggtttcccgatcagagcacacacgtttcccaagttctcactgaggtgagtcagatccaacatcaaccttctccacggagccgtgtggactgtggaggacgaggcagtgctgcctggcagacggagcggagggaggaaagccagcgctcagctcctttctcagaaccagtgtaggccatcaatcttgctgtgtgctgatctagctgcatatttcgttgacgatcgcatgcactccctgttcttaatttctctacgcttgtttactctgttagcctttcttcacaaattctagtttctagtttttcatgcctttgactgcaattacagaagaatctttttagttgatactggcatgtcctaccggagcactggcaatcgtatataaaggctatggattaagtgtttttagttgatccagatgactctgtacgactgtacctatctagatagtatcagaatctattctaaatttcatggacaacaattcatgtcctcatgcatcaattaactaggtatttattttataaagagtgaaaattggcatggtttctgctttaagtaagatctcagatcgattgatcatgtgcatgtgtgcctcatgcaggatgaaattaatcatgaaagatttctcggtaattagtcatgccttctatgtaaaattaatattaaatgagtgttcatgtgtccacatgtatgtgtcatcagttcacacagcttgtgaaaattcggtgttgcgacaggaactgaacatctgcatcatgataaaataaataaatcttcaggataaaaatttagatattcacaacttaaatctacaggatgatatgcataacagtgtcccatcgttgtttttctgcattgtcaaaaatcagtacttagcactgccaacaccatcatctgagcgtgcagtaatgctttagttcgtctctattctcaagtgtgggaatattgattgatcttggtttcgatttcgcttaattgcacaatgtttggttgcaggctaggacaaggcctccaaacaaaacttctacggttgttggcacatgcgccatcgtcgtttacgatttgtcctccgccgatccaattggagcagcaacatctagttttttcatttgtacaatcaatatgtatgtgtacccccgagtctttataaacatgaaatgtagctgtaatttatttttggctatattgatttgttggtaaatatgttactgtagtagttagggagtaatttccccacaaaaaaaaaaagtagttagggagtaatttatttttatgagagaagattgaagtaaatttgttgttagagcgatgtgttagtacgtttttatctgggagtaatttatttaccaagagaataccagagtcattgttggtatggctatatcaaaagtaatcaatttactgagtgaagcatggaaaagtaaaaaaaaaaaaacaatggctagattaaaagtaatccatttactggagtaatatttgttgctaaatcaaaagtttttactgctaaattgtgagaaatttatttactgataaaacaccatagtaaaaattgtgtataaccaaagagtaatttatttactgataaggcgacgtacttagtatatttcgtgtgtaataatttatttactaaagaccatgagtgggactgatttattatcaagagaagcacccgtccaaatagtaatctatttactgtgttattaacaagattaaattgtgaaaaataaagagaaatacaggtatttctattgtaaatgatccatcaaggataaaaattataacgatcagtagtacggttccctacagggccttatttaagatgttagtaattcttttactcacgggcttaagcgcgagtaaatctttcacttacaggcccatctagagagggcctattagtaataacgtactcagggtgcggtttagcgccattttcctatatatatatatatatatatatatatatatatatatatatatatatatatatatatatatgtatatatatatgcgatgtatacaattactctgtctcaaaatataataacttttagccctcatcatttgtcccaaaatataacattttctctaccaatattatcttcacaaccaatcataatcctacaacatttattttttccacctacctccacctttatctaatcacaaccttccgccactcacttctacttactttcttaataaccgtgtccaaccttaaaacttcttatattctgagacggagggagtgctaattaatagtatcacctcatgaggacggtgactgttttcttgtcccagtcgtggccatttgccaggacctcccggaacttggggcgctgctccctgccgccgccgtagcggcgcgccggctgcttcggcgtcggcagcgccgagagcgctgccacgccaccgtggagcatcagcacgacgtcccacatggacgggcggtcctctgggtcctcctggacgcacagcagcgcgatgtgcgcgcagcccacaatctggcccatcaggtgtggcgcgtcgccgcccacgctgatgcgcagggacgaccggatcagcctctccgggttcttctcctcgaacaccagcctccatgcctacatcggttttgtacaggccggtataaattttgttccatgtaatatatcaatctacaagacattttataatacaggggctatttggttctctaccttatcaaatcattggtagtaccaaattcttggctgttttggtactaccaatttttggtagggtagagatttaattatacatgtttgaattagaagaaggttctagattattgacaaattgatcattggtgttaccaataactagctgggtggcccgcgcaattttcacggctagcacccaaacaaaatcatatttttttaagtatgattttatttaaaatttattaaatagctatcttattgtcttaagtctttgaaagaccaaaccttatcatcctcgtgtttataattacatagttttttaaagtcacaccagttactaccccttatgtcatctccttctttatttgcttgctcgatctaccactatttctattcattcttcttgtaaccattaaaaattggattttatagtttttagagtttattgttacgtggtttcatttttataatttctaaatgtcatgtcaaacattgccattatactcctttacgacctgtccactgtctcttctctttattgtcattgagattttaaaaatcgaacataattatcgtttgggttcatttttaccttttagaagtcccaccaaaccgtcagcggctttgccattgtactcctctacggcttgcccgctacctcccttcttttattgtcattgagattttaaaatcgaacatgattatcattattttttttttactttttagaagttccgaaactttaaaaattggacttgtagtttcattttttatatatttttagaagtcccatcaaacgatgccactatgcccctctacagcccgtccgccacctactctttattatcattgtgattctaaaaatcgaacgtaactatcgttggaattcattttttattttctagaagtaccatcaaccgtcagcggctctgcaactatactcttatacaccccgcccgctacttctcttttttattgtcattgagattttaaaaatcgaatatgagtatcaatagggtttatttttttactttctagaagtcccggcaaccaccttactcgtttgcttcacggcctgcctgacgtccctccttttaatcgtcattaggatctattcgttgttttattaacaatttttatacgtcgtatcaaccgccaccactctactcctttatagacatgttacataatttatttatcatgtgttttagatggtcttttctttcaataatctttatttttatcacaaattttagtttttataaattgtattcctaattgaaatcttatttttctttttctaatttcagaactttttttaaaaaaaaactttagttaataccgtattgtgttcttttaatgtttttatttttattttcaatttcatttgtttgaaaaatgtattcctatttaaactctcttttaatttttctaattttagattttattttattttatttctaatttcgattaatctcgtattaggttcttatatggaaacttctttcaatattgcttatttttaattccgaatttcagctatttttaaattgtatttctacttgactctcctttccttttctaattttggattttattttatttttattttgaattttgattaatctcgtattgggttcttatatggaaacttctttctatattgcttatttttaattccgaatttcaactatttttaaattgtatttctacttggattctccttttcttgtttttctttttctccgattaatgtggaaatttctagctcccacagcgaacgtggtgcctccttttaaagctgttttaataatgtaatagatttgtcttcaatccaaatccatactattactattcaagatactaataaatttgtagtgcacattttggcaccaatccaaaatgcccacaatcctataatataacaatctataaccgaattagacgctattcggtcctatgttgttattttatgggacggagggagtactacttaacaaatagaaataagtatttactaatccctcttaaattcaaattgtaattacaacatagtagaacggtacaataaatcttgaccaaacctattccatattgtaatacttttgggacggagagactactatataataccttgttcattccttttattttcttaattgaatagtttcaacattcaaataataataaaaaagctttttcccctaaattctttgtttggtctaattttgatcctacaatttaaatataggatagctagaacacatccttatcttttagtaccagacaggtttgatcccttctattgttcaagatggttttggtcgacatgaatagcagagttggtggaaaactgactttgactcaatattaaaaagaatatatttcatatactaaaaaaccttaacca

SEQ ID NO: 47151 - DNA, 883 bp, Oryza sativa
gtggtgtttaaaattcatgtagatgaagattaagtgttttacgtaaaacaatgtggtattaacgtttgattaattgagtttttattattacaaatttaaaaatatatatatatctgatattttagagtaacttctttatagaaagttttcatgcaaaatataccgtttagcaagcagtttgaaatcgtgctataaatatctacattttcatccaacctttttttgagaaaagaacggttacttaattgggcttgccatcctcccaccctccttctctcctcgtcgtttccggcccattaacccccaatagagagaaaaaaacccaaaaccaaaaaaccctaactcttctccccatcgatctcctctctgagctctctccgacagccgccgccaggcgaggacgcgccggcgcccgtcgcccatcgcgccgtagccgacctcatcacctctccggcgccccgcggcctgcgccgtcgccccgtctcgccgtcgcacccgcaccgccccggcgccccgcgagcccgcgacgccgcccgggcctggcgagtggcgtcggcgcgctgccgtcctgttcgtccaccgaccattcaccaccgcacttttcctgtcccgagagccgagaggccgaaggtaactctgcctaaatcctaatgcctactgttagatggtagtgctaagtgctgtgaatttaggatttaggaacttttttaccatttgaatccaggggatggttcatggttgatttattgcatatatttgaacaattgaactttagtaatttaattagtagtttcatggttcatggttcatggtttcttatcattttgccattttccatcctctataaatttgatatgttttgtcaattagtagtttagtactt

SEQ ID NO: 47152 - DNA, 6707 bp, Oryza sativa
aaattatgcttataccgctatatattatacaactattagactttgggttgtaaaaaaaaaatgatctcttcccattgcgaataaccaagttcaatcctgggccggtgggcccacccccatggccccctgagtcctgatgattacaagcgtttatattgctttgtcagattaaccgccgcaactccgcatgttctccttgtgttgctgtttcaatgcttagtcatcttcattgtttcttgctctgtggcacattaagggagtaggaatgtaaaattgtctcttgtgcagttgattcagtgcagtttgtttgggcaacttttatgttctcgttagctatcttacttgctgcagcctgcaagtatataacatatctatgttttttgaggaacatgttagtttattactacttttctgtgttattaaaaggaacctgtgttattgcagaaaactcgagggttaaagtgttctcttacctgttcctttttgtgatatttttagagtttaatttaaaaatatatgtatatatttagcattcttataattgacaataccacctgtcttgaaaaaaaaatcaccctttcactatgaaagacacaaaagataaaatgatttacacatggtgattcatgcagcttaggtggtgcaatggctttaagttcatccattagcatgtctcggcgtcttttcaagggacttactatcaacccggcattggcatctgggatgacgtgccagcatcaccagcttcaacagcatgcgccagtgagtggaacagccaagggtaaggctaagctcaagtctggccaacaattgaagcgtaacaccattggagcaaagaagggcggcgcgccttccactggtgggggtggtggcggtgggcgtggtcgtcgtgaggctattgagcgtattactcagattgcagagtcttgtctgaatgcctcaactcctctgcgccatctatcccccaaggagcgtcttcgtgaggccaaacgtgaggagcttggactcatttctaaggaacgtcaacgtgaacttgatttagccaaggctaaagccaagtccaaaggtacccgtgagggtgatggtggccgtgtgctgatgggtccaccaggtcttgactacatcagtcttggattggttgatgaggacgcaatccctaaatacgagctgacagtcgaagatggccggcgacttgccaaacaatacagtcaggtgctaatgcgacggcaccgcgcacggcaaactgcagaatcgtctcttctaagtctcaagaaggaggccattgcagcactccctgagaagctgcgagctgctgctatgattcctgacatgacaccattccctgcaaaccgatacatggcaacactcacgccaccaattgaagggtatattgaaaaggtgcgggatgctgccaagaagtattctgtgaaggagaaacttcgctgatttttacctcaagggaggaaagggtatctagaggtaattatttaagttgtgcttttggccttatatagtaaactaagatgtgcaatgcttgctatattttattttactgaaatagtgtgttcaatagctcaccatccagtttccagtatttactctgtaacctatattagtaatgtacaagtcctcttggaagataaatgaacttaatccaattcgtagcaatgtgtacatataatgattttggcaagtgttagtttctagtgctaccagaaattagcttgagaacatgagttgagaatcgtgtgctattttagacaaatttgttgggaagtttgacctcaagcaaactgtgttgatgttgttcactttctatagacaaactagtttggaactctgaccgcaagcatgaatgggcaaaactgcacaggtttttttttttcattagacacaatgcaagctgagtaaactaatttgtttcctgtgtctactgtcaatatcctctaatctagcatatgtttttatagtctagaaactgggcttaagtttaatctcacatccaataaaatgctaaccactatcttgtatctctagtgcatactgtctactaaaatccagtatctgctcttttattggtggggtttcatcaactgatttctctcgtgtgtccatcttctaactcacttctgttttttttttccattacatatgtataggtacatgaacatgtcaggctgtcagctatgacaacagagcatactttgttgattggcatatcaatgcaaggagaaattgggaagcttgttcaattttcagtgagtttttggtcattttcttctggctgggatgctgcatgaatggcaatttctgaagctcgatgggcattcgctttgtttcattgtttgtttgttacgaatgttgtatgcagccacttctgtaataagttcccggcagttagatttgcttctgccatttagattttgcgaactttttttttactgctaaaatggctgtagcaaagcaatgcctcacttaggatcttgataatggctcccgtgtttctctcggcaaaatagcactgctgtctgctcctgaatttaatctggatagtgctgctccttagtttaacctggatatgtgttttttgggcctgttagcaagcacggaaagggaaatatttcaacgaaagcactaattgcagagggtgtggatgctactgtattcgggcgcccagcgcggaaaacggttcaattaagtattagctaaacttttgttaagaaaaatgggtcaatatgattttttaaagcaacttcatttcatatagaatgttttttaaaagcgcaccatttcagtttgaaaaacatgtacactaagtgcgggtagttgggaactttaacagacgaaaacagctgttattgtgttctttgttgacaatggattagcatgggcacgcctaaagttattctggcctaaaatataataagttaaagttagttataactcttatttagatgtataggtaaaacgttaatttattttgagataaagggtgtaaattgtttttttcgtgctacaaagagtttacttttataagggcatttccactgtactaatatgtgcaaaggcatctaaatgtcatttcccacgatactaatatttaatttatttatttgtactcttaataattgtcaaaaacttaattttatccatcatcactttatcacaccctaactaaaactgatcgagaaaagcaaactccacttgattacttcatcgtgccgacgtcgacacgcaaaatgtcgtactactgcatcgtcgtgccacgtggctatgcagcggtcgtcgcggagctctcgtgtcgtgcaagtgtccaccgcattcgggaagctcggacctgatgaggcacatccaaattgatccaaagccaaattttgatacttccaagtcgcgcgtgatttgtcagctgttagttgtcacacctactcatcagccaaccaattcgccatcaatagcaaaccaagcggattgatcatctcatctcatctcatcgaccgagcattctagcgagcgagcggccaagccagcaagatcgactcctcactctctcaccgatctagcagcagcagtggtagtagctagcagcgtcagcgtagcaaggggttgcgagaatggcctcgccgtcagcgccggggccgaagctgcagaaggcgatggtggcggtggacgagagcgagttcagccaccacgcgctggagtgggcgctgcgcaacctcgcgccgaccatcgcgccgccgctgctcgtgctcaccgtgcagccgctcctccccctcggctacgtctccgccgcctccttcggctcccctcgtacgtgacgcggatccctttttcctcctctttcaccggattgatccctttttccccttcttgaatccgttgttgattttgggattgtgtgcttcttctgctccgcgtgtgtgatagtgggcacccccgttgtagccccggagctgatcaaggcgatgcaggagcagcagcagcagctctcgcaggcgctcctcgacaaggccaagcagatctgcgcgcagcatggggtatgtattatgtgcttgtttccgcacctactatgaccataatttctcctcattaaacttgtgagaagttgaattatcaagcaggatgtgcagtacatcagtatgaatgacctcttgtgtttgtttggtcgctgctcaactactcagcacattgttgttagttgttactagttcaagatattcagcattttttgttgtttggccatatcagtaagggaaaatgccataggtgtccaatttcatgtgtttgcaactgcaattaggtaactggagatactagcttgtagttacaaatagtaggagatactagcttgtagcttgtgatcggtttggctcttgtctgtctcgtcatcttatacatttgactacatttgtatctactaaccctgctctagaccacatggactgggtttatattttacaatcgacacatcatatcagggagggtagaattgtgataattgtttggattgtcgtaaatttgtctatgttattttataacgaatggcaacgtatgaccgactaacaaaaataaattagcgtgaggtcataaggataaggcaaatcacaggagatcttcagtttattccgtgcaacactgtgctatgtggatggattagtgttcagtgattgtaatccttgtaatattgtacctacaattcaggtggctgtagagacaatgatcaaagtaggagatcctaaggagatgatatgtcaagcagctgaggaatcaaaggttgatttactgatcgttgggagtcacagccgtggacctgtacaaaggtatagtttgaaatatcgtggtttctttatagattatagttgatagattatattttctgcatgaacaatcaaaatagaattatatgttcgatgaaaaactgaaaacatgttgctctttttgtatgtattatggttggattaggctctttttgtatcttttcatattttttttagataatggattaaaccggcctctacatccaaacggatgtacacagccaacagatatgatcttttcatgaaccagactaaatggattggtacaagactgtaacaccttccgatcaataaggaaatccacagttgcacctagcacctatggagataattactgttagctgatatgtttttataggactccttatataccgcttgcaatcatggttttactgaggagcacaatataaaaacaagagtaatattttttatgggtgaagataaataatattttttgtgtagatcctaataatatggtattttagtgagcaagactagatggactggcagaaaacctccattagcttcagcaaagaaaagcctcagtttcacctatgggattaatcgttgtcaactgaacatgttttggtggtgctctttataaactgctcataatcattaagtttattgtactctgtacattataaagataagagtaatatattttacaggtgaagataaaatattacttctaataattttatcattgagtgacgcagatgtagtgattgcccttcttttcagttccattcctttcttttgtttttctcaactcaacagcttctgttttgttatgttccttataaattccaaaggcctaatacatatcggacattctgcatttctacaatgacattgataccaactctttgcattcaactatcttttcttgaacaacagttttatcaagtaaaagaataactctgattacatcagacaactattcagttacttatataaagctctcctgattccagatatagcattatcgaagacaaggatatagcataaatcaattgcttgttgcatgaattaatttccaatttatacataaaactcatcgtggattatctaactgttgcctattgctgctgcaggttgtttcttggaagtgtcagcaattactgtatgcatcattcgaagtgcccagttcttgttgtgaagaagcaggagtaaataagctttccgaatctcaataaaaatctttgtgtattgtcgatgtgttatcctcaacaatgcaataaacaaagccgtattagatgatattcagataactgaataatgtattgtgtaaatagtcaagattatcttgcaaataaatatccgcttcttgttgctgtaaagtaagggcgtttcctttaggagtatcatccatgtagctggcatctgttgcagaaccgaagacgatgaacacccaacttgtgtatatatgtgatatgtgtgtatgttttgttacttattcacaatgtgtctcgttcatcttgatgtctattgccgcttattggttggttattcttgtactctctctagccagccaaaaaaggaagtcgttttgagatttgcataaaggtaaatacgagaatcgttaagccaacgtgacaactgcctctcgtgacaaatattatagctgtaggaataaatacaacaatcaatcccaaaattacgtactaaatttcattttttttttgcagtattttttgtttgcatcctaaggtggggaggggatggcatgcatgcacaggtattagttgtatcctcccaacttttggtgcatcaacacatgatagataatttttatttcgaacattaattttgtcttgggatcaaagatgtgaactcgtcaggaacaaatcagatctcgaaaaaggttagtgaaataccacatcaactctg

SEQ ID NO: 47153 - DNA, 13481 bp, Oryza sativa
aaaaatgctagacaacacaatttcattttatagatgtgggtgtacatagacttatttctaatataaaatatgttttatacaattttgtggaggaattatcaagggaaaaaatgataatggtgtaggggaagcacttagttttagtgtctgccatctaattcaatatgcatagactaatcagtcatatctagcaagctatgcaagcacgtttgttgtttgccggcccccactgccatacacgcaaagtcttcgaattatattttgaaaatattactattttttcgtaattttgcaaaagtacaccggtttcaaaaattctacaaaaatttttgtgtataatacaacgttaggaagaaacaagaaagataaataacgttagatagtaaagcgaaccatttttaatcttttggaggggtaaataagttttttaaaaaataatagttagtaagtgatccaatgaaatagttgagggtaaaattgactttttttatatgaaaagaattacacaagaatcattagaggaattggcgaagccatgtccctttgtttccaagccatttggcaacaccatgccgtgccatccgatggattagcgccatccgatggattagccaatccaattggcgaatcgggtataattttacaattattctgaaaaccagtatattccttaaaaaaatatgtaaaagtttatattttcatatttaaaacaatagtcctcaagctatgctactcccatgttttctttaccgtttggagaggttaaactacccccaaagaaaaaaaaaccgttcttgcagtttctgtggtaacagtcaataaccgcatgaatttcatctaaaaaaatgaattcaaaattttcaaaaatcacacgggtgtgctgaccttagcgtaggcctatatgttatgctgccataatacttgtatagctttcaccgtgggtatattgtgacctcgaaatattctgtgatgagcatacgggaaaaccttctttggatttcatccaatatctttggaattcatttatttcttgtaggggtggctttctttagctttggcaaatttcatgtaacgggtttgtatggtcctgggatatgggtgtcaatccttataaactcactgggaaagtacaagttgctgttacgctagaaattcaaggttacacacgagttcctattcacagcgtgctgctaggggatttgttctaggtataggtaaggtcaaatccgtaggggttatacaaatacataggccccttttcttctatcgagttgtttagaagacatttccgttctacggtcctggctctaatgttgtgttcatcaggttgcaggtggataaatgtggatgtggggactcgggtcagggcacagcgtaactaacataggagagtggtttgtgcacgataagccatggtaaccgtatgctataaccgtggtatttgtgacttaaataatgaaagccactaagaaaaataaaaatcacaacctcacgtttgacaacaacaaaaataaaccataatataactgtcataaccacagagattattgtgaacataatatactatccacgagcatcaaatctttattttaaagcaatgcagctttgttgttatgctaaaatatgaagttagccttagaatatttcaaaaaataaaaaatcaccatacctcattacaaataatgtaatatttctccaaatgttttgagatttttcctttttctttttaagattgaactcgaataaatttctatacccccacgctgtcgtggttactgcggttatcggtagttgtagaaactctggttgacactggtgtgcctatgtgggagggagtgtaaattttgtgcagtaaatactccctccgtcccaactatatttttttataaggtcttcaatgacatatttttactattaatttattccatgttatgtttccaataaatatgaaactagcatcacatgaatgtactttaaaatatgaatctagtgatataacatacataatacttagcatatatatgtttagtatgattattagtcaaaatctatcaagtttaattttctttaaaaagaggacgtcctataatttagggatagaggcagtaaaatactagtagtggtattaattatgtgctattacaaaattcggacatcacatgattaattaagtagatgttaagaacctttcccatgtaaaaaaacgaggttgtttattagcacataattaattaagtattagctaaaaacttaaaagttaaattaatatgattttttacaataactttttattttttaaaaaaacacacacatcagttagtattttgggaagcgtgtgtatggaaaacgagtgagtagtggtttggaaccttgactaacacaactttaggccacccaaccctctatgtcatctagtgtccatagcattaaatacattaccacataagaaaaatcttatgtggaaaaagagttaatgaggagagagaggggtaaaaaggtaaagaaacaatttctcatggaagaaaccatctctacacaagaaccaagaatgaaaaaaggggatatttatgtgaataaaaggggagggaatggatgtggttggatgagaacttaatttgaagatattatctattgaatacatagtttcaacatagtgtttatataacatgataagtatagaaacttacttgatagtttctgagttgggatagccttaggctatgttcattccagtcgattcccaacccctctcactcgttttccacgtgcacgctttttatactgctaaacggtgtgttttttgcaaaaagtttatatgcgaaagttgcttaaaaaatcatattgattcattttttttaaaaaaactagcaaatacttagttaatcatgcgctaatggaccactccgttttccgtgccagaggtagcgcttccagcccaaggagatgaaggcagccttagtctgtgttcccaacttcactcttttgtttttttcgcacacgcttactaaactgctaaccgggaaagttgttataaaaaatcatattaataaattatttttttaaactaatacttaattaatcacgtgctaatgagtcatcatgtgttcgggaagtgattaattaagaactagcttaaaaaaataaaacaaatggattaatagctgagtgtgcgcggcggtgcagctcgcgccgcccacttcttcggaccgcccaataacctgtcatatcacgcggcaagtgcccgccgctagattctcgtaccaacccacagactctctagccaatccaggattcaacccgcgagtcttttgccaatccaaccaacggtgagagcgacgtacgggttccaaccctgagcaaagggggatgtaacctgtaaccagacgcccatggtccatggattccttcaccccacccccctcctcccttaaaaaaaaaaatgcggctccggcaactcggcacgcaagtggcgcccgcgcaccactcgcctcgtccgtccccggatacgtgatccggtcacacgtactatactacatcatccgtaagaatcagctggcgaggcggccaaccacgggccccggattctctcatctcctcctcatcaggcttcggtttccgccaaacagtagtagtaataaaataagcacagtattccattccaagttgcacggaggaaaaccgcggaagtgggagccgttgggaagtcacgagccgcggccgcgcttgctttgcttgcttctcgcccaatattttttctccccgccaagcaaaaccgctgcaccgcccaaggcatcgggggcgggcggttgttctccttcctttcctcgctggtttgactctggattgacagccaacttgggctctctaaaatgctggaatcgctccaatccgtgggtggcatatgcatgaacctgtgcgaaaccgaccggtttggagaggtagagacggtggcccccagagttttggaaaaaatcttcctttggcccagccgtggcccgtgggattgggggatgcagcttcctgttccctcggtggtattcccatccgtgttccgttagtatcaacggctgagtttataaacagcgggacccacaccttcttcttccttgagaaccagcatttattgcatcgagctatccatatatatgatcagtgccctttaatttcattcatcggaaaagatcacaactcacaagaaaaggaatcttcacagtaaagaaacatgggagatccctcaaaattccgatcacccgcacgcggctagatttataatcgtgtttaattacccactagatggttgctgaaacaaaatcatgccgtcatggacgtgatgactccatggcgctgaatatttgtcttttatgaaaattagatggcacttgactcgtaaatagttgaattacaaatatatttgagaatcttagttatgatatattcaatttctgttcaactttttgatacaattcaagttgatcatggtacgagaggtttcgtcgtcggcttgccaattttattagtaatggcatgtttgtccaagtctaattagtttgttttggaaggaagagatggtggctcgatactgaatctaattagtttgtttagtggttgatgccattagccggttctcaaggaagaagaaggtgtgggtcccgctgtttgtaatctcagccgttgataccaacggaacacggatgggaataccaccgagggaacagggaagcctcatccgggattgggaacatcagttgtatttgtgtgctttgccacgtctctttttgctgaaaatttcattaatcttgaaggagtacaatagcaatttactgggataaatatacatataaccgcactggttaataattttttatttcaattatataatatataattatctgtatatatttttgaataactatttccaaattttttatatgttgaaaaccatataagtttacaaattaatttttatattacataactagtttttattgtttatacaataaatacttaaaaattgcaattgatatataccaagttgtacatgatgaagagtcttataaatctagctagaattcagatctagtatgtataaattacttcctctgtcccataaaaacttaatctcctcttagattgagttttttttggacggagagagtaaacctataaattttggaattaatagttagtactgcgtagtaagttgttggaatgaagtccctaaatctctacttaatatatatatcttttatctagattgtgttatcctgtgacgtggaattgagattacataaacccattttttaattcatgctaagggggcgctgagccattgtcttcaggaaataaaagaaaaggaagacataaccctctattttattttgtcgtagaacacccacttgacgttttcccaacagcttgaagaaagcgacacaagaatcccacgatagaactacatttgtatccatcataccatcatggcatcatgcatgcttgcggaccaaagatcttttttttttccaaaattgggccggagaagataatgctattcctataccacatttattagaacacacggattttttttattgcttctaaaattgagctatacattctctgggctgataatacttgtctttttatataaaggtgatgtcaaacgttagaatctttgattataaatctttttaaaatatttgtccttcaaatatgatggctacatgtatagactggttttaaatagtactttaataaaatcatatatttgttaatatttttatacatattattataatagaaaataagtgttaatttttttttagagaccgtacttttgtcaagacgataagtactccctccgtttcgaaatgtttgacaccgttaactttttagcacatgtttgaccattcgtcttattcaaaatttttttatgaaatatgtaaaactatatgtgtatatgaaagtatatttaacaataaatcaaatgatatgaaaaaaataaataattacttaaattttttaaataagacgaatgatgaaacatgtgctaaaaaatcaacggtgtcaaatattttgaaacggagggagtattatcgttccggaaagagtactagtaacagtaaacgcttccacagttatttttcctttttccgtgaggacattttttttctgtgaggatattaacagtaaacgcttccaaagattctttttccccctttcttttcgatgggaaaaacgcaccaaaagttctgaaaggattcgtgcagccccatatataactcctctcagaacgttctcctcctatacgagtataaatgctgctgtgtgattttctttttcctttttttagaacgtttgtgttttctcacgacaatcaataaaggcctcaaagaaatggtagaccccagaagtagccacctgtatccagattccatggggaggaaaacacacatgcgccggtggggccaggacgatggccgggaagttggagctctctctttctcgttctcctactccaacaaaaccggaaacctggactcccaaaaccgcggacgcagctggctgtttcggacgcccccgcggacccgcgatggcgacggacggccgagccgagtcgtcccggaaatctagggaatataattgcgcacaatcacgacgccatcacgctacagtagtaaccagtacccctctcctaggacaggtgccaggtgggacgcaggcacggcacgcgcgcgattttcacatcgctgcaaaaatggaatcacgatgcgcgcgctcaccgggtcggcgtcaccggccgcacccccaccaccactgcgttgtgagcacggccactccgcttatccgcagccgctggttatctccattattactgctccggctatggtgtggttgagattgatgggtaaaatataccttaccaaaattttgataaattgataatattactaatattttttattagaattatcttgataatgttgctaaaattctatgcacattgccaatatttgataacaaactaaacataaccacataattagcattcttaccaaataaacaatatggttgaaaatgtcattaatctgaacaggcccaatataatttcaaaccatactccctccattccataatataagtcacaaccactttttttaaatattctataatataagtcatgcatgcatgtagacaattaactataacaatttctccattaaattagtacttttttaattcatccactctcatgttctctaattctattggatgcatgtattgtatttattaggatgatccaaactacaagataataattattttcttggtttttgggttatgggtggttatgccttagggcatccacaatggttatctataggctctctacaagatatccatatcagcatattttcctacttggaagagattaaatgaagagagagcaaagctatctactaacctggagatagtctatagagaaaaacgaggcaacggattagagagctatagatacccatgtgtagatatgctattgaggtggtatattattaatctagttgctgagatgtacatattttatagatagcaccttactttaccattgcgggtgctcttttattttggaatggagggagtaccatttttgataaagttgttaaatacgtgtattcatttagttttttttatcaaactctggtaaatagataagaaatcctgtcaaaacttagtaatattatcaaattgctaaaattttagcattgccaaaatttgttaagatttaatcaaaatattgccctgtactaaaatattactgccctgtttcgcatgcgttgcgtccgacgagtgggagcaccggtgtcctggagtaccacttgtgctggtcaaacggcggtatgctggtatgggtgtgttagactgttgtacattgtgttgggggtgtatggtgtgttgtgtgtgaacaactgaacataggtaagggagtggggcttaaacaaacgatcaactgggcaaaatggtgcggggctgtctcctggattacgcgaacctggcgccttggattcaagaagaccggttaggggtgagagcattctccggattaacaatcctagtacaatttttttatatctttggccggtgagccttctttttttttcattcatacccgctatatagtagagatgctggcagttacacacggttggtctttcaaggcttccctcgagaaaaatagctgtagtttatagaagttgtttcgaaaggccggtaagctttataaaactatgggaggtaggagtatatataatatacatgtgcagatctagtgtcaaacttatgaataaattacgttcataagaataagttctacataactatgtttaattctatagctcacatctccaagctacagaatattccaaaactctatgagcctgcattatgcttcaacggtggcaaagagataaacatgtgattttaggatacaaattgcttatgcacttaggctccatttgtaacatacaaattcaacgacatcttcgcaggagttcgataaaaatacaaaacaaagtctttttttttttgtaaagaaaagcactcagttctccctttgtgttataaaagaaacccatgtttagtaacgttgattcttgaacaatagttccctggcaattttgattagtattatttgtggaaacttgtacgagaacatgtatacgcatttatggttcaattcatcaattatattaagcctcaagcgtcgatataaatagagctacaaggtttagatctcaagtaaatgagtaatcctagagataaactgcaaactaatcatatatgataatatcctaacaaatcagccggatcatatatgatcctatcgttctacataaagatgtcatcatttagcaactaattagctcttcatgttttgtgcgtaaggcccaccgtttgtccattattgtatttcttccataactcccactaactttgtattgggtaggtcattcgcggattccgctgtttagtcatgtatcaactgcacgcacgggctaatttttgcgattttcatactttttcaaatttcgtaggattggggtaagatcttttatgaaagtcaacttaaaaaatgatctacatattaagagaaaacatacatacattattttaaatggaacaacaaaacggagtaagacactactatacaaaacgtttttctacacggacaaagtagattatcgcatatggatggctgacccgcttgcctgaagctatatatctatgaaatgggggttttacatagacggccagccgtgctgcatgagttaactcctttcgcacacgtgcacttgtccctcgaaggaccgagcataccgcaggcatgagttgaggattgtccgttaaaaccaaatttacatagtgagatccaattcattgaagttgtgatacaattttttttctcttgtgcatcaaagtttgagttgaatatttccatgttttattatcaacgacgaggatccaattacttgaaattaagaatttgagacattttatacatccacgcccttctttttctactagtagtacgtgaaccaacagtgagaattgacaagtccatatgaaagtttgaccataacacatcctatcagtagcctgacgaaagagagaaaattggacgcagcttaagtaggaactaggagtgcctgccatactagtacattgctttactctcagggtgtgttttttccgtcaaaattggaagtttgattaaaattggaacgatgtgacggaaaagttgaaagtttgtgtgtatatgaaagttttgatgtgatgaaaaaattgaaagtttgaagaaaaagttagaaactaaaccagacctcactcactccatccaaatatgcatgcccgtggttatcttcaaaatattttttcttctcaaccacttatctgattttcaatcatctgattttcaatccgattacaccattgtacttgttataattaaatctttacaacatagatttcaaaccgttaaaacttaatgtttatatacaacagtggcatgtttcactatgggtttttactgtgttacacaaattttttttcaaatgtttcaatgtttactttttatttcaccatatataacttaatatttcatcgatggctgatatacatagggtgtgtttggttggtgggatatacccggataggccgccgctttttggagggtgtttgaatgctgggcgagagtgggatagggcggcccagaggggaatattctctccagatgctggatagagggatccggccgatttggccggatacaaccgcccgaggctcggtcgagccgggcaagcgagttgcgtgactcgcgtcacccctcaccaccacgacacgagcgaggcgacgagcgcagcggccggcgagaggggcgacgagctcggcggccggtgagagaggcgacgagctcggcggccggcgcgggcgacgagcgtggcggccggcgagaggggcgacgagctcggcggctggcgtgggcgacgagcgtggcggcggcggcgggaggaggcgagccgcggcggtgggaggaggcggccggcggcgggaggaggctgccagcggcgtcggcgaggccagatctggcgctgctttttttcctttttctttttcttttttcttttttctatgtgtatttataatggaatgtgtttttataatggagtgtgtatttataatggaatgtgtattatgtattaatttgatgaggtatattcaccatctcaagtgagaggtgaccacacccacaaatccaccatacttcctccaactaaacaaaaaaattggatcaccaaatctacctttgtccttacaaccaaataaaaaattggatcgccatattcacacaaccaaacaaaaaactggaccgccatatccagcaaaatatggaccgccgtatcccatccaatcttgaccaggaaccaaacacacccatagcttactgtatactctatcaatgcatatatgcatgtagtgatcttcaaaatattttttttttgctaaaactacttatttaatccacaatctgatcacaccattgaattcgttataattaaatatttataacaatatatcatataattatatttcaatgaaataaaaatatatgtttcaaacaacacattgtttcatacgggatagcgatgtatttcaacgtgtggttttaccgtgttttacagatattttgactgtttcaccatgcactatttaatatttcactcgataatcaactgaaatatttgaccatttaattttttggtaaaatcaggcactcgatttgtaggtgttcgaaagtttggctctcattttcgctggaaaaagcgaagaatatgcatgcctcagctcagcgcaacttcaagcgggcgacccaaaaagccaatttccttaaacaaactgctaaccacatttagttaacgttgattgactccatcaacagataagcacgagaggaggcgcgagagagggagaggaaaaaaaaagcaaataaagtgggtacaggcacgggtgcaacagccaaaaactatggagagcagcaaaggaggagaagaaaaaacaaacgtgggtttcttgggggtggatgactaggaaactgagagggggaggagagtggggggacctggcgggaggcgggatccggaaacccgcccacggtattgggcgcgcgcgcccacagaggcagcggaaacaggggccgtcgctgtacgatttccacaaaaccgggagccagagccaccccaccccctcccctttccagtttccgcggtatatgtggtggtgtggcgccgcggtctgtggctagcttgcctgttcgctgggccccaacggggacgtggacgccacgcgctgcgctgtgctgccccgcgcggcccgcctcctcctcctcgcctctcgggcacgcaccactgaccaccctcctttccctgcgccgtggggtccactgccccccggagtcttggatctgttcgctctcttcacgccaactgtcagaggacagaggttaatcataaacacaactgcacagtaactagtactactagccacgatttttaccgtgcttttaaagatttattttttacagagtagaatgattggagaagggaggaaaaaagtggagccggagtactagtttctttgcagaatcctttttttttgcgggggttctttgcagaatctgagtcatcgccacgtcaaacaacctgcggtttactgtaaaatcaacggacggccgggccgttgtttcctttctggaatgaaagcagccctggaagatggtagtagtaggagtagtaaataaactggagtagtatacgtagtactaccaacacgtaatagtagcaaaagtgtgtactgctgctagtgtactccaggacgacgcgcgcgggggtagtggtagtagcggcacgcgagcaacagggaaaaagatagcacgcggttccaccgaaatctcccggccggggcgcctccagttttggagctagaatccattcctcggacgcggcttggcgctcaagcccgcagttaaaccacgcggtgggccccgccccttgattcgcctcgttttttcttttccctttttttttctggtgcggcgccgaacccggccttccgaaaccactggcgccgaacccacttataaaacaggcacccctctctctcctccgctccccgtcattctcacaccaaacatctccatctcaactcatctccaacaagcaaggcagtatcgagtcgagtcctcgcacaggcttggagaagaagaaggaagaatagtaccacctcggatctccaacaagtccggcgcccagttgataagggtttgcagaagcatttcgaagatgcggatgagttgcaacggttgccgggtgctgcgcaagggatgcagcgaagggtgcaccatccgtccgtgcctgcagtggatcaagacccccgaggcgcaggccaacgccaccgtcttcctcgccaagttctacggccgcgccgggcttctcaacctgctcgctgccgggcctgaccacctccgccccgccgtcttccgctcgctcctctacgaggcctgcggccgcatcgtcaacccgatctacggctccgtcggcctgctctggtcgggccagtggcaggcgtgccaggccgccgtcgaggccgtcctcaagggcgaccccgtcgtgcaggtctcctctgaggccgccgccgccgcccaggccaccccgccgctcagggcctacgacatccgccacgtctccaaggacgccgaggccgacgccgccgccaacctgctccgcgtcgcgcgcggcggccgcacccgcttcaagcgcgcctcctccagctccaactccaagcacggcgccaagcttgccggagcagccgccgccaagcgcgccgcgtcccccagcagcagcagcccgacgcacgagacggagccggaggcggtg

SEQ ID NO: 47154 - DNA, 8241 bp, Oryza sativa
caccctgcgctgagccacgaggtccacgaggagtcggctggcagccatgaccacgacgacgacgaccatgtggacgacggtgacaacaacgacatggccatcgccgacgtgacgccgccgcgggcgggatcggaggataccgaggtcgagaccggctcacacgtgagccaggccgagcagagccccgtgccggtggagcacgaagagggggaggaggaggaggtcgggctggagctcacgctcgggttccagccgctcgtcgtgcgcgcctcgaggaggccttcgtcggcggaggcgcgctgcgaccttagcggcttgagcgcggagtcgagtcgcatcggcctgcggctcgagctgccagcgtgagaagcggcgtcgcgagccgcgagctttcttttagctgatagtagacagttttggtttcgtgccagaagtgaaacaagaacagaggaaaacatcattattagttttctttttttttttcacaccttttctttttgcttgctctgcatcgttgtaggattcccatgttcctcctgtcatgtacttgtgtgatgtctgcctgtacagactttctcagattcggctgtgacaaaacttgttcaaaatcgatagaacaatccagatttctggagtgaaaaaagaagttgaaatccgattattctccaaagaattgtgatataatttatctttggttatttccttgtttcgcaccttattttaacttgtgcgatattcgtcctaagaactgcaagcttgttaaacttgattggatattaaattactccattggaacttttatttgtgattcgttgcaagtcaggccaggaaggattggaagcattaatcccagcaaataaccaagaaggtcacagtcccatagtccaaacattcagtgagatcgacaaagttgctgatactctgtcgcagccttattgttcatttcatccactcctcgcaaaccagagaactttttcctgagaatgagaagcaattggatgacttcaatcccaacaacaagactccaccttcccaacatccagtcagaccaatacaattgagaggattcatgaaatgattttgcttagacctgattcagataggcaataaaaatcatggggatacatggcagtatgggtcgtatggcctgcagtaccaggttttccatgacctgaataattgggcattcgatgatccaaggaccacagtccacaggagaagagcactaacaggacctatcacctaaccacatgaagatcggcgttttggagaacatagcaaaagctgaaactttaagatgcttaaatcatgactggaagcagcgaagtcattctaacaccatggagcatatgagatcaaccttgcatgctgtcttcctccactagtgaaatacatttacatatgtaaagcacaacagtagggttgtgagacaaatttcttctctatgtccatcttatttcttgtagtccaattagtcgaaacaaaaactgcaaaagaagaagaagaagaagaagaagaagaagaagaagaaaagtctgaattgatagtttccacaccccaagcatgagaatcggggatgccactccatccaaacccagaggctaatgaccatccaaatctacctgatgaacaacaaaaatttgtgtccccggcatcttttcttgagtttcttgaattttattgtgaaagagaagttgcaagaagatcttaactttagatgggttctacagtgccgaagtttttcaaactatttactcaccctctagatgaaataattttgtatgagttggatacacattgatgattttgagtttacttctgaaccacttggccctattgcccaggagtttgtgaaggagttggacattgaaggagtttgtgaaggtcggatctcaccttcaaaagggaagagatactcttggtggaaggagtagtgcatttgtgcagcctcagaggatagggtcagaaaagactcggctcattgtgagctcttcaaaggagagtagaatcccctcaagaatttgaactttggtaacacatcgacttgcaagaatcccggtgatatctctctcacactcttatagctttgctatttggtgctgctagtagtttaattgttgtttgaacaatcctttccctacatgtgtggctatcccattgtgcttgccttgctaacttgcttgaaaatatgagattttcggaatatccgaaaatattccgaaatatccgaacaaattctaggatatctaaaaagtttagcttctgcattttattaaaaattttaaatgcctattcatccctcctctaggcagcatcaaggtcctttcacaaactcttgaaatctacagtcttggaaataattcagtcaggttgaaaaccatttcagggtgtgaagaaactcccattctgttttgaaaagaattaaaaaatagagaagtcttatgttggtgagaagacaccaacgttactctttcatcattgatttgagcaattatatcatccaaatctttttgtagccattgcatggaagaacttcgtgttttctcccccaactcgatccgtctattagtgcatctccttttccaatataatcttctaaaaagatagagctttgagatttgtttcttgaccacttctctaaaattccattttaggatagtgagacttctgcgttcttctatcagatatagaaagtctaaacccttattatagatagagattaactgaagtagcttggagagacccttactcaattattttaagaattttctcagtagctccggcttatagatgatacatctagcagggtcaataaaacctggatcaatgttccatatccaagcaccatgataaaaaaaacccttccatatcaacccaataattctcaaaatgaaagacattggatatggggatagaagagtattttaatcatttgaactgatattgctcttgttagggtaagaacataggactttggatatcttagtgtccaagcattggaagttaaaagctagtcaagctgctctaacaagaggttagcttgtatattactacaagtaaaagattttccttttataggaaattccactaagcctaaagaacttataatatcagtgaaaatgataatatcattcatgtcaactccaagtttgttcctattcttggtggatctataaaaattgaaattcccttggaggatccaagcttcatcactttgcatatgaaaatttctcaagtagtcaacaaaattgtctctttcctgtcctctacatgggccataaatggaagccataaaccaagactcagaattatgctttgagacagaattcaagcataaagaataattattagcaagaactaaagaacccacaaaatattttcacatcatagagccactagaggcccccatagaaggtatgatctgaaaacaattaaatctcttagggaccacttttttgaggaaatttatgtcaattgattctctcttagtttcctgcaagcatatgacctgacatttgctatcatcaatgcattgtttcaaagcatctcacttgtcctctgagttcatccctcttatgttccagcacaaaatattccaactacgaacttgatggatattcattgataaacagttagttaaagagaagcacataacaagcaaagcaggtctgaataaaactagactagcacattacaataaaagtcttaaatcctctgaacatatttagaggcacgacataaatagattcacaaaaggaggaccactgcaaacacattatctttaagacaactgccattaacataatgaacatttgctactcatcatcctcagttggccttgggagtttttccatcttgtctccacccagtttgccctcagccacctcgtcaggagataggccacacatattaactcccatcttttgcagaaacaagatagaacaataagaagaggaggaatcaacatcagagtaaaaatcacaatcaaaatcagattctgtatggatactgctagaagattatgcaaaatacctactagttccttaagttttttggccgacattcccctaggctttccaatacccattcttggatcttgctcaagataactttcagaagaagccctcacccttgcactctgcctcctctctaggttaaagagtatagtcttaccatccctctttttaactggagttcctgggaggataagggccaatatgttactctgatacggggatacggatacggatacgcgatacggggatacgaggacacgtcattttcttaaaaacactgatacagggatacgtctatatatatttaaaaaaataaaaaatacaaatgaaaaacataacacataaataactataagcctgcaaatagagttatacaaattacatgacatcattagagataattagaataaaactttttctggatatcaagctcaactcaatagaagttcaagagctgcttgcattcatagcaagcgatgtggctgaaagagctacatcccagacatgtcccatgcaccagatcttttagtagtactatcccaggagatcaagctcatcatgtagcttgcccctcgtaaataatatgctcccatgcctggtcacaagtgatcctgatgaatttgtagccgcgctagcagtacatactagtgctagataagtggttaagcttctaattccaaaattcaccggatctaaatgacaaggaaaaacacataacaaaacaaccagtgcagatcgagacttaaaaggggaaagaaccaaatagccggtgatgatggactgtacgcgttgggcttggtagccggcggagaagctgcgcctggtgacggagatgccgcgactaccgacggcggaggccctgcgcctaggggaccaggggtggcgacgcgacgcacggcgggcggtggaggccctgctcctcaggtggcgagtggcggcggaacccggtggccaactggtggaggccttgtgcagtgtgcccctggtagcgatgcaagcagcgctacaggaggattggatctgcccttctgtgctgcgagcgtgggtttgtgagttcagacgcatggggaatgtatcggagaagtatccgagtaattttcttttttttatatcatggtgattagggatacgtatccgtatccaatacggatacgtggcttgtgagccgtatctgggtatcctaggggccaactgagttgatttgtggaagtgaagaaggctgctgttgtatagcctagagctgcaaatgtatgactaggaccgattctttagtcactggtggcaaaatagccaggggagttggtggctctatcaagaggtcttaagtcatcatgacgtcatccacaataagctggcttgtttgcacggcccaactagaggcctcatccaaatggtctgttttaaaaactagcgggaggatcagaaggagcattcctctttgggtacaaaagctgaatgaaaggggttgcaatctgagttggctttgaacactaccccttccaccctatccacaaagttgtttcaaaagttgtgttttaagcaccaactcttcaatttttccctgcatgtcttcagagatagaagattgaggaagtgtgagctgttgttctggggtttcatctgcatacataattatgtgcttgtgaccctcattggcatcatgagagctcacaccagattcaccagttgcctgctggttttctgcttggtgattccaattgccccaaccttcatcttgctgtggtggctcctcttggtcatcccaggttgaaccctaatgaggaggttgttccggaggtggaggtggagcacccaaagttggcaaatcttcatcttgcgcttgtgtatccacaaaatcattataaaggacaaaaacacaaaaggtccaagattctccttgccctcgctgagtcgggatttgcttaaaaacaatcctcctaggaacctgatcaacatcatcaaagaaagccctcatcataactttgtcgggaataacgtcaacttcctgccaatagtccaaccagccaaagagcccaactcctctagatatataacttgtagtgtgaaaatcaagtgggcagccaggaacatgatccacccaaccctatctacatacgctgccctccaattgagcctctgtcatgatttctaaatttgaccacattaaccccattgtaatggaaaccaaaagcctctaccagggtatctctggttaaagttgatctaacaatgaaaaaaccaaccccaaaaggatgaggagagcaatgggtaaccataacacctaattcattttgcagatgattgcgaatctgaagcagatgaccatccaaatcatcttttggaacccatggctctatgtctgcaagcatgtaagactcatgctacctttgagttatacacgtccccggcgcctcctccataccgttataccatccgatccgacacaggtctcctcctcgcctcgctggaagaaggtagtagtagcctctgctctgctcctctctctctagtttctctctctagccccgacacattgtaataagggcacccgcaatggttatctataggctctctacaagagatccatgtcagcatattttcctacttggaagagattaaatgaagagagagagagtatagctatctactaatctggagatagtctatagagaaaaacgagacaatagattagagagctatagatatccatgtagacataccattgaagtgatttactattaatttagtctattgctgagatgtacatgttttatagatagcactttacattaacattgcgggtgctctaagtgatcaaatatagtaacctttttcgttttagcaagaaaacttggtttctaagagcgggtacaatagtgctattaggaacgctccaaaacttgttaatcagtctaaaacgagattaaggaaagaaaatcagtgattgagaaagaagccgtcgcttgttctggcgccggcgcttgtacagcgctccacgctgtatcggccaggagatacaataaaaaaatttgtttgtgggttctactgcttgttaattcgtttgaaccaaggtagtttatagctaacttgtagttagcttgttgtatgagatgctttttaagttagctctacttgagacatgataaaattttagagcctactactagctgcactattgaccttgctctaatggccgcgcacacgccgactgcttaactcgggcaacgcccccctctcccacaccctgcgcgcgattagtgcaagacgcccgccgctaattatagtcattagtgataattacagtaattactgttaattatcataattagcatttttcaaaatacataaataattttaaatttgagttaattttttttaaattttgatatggaagttttcattaagttttcagttagaaatgaaaatttagaattttgagttaaaagttttacatttttgcgatgaaaatttttaattgtgagttgaaagtttttgaaatttgaattgaaagttttcaaaatttgagtcaaagttttgatttttgagttaaaagttttgaaattggagttaaaaattttcgaaacttgattcgaaagttttcaaatttgaatcaattttgagttgaacgtttcaaaatttaagttgaatgtttcgaaaaataaaaaaacgataaggaaacgagtggagtcgaaaataaggaaacatagcacgtggatttgtgggccgaaaatcatggcgaaaaaaggaaacaacaagtaggctggtgggccgaaaatcacgggaaaatgtgaaaacagcacgtgggctggtgggctgatgcgcgaccatactgacgcgtgtgcggcagataagaatttcgcaagtaaacaccctagagagaagtatataaccaattgctccctaagctaggaatatatcctacgaagtagttttctattttacgagaaattcttgattcacaaacgtttcccagccacactcggtcaaatcctcttctcgtcggctccggcgtgcatgccagcggcggcggcggcggcgagaaacgctggcgaggaggcagcggcgagcgcttagatgctagcgaaccagcgaagagggcactgcagcagtggcggataggcggaggctagaagggagcagtacggccagagagctagggtttgggtaatttggcgagcgaggagcgaggggaggcgaagggagaagagggggggggggggggggg

SEQ ID NO: 47155 - DNA, 21184 bp, Oryza sativa
  unsure (1)..(21184): unsure at all n locations
ggatgagcatagtgcccaaagagacgattgaggtgatcgggcagagcgtcggcatcgccaacctccccgccgatgtctccgccgcgctcgcccccgacgtggagtaccgcctccgcgagatcatgcaggtccgtcccccccgcgctcccgaatctctcgcttcccttcggttttagtttcgtgcactttgggggactaggaggcaacttccaccattcccttcgtaggaaaattgcctgcccccccgaggcgtggatttgtagtttctgggtgatttgggaccgcagggagcaattgcttgctctttgttcttcgttctctcaattgattgctatgctcaaccattgtgctaagttgtgtggtggaatatttgcgatagacctattccaatgggttttgagtttgctggacgagatgcgtttccatcttgttgtttgaacatgctggttcacactgactgcttaactgtgtcctgctcaatatatgttcactgggtttttgtagcaatgcaatatattggacggtcttcatagcaatgcaatatattggacggtcttcatagcaatgcaatatattggacggaagatggttgttttttttgttcactattgtctcttcaaaagcattgaagcacaccattacagagtttctggactgttcaatcttctctcattcgattgcatgctatagcttactggtaacatatgttggggttttgttcctgttttatcaccattttttttaatttgtatatatttagtgaggtagtgagtctaagaatttgcgttctatccactatttacacgataaattcatcatttgaggttttctttactgaatcttggaaatatgttattcctatctgatctttactcataaattttggaaaactatcattgacaaactacagagttgtcacaaaaaatacaaatttaacactgcattaccagaaaaatacatatttgagccatatcacacaattatcgatttagcaccgattttatcatgaaactacaaattttacaggtttcatctatcgtgatgaacttttcataaattgtagttttctcataaagtccgtgctttatctgtagatctataatctcgttgcttaagttataaatttggtgttacatctgttgttttgcgataattttctggaagtatatgttgatctgcaaaatttgtatgtaagcatataaatattcagtcacagaaatgccattccattttctcctaggcactatatgtattttattatgctgtggattgtgacaggaggccatcaagtgtatgcggcatgcaaagaggacagtcctgactgccgatgatgttgatagtgctctcagcctcaggaatgttgaggtagtttctatttcgttgacaatattttttaggactactaaataaaggttttgtagatctagtaactgttgtatgcttgaatgcatcaaacttctgagttggatagctaaatagtcgagctcagtatttctcggaatcagctcattattaagctaaaagtataaatgtttaagaaacttagagttgacgatcttttcatggagacatgttagccataaataaggcaaactctatgcctgtatctgtttttggtatgtctgttccctgacatataaatgccattgcaatcatctcttgtttgaaaactgatactgcaattggtagaggcttttggtgtctgggtgtattcggtggtttcttcccctctcttcttctttaatacaaatatacaatccttctgttccatttgagaacacagctctcctgtgtgttcgagaaaacaaataatgtctttaaagcttgacatgtaatcctcaagggaacagctgaactgagcataggggagaaaccatatccttccattcagccccctatttctctgacacccactagttgtgaggttactgcagtccagtaggatgctgattttactttgcgtggaactgaatgagagaaagctgaataagtaggatgaagcccaatagtgtacgctgggtaagatgggggaaataatccatgtgaaaatacaaaataaaatatgagatatgtattcatgtcaaatggggtgtgctaagctaaatgcactttatgttagaatttgatgattatgttttttgtttcaaatcaaggactgagaactatgtattaaacattgccaatgtgtttatatgctgttgtatatgacttcgtatgtaaaagtttcctactttgcttacaagtaacataatgcccctttgccacgctcaatgttagaactgggaaaatgtgaaactgtttttcttttaatttcagattaagaactgagaagtatatattaaacattgccaatgtgtttatatgttttgtatgactccatatataggcgtttcctccttttttgagtaacataatgtcctttttggcactctcaatattatcactgggttggtttagcgtgctaggttggtttctttgatgttacttttgctacatattttcgttattttggttaaaatgttactgtagtggagtttaggtgggacatgattgccttcagtgtctaagacacaagctaaaaataatagcattgtattggatcataatctattaccacaaaaactgatgcatatgcagcaccgctggtaggaaatttgttgacattagtttttatggtggttctatgttatggtgaagttggcattaaaaagtattgtttcagtgcatttatttaattgctttgaattttcacacagcctgtatatgatttgcttccggtgaccccttgcggtttaagagagctgtgggacacaaggatctcttctatattgatgacagggaggtagacttcaaagaggtaggggctctactaatggatgaatcaaataacttttgtacttattttattatagggatcaatttgaaaattttcttattcattggctctgtgcagattattgaggcccctctacataaagctcctcttgatacagcagttgtagctcactggctagccattgagggagtccagcctgcaattccagagaatcctcctgtagatggttagctcatatatcttatcttattttactctttaaaagagggagttggggggttatgctaggttctacacccacccccacgttgatcttttgtggctgtaaatatgtaggtatgtgttattcgtgagatttttatagaaaaatattgaatctttgaatatgagtatacgaggtggttagttggtgttcaattggaggatagttaattacctgttgcattttatattctagaactaacatttagttaggatatttggatccattccaacacaaataccttctagttatctgtatatggatttgcttccggtgaccccttgcggtttaagttatcttcacaaaacttacatcatattgttacctgctttatgtatacaatgttccttgggtgaggaagagattagttgtgggatctattaacagaccttagtgtgattaaatccgtgtttataatgttccttgcttgttcattatttgtagattttggtattatctgacaattagtgtttcacttcagctatcgtagcaccaacagagaataaaaggacagagcatgggaaagatgatggacttcctgttgacatcaagcttcctgttaagcatgtgttatctagagaactccaggtattgtggttactgtatattgttagagccttacataagatttatattcttctttactggtttcgtttgcagatgtattttgataaaatagcagagcttacaatgagtagatctgaaacctcagtttttagagaagcattagtgagcttatcaagagactcaggccttcatccgttggttccttacttttcctacttcatcgccgatgaggttgttatcttgctcttagagtctatattgtgcgagctggcattgccttacaatgtatatccttataatttcaggttacccggagtttaggtgatcttcctgttttatttgctctcatgcgtgtagtccaaagcctgctacacaatccccacattcatattgaaccatatgtaagtggttgatcagtcaactttgatgcttctactttctagttgttttgtttttagcattgcacacttatgtttgcagcatatttctgctaaagaaacaaaatttctcttgattgccagttgcatcagttgatgccgtcaattatcacctgcatggttgcgaaaaggcttgggcataggctttcagacaaccattgggagcttagagacttctctgctaatttggttggttcagtatgtcgaaggtgagtgaacacgaagagtactactcaaatacctatgcatcgcaatgggcttcaaatagacatataataagtaataaaaaatatgaaaaaggcgtatatatttcgtgaattaatcttgttacaagccatacaagcgaatgatcaaatagtccacagaatatgaaaatatcccactaactcaggatgttaccactactaggttcaaaaatatatatcataaattttaaatttttagaagttttaaagctgcatgcacaaggatctacttgtagagaaactcaactggagaaggacgagaagaaagacttgagtagcttcttttatcagatagtaatatgtgctatctaacctcattctactcagatccaagaatgttatcagaatctaatctgttcttgatggttacagtttctagacataatctttagaatcatttccacaccattatcatagttcttcatttcttctattccctccattctcttatacatgacatttgttatttcatttttggatgaatggtgtacggactctctgcactgacttctggatgaatgggaagtcaatagtggtttgacctccatttcctactgtgtcagttatttatttctaggataagtccattttatccccctcaattcttgcctttgtaacacacccccaaacttccaataccatacaatttacccgcttggaaattcggggggggggggggggggggggcaaaatacctggttttgaagttcantggtgtgttttaaacaaaggcaagtagaatggacttatccctttatttcttggcgagacaagaacaattaccatcagttatggaaccgtttcctcacttgcataattctactaataaatagaatgttaggtagtatttgttttatgttacattgatttttgcatttttctaggccatgtagactaaaagctccacgctttatctcgatgcatatatttagttggcggtgactttgtctcatgtgaagtccccttagagaaacgataggggagaaccccacttagaaatatagcatacagtagataataaagcacaaaaaatttcaagacccaacaagaacaaggtctacaagatcataaaagctaggaaactggacactggagagtgttaatacagatggaaactaataaccaaacatatttccatgtggggcaggaacttgcttgaggcttattccttacggatttactatgtgtgatagcacctcttcttagatttatgtttagttggaggagctttgtcacaattactaggggtgggcgttcggtttcctcggtttaattggatcgggtttttcgggttgcttggaattcggttttcgtaaaatgtaaaccgaaggaagttctagaaaaatatcaaccgagcaaaataaaccgaagaagatcggttcggttttttcggggttcagtttttaccgagaaagatctatgccacagaccgcggttgacttcacgcgagtacgcacggcctgcccagctttgcccgagggcgtgtgcttgatttggagagggaacaggatttgtggatctattagctgtcatgtatttgagtgcttatgttaacacacttctgttatgaagtccctgcgaatggttgaacattacttaagttgctctgtggctagaggttaattggtttctgctgcttgtgctgattgattgccttttgatgttgctttcattgaaatacaaacatttctttttgtaggtttggtcatgcgtatcacaacatccaaacccgggtgacaaggacgttggtccagggatttcttgatcctcagaaatcattgacacaacactatggtgcgattcaagggatatctgcattggggcccagtgcagtaagtcctgttcaagctaatctaattttatatttcagcaaaattttgctcacaatttttgttctttaccagattaggcttctgcttttgcccaacctcgagacatacatgcagcttttagagccggaattacaacttgataagcagaaaaatgagatgaaaagaaaggaagcatggcgtgtttatggtgccctgctggttagattacaagctttcaatgaatacatgttatctatttttatgcaccagcttcttacctgtggaatgtatttttcagtgtgctgcaggaaaatgcttatatgatcggctcaagttgtttcctaatttgctttctccatcaacacggcctcttttgaggagtaataagagagtcgtgactaacaacccaagtaagttggtacttctatataatatatgtgttgctacttgcttggcaacgcacaacaaataaaaatggttattttatcggctgaacaatttcttctcagatacataatactgcaaaatgttgaaattattaaggtgtgaaagtaaggctatggtcaattcaaatttcagataaacggaagtctagtacagatctctccacatcccagccacctctgaagaagatgacaacagatggtgcgatgaattctatgacttcagctcccatgccaggaaccatggatggcttctccacccaattacccaaccctagcatgacgcaaacttcatcctctgggcaattggtggaaagcaccgcatcaggtgtgattcggagggatcagggaagcaaccacacgcaaagagtttccacagtgctgaggctagcctggaaggaggaccaaaatgctgggcatctgttgagttcattgtacgaggtattcggtgaagccatcttctcctttgttcaaccaccagagatatcgttctttttgtaggaagcaaatgcatagtgttcagagctatgtaatatgcattgtaccattaggctggtcttgtggaattcttgaaactgaaattgacgtctaggaatcttgtagtgatctctgatgctagatttaatcgcttggtgacttgctgctgcaatattttatgtgctgatttcttgaagttttatgtttattgtagtaattttatctaatgtaaacattttattacgctctactggtgcgccattttatggcatatgtacatttttgaaccttactgattaagcagagttgtcgttgacatgtgctaatgccaatgtattatttgcgttgatgaaggttgcataaaacgagagaaaaaaatcacccatatgagacttacctttttttaaatactttttaattttcagggtttagctaggtcacatacacaactcatgatatttttttttcctacataagttagcagctgcagaaccgaacaaaacaatagggatgcagagtgggagcagcaacagctgcagaggccttctctgtgttttgacatttttaacaacagtctgttgaacatttaaactttgttgtgaatttatttttttagcctttaactaaaagaactatacctttttacttccaagttttctttttttaggtaagacctcacaaaaataactaccgaatatagctatcaaaattacattcttcctttaaaatatggttgatgtaggccaatggaactgacagccaattcgatgtttcgcccatcacgcatccttccttgcctatcaagtgagcagctttatatgctgatcgtcacaccaattggaccttcatttcccggaacgattttaacctgctatcgaggttttggattattgtcccatacatagaacagtttactccaacctgtgttagcatccccaccacctccaaattatctattttaattatcactctatccaccccttctccatagtcagttctgtggcttgcctacatgccaacacttccgtctgtggcatttgctacctgtgaataaaaactagttgttgcagccacaaaattcccaaagcattcctcatgtccacccctgatgctcccttatgtttatttgatgaaaatgcaccatccgcattcagtggcggaggacggaaaaaaaattaggtgtggcggtgtggcccatgatcttctgcttaagatgcacaactagtgcccgggtttcagtaactcttcaaatctgcaaaatacattacacaaatgcaattttagtatcaaatttgtatacttcaaacccacaaaaatattctgaaattgttaacatttgaagaatatgtacatctttgtgaagccaatgcttttccttttctctttctatccattttttggttgataagttgattgcttggctagttggctgcttgcctgcttctgcctgactgcttgccttcttcctgctggctgctgcggtgctgcctgccgcctgccttgcctcctgctgccgcggtgttgcctgcctgcctggccgccggcccgccgcgccgctgccctgcgcagccgtgccgccgcgcgctgcctcgcgtcgccggctcgccgcgccgccgcagcgccggcgctcgccctgtcggccgtcgcccgcagcgccgcctctcgcctgctctgccgatgaggatggatcggggattggggattacagaaatttgggttagggtttcatggtaaagagcctaatttacacaagaaaacaagccgcacacggctttggcatctcgaaggtcgcagcgttgttcagcctgcgctctatcgccgtctcgcggtcgtcgcggtctctgcgtctcgcactctgcagacctgaactcccgggggtaggcgggaggagaaggtatggcgagcgccatacctcgccctaccgagccctccgcccctgtccgcatttacccatttggtggcttcgtccacccctgtgccggacttggaatggtgaggttcttctgctccctcaggttcgcccactcttccagctggaacaacaccctttccgccacagttgagggatggtccggagttttaatactccagcacataatggttccgggttacttcctccatcccaaaatgtaagcatttttgaggctggcacgggtattaagaaagtaggtgagaataattgaagaaggtgtgtgattggttgaaaagagaatgtaggtgaaaaagaatggttgtgattggttgagaggagaaggtaggtagaaaaatagcttcattttgggacaaagtactgtgctaaaaatagctacattttgggacggaggtagtaactagcagtctccacccctgacgagccagcagagcttgattgaaatcatgtaaatcccgaaatcccgatccaccatttctcttcgttcgacacgtacgttgccattctatccagtgcgtcttcctttgtcctttctttgcaccccaccaaaaatctgagatcattgaatgtaagtccgtatctgagaacataggcctttggagatctgaaacacactcagagtacttcctcagtccaaaaaaagtcaacgaatcttgacaacgaatcttgacatactctatgtccagattcgttgtagtacgaggttggtttttttacagagaaaggacgtcggtatcgtcaatagtacaaattttatcaaattctccttccctgacttcgacaaaccctgccacttaagagtcgaaattttctcccacatcttttacttgatgttcttaaaagcaccttcttttgatctaccaaccagtgttggcagtccaagatatttatgatatttttagaatttgacaaaaccacatgtgggatatttttttaatagaagtacttgactactaccataaaggaatactccctgagttccaaaatataagggattttgatcggatgggacatatcctagtactacatatctggactgtccaaattctcccattcgatcaaaatcccttatattttggcacaaagggagtagtttactgtgttacgtgtgttttaaaaactgaagaaaaataacatatttgctaaatgacatttgacaaaaaaagaatcaatgcaaatcttactattttgtgagcttcatacatactccacaatttgtatgccatgacctccttctctagtctaacattatcatttggagggtgggcatctccagcgagtggttaggtgacaatggacagtggcagtagatttgacggctggagttggcggagacaagagagaatgacagtgtgggagaatcttcccagagttggagaagaagaggccggaaaagaaagtggcaatagatagaggacagcacatcgtccggctcattctaggcataagtggacatggcacggagcagtcaacgattgcctctgaaattgaggcaggaggcttggtgggaggtagataggaactagggttgattgtaggttggaaagagaagtatgtggattgtgggatctcaatctaatataggaaaaaatttgactaatatggaatggggatttcacgcaaaaataataatgtagaatcgatgaccattgaccaattctgtagttaaatacgaaagggatttgaaataaagttttaagggccaaaaaatgaactttgttaatataaatcaccaatgattttgaaatattttcatgaaaaatgatttttgaaataattatttctaaaatgttagcacttgatatatttgattttccttaaaaatttaatttcaaaaatttattagatttgtgtaattattccacataaaattgtgataaaaattcacctcaaaaactgtgaaaaaagacataatttcttactttgaaggcatttattctgaagttttatgtaatttactcaaagataaagtgatatccgtttaggagtgtctatttcactacctaatacatttgttggcaggggcggatccagcatgagggcggcggggtctcgagctcccaatactgccgtgaagactatgagagaacccacgaagagcccactaaatttttttaccataggtagataggaggagggactgcaactctatctagctagtttgctcagaccccactgctatttctttctagatccgtcactgtttgttagttgcacaaatcttcaacataaggaaccttgtttagtgatatagaatccggatggttttaaacaaaagtaggggttttagaatgcaatatagctcaggctcgtcttggctcgcatagtcgcatgccaaatgagccgaagtcgctagcagctcagtggctcactctggcgcttttctttaaaactcatgaactttattgaagattagattaaaagcatattacatgagcgatgattacatctcccaaagggagtgttgaaaggattcccaaaatgggactgcttggaggataataagcatgtatgtctattgttatgacaattcagatcagtttaaagttggctttgagatttctagccttttttgcaaggctatcagcgtgcttgtttgcttctcttggaatccatttgataatgatttgtgttgagttttactggaagtatagtcatcctgttgcaaagtttgaacaatgatcccgcaatcggaaaggaataccgtggttcccatagaaagtgcagagcatatctgataggccatgattattcctacaagttcagcaagcaaagacgaaatatagtttttggaatatgcttttatcagataaaaaattccaaatcatgcttcattgtccttccaatatgtgtaaacatagcaacgggtacctgtaggtaagggctgaacagaatgtataagtgtttggtcttgattgattacctgttgctcttgttgtcggttttgcataatgtgttcataagtttttgccatagcttctgctgcgttacagacctaaaaaagcttacaagtttttgaattgaaaatatggtcatttctagctttctagattttccatagtaaaactgaaatttttaaaagaggtttggcattagtgaagttgctactacctccatcccaaaatatagcaatttttggccatgaatctgaacatatagccagaaatacttatattttgggacgaagggaatagaagataagacaatgtctcaaatagcgtgtaaatggttaagggcatctgctttgagttgaaaatcatagatgaaccaaataagcctgctgaaataataatgaaaacgcagttggaagttttcggacataggagcttacacgagtaagtttacttaccgcacctatttcactaggtcaataaaatttgagagaatcccttatataccactctaaattaaccggctcccttatatgccacttcaaatcggcttctcccttttatgccaccggttcaagtttctcctcccttttatgccattgccgtcagtccacagtcagttgaccgttaacttcattgtaaaaagacgcatttgccctttagaattagtatgcaaccaataataggtattttagtactaatatagctaccagatacaacatatgaaaattgattttttctgcatcacattcaattttagccattaccatcacaaataaattttcaatgtaagcatgaaacatgcagttttccaacaatatttttaatataaagagcatttttcactggttctgacaaaattttgttcactaaaaaaggatttaaaataaattagttatgatttttttgaagtttacacttttttagttgagagggcatattggccatttacggaaaaaaactaacctttgactaatagtcaactgtgggagtcgcttaaaagggtgaaaaaacttgaattagtggcatataagggagaagccaattttgagtggcatataaggaaactggtcaaattctagtggcatataagggattctctcataaaatttgccctacggaagagaacatacatgatttgggcggcccttaaatgtaagttcttttttattggtagtgaataaccgatgttagacatcggatcgccttgagaagtttgggatgtcacacccggatgtttgccatctttgtgatcaacaggaggagacagtacctacgttacccagatacggggatacggatacggatacgcgatacgtcgatacggggatacgcttatatatatatacatatatacatatatatatatatatatacatatatacatatatacatatatatacatatatatatatatatatatacatatatacatatatacatatatatacatatatatatatacatatacatatatattaaaaacacacaaaaaattaaggaaattgtatttatatatattaaaaatacaaaaaaatcaaggaacttttgtaaagaaatagtgatataatactagtattagtgtagccgattccatatcaatattctgcaattttctcttctataggcaattcaaattaagaagcgattaagatccccaaaaccaaagattaatagttcaatcatatatttcttgatgactttgcatcaacattaacagccgcactaaccagtaaccactaggattgctagatgcactaccacttgtaactaacaaaaacggtagtactttgtcctaaggaaaacaagaaaggcgcagcagattcaagcatgaaacttttgaagagaatggattacccggccaggcggtcaagcgaagaaagaaaaagttctgctgtcgaggttggcggcgaaagaggtgcgccgccgcccagcagcggcggctctgtcgtctcgcggaggggacgttgtggccccatgcacggcagcgacgcgcgcggctgcagccggcgtccggcggcaacgccgggcatgcacgagagacatcagccatcaagttgggccaaagctcgtgcggtggcgcatcccagatgcgagcgaagacagaggaaggtcgtgggcgtatcgctggcgtatcttgatttatttatttttttgcaaatcacaaatatgtgggatacgtacgggatacgtattggagcgtatccgatacgtatccgtatccgttgccgtatccgacacggatacgtgactatacaagcatatcagggtaacccacaacacatccttgtgtcttacatccgtcccataatcattgtatttctaggattctctaacttcctcaaggcgattctctaactgatgatcccaagtggtcagaggtgtttctaagaaagctaagaaatggctaaactctctaattatcttagtggcttggaaaatttggaaacactgaatgattgtgtctttaacaatgccacacctagtactgctgccgtattggatgctgtgccaagagagtttattatggtgtactgctagagcctattcattaactcttggtccggtcactccccatgtaggagcttagctcctaatggagttgttgcgcatcgcttcggtgaagccctttatcttttttttagagtgttcttattgaagttgttggtcatatgggtccggggtacccatgctgaggggaaaaagtcctttcccccagccacgtggccgagcggcccggatcccccctcagggggtcagacgcgtgggtaataaatagccaagaggcgcccgagtccgcctagggggctcggggtatcctgtcgcaccccgaggccctcactcggttgccacgtggcggtcgagtgggcggagataggggcgttgccaggcgtatttacgggcggcgccccaaccgccccccgtcgcatttaatgcggtgtggctggtcgtgcgccgcccagtgattgacgtgcatcaatttccttgaccgggctctgaccggccaccggcagatgggacaggcggcatcgcacccacgtcctaccctgtgtcaggcggcgtggggcaaggtatgccccgtctcatcaacggcagaggatcgatgttcgaccggtgcatcccatgcgcatgtacccacaaaagtctacaggaatttatgaaggaatgacagggatgtcccccgtgtcaggcgaaggacgacgctggggcccacctgaggacgagcggccaccttactttcggcctaaggcatgggcggtagctcgacccaggttgatgtgggcccctctctaggaaggagatgtgtagaggcggtgcatgtggtatccccttgaactataaaagaaggaccttgcccaccgagcaagagggtgactattgggagcttgagccttaggagaagactagccaaccgtctctcttgggtttgagatctcttgtaatagcgtaaacagaaatccacacaaaggagtagggtattacgcttcccagcggcccgaacctggataatctctcgtcgtcctcttgatcgccatccaccacgctagcctaatccacggcgaggttacgctcttgatcatcgtgccctatcccctggccgaactcacaaagaggggtctcacgtcctcccgctctttgttgtacaaactttctattctcttctaagaaataaaacaatgagcaatattttttgggtcagttgtaacctgtccattcatgggggttcctaacgcgcgcgtatgcgccgcgagcataagtcatgcacacccgctgacgcgtacgctgtgccccgtcgctaaccatgtgattagcactaatgatgatgtgattagtgattagtgctaatcataattagtgcctacaagaactttttattttttctaatagattgaaaactttaagttagatttgaaaactttcgacttaagatttaaactttgaagtcaaattttgaaatctttcaactcaaatattgaaaattttcaactcaaatttaaatttgcaatataaaatttgaaaactttcaactcgagatttggaaacttacaactcgagatttgaaaactttcaactcaaatttgaaactttcagctcgagatttgaaaactttcaactcagattttttgaattataaaaagtattttccattaaaaatatcttacttcctccgttttatattataagattttctaacattgcccacatttatatatatgttaatgaatctagacatatatatatatatatatatatatatatgaatgtggacaatgctagaaagtcttataacctgaaacagagatagtataatagaaatttttaactttcactacatcctaaattaattaagatgaaaacattaaaataaaagattatgcatgcatgcgtgtgtagggacatgcatgtgtgggaccaaggtggatgcgcagttgatctgccgtgtgcatgcgagataagcatatggcgcatctgcgcgaattagcaaaaccgccattgatgaggatacttcaaatattttttctccctttcctatttagaactgcttgttgaaaaaaaaaggtgtttctatctaaaatctcgcacggttgcacccaatatttctgcgggccagccacacgcagtcacgcacgcatcgccgcatcagtaaacgagctggtctgctatgttagccgagccaaagccaggctcggctcggctctccgcagagcagatgacgatatgagctactagcagcagcagcatccaacgacagaaagggaagagattttcccttatcctcttgatggagctcctcctgcgtccctcccctccgccgccgtgggcgattccacggcggagctctggcgagagaaccaaaccctgccgctcccgctcccgctcccgcacgggaacctctagtgcgtgcccatttccttctccctttccgtttcttggaagcatttcttggatgatctttcgagctgtttattgcgatgcgagctcgtaggaatttgctggattactttgaacatgtatgtatttgtgtgagcatctttgttgaaaattgagggtactttgtttttttttctgagcttttgcttgccactttttcctacgacaaacatgctggttccgtttctattttggtaacatttatttttcaactgaaataagataataaatccttcacaatttggagttctaccattcaaggtttgttttgtggaattataggtgcaggaagcttacctgagttagcccatatataattttttatgcttaacacaacaagctaacttgtcaaataggaaatgccaatttatgtgtttcaccctactttggttgattctctgataatgctaagctaactttgttgcagtggtttgaatacataagctgcggagctttcttgctttcttgtttttcttgcttgcaatattagtacacatggtaaacaggaacccaagttcacagttcatgtagttgggattgatcatagaattcactgtagcgaattttatatgattgataatggagtggccgcctggccggtggacactcatgttgcgccgtataaatatcaaatagaaacttacacattctgaagagcgaacaattgttttgaatctttctgacatgtgctaccacttgttttgcagagcaaacatttcctgtccctttactggttggcaaggttggaagacgtccgtttcctgtgcagtgttctatagttcgatgctgcttgtcatcaactgatgccatccattctacaagtgatgacatccatgaagataatggacacggccattttcttatgaagtctacatctgaccttcaggtatgatggtgagtcccatgatatatatatatttttatcctgttatgtttcacctgattcttaattatataatgctgtaaaatacccctttattcatttgcattatttttcttaaaatagtattgtatcatctcgatttttagtacaagtcaatctttactccttgggctaatgtttactgataacatcaaaacatcttttttcttttcagaaagtgatatcttcctgttttgggaaagcatgtcttctcagttctgtcatgcttgttctaccacccagttgtttcgcagaaccgtgtgagccagagtactctctacctaacatgcctttgctttttgcaattgccatgattggagctaccgttggaggtaagatcattacaatatgaagtacagaaatgatggaggcatgtagaaacatgttgtggatagcaaactggatataacattcagccttccagtacacaattttcttatatatctacggcatgatacttattgtgcagaatggtttgaagaagattaaggtaatagaagagagtgagagacaaattggaatgagagaattagaagtattgagatatagcaaattgaagaagagaaatagttattatttcttaaccatcatccttgtattgaggatgttgctatgaacacatagaccatatctccaaatatccattactcaagtctccctgaaggttgttttggcctcttgttagtccctcccatccagccatggtgtcctaaccctcctttttattgtgtttatccccataagtccactgtggtgcgtacaatcctttcactttttgaaaaacacatacctggtacaccaaatgtacattaatgaaaatttcaataaaataattccaaaggagttcatatgtacagtacacaactaaaagctaatactttcaaattaactgttcatatttgattggttgattggttaatatttaaagtacaggcatacccactttacctaatgtttgacatgtaatcccgtatagtacacagaatagaccgattcatatggttatcatttacacacatcctaagttccaacatccaatcttgttttgtttcttcaatatattgttatttacaattgtaaaaaaaaagcagtaaataacacaactctaggcttgaggcatttcacgacccttagagaaatattaataagtgcatgtgctgagaatgtgaattgtcgctcacaatgtgggcatatgctaaaaaaaagagtttaatcctattttttaataaaattgcaaaatatgcattatagatgcctcaaagcctcaaaacccagagttttgtgaatttgactgtaaaaaatatcatctatctgtgtgtattctagatgtcttgcctcatatatctttttagcttattgttgcttttattcatttctgatccagtaccagttataaagtcttaaactggaagtgtgatatcatcagattattcaattcgcatgtttccatttatctatgcaactatgtgggccagtatagttggtacatcatactacttcatcctctttaagttggttttactatttcttaatatgttgaaaaatttagatatcctgtagggctccttgcaagacaacggagaggggagcttaaacgattgaatgatcagctacgtcagataaatgcagcactgagaagacaagccaagattgaatcttatgctccttctttgagctatgcaccggttggtagtaagatacctgaatcagaagtcattgttgatccccagaaggatcgcttaatttcatatctgagggctgggaagaactatctgagaaaccaagcccctgataaggcatttcctgagtttaaggctgcttttgatcttgcacaatccttgggtgatcacgtcgaagagaagaaggcggcacgtggattaggtttgcttcccatcaataatttactttcatgcctttttccatgcacgtttgaaactggatgttataatagccaccttgattgttgtagaatcccctatagattgctttttttatgaatgaacgtttttgaaatgctcgataatgagacacatgttcatatttatgctgattcctgaaggatcttttttccatgttcaataaaaattcaagaaatgcgacctgcaaaaatgaaaacagcaaacaatctactgatgttcgttttttatttgcattctttaggagcatctttgcagagacaaggcaagtacaaggaagctataaagtaccactccatggtgttgaacatctctaagctgaccggagaggacgcaggtgttacagaagcctacggtgcgatcgccgactgctacactgagcttggtgagctcgagaaagcaggcaagttctacgacaagtacatcgcaagactggagaatgactgaacagatttaaagaaccgtgtgtgcaacctttgagagctcaagtagggctgtgtcccatcttttgccttctttggcctgtcttgtagcaacgtttttgtagtggacgctcagttcatggctgtaactgaggcacatgccatctttcaagttatttctactaaatagtgtcatcagattttttttttctttgtctggtcaagatcggcaccatgttgtgtaaaatttctccatctgttccaagttataagcatggctatgtatctggctatgcttgtcctgaatcaggaatgcttatgttttgaaacagaggggagtagttgtagcagcaggaaggcttgttcttaaccttgttttagataaaaggtttgcaaaaaataatagctttaattgttttagataaaatattcgcttgagattttggggagtgacggatgacaccgttacctatgttatgcagttttttccccctaaaaaatggttataggttttctgtgagtttgaaataattggcctagccaatcatcctttcagcgatacaaattcatcgttctggaaaataataggttatatagctgctagtttatgtcccactaaggatgcttggatttgatatgattttgcccggaaattcttgagcaattcaatcacaatactacatggagattttccaacattgcaacgtcaaacactacatatgaagtcacctaaccgaatttggtttagtataagttataaccaaggacgcatatactgtgcacgccagagaaacttggaggtcaaagatatcttcttatctgttgaatgaacatgtacgcatgtgcatactctaaataaatacggactaaataacacaccttcgtagaaattttgccatcaagggtaaatatttcttgagttcacaaacccacatgacgctttaagtgggccaagggaccattttagactaaaagataaacttaaaaaggaatcttttgaataaaattaaaacatgaagggtgccaatctacagaagggctccctccctacaagtttcaagttggtccaggacatttcagtttttcatcagta

SEQ ID NO: 47156 - DNA, 2131 bp, Oryza sativa
tttttcttggtgagtactcttcttgataggaatagccattctttcctcataagcaacttccacttgtttttctggagggaggctcccatcaacctgatcaggggttcttttcctgctcctgttatgagtgctattgctttcatccatgctatgctctttctcctttcctgattgagagatttgctggtaattagtctcagcttgtttcttcacaggaaggctatcggatctatggtactctttagctttcacttgtccatatccagcttgtgtcttcacaggacgatcatctgatagaataacctctctgacatcgcatgatgtcttctctgtagtctctttctctttgcctggtccaacatttcgtttgttgccagcttcagcctgtctcctcacagggagatctgatagattggtccctttgagattgcatgaagtttgtcctgcattctcctctttccctgatctagagttatgtataccataagattcagtttctttcatcatagggaggttatctgatagattatcttcttcaacatgggaagcgatcctccctatgctagtgtggttatgctcctcagctactttcctgtgcttccttgtccaatcaggatggctccataaatggagaggtggtgcagaggcattccacccttcaactactttatcattaacatcaacagaaccaggcaaataaaatgcctaaattacaagaaaaatgtagaagacgggtatatgataaaaagggaagtttaaacttcaattaaattttcctgacggtctttacctttcccgaaagacaatcactatcctcccaaatcaaatcataaggtgtcttcttttgatccaacctgatggccaagagtggagacagatatggaagtaaggaacatacgttacaccaaaataaggatattatgtcattatgtgaaagcaatatcaggtgaaatctattttttttaaaaaaaacatagttaaaatccaatcagccccaatttggcccaggcgatcagatgcttcacattaaatactttagatcttcacctgatattttgccatgtgttagtaagacaagttcaactcaattttctaaggaatgggtacgtgttggttacctttttgtttcctttgggacaatcaatataacgagcttaggcttaaaggtcaatgccttgtcaataaatttgttcgcaagagatgctttgactccaaaaggaggattaagccccattatctaatcaagaagcaatcagatgttataattattttaaattagcaaatttgagttaaataatgtccaaattaaacatactagtttggatccatgaggcaattcttttggccgtacagtcatccaatctttcctttcgaaggcgaagcaattctgcaaaacacatacacaatgcatgcttatcagaatgtgcatgatgacctgttaaatgctaatagacttcactttctggctatgataatagagtttggaactggctgagttctaacgcatttgcattgaggagttctatttaatataaaagaaagcaatggcattccaaaggatcataaaactcagattttttttccccagaaggaaaattgaatgaaaaatgattgatggcctccattttacctgcggctggataagatcataattcttgaaatgacacttcttctggactttgtcaagtttttctttcatcaatcggctgaaatcatttgcaccacagcagaagtccactatctacagttaattaaatttaaaatgatcaaggactggtgtaaaacacagcattggactagtaatgttatatatctgtttcagtcaagggataatttttttttaattagaacaatattttcagaccaaagaccatatggtccagcttctattaaaagctgcaaggaacaagtttcttttgcacgggacaccagcttacagtggcaggctgaaagcacagggacctattggggacaaccatccatacaccattcgaaagacccaacagaagaactcagagataacccagctcgatttttatgagaacagtaaaggtgagccatactcaaatatttatatcaatataaaggtgtacaattatcatatgataccagatacaggggtgcaggaatt

SEQ ID NO: 47157 - DNA, 13862 bp, Oryza sativa
  unsure (1)..(13862): unsure at all n locations
caaccacatgagacaatggtacagtactacagttgttcaccttgctagcagacatcaatttgaacacaagcatatgctacattttggctctggttaggtctatgaaaatttatgaccacaagccttgtttgggtgcatttagacatgaaatttggggttctctagagctatgaccataaatgtgcagttttttttctcgaaaatgcaagagaactgcgtttcatttcattaaggggaagaaaacaaagcgaagataaatgtgtggttttaagcgatgtattaataagaaatcatggaagtatgcatgaggtgatgactgcaagaaatcagagtcaggttttatcatttgtgtttagaagtaatatccttgacaagtttatggtgtccagccaaaattttcctagggaagatccagtttgttcgcacttgtttccttctccttaagtcattgtatgtatagtgaataataagataagtctttataagtacatcaacatagcatactgacattcttatttgatgatctacagtgaggataagaggattaggaaaacatgtcaaaaaatctgctccctagccagatggcaaaaaaacatattctacaatgttttttttttaagagcaagggttttcaagattctatatttgaatcaggtatataacacataaaaaaaagcatctattctacaaggaagaaagatgtcatttatgccttgaattggacctttttaaaaaggcaaaaaatcagacaggatttctggtttttctctactttcttaaacctagtctgcaatatttcatttttttttgaggcagaaaacacttctcaacaaattgcacgcaagtgtgtgtgtgtgtgtgtatgtatatgtgtatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatgtataaccgcagttaaatgccaatgtggttatcataactcataaagccatcagccatgctagaaaacagatgagaggatatttgtttacaagagccatcacaagatgacacttagattgagactggagactttcttttcaatgaatctctgcatctaacatccggtttgtggtgcctttccaaatagatccggagggttaataggtatatagttacgcatttatatacaactcactatcaacatatatctggattcaagtatacctcaacaagcttttccacctttgtaaaatgccgaccaaacgaactgtagcgagtaccataaatgaaaggtgatatatatactctgagcttactctggaaggacaaacaatcaaaagttggtaaaaattagtcaaataccattacattgcaaggtataagggaaaattttccacccaactaaacatcataactccaaagtaattacatattggagaaaattagtgctcattcatgcaaacacatagtgaaaaacatataagattgcaacttttcacagaaaaaaaatgtactcaagtcaagaatagtagatgttttggacatgatttcagacaccatttggaagcagcgaaatggacccatttttgataatgttccccctctgtcctctcttggatggcattctttaagaatgacttatcccttctttttcgtttaggtatagatgagagatcaactctttcctcctggttgagtcgtttgtaatttactttattttattataatatatttactgtgggtgcttcccctacagtgttttccctaaaaaatcagataccaatgctggggtggtattatttacccctgttaactccaaacagagcatacccacattagtgcaggtactgtaactccgatgcacattctcttccaaccttcctactattgccatacaatacacttttttttaatgaaaactagtattacactattactagtagttgctgaatcctgtcctccagccagcctgtaggtcacctggtcactgctgttgcctccatgactgtgtctagagggagtgagggactcattgtaccaaggctgtcactgcctctttgtgactgttatgcactgagtcactcataagggttgcaagcgtcccacccctactagacaacccaagtgccggacataccctcccaatggccaagcctaaacaccaggattaccttcagcacccacattggtctggcttgggagctacccaatttgagcttaggaacagatattttgtatgtaatgcgtggtgagctcagccaccaaatcaagagctcagcaaattagtgatagatcgccccaagttgcttctgtggtcttcttttgctttaaacaatgaaggtagtgttaggagatagcctagttgtagtagtatgtgcgcattcaaagaacaacttttatggcaaccgcaagataattaaaatcaattaagggcataaggggcaacactagactaagtccccccccccctcgcagggaaaaggacaggtatacttggatttttccaaataaatccaaatgacagctattcctgaccagacccatcggaagcagatagtgctaaaacctccataatatagctataagttagtggaggagcacaaatttgcactccaaagcccaaatggtataagacatcattcaagtaaaagagattacttagtaatgccagtattaatggaaaacacaagtaccagttaaaacataagaagagtaccatacatatttcacactagatgttaggaatggcactattaatggaaaacacacaagtaccagttgaaacataaaaaatatgtataatacatatttcacactagaaagcaaatacgcatcacatctagatccaggagagggcctgtgcagtaaaaatctcaaagcaggaataatatataaagattctataaaataatgcaatgaaaacatagattaatatatgtctagtatttacatacatgccatcttgtaagctgcttcaagacttcaggttcacagactgctttagcatcattaacattgcctccattttccagcatttttaaagctgcccctacagcctacaaatgccatcattaagaaaacagagtccaaataataaatagtgtgaactgggtatcaattcatgttagaactaatgacctgaacagaacgctcaagcttgccagtcgcaataatcctgtcaacctgcctgcccgagtatgcatgagttgaaggcatcaagcactttcttgaaatatcctttaatgtcaaataagaggcttctctttccaccaaggccattaccctataagacaaaaaaaatctgtttcagctccatgaggattcttaaatataaacactacatactgtctcataatcatttactctgcacatgacaagatagaacaaaacaatttaaaaagaacagaatatgaaagaaaactgtagcaatataaatataaatgactaaaaaactaaaaatgcctaggtacaaatagttgtgacctcgatccccagtaattatgtagaagcgactcacctcttctctgtttcgctatccactctaggaaatgaactttggggtatcttcgtagaagtagatgatgaaggcatagttaccaacagttttccctgctcttttgcaggttttgtaatgcctgtagaagcatccttgagcagacatggatcaggctgtggtgtatctttcaagaacctggcttttttcttatcgggtttgacaacaaattgctcagatgaactcctagcactaatctttctggctcgatcactttcttgaatgcaaaccatatctggcagttttcgaagttctgttgaaagttgatcaggaactgactcactaaaaggcctttttttcttaaccactttggttgacttctttagaagtcttgcaggtttttctatgtttggagtacgagggaactttatatggtctctgatcggtgtgtcaatgtcagtatctatctcatggtccctgtaacagtttgcaaaaaatcattgatatgaacaatgttgacaaagcaagtagcaagactgtggataagtcacatacaagcaatagatcaaaattcttttcgaaagttcccaagcacgtgtaatagcatcctcattttcactatcttcaaaggaaatttctctgaaagaatttcaatttccatgagataaatagaagatattataaatgaaatggaacttgaaaagacaaaccacttgtttcataacagcacctaggcaaacactttctgtgatacgactttgggcagcgtctgcaaacagcaaactgtaattcctcttgagttctgtcctccaaacctttgcaatgaaaacaccaatggctggggcatgtaaatgaatgtccatttgctatcttcatttccagttctgaggcttcatttttgtttttagaatgaagttgtcgcgcaacacattttgggtggtaaaagtgcccacacgtggcattattacaaagaaacacctaaaagaaagatgacaaaattaacaaaacataactagaacaaagccctgaaaaagcatcccacacttagaatttatgatacggacttccaaactgctgaactatatagcgttacttcctcttgagtgaatctaaaataatcaggtgttaccatggcggcattaaattggcccgactgataattgctacatcgttacacaacttctgtcattagggcccatatagaagcagtcaacaaatccagggccagcggtactgtacatgaatagtgcccacgtgatactgttcaagcaagttgtgtacattagatcgatttgttagctatttccatcagtaccatcacctcagcaccatagcgcgaggcactacaacgctacatgaggtggctgaggcatgattagtggaaaatattggataagcaagagaaaagggaaaattgaataaaggcccactaaaacttccgctagagattcaaaagctgcagcaatctgctagatctgatagtagtggcgtggaatctgcgacagcaggccagctgtggcaaggaagaaggtgactgcacacttaaatcaacaacccgctgctttctgtcccctttttccttggagctctaacccttccttctcctgtaagacaaggcaccaacaccttacttcctctgtgtgttttgctgctgtagcgacaccttaaccatgataaagttccttaagggtcaagtcatcccagctatataaggatgaggtcgtatctcaattcattattcaaaaaaataaacaagtctttgcatctccctcttctccacagccattgtgatgcggctgccctcatggcaccatcgcacccgctgcatggacagctcaaacaggcctatggggcccttatcccaaacatgccattagaactttggagcttacaagtagaatgctatagcactatgccactatggccatattcaacaataaaattcactgtatcataaaaaaaagaataataaagaaacagtttttttatctaattagaagtgagcaatgacagtataccttagcagctggtccatctgaaggttctaaagctccacatataaaacactgatgttgcttatgctcacaatttttgcacaagaaagttttcattgcctaaaaatcagtagaataagataactcaataaaataaaaaaggtgtagatttagagctctctttatcactcaaaatgttcaagggctacctgaacttctgcctcagtgtacccaagtgtatcacaataggaatcttcaccagtaccgatttttgcatggaaggacctcatacatggaccatcacagctacagtaggataatatgtaaggattaagaattggtattataggcctgacaaaactactccacagtatttacagggaatttcatatggcaatgatgaaaccagaagcaaaatatcaatgaaagcaaagtatgcaatgttgttttaagcaaagtaaaaatcagtaagaggaactaaagaaaaacaaaattgtaccattgtactatcatttttgttgaacaatggataacaccatagcagacagggttcagtcatgatcacatattccatgtagactaattatgtgagcgctaaaacagttagaaatcaactaatttaagtgcagactgaatggacaatctttctaacattgcatggggcagaatcactagatggttcattacttcatttggtaaacaactagtgtttcctgataaaaacaaaatggtctgaacaatttgctagaagaacatgcagaggaaagttccaataacatttgaaattatcatctacaggcaaaatatgttattaataaaagtaagaaaatgatggagcagctgtacaaaaatgctcaaattcttgaatgtagcagccttgattggatctgttttgggggaacccaaaacctacttaaattcatttgcattcttagtttcttgtagattgttttttttggaaaaagtccaaatacccacctaaaatttggatggaaatccatctagcaccctgaactttaaaaccggacatccaaccccctaaactttgaaataccgttcatattaccccctaaggtggttttagatggtggttttgcatattttggaagattaaacgaacaactttgaataactaatataacatatgtgcatatcgtcagttgcaagccattaaatttatatttatacagtgataccatactatattatgttggtacttgtttgtaagtgagagctaacaaggggtaaagagaaagatttaggtgatcttaatatacaagcaaaatcttcaagctcccttcaccaacccgctcaccctatagaggaagcaaaaccagattgctcggccagccacagcagcctccttcctcacctgacctgacatgacaagccacctttaccacacaaaaatatgccccctcggcccaccgggcagcgatcccccggtgaccctgtccccacccacgtgaccccaagctccaagctcccttcaccaacccactctccctatagagcaagcaaaaccagattgctcgcctagccacaaccagcctccttcctcaccttatgtgcgagccacctttaccacacaaaacacgccccctcggtccaccgggcagcgactccatccccacccacgtgactgccccagtgacatacattaatgtgtgtgtgtccaatcaataaatcgtgttcaaaaatagacatggtattgagcgttgacatgtaatttcgtgtgtttagagtggaaaggttaacaaagttttgttttggatagctttatcagtgtcccatttctaaaccttcgaatgaaccatgccattatacatatggtaaacatgaattcatggtcaagctcttacgttattgatgtacattgccttgcatcgtagaataaatatattaccaggaaagatgttttttattacttttcttggatggttttaaaaactaaagagtgaacgtgcttgatatatgagttgagagtcagattttaaacatataagatagttgataggagcatagacttattccttccgttttaagtatatgattagttggcaccctgtgccttgctgcaggatttgttagttttatcgtcaaagaaaatcaatgttttaaatgattaggtgcaactctgtgcatataaaaaataggtgataatgtggcttcataccctatgttattacgatacaatttatgctttacttttcaaagctttattgtgtattgttatttccatgtgtaatgtggatgtagtaccaattagattgtttggacctctctgcttcatctcaagtttgttctgaacatgggtttagtatgctatctaattgttcctaataaacaaagctcgcatctaagccaataatttatgttgtattcaggaaaaaagatatgtttgcgttatctttgaggactttgggaggaaaaaacatggtgttaagtgtagaatggataacactgtcgtaggtgactgtgaggtgaatggataactaatcaatgattgagttagatgaataaggctgtgttcgttctgttgagttgggaactcattccctccgtacggaaaacggagcaacatattttcttatgtttaattaagtatttactttttttgaaaaatggattaatatgattttttgaagcaactttcatatagaaactttttgcaaaaaacgcaccgtttagcagtttgaaaagtgtgcgcatgaaacacgagagatgagttgggaaaaccgggggaagaacacaacctaagtaccttgttgatccaacagttgtatctttgtaccaatgcgatctaatggcttaaaattagtgatgacatggcttcttgcgtgtcttgctttataggagtaagtgctacttagtgggtaccaattatatggtaagatacgatatgtccagtgtgtatgtcatgcgatcaaactcatccaacttatatacaaattagataaaaaacactctgcaaaccaccttgaggatttatataaacggcattgtaaagtttaggggggttgaatgtctagtttcaatgttcagggtattagacggaccttcatccaaagtttagggggggggtagactttttcctctttttttcaaaaaaaaaaaaaccctatgtagagggacttttaatttcccttgaataatttaaatacctaagggcctgcatggacaggagtgattcagattttaatcaaactatttaaccaggaattagtgataccatcacctgagtagctactttatagaatccaatttctcaaaatctaatcccaaagaccaagaagtcaggcatgatctcattgtacatgagacacaggcttcaataggcgaggacatgttgttgttggacagctagaaaattcagacattgctaagcagttaaacctgatagctgacaaagtctttagaaaatgggagcaaaactttcgccaggtaatatggaccttcctgagcttgacatcgcaaataattcctatttctaaaagcaagtatctgtgccaataatgaactctccccgtgtatgttcaactgactaattagactagaagtcgcgtacattctgaagcaatgggaaaggattttggatgatatatcatctgtataaatatcaaacttaccataacagatctcctccattgtcacatatgctacagattgaatcaaataaatcttcctcctcttcttcatcagattcaatattgttatccacgtcagccatctcctctatgtcctcatcatcagcaatgaatggaactttgatttccactttatctgaaccaacctagacgtaattataataagggtaataattaatatcatagatcagtttttcaaaattttctagagaaggcacagtcccaacgtacctcactaaactttttcctagaagtttcttgagtgaagccttgcaaaatctgtaaaaaaaaacatgataagatgtcaccgtaaacagcaatcaagcacattgaagagttgttacaatcaccagagttaaattacactatactggtgttattatccatatcaataatcagatggtgcgtacctctgatttagccaaggtcgagtctttctcagcaaaatgcttaattagtaaacggtgatttcttaagtcatcctctgagggtctaacctcaaatttgctgcaaaatgaaaatgtttcaacaaatctgagtttttgtcatcaggcgaagaatggacagatagtgaatgaaggagtactcgaaaattttacgaagatgactccacaggttcttttcaggctcctcaggcttctttttgaggaagtgaagcatctgcacggtgatcagtattgtccgaatcttctcctcatagctgttcttgggttttgtaaggctaatccagctgccttctgctgaaagaacagaaatctccggctgcttgccttgaaggcctagcttccaagcgatcactttcctgtatactttgatgccaggatcagcagttccccacaagaagacatccttcttgcattcaggaacctcatcggtgtctttgaactgaaatggcaagactgataaacagacaggcacctcccgtgcatcaagaaggtagtaattatccaccgcattcaactgaggctcatcgtcatcatcgtcgaacatcatcctggataccggattcttcgccattgattctcaccggatgagttggacctagcgtggggcatgtgggttcagttgaaccccaatttttttctgggaacaattgaactgtttattagtactagggttaaggcaaattagggggaaaagcagcttccagatcttaggggagaagctagggctaacgcaaattcgagaagtagcatgggtgggtaacggatggatgctcaccagcgacagcgagctaggatgcggcggaagcagcagcgacggcggcgccgctcctcgtcgcgggatggagatcgacgcaggcgggcggtgggcgaaatccgaggaaacggccggccaccgaggggacggggagattgacaggctcttgtcttgcacgggcgcaccgccgcagcccgcaaggagtcgtggcttttcctctttttttccttttttttcttaaggaatcagaggagtcgggagtcgggactcgggagaggagagacgagtaagggctatgagattagtacatgataattgtgaagcgagtatgggctatgggattagtacatgataattatgcacgtgcaatgcacgttgtggtcaatatttaaactaaaccaaacatattgcacctaaagatttttttattgatatatattaagagcaggtacaatagcagtctataagctagcaataaatataatttaaagagataaaggaagagagagaagagcagcggtctacatatctgtagtcagctgtagcacggactacaagatataatatgtgtatgacaggtgggaccatgtattaatagtatagtaagtaattattgtatgaattagctattacaaaggctatagatgatttgaagctagtagtaggctatactattaaacttgctctaaattattttaaggctactatgtttgcgcataacatagtgcttactattgctttagaaaatgaaaagataagaaagatctatagcttcttttctatactttatactctatcattgacccaaccaactaattttattttcaaacctaaaagttcaaataacaaaactaaaagagggcaagatgcatatcatatggaaagatggcaaatgccacaagaccaaacctgtgcaccaaaatttgatcatattggtcatgtgtagttgccaactgatatatatgtgattgtcataaggacaccagtttctcttacataccaatttacacataatctcataagacttgaatcctggatactccaattaattaactttgcataaataattttgtaactccataggatctaacaataaagaaataaaaagccattgttctttgcataaataatccaaatgttcattgttctcataagctccaggtcctgccattctgccccaaaggatttgattacaccaacttgaacttttaaccatgttcaatgctgtctacttcgaacaatagagctgcttctccataatatctgattcgagatgtcaacttgcctctcacatgaaagtatagaaccaaggttataggaataatatataatttctgaaataacgacaaacctgaaaaattttgtagtccacctgttgcttcattccgttggcctttaccaaatttagaagttagacacaactgagctcagaaggttcaaactacactcttttcccttacttgaccacaacaccaacatcaaagattcctggcgtaagatcagattagagaagaggcaattgcttaagaaaattctattatttaacaacaatatcttctacatcactattttttatttttgtggagcatggtataaagaagaaatggaaaccattattcatatttgtctatacatatcatgacactacttagtgtgttcaactgaatattcactaaataaatttgtaatcgtgttgtttatgtgttgtgagctgagtcaagtagagtagcatacatatattcataagaaaattcgctgcatgagattggcactggatcaataaaagaacatgttgaactattgatcgatgcaatagtttgacacacatagaccaccacatggcccctcatgggtgaaaaacataatatagaacaattggattatgcctgacaattacggggtcatgttctttcttgacctgggaagaaagatttcagctcttgcagtttaatcttgcatcatgtgcagatgtaaaagaaattaacagctacatctataatttcttttagaatttatcatgttaatttagaacgaaagtgaaacagtacctcatagttaagtaatgtcaccatgtgcaagcttcattttcaaatcttcctctgaagtatatcttcaagcagcataattttgctgagaaatcaacctgagataacagcttggttgagcatatttcgttggacattatcctataatagagaacttttacggtgtttgcattccaaaaagggtaaagatccaacgctcctcaatcacaggtactatgttaaaggtatttaagtattgatataggtatttaggtactaagggtaaaaatataattttgctagtagagtgaaaagggtagaattgtcctccaaattataataggtaccgcataggtacgctctacacggtatcagcgtatcttacacagtatcagcgtatcttttacgtggtttcttgaagatttacgttgtattcgagttaagccaccgtagtgttctttgatgttctcttttgcgtagatttctctagatttacattgtattgttataatacattagtagcctaattatgtgaattttttctacatttacattttgttccaacgaacacatgaaaactcataccttaattctgttaaaaattatagtttgtttctagcaagatatttatattgtgtttcagaaacatgaccagttaaaatatcacccaaggttagcatcaatttaaattatacatttcatcaatttatgatacttgcttccaattgaacatgctatgtcaagttaaccaacaacatacgaacacaagtagtctgactcatggtgagcatgctcacaaacaccaatatcatatccgctagataaatatgttatacaaacttcatcaacaacagcctttttacaacaaaaggtcataggttcaacaacaggctaactctaatattagttcaacgcatagcattctgtaccattagcctatttacattccaacattcgcacatatacaaccaaaaggatgcttctgggacatggcggttaaaaaggtgcttagcagccattcatagcccttaacagtttcctctgcaattatgccacaaccaaacacaacagtgctccggtgctgattcaatcccacaaaaggaataaatggcagtttatacctgttggtcatgtatgtactgtcaaatacaacaacatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47158 - DNA, 8192 bp, Oryza sativa
  unsure (1)..(8192): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnctgcaaaaataactcttgggcaggtatggaagaaatcatttgaatgaaagatgaatgactttttcaaatattaataaaaccaaagggctaatgaaagaattaatgatttttttaatagaagacggcaagagagttgccggttatattaaaaggagaataggtgccttacatatacacaggagacaatgcaatatggatacactttaacaagagaagaaaaagaacattaacgcttaaggcggtttgaaagcaaattccctatctcgtatgtcatctagaatgcacgctactgcacggctggtatttgggggtgtctgtttgaaaattttatcatttctcattaaccatatatgccaccaggttgtaattagggcactgcaggcagaaagaattaatgatggatagcatatattttaccatctcattcggtcaccccatcttttgttcggtgggtcatttcatctcacacatgagtgggtaatcacgtaacgcactcccccatctcagcctctgctaagtgctaataacgctgattagcattaatgacattaattagttttaatgataattgttagtattattatttttaaaaaaataatacataaatagaactttaactcaaactttcaaacctagatttgaaaaaaattcaagtcaagatttgaaaactttcaactcggatttaaaaacttttaactaaagattgaaaactatcaactcagatttaaaactttcatctgaaaatacaaaacattttattcaaatttaaaaattttcatctcaaaattcaacttaaatcttaaaaactttcaactcaaattcaaaaccttcaactaaaattacagatgaaagattcaacttctaaaataaaaagatcacgaaaaaaatggcaaaaagaaacgaaaaaaatgcgtggacgttagcttttccggggaaaaaacatacggacatggacgccatccgcctcacgcatgcacgctaggttatgcgtgggccttagcccttatgggcctaaaacgggcgccgtcaacgcgcgcgcgcgaattagctatcgcgatcacatcaatgtcagacgtgaatcagacagggaagtcgcgtggacgagcacgggaatcggactatggatgacgtaccaaactttagcaaaaaaaaatacctttaatttttataacattagagtagatagatttattaaatctttacaaaaataattttttgtttcaaagttttacaaatctacgccccctaacatcctttaggatgtcgttttttaaaatgcccttccaaagggcgttatttatgacgtgatgcattctaacggtcacatggagagcggtcggccattttacaggcaacccctggccgccctcccaaagggctaaagggggcgcttgcaaaacaaccggagctgaccatttacaggcaaaactcttgccaccctcgtagatgttcacccgaccattacaacaccaacgggcgtgtgccatatcataaaaaacgccctttgagaaggcgttatgggtgtagatttttaaaactttaaaaccaaaaattatttttaaaatattttaataaataaaattaaaaattaaaaaaattccgccaaacagatccgatcatcatacacattcggtctttttgtttgtatatatatatgacacacatgacaaggttatggacaaaaatatattttaagcacaagtttaagaaccattcgtgtattttactcttatgtttttaataatttttatgaagtatgattaaaaaattaataatcaaatatgttcatgaaagatagtcatgacaatatcctaatgttatctaaaaaagaacataggtactcccttcgctcaaaatataagagattttgggtagatgggacacatcccttcattcataaaaacaagttgttttagacattggggctacaactttgtccgctattttccatcgcaaaatatttataaaaaacactagtattgtaatattatgaaagtacctttcaaggtaaattctagacataattccacacgtctaatgtaaatcttaactacttaaaaaattggtaaatttccgtttgtcatacttattttcgtccatcaatcatctgattccctctccccctctcactcgtgtgtgcgtgacgctgcactttgtctgtctccgatcgttagcacgggaaaaaaacacacgtcgcatcgtattaaagtaggaaaaatagggtttggatagggctttattcacagctaatacgaaacagatttgctccgattctcagaaaaacggaaagaggacataaagattgaaaccccctcaatcaatttcggattatctccaaggatgtggcccgatttgacggaggcggcgacatcaggaggcatcgggaagatgaggaaccctggacggaggtaggggacgacaatgtagcgataggcccacacaacagtgagagaaccatggggaggctaattgtactttcgattgcttgctgggccggacgcgtgcttgcgggccgaggcggagggaagggatgaaagcaggccggctcggttgtgggctgagggaggctatgggctgaaaatggcccagagtgtaatgaggatttttatttaaataaatattgaaatgatgtttgtattattaaaattaacaattaagctctgaaaatttcaagaaaatttaagagagtgtaattaactatggagaatttaataaaaattaaatccagccatatcatttttatttcccacacttacttacttttcaattaatttaaacacctaccagcttaaaaaaatacaagtattccggaaatttgtatttacttaattaagtaatgtaaatatttcttaacctctcctcaattttctcatcttttcttcatgttgcaacgcacgggcactttttctggtaattaaaaatatatttatgtgtaaagttgacttgaaacatgtccataacactataacagtacgttttcatacctggagggagtaataactaaataatgtacctccatcttgaaggtatggttttcaaaggaaagagtttctataggtttttaggttgagaagactgacattgcgtagcataatgacatttaaccctcaatgtatatataaatggggctcctaagcacaatatcatacattatgtaacattatgttgttacatgactactctatatatctcaaaataaacgaatgcagtacgaaaatgaatcttgttttactacaaatcctgtccagattgaagagttgccctcgtgtgtatatcctgcgagtttattttttcttactctagttccctaacacgtggtaaagaaaaagaacaaatcggaccactggttcacccgtccaaccgccagtttatcggtctaaccgccggagcaataatatatttacttcatgttaggcaaaacagaacaagttgtgaaaggtaagtacatgtatgtttaaaaaaaagaagagtgaataatacaaaagattacagtagcatcaaatcaagaataaagaaacaaagagaatctaataaaatcaattccataatttatgcactacagaaaacattttaagtagtctggatagtctctacaaacattttatttagtctggatagtctcgagagtagagactagatctgatgaaaaattacaaaagtataaacattcgaacgggtgaccaggcttcagtttggtgggcccaactgcgaacgtgacactggatcccatctagtcgtagacgtggcaagctcaggccagatgacaaatcaccgcactgtgaaagcccttagagcctgaaccaagctgataaagccactagttttcgcttttccaagtttattacgtgcgatccgtccaattcttgtactgtgcctgacatccttggctggctgcctggctgttctaggtcaccctctcaccaaatggtgtctggcctagcgactagcatcacttttcaaatcatcacggtctagcatacttctgaaggatcttttccctcggtatgtactgtagtacatcttgaaaagagttttcccttctaaattcagttcatcttatttagcatctataggacatgtttgcattgttcaatctagattgtacatatataactggatttatgttatgtgaagcaagaacatgaaaacgatttatgaatgtgtataactggtacattccagtaactatgtaagcctatggggatatgcatagcgaaagtacccatggtcttacagtattagggataattagtttgcaaggttacatcaatttcttagaggtataaggagggatgtaaaagaagtctacattaatactaccaccatcccaaaaatagtgcatttctcactacctggacagcactctttttgggacggaggtagtaaaagataaaaacattaagtctggttttgtacactatgaacaaatatattgccatggagctatgaagaacatcaagtgctatgctcaagaaagatatacaggatacaacagtggcagttagaccagctgccacagataaaccaactaaataacttccatgaaatgaaagtgaaaactaaaaaccgctgaatgtgaatgaacaaaaggtaacatgtacttggcaatagaaatgtatcaaaaacaagggagtcctcagcaactatagaagaaaatcctggattataggagcttgaggtacatcaggttgagtgcaatgcctttctctatgcttatgttttccttgacgatgcccactcctagatcttctgtgttttctcgcttccttcccatcactttcaagagggtttgtactctctttatcatggctctgttgaatacttggtctagaacttgaagtgggatggcctacgaaatcagcatctacattatttttccactgagaactagattcaccagagtccattttgtttataattccttcgtaagccttatctgaagccttttgtgaagatgatggcttgagatctctacccaacagtacaccacgtacagcaccagataaagaatcttcttttggaacacttgcactagccaccatagaacttaggaaatcctcaccatccaacttcactacttttggtctggacttgacggccttcggttttttcccaccggtaacaggctggatagtcttcaatttatcatccagagcactttcgctgctagcaggcagcagaggatcattggcatgaggataatcaactggcccatcctccgcttttcctgttggaagatagtacagtccgtgccttttacggtgctcagaaagaagagaagatgaaccaagtgataatgcaggttcatctctggtttcgactgaaccacagctacgagggtagaaaacaattgaagatgacagagtagtgtcatcttcactgatgatgtcaacaagctcggcaagattttcattcaggacaagatcatctggaagggatactttctcttgtgcatttaaagaaacaggccctatttcgtgagataatactgtttgcatattcttaacaagctccttcaccctgctatgcttatcatcatcaaacttgctttccttcaattcttgaatctctcttagcgaataaacaaaaccaatcaagtttcttgccctttccaggacctcaacctcattgcactcaacaagtgggccaactgttgtttcaatcaagttaatcatgtgaacaaccgatttaagtgaaaaagggtccttttccatcatcctagggactgtaatttgtccattgctagacccaattggagcgtcacttcccccactaacagtttgatccatagataacccattcaatgctacagacacttccttgcttgaatcactcaacctctcaacatacaaattgcaacagaaagtgatcactttaagtactgcctggatgtagacagctctcacggacatcggcaggaggctgatccttggctgcagaagtgcctcaacaagctcaacaggatccttcgtgaagttcacatactcacctgagacccatgcagcagcagaaagaacaggacaaaggaggtggttcccaagcaaagcaggatcaatgagaagagttcgagatgaatgaacaagctctggccgtgcatcctgcaccctcagtcccacatcaacaagctgccgaccaatctcatccccctgtgcacaatgaaggttcctacccatatctgtgaggagtgagacataccaatcaaagtccgataccagctcatacacattgcgcccacatgctgaaagaacagcgccaagaatgtcatttgcaaactctgggtctgacttcgaagcatgactgaccagcatgccagcaatgtccgtgacattgctgtcatcgatcaaccccatcatgaggtgcaacgcctcccggcagatgtttgagtcagcatcacccagtgattgggcaatcacaccacggcattcatgcaacgtcgatgcatatgccggtccaagcataccaagcgcaaggaggccaaggtaccgcaggttgggatcatcctcagcagcaaggaactccttggccttcccaatggcaaggcgcacggcagcatcatgtgccggcagggcagttagaacagtccggatgcactcaaacgtcagggacatagcagcagaacgcgcgagaagctggcacaccgggtcgacaatccgtgcggcgaggcgtgattccagaggagccagccgtgcaaacaccttgagcaccttgatgagcgcccagttggagcgggacgtggtgagcagattgtagaggtcgggcgccagcggcaggaaaggagcagcatcggctggcggcgccgacagctcacagaatgcagctgcggcagcagccgacgcccgcgggtcaggcgacgcgaggcacgcggccagtggcttgaaaaggaccggcacggccgcggacggcgaggcggctatgacacgcgcggcggccgcgatcgcccgggggctcccgcgggagaggtggggcacgaggtcgtgcgcgaggtggacggggaggtcgggcgcggcggcggcggcgggggaggcgagcagctggagcgcgagggccgtgacgtggtggttggcggcgctggaggtggagggggagaggtccttgtggagctgatgggtggcgagcgggaggagggagagcgaggccgggtggagggagagcgaggcggcaaggtaggcgaggcgcctgtggggtagctgcggcgaggcgatgagctcgatggccgggaaggcgagcgggtgggaggcgacgggggcgaagtggagcgacgagaggtaggtcagcttctggagcgccacggccttggtggcggtgtcgggggcgcggatctcccggtggatctcggagagcgcgcgcgcgacggcggcggactcgccggcggccgacgggtcggcgcggagggacttgacgaggtcgtcgagggagcgctggaatagcgtgtctaccagcgatggcgccggcgccggcgccgccggcggggcggaggccatcggaggtggatcggcgtgagttgggcttgtgggggatttgccggcgcggcggatcggagatgggggggaggcgtgggtttgggtctgaagaagaccaggggaccgacatgtcagtgctggcctcttctttctttttcttttttctttcctttcactactgatgaaattttccttatgcaactctctcctttaccgtcaattcgtttcttaaatcgccagaatgtacaatttctaaaaaatttctatacaaatatttttaaaataatttttaaaatttataatacttaatactcaattgatcatacgctaatgagatttatcgttttgcaagcaactcaatactcattcctaaatgcatgaacgaacagacccttagctttatattacctcgatctttaaaggcaaaattggttatatagcatcgaaagttcacgtttttggttttatagcaccgaaagttaccggttcactttaatagcacccaaagttcaccatgttcctatttttaatacttccgtcaattctcgatcattttccgtccgtcttgatccagccacacacacgatatgacgtttctacccctcacaagtacaagtataatgcatgtcaatgaggggtagaaatgg

SEQ ID NO: 47159 - DNA, 47486 bp, Oryza sativa
catgctatataaccaatttttcctttaaaatatagctatttctagcatgatgtcttgttctaaaatgaagctatttctccacctaccttctcctcacaaccaattataaccattcttctttaactactttttttttcaactaatcataatcttctttcaatcatttccacatattttcttaatatccgtactaatctcaaaaatactatattttaggacaaacaaagtacgagactttacaagcaccaaggctacatagttacaggtcatgcccagcacgatgatgtgtcgagtccaaaatctggtgatttcatccccaaatttttgtcggaatgctaatcccaaaagaaatagctcatgtcgtcctttgatcaacgtgatggcaatttagcagatgacctcataaataaaaaagggtcgcaactgccatcgttagcatgaacaaaaaaaataccaggattttcttgctacctgcgatcaagtcggtaatatttcttctgattaatgaaagttttgaccttaaaaggcccaaagtagtggctactacaatacgtccataagtaatgggtaatgccaaggagctcgttctgacaatgtaactgctgaaatgggataattagcaccgaaaacaaacaaataatcaacaattgcaataaagaacctactcgagttcccacttccaacaccagtgcgaattaccttagcaatttctcgaccggcaacagaggtaaaagagcaagaggaagacgagatagtggaagaaaagtaagacaggaacatggaatttaaagaaggataatacatgactttctgtgtccaaaacttctaatgctacaaaactcccaagaattggtaaccgttatagctcacaacgcacaaatacaatagggcttctgaaatgtacaacagcggaagatccttgatgaaagattactcaagctttcttgtcagacctattaagattcaaattgaaccacttctttttacttgatttatctttaccatctatgttaccattctcgggactctcagtggggtatctactactgctgctaccagctccaacagagttcaccatagttcgttcggtcgtgaaggaggagtggatgtcatccctttctctcagcatatcatcaacctgcagaccttacaactctttagcaataatccaatattattagcaaaagtaatgaagaatcatcagggttcagcctgagaaaagaatatgatacaaactttatcatattggtagatataactatttgatgaatttttgtgaaggataaattgatgccatttggtttcaaatttttacagcgcacggttctgtaagctacactactatgtactcccttcgtcccaaaataagcgcagccatgagtttccgtattcaactttaatcgtctgtcttatttgaaattcttttgaaaaaactaaaaaccagaagtcacacgtgaagtactatgcatattttattataatctaataacaagaaaaatactaatcataaaaaaaattaaataagacggacgatcaaagttagacacaaaaaaatcatggctgcgcttattttgggacggagggagtatacttcaaactattaacagctaggacactatttaattgacgaaagctcagaagaaactgcatgtcaactgacaaaataatttaacaagtcaattcttaataacagtatttctgctgcattcactgacatggctgcaccaaccatgtaaatccactgtgcagacttaattatacgcaacttcagtttgagtgggtaccaatattcatataaccaaacatcagtgttggcaatcaagtactagctgcaaatatgcaactcacttagaatttgaacacagcatggagccgagcacttatggcctcatcttttcgcttatgcttatgcttatcatccaaatttgaattttcaaccttaaatttggagttgattttgggatttttttcatcgtagtttatttttcagcctttgcttttagatcgttaagaacacgtatataaaagttttatttacaaatatgccatttcgcttatgcttataaacagccaactgatggggccgttaaaaggttctaacaatgcaatgagaaaagcataccatggattcacacaattcagagtcaacgttcagactgcaagactgatagaagaagagatatatgctaataagaaagataacacacgactgttaacctaggctacaagttataacacatttcttgcaagttataacacagtgattgcttttcaaagtgccctccaaaggaatgtttgaaatcatattctagtttgacttattttctatgaaagaaaagtttgccggtgcaagatagacatcaagaaaatgtggacatgtaagaatttagagacattgtttgagagctagcctgacaccctctgtctagaagaacagagaggcatctacatagtcaatatgctgctgtgccagttcaaacaggcacaagctcactacaaaaaaacggtaggtgtgatatgtctaaaaaacatcactatgtagtctgcttcacccttacatagttatgttagactctacaattagagggcaaaaatacgatgactatttcttttgtctctacaatatccacaatgaagtatcaattgtgaaagaaggaaaaggcattcagaggagaaaagatgtgctcaccgcttctttttcttgggtgtatctgttggtcacttcttgaaaccgcgctaaagcctgcacaccatttaactcgatcaaagctctctccaaattgaaaagaaaactaaatacatatttcatgtgttatgtagaaaaagatgtagtggctgacttttctgtactcagtttcaaattggcgcaaatcatttctcttctctagaattttagactctatttcctttagcctctgtgttgtgtcttcgtaactctttgcacacattgcttcaattgtatagctagctggcttgaaaaaattatcacctgaacatattaattaggatggatcagaacggaggtatgtcattcatataaacagataaagtaagtttgcagaccgtatacagcaaatatatgagttccagatttgagagccgacacttcgcacggctggagaccttccaaccttttaaagaatgcagcctcaggatccttggccattgccaactgtagtaggaagcagcaaagtctcacatcacatcaggcccaaagagcataaaaactaaagctatatagcagaacatacataccgcattcactgttgaatccatacgatacacttgaaaatgcaagaaatacatgcctgcagatgtcaccttaccagtcttctgactatcttcctggaagtgcggaaaaaaactggaggttattatttttcttgaatatgcaagagagctgcgtatcatttaatcatttaaagaagaagaaaaataaagaacaaacagatccaagtatccaaccccttacaacgtttgacacataagagccacataaagaaaatacacaaccaacactagtagcaatgcaaacaacaagctctcaagctcctttgctccaataccacaccaaagggtgccctccatttccaccaaacgcactactaatacaacatccctggctacatcatttcactgcaatatgtccatatctcccaggctattacaataatcaaagagttgagccttttcgtttcagtttgtgaacttgcttgctcggtactactaactcgaaaacctaaccgaatctggttgggtatcatagcatgtagacccgagcacttcaatccatatttgccgggcgaccatgcaagaaaccagcaggtgttggataatctcatcgtcttgatcacaaagacggcaagctgctgggtgtggcaagccacgtttagcaaatctatccgccattcaacaacgattaagcatggcgccatagaaataacttacaatgtaatggtgcccaggtttaccaaatgcattattaagctaggcttctaattttttttatatgcagcacattaacatacccaaaatgaaaaaagaaaaaaactgcagattaatgtaaaatattaagatcatgttcatagctggttaacaaaaaaaaaatcattgttgaccattcatactactccctccagccacaaaaggtgagttgttttttacttttcacactcaaaagacataagtttgatcacttagtttattgcatgaaccaaaataagaacttagacaagtacaatattaatgttcttgttgtcacaaacttggctacataatgtccttatgcctaaaaacttacgttccaaataataattacggtcaaaattaatttgtgttgactgtgtgcatcctaaaacgacactcttttgtgattagaggcaataaagaagtcaatggcagaactagagacacagatgcaaacttggagacagctagaaaaacattggctcttatccatttggcagacagttatgtacagcatgcattggtcacttactgcacaattggtatcaaaattaaaattggagaagtccagaaatatcacattttacataaatgataaatttttatatacttctagtctacgccatggactcttggagagctcccacccctaccactcgcattactcataagtggtagcccacaatagtaaatgggtcaatcttggctgtaataaactgcttcgaccataagcaggtataaacagagtacaaacggtccaaaaccctaactacccactcctcttcctccctcctcaacaaccgcctctcaatcctactccagctgacagcatcccaaccactcccacttcaacaccaatggtgacgatggcagtggcctccaacgctcaacatggcacctcctctcctccaccagatggatccatcaatgagacaatgacacaccattgctcccccagcccagcagtggcaacctcaggagttggaatagatctgacaatagcggaaacctccagcgctctacaggcggccttgtctcctctagccggatatatcgacagcacccctgtcctccagcactcgatgccaccgcatccaaaactccttcaaccagatccatcaatggcatcccacttatccaccagaatggtgatgaaggcagcctactgtgctcgacaagctcaagccaccaccaccaaaccttgtcacactgttggtttcactgccttccttccctgacagagagtccttgcatgctggtccttgcagcctcctctcctatcacctcaacctcccattagagaacacaaggcagttactgccgttgcgtcaccactagggccttctttctttttgttgttggtttgggttgataacacagaatgtaatggatctacatgtacacgcattatttttcttgtggtcgtaaacaagtaccattgactgtaaggtctcatgaacatggatgtaaatagaatttgcttgattataatgaaatactaatgggattgtaatggtagaaccttttagctcaaagtgtaatcaaaatttacccctaaaaagtgccatggagctatattacaattctgatagtatttatggctgcggactacttcatttacaattatgtggtgtcattttatctatgttacgattacagccatggagaaatcatttacaatcgctgtgaatctccttcattcgagggaggtatttgtagttgcaagggaggcatttacatcttgctgtaaaaaataaaaggatcttagccacccatataaaaactcatatagataaacggtttttatatgggtggctaagatgcttgccttttttagggcaagatgcttgattcatttatggaaagataagggtgcattttcttttcattaaggtggccaagatgcttgatttattcatggaggctaagggtgcaacagagaacctcattatccaccaaaatgcaaaatgtcacgttgtttaatatgccgagtgtaaaacgccaggtatttatgaacagagaaagtaatactaatccatggccgcatggcattccattgacaaataatgagaaaaactacagaacacatcaatcatgcaattatataaaggcgaaggctcgaaagtacctgaagagctagtccataacctccattaatttcttgttcaaagaaaagcagctatagagaaatatttggcaaatgagagaattaaataatatcctgaaattcaaagagatgcagaacataaaagcttcaattccagagcaattgaaggaagaatcaacctcataccttaaatttactttgtgcggctgaggtgactctgactacaatgcctgactgagcttgttcttcacttattgttacaccataaaaatgagcactttgcttgtcaacctataaatagaaaaatatatatggtagccgtcccattataaacaagaccataaaactggtattggcagaacctttcccgttgctgatgatccaactgggagaggtctcactgtaactgttccactcatagcttcttcaagaacattaggagatactgtggtcttgattggaacaccgagcttgctaaatggtataatatgtaagaaagttagcaggcaattagtgatcctcgattctttctagaaaacaattcatacagatgctacagtcacctgaaaagtgcagcaaacattgtgttcacagttccaagattagataagtcaatttccatatccattccttcattctccaatgcctaagaaagcatattacaacagatggttagattacaaaccaacaaagttacattatttctgccaactatgtgaaacttggcaaacacatcttaacctacacgcccaaaataattgaagtgcccaaaaaaaatgccactgagttcaaatttgtaaaggataagctgtggcccttggctacttggtacaattatcatcttaagcatattatccatgacaaaggtacttagtcaaatggttttggaattaaaatagttatacatggtggaaatgcttctaatagtttgtcattgtttagaggatacaggttctccattacctcttaagtggtttccagggattgtctatctatgacaataaatatcaagctagatgagtaatctccatttcttctttgacagattccagggattaaatctctctctatgagtctacgacgttatataccaagctgccttagctaatcttcattgcaacagaagaaaggattggagataaataagcatccaaaaatctcatcagttatcacatggtctaataaatacacagcaacagtatgatacatgtcggtgcagcaccaccaaaaatcaccttgctggtcatttatcccagccaaacttctccttattgattgatcagaaaaggagaagaatgcagaaccattggagtaaaagcaaaatacacacaaaaaaaactgttcgaaaatagtctggtagtcagcatgagattatgagaatagcacctcaaaaccagcagtatcatattgcctccgtttctcaggatctgacaagatactatatgaatatgcaacctctttgaagagttctgatgcttctgggttactagcattcttgtcagggtgatacctatcaattatatcaggaactatgagtacagaaaatcatcaagactgcagatgcaggaatgaatagatagagcagccaagcacatcagtacatcacacatgtaaatacatgacagacctaattcagtaatcaacagggtgtaatggggtgacagtatttgagatgacacattaatagagaggactaataacccaaagaagaatcatgtggtcatcaaaaggtagtaaagtatagatatccaaaagaaggaaaaactcattgccatggaatttgctcatatagagcatgctaatccaaccctttatgaccaaacagtttctaatcccacgtaaataatctactattagagtacaagtcactctaatgttctcttttctgttccattgttagtattgcaccaatcaagaaacaaaatgttctatggtaacccagaaacagtacaaaaataaggaaaagacagtaagctcttatgtttgtggtaatagcatctaacaaaaaatgtatctatagaaaagaatgcaagtacaacaaagaaacttttgctctcattcaatgcttcctcccaaatttaatccaaaacaataaatacacttgattcagtttcatctagaatgatgtttgcgacatatcgtttcttcagaaataatgttacatatctactcagcacaataaagtaagagcatcattcttcatgttgcattggaaaaatgcggttgttatgcgttcagtggtccattcaataaacacaattggcacatcattagtcaattacacatgggcataaagttcagcgctgttaaatgcatctggatgagaaaagttcaagtgattctgaggaacaccacagctgatgtggtaaattgctgcagctgatccaaacaattgtgaccatgagcaatgaagccgcagagaacgcattcaactaaactagcagcacgttcacattctgcaatctgaatagcgcgatcgaaagcagcagcaagagcagggcggacaggttagggggagcacgaacttgagcgcgagcttgcggtaggcggacttgatctcctggtcggaggagtcccttggcacggagagcacctcgtacgggtcccgccgcatcgccggcgccgacggcccctccatcttccccgacgacgccatcacgcgacgaaaccctaacaacaacaacaacaacaacaacaaccacacgacaaggtcacctcgccctgcccccccgaattggcaggaaacccgcacgagatcgggccgggagatggggctcacctgaccacggcgcgagcgggagcgcggcgcaggcagatctcgccggccgcctcgcgagagagggaaggcgtgagccggcgaagcggagaagggaggccagggggaaggatgggtttgccttgcctcgaggtcggggagaaggagcacgagccgcaaggggattcagttttttcctcctcctttttttgaatttttattcgtggaattttctctttttttcttcccctcgaccttggattcggtgctcctctagtcctctctgctccaaggaaggggaggccgctgctgctttgaggggcgtgcgcttttcttttcttttatattttttttctttcgatttgattgattaccacgtcgatggattgtttctccgtgctttttgccgttttgggttttccaagtcgagctgcgaaatttcgctatgccgaaatttcgtcacttttgggaacttccgctggcgacagcgtgtcatcaagtggcgtggacggccgcggtatgaaatactcttccactttaaaattaatggtatttttaaatattatgatatttatagcaataatatcataattatataaaagtaaatacaaatatcgatcaataatattatttttttatcaaataaaacttaatttataatctaccctatagttcatcattgatatcctacggaccttattcatcaaatctaacgtccgaaaatcatccaatacatcagatctgacaacagcgcatgcacgcagggtcaccagctgaaaatcacacacgccagcaaatcaatcacggcccattttccttcgcatgccttcctctacaaccctcacccactaatcaccgcgtccctgtactgtctgccaccgaggtcgcccagatcgacgcttgccctagccttcctagatccctcccaccatctacctcctgtgactcccgtctttcgcaccctctcccacctttttttcacacgctcaatgcccgctggcagtcgcccacctcgccgatctcctctgcgtcgccaccaccgaaacgtaggtcatcatagtgctcagcttgatgattgcggcttcaccaataccagtgctatattatatgtattttctttagtattggttatggcacacataggattttgtttccagataaattgatgagtgtgaaattctcctgacttggtaagaaaatctataatttgttggccaagtagttcctgcttaagtacttactaaacaacttttgcaaagacgtccttttttatagcagactgtgagacttgtctattctcgatcaattatatagattcgacagacaaagcaagtaaattcaactaatttcttggtgttggaaaatttgactgttccttgctgcttcatgaaaatgttaaatattttgtctttccattgaaagagaggcaaagagatgatagatttaatcccttctatctgtttttatatgctgcattgcactttgactagtgcttttgcattctcaatttcggttaaagtgttggtatgaaggttaatgaattgtctaattccgaagtcacccaataatttgttccgttttgtgtgaatcttataccaatctcattatatatttaattgtcaaaataactgttaagccgtagcgtaagcatgtgcatgttaccagtaaattattgttggttaaatatttagggagttaaatcttaaaatgtgtgcacgctttattgggatggagagagttctataaagttgctattgttttccatatatataaataaatttcatgaaaccttaagtctcatatatttttatttgtttaaagaaagtattgaggcaaaaagttttgtacaagcttatattatatatttgattattatatttatactagtaaagtgtctcagcgttgcaacggaaaaaactaccacataccatgcatgcacgttgtatagtatttgggggcaacggatcgtaatgttgatgtagtacatcgtgttctctttacccgatcatgaaaattgcagggattcctatttcgcgtgcacactggctacggaagtaacgcgcagccacgcccccctcgacgccctgcgcggttagctctgtaattagtttcattagtgctaattatggtaattagcaatattttccttttttggcagggttttttactagtagattgaaaagaaatctacgttgaagtcaaattttaaaaactttcaatcgaaatttgaatttttttcaagtcaatttttgaaaaatttcaacttttcatctcaaatttgaaaaactttcaattcaaatttgaaactttcaacccatatttgaaaacttttaacctagattttaaaactttcgacccaaatttgaaaactttcaagtcgagatttgaaactttcaattcggattgaaaaatttttaggttaagatataaaaactttcaaatcaagattaaaaaacttctaactcaaaattttgaaaacacatgtgttgaagattgaaaaaagtcaaaaaaaacacgaaaagaaaacgctaaaaataggagaaaattgaaaaaggaaaaaagaaaatcgcaaataaaaaaggaaaagcgccatgtggaggggtgtggaggctaaatggtaaaagaaatctgaccattgcccttggatgtaaatgaaaataaaaaaatataaatgatgaaaataaaaatctttatttggcgatgatttcactagtgaccggtagtaataaggattttactacgttgggcatgttcgaaagctagagcaatgctgcggtcagctttaggatggatgaaacacataaggccatccctaacctaatgactaaaatggtgtcaatagcattaaataagttgtcacctaggatgaaaaatgatgtagcaagtgagtaaatgaggaaagataagaaaaccagatcttgcatgacacatagtttctacacatcatctaagacatcatgtgatataagaaacattaaatttaagtatggaaaagtggtgtttgcattgaaagagtatatctagtactagtttcttgatgatatggagtttatgacaactatgtctagtgtcttgggttgggaatggcctaagagttgcatgggaaatttagccgaaattacttgtagcttcctatctggtgcttgatgagagcagaattaatgtttcctctgaccttgttgaacattttatggaaggtgaaggatccctgagcaagtgcgaggtgagagaccgcataggccctcgaaatttagggccaagtgcaaggtgattgaagggccagtggctgcgatgcagatcaaataaaaagacaatgttagtagagacatatcaacgtttgtgaaaaacatatagccttgctctattcatataatttgtattttttaacacaaggccttattttgaatttggcacggggcccccaaattgctagggacgaccatggaaagttgtacggcatttccctaattcttatacacttgcagttgcaattatcatatcttgtagatttttttcaagtcactcggtgaacttctgttgcgacatcaagtgtatgtggtatcttcctcaaatgaaatattcttgagttctggctttgtagactactctagagaatctgtttctgccgtcaggttagaccaaactgatggcaattgagatgttcaattgatagttcggtttgggcctcttgcaaatcgagaaggaaaaagtctatattatggtattacctccttcgactatggaccgagtcagattttcctctcttaaccaaaaaaacagacacatagtctccctcaatgatgtggccatcaagtatatgcatacaaccaagcatgagaaatataaaacattgccaaagaatacgttggatgaatggaggatctacaagatattaaagtccaatgagttttggaacccaattcggcctccggagacagcactgacttcaaacggacctagcaccttcatgccaactcgaatttggatgatcttggacttcgtggaaagcttatctcgctacctttcaaacgcatccagtctcatgtccaaattcatctcgagtcaacgggaatcgccaaaacaagacagtgttgttgctgaaaccgaacttgggccttgggccttgtaatagactaggcccatctcggaagtgtctccctccacctccacgaattagcacttaaccctagctttattttcctctacaaatagctttgtacatcctaaaaaaataattgggttttgtttagttgaattttgccaagtgccattcaccttgtctctagtcctcgttcgattagtcggcgactattgattcagagcccacaatagttggtgtgttgatttgccgggtcgattagatctaccacttcaatcgcaactattcctttgtgcttaatcacctattcgcaatatttagattgcatcttatcttgttcttgcagtgttctctcgtttgcattgcagggatcatcaaccgcgcgtcacggttggtatgacatcgtttgtggtgtagcgattgcacgacgtcctagacttgttctgttggtagccacgtcgcaaacgtcacactcgatcaaagcgagagttatcccctcaccagaagatcgggccacgagagaaagcgtcatcactcaactatcaaaacggtcagtttacctcatttagtagttagcacaacagtctcgtctaacgtgacgcattgacttggcccacttgtatctacgtgacatcatagtcagtacttcaacttttttaaaatagctgccatatttgtcccccattcctccacctctctcctctattccttttgtaacagccctacattcataaccaggtatttagaagtgcatttgttgtcgtttagatttcatatttactatattgcaatttgatcattggcgataacaaaattaattctaatcggtaaaattgaaaccacttctatttgaacaataacttgaacagaagttacatgtgtaataatttattcaaatactagtttatttatcaccaacaaatataaattttgtggaatttttactctctgtttaggcctcctaagaattcaaaccaactttcagcctaaccaatttcatcttttcaccagaattaaaatatttcgaatttttgagtgaaactttgaaaaatggaacctagaaaccaacacctatcaccacaacaaatcccttaatttttgaactagttttacctagtcaaattgaatttaccaagagagggaaagaaaataaatcctggaaattgcaaaaacgaatatgtactcagtttttcacctacctctctcaccctcattaacagccacgacttgggcccacttgtcactgaccttgggtgcctctttagccccacaacacacccatgggcgtgcttccacctcaggacttaagggggggggcagagataaccccttcttcttcctcccctttcatcttcactgcttgttctttcttttttttcctcaagctgagctctcatctcacttctcctccccaaatcccatccaatagcccaagatcaattcatgcatgttagatcacaacaatccccatcatccaagctttccatccatcccaacatcttgcacatgcatggagagttgagagagattgaaataggagaagagagtggtggtttcagcctgcatggttgcagcagcaacatgactttgtttccctctatttggtgagcttccttgccatccatggtgcctttttttttatttcccttcatgttgaacatctacagcaacattcaacaggtcatccatctccattattgcagctaggaggtggctgcagctcatccggtgttaatctcttttgatttcggttgaagcagccctaggcaacgtctcttaccgtcagcccgaggccttgctccgtctcttgccatcagcccgaggccttagcctcatgaccctacgtccaggttgctaccatgtgagcgaagtctggtggaatttggagaaaagggggagcgaaaatagaaatcgatttctgagatagcttttgagctgaaagaggtttgcgctttaaaaattcataactagttcatatgaactccgaattcagtgaaccaaatttctgtggattaagaaaaacgtgatcttcaatgttgtaaaataaaaatgaccaacatttgtactggttttcccagtaaaaatataaatagctatatgtatcccttgtgtggtctagctcttatgaaattcgtaagaaattattggtaaaagctaaaattatgaaaccaattttgttgagcttatattttagtactctttgctgttgtggtgttgtttttggaaaaactacctcttaaatcatgtttaggagtttatttagcattcctatgtttctaacttgtaagatctataaataaataatgacaacacatatagctgtgaaataatttttcataggagctgtgagtgatgtaatttactctaaaaataatcattattatgaaatcttggtttgaaatgcattttacttgtaatgtactaaaggaaacgttaatatttacagaactgccattttcagcacctaagagcttgtcattttcatatctcccaaaccataagtgataatctggtgattctttcacctaaattcaagttaaaatatgatctacccactgtatttatttcataatttattgatcattttgcatgtgcatgtttatttggctcttattcgcatattgcttcttttcgatagattcggagattccggagagtaacgagccatatcccgaggaggatagtgactaccctcagcagcaaggcaagcacctaagcatatagaacctatactttctctaaaaatgatttggttgcaatctatacgtatatatatgcatgcattgcctagatattaatattgtcagtttatggtgtatgggtagaacctatttatgcatttagttcttgtgttattgctgtccttatatcctattaccacttgttgggattacttgggatttcttattcattaatgcttagccatgcttagtgctaatagaactatagggatggacagtgctattaattgtggtatataaacaacttgcattattgggcataaaacttgagcacttacactaaataatggttgatgaaatatgttggacttggacgggtgatagggcgatgatgggaggttggtttcccctgatgcaagtagccccgtctaggtcgttaaggaccgaacattttgacatctattcaagcacccttcgtacttaccacatgtcttatttgggaccggcttgttcttactagttctactgtgatcatttataccacattggagagttgtgaggcaggtagcctttggagggcctcgggtgcctaggtttggccgggggtgcctcctgcgtggcgcgcccaccttggtcacatcacgcacgcacgtgactgagtcgtcgggaaccccagcgtggtataggtggttggggtggggctaagaaagggcatttaatgagcttgaatcacttgtgtaccgcacttgacggggtgtgtagcatttgatctttgttcatttcgtgtgggtccaattgtacacctctgatcaaagtataatctattcgaatagccgcgtcctcggttatggacaatgcttgatgtgttagctagttatgttagcatcaaatgtggattattatggatgtgattatgcttgatggtggtgttggcatgttgtgccatgttggtatggactttggtagtccatggatgatgatgagagcgccgtttgggctcatttgcttatacatttcagaattatatacttgctgtccataaattaaaatgatgctagatttacttatccttgcttattttactcattaattgctcaataaaattagctttatgcaaatgttgaacctagagacccactgtaggctagaaagcttgcatatttctctctcccttatgtatatataattttgggtaagacttgcgagtacaatcttgtacttaaccggtgtctgcaattttaggagaggattccggttatgagttatgcttcttgtgtggtcattgctctgccgagggcggcgagggcaatgagtgatctcttgcagcttggctcttgctcggttggtttgccctagtggagttgtggcaccaccggttttatcttttgcttatgaactctatttgagacttccgctgctatatttatgtgttgtatgttgagacctcggaccctattatgtgtcatatacctcgctgcactttaaccctattatggtacttgctatgtttattaattgcttgcgatgaaagtgtgagactagtcgcattcctagggactagctaagcacgagtaacgggttttgatcgcttgagataattggggatagcgctttggatcgagtcactggggtatgcttttggtcgccaccttcgagtggttgacgggcatatgacgtggtggactggcaagctatcttacggttatgtcttgcgctcactactcgacatttcgtttattataatagaaggttgtcaaccgcgatcatggacacattgaggacgagtggctatttatgcgtgtatggatcccacttctccaatagtatgtggtggtcgcgttggacactggatggtataatactcggggtgtccacaccttttatctaccatctctctataaatgggtgacatccaagcaaagccataccatcattgtcaagtcaggtgtactctcgtcagccttcgtcttcctagtcaagtctggtaccccatcattcgcttcttgcgcctcttcttcgccaccttcttgcctcctctgccgcatcccatcatttctggccgtcgatagatgcaggaacaactgtcctcattgttggatatcgagctcgttgatgctcctcctccagtcagcactcagacgcaagcctatccccacacccccaccgtcgaaggagtcgatttgcaccggttttgattgatgtggaaggtgttatacccggttttatggttagagagatgattcgatcgagggtaagagacgagagaggcaaagtagacttattctatcccacgaccacacccacccaggacccagctatcgaatcgccactttgccagccgacgaggcgacgatgcacacagccacgtgccatcctggcggagatgcggactcacacgaacggagggcgatggactggggcccgccgggccgtgctggcgctggtgaacggaggccggttggcgcctggcggcggaagagcggtgaaacttgaaagatgcagtggatggcggagtggttcggcatctgaccgtggtggcgcgggaagccaacggccgctgcgctcccttgagagttgaagccgagaagtcgatggctcgcggacgacgcgaccatggatgtggtcttctcgttgcccactgcccaggcatggagaaggtgattcaccggtgcttcggtttaaactaaaaactttactgtagttgggggttttcggcttgggttttatatttttttccccttcgtagtttttgttaaagtaactagctgggtggcccgcgcagttgcgtggctagcaccaatataaaattatatattttttacagaactttttatttttgttgctttgaaaagtcacaccagtccactacttattcctttgccatccctttattaatttgcttgcttgatctaccgcaacttctatttattcttgttggaatatttcaaaattaggtttttagagttaattgtctcattgggtttctttttataacttttagaagtccgtcaaatgtcgctattgtactcgtctacggcctgcccgctgcctcccctctttatcattgggattttcaaaatcgaatataattattgttgggttcattttttacttcctagaagtcccgccaaccgtcggcggctccaccactatactactctacaacctactcgttgcctcccctctttattgtcattgaaattttaaaatcgaacataattatcattggttttttttttcttttgctttctaaatgtccggccaactgtcatgacagtgctacttaatggtttacccatcgtctcttttcttaatcgtcggattctatttggggttttgtttatagcttttagatgttcaatcaaccgccaccactctggtcctttataggtttgttgcttctcccctatttattgtcatgtgtcatctttatgttctagatgtactatttttaaaaaaaatccatattttttattccgatatcttgttgtattcctacttgaacttttataattatttttctattttggaattcattttatattttatttcaaatttcaattaatcttcttgtcctttaagcaaattatttgctttctttttctaccattgatatatagaggtagatatctatatctatactaatataaaaagggggagttatctccttgcaatgctgcaggctaaatcaacatgttggtcctatcatcatctgcatcctcatccgcatagctctcatccctaccgtccactgcgattcaccctcgcacagcaactccatggagaccactacacttcatacgtccgatggataacagaaaaacggacgcttgttatgttatatttctgacacatgcactgatatgtgcaaaaacactttaatctattttttctcttaaattatgtatacaaattatgatccgattacactattaaattcgttgcaattaaatcttcaaaacaagaccacacatgaatatattctgacgaaatttttttagctaattattgaattatttttaaatgttgcacgatgttccaccaggtatattggaattgtttcactgaatagatcgaaaatgtttcaatcgtttaaatcaggctttgtttcaccttatataaaaacaatgtttcagcaaataacgaaataatgttccagttcacggcaacatttgatatatacatagtgaaacactataaatacactaggtgaaacatttttggtagaacaaaaaaataaaataaattctcttaatagagggtttctaaaatatgtgggtaatttgttgcaaaagaatgtttcaattcacttcaacattagatctatacatagtgaaacatttttttgaacaaaaaatgaaacgaattcccttaatatagggttttcaaaatatgtgggtgatttgttgtaatggagtatgtggtggagacacgtggcagtgtgaccggggagacgtggtgggtcccagggggagcatgtgcgcacgtggtgggggcggggggagcgcctgattttctccccctcccccgggcgaccaaggcgggatctttattgtaaagatttaattgaaacgaatacactgaaataaacggatcatagactgaatgagtagttttggagaaaaatgattttaaagattacattcaacttacgtatgcatatatacttgcacaaaagttgcatcctgagtttctaacatgataaagagatgaggaggtattagcatgtaacattaaaaaggtgattcaaatgggggaggaaatgatgaggcgtccgaagtttcgccgtgatcggacgctagatgggaagtatttccgcaactccatcctatctccaccgtgattttcgctcccatcaccgcacgaagacttcgcccgcggtactcgctactaccgctctcgaaccccttcctgccacacccccgcgccgccgaatctccctgacctgccaccgtcgccgtgtcctcctcctccccacccaccgccactgcatcgcctcctccccatcgcctccgcgtcgtcctccttcacactcaccgctgctgcattgcctcctccacaccgcctccgcgttgtcctcctcctcacccaccgccgtcgcgtcctcctcctccccatcacccgccattgcccgccattgcctcgccgatctcctctctcagcgccaccatcaatcccgcggcggtcaccatccccgagtccccttcgccggctcaacagtcgtcgtcagatccgccgacggggtgaactcggcaacggtggtccagctctcgatccctaacacatgtcgcgccgtcctgtccaccgccgccgcgtccgcctccccatcacccaccgcgtcgtccttcgcctcgccgatatcctctctccgcgctgccatcaatctcgcgacggccaccgtcgctgccatgcagccgtcgtcgtcagatcctcctccactgccccaacgccggttgtgtcgtcctgtccgccaacacctgcgcaccctccgtcgcttgatattcctgcgagttttattaagaaaattacttttttcctgctgttgttacacttgctgtgtggagagaaaactttgtcagaagctaaatattgttgttaatgttcttggtcaatcttttttcaggcattacagtttgcaaccaactgatgacgaaattgtgatggctccatgttatttgcaccaactgattaactgaactatgctatacacatgggagactttggttaaaggattagaaatcagagtaattagaaaaagatacatgtccaatgctaatgcaaaggcttgtagaaagattatgtagagtgtttacccgaaataatctctagacactacaacacgatcatgtattctgagagccttctagctacttcagacggtgacagtgcttacctctaaggtattgtttcccttgcactctgaattaacatgacaaattctataataaattatatgcagcaatcaatttgatttatctccgtacatgctgcaatagaaaagtgcaggagctgaaatatttcttcgccaggtcaagaagaataggaacctaaacggtcaggtataatcctaaggttctttattatgtttcacccgtgagtggtcatgtggtggtttgtgtgcatctaactactgtatcgactaacagttcaacatgccctattgatccggtgctaatccccaagagctacttgattaagctcactacacaaaacagcgtggatatgacttcatttggtgaatattcatgtatatacattatgtttcgtgatatgtacatatagacatatcaaggaatggttttgttatttatttgtagttttgttccatactccacaaaagtagaaaatcaatgattaagctcaattatgatttattcctagtagcttggtttatgtgacttgggactgctaaacagtacacagctagcatattttgtttatagtgctctagataatatggaggctctagacaatggtgtcttggagctccttttggttaaacaacatatccacacaaacaaggtacattatgcttgctctcaagaaaaaaaagggttcgtttattcagtgagtatgcttttcctctagaaatcattagctgtagtgttagattcacaatttcattcatttgcaagatattcaatggaatttctatgtgagtaaattgttgtgcatatgaaggtgcatttgacaaaggtcaaggggaattggcgaactaatcagtacgacaactgttagtcaactaattagactgtctagtgtttagttttaacaattccattgtttcaggctacccaaacttcagacagaggcagaggagcaggaccacatgaactccttaatatagatgatcaacatgtctccatatctatccaggatgttggtcgaggagattttgttcttttatttagcattgattggtctctagttgatgtatctaatttcatatactccgtaagcacaacatgaaggtaatatccatacgtgcaattatttctttacttttagtttttactattttataagataacggttcactggtcaagcaagggcaaagacctatatttgagtagtacctattagatgaactaaacttggcatggaacaattctaattctgactatgaaaattgatccatttctctggtccaggaatttgagtgtttatcttttcattaccaaggcttagattgcctcacaatgaacctgcccaaggaccaatctcttaaaatttggtttgagtggatccaaagacagatatattaaaagaaatgatgcatctttctttagagacattttattgaagcacaaggtgtgttgtgttcccgacctccgtgctaggagcgtgcaaccgaattgcattccatgaatctaattaattttgccttcatattggcttgttattttcaaccttgattggcatggtccggcatagtagtagttctttaaatttcacaaatacaaaaaggtaactactgtttttcttgatattgttgtctgattgctcttatgttgtcccccttgaatttttcttacatccctgatcaagcaaatcaatgatgtgttgaagaatattatcattgtgctgcaggttcgtggtacctaagtggtccttatgtgtacaaggatcaatctgctgatgatataaagattttgggctactattaaaaaaaagtgtagcaggtacccaaatctcacaccttattatgacatagctagcagaaaatagcttgaattgatattccagtatcacacaagtataagacctcatctaatataaagatctactgttgccaccttttcttttatcacggattggcccattggattggttctgagttattcgctacctgtaacctgttgacctcaataaaagttttagcagttgaactacagatcataactgattttaatctgaatgttttctaaatgcatccttgcttgatggatctctttagcataatctggtgatcgatacgatgcatgcacttcataagtacagtgcaagttgtgttagtttttcaatgttgctagctagcttgagggaatggtttgtttcaaaacaaacgagttagttgtatcttcaattcttctcattcttcatattctgcggaattgttcgttaaaatctctctatgttcaatcagatattggcctagcgattcactgccagtaagcttgggattacattggctaagtatcattaagtgtaagtttttttttaaaaaaagaaagctattctaagagcaggttgcaatatatgctacttggagttacaagttagctgttctttttctagaaatattgcagggtttttgtattttctaacaaagctgattgaccatgctatgctgttttgtcaggttcaaaggatcataatatatatctgcaactctactttatttaaaacttctaggagaagttgaggatcacacattcacatataagtgaccatttcttatacaaatgtaagcacaatttttttatgaccagtagcatcggatgatcaaagtgtcttttatctccgttttccacattctcttgaaccctgaggtttttttttctgtctaatccttaattcatacaaggaggaccttgtattattttatcttatgcttttgtatttcaatgaaacatggcttgaatataagtttatttattctttatttgatgtgaaatgaatcgtatactttaaatttaataaacttattgttgttgtaatatcggtgatatgctaatctcaagttaatttatatttgcatgacgtgccttgcacttgcacgattactagtattattcaagctttgctttcacgatgtaacacgcaacatgcaaagacgacaagacattcagtgcactagttatcgtgcagatgttttgacaatagaattaacaaatgaagaaaaatctatgcaatcttttttaatgtaatgcactccataatctgaatggttatcttataaaaccactctgttgaatcactactttctgaccaacaaagataaaaatatttagagggtacaaaattgctaagcacaatttatacattgcgatgttgctactttttggaagccaacaattatagatcagagcttggatgtggacataggagtacagaattcattactttcatctttgtccgtgaccattttcattatcttgtcataaacagttcacaaaatacaattcggtaaaacaaaagaatcaattctaaactcactatttcttctccatttattcatcagcaaagtgactcttcgacattcatgtatgcaaattgtaacatctgaaaacaacagcccaccataaaacatacctatcatctagtaagagccatatctttgcaaggactctttgctgcaatttctatctattggtattccctcttaaggcaataaaaatatacaactatctgtgctgaataacaaaccattaaaagtatataacatctttactcaatcattatctaaaaaaaatctttactcaatcaaccaattcatataataactgcgacgtaacgtcaacaaaaagaggcaaacatgggccaagagaaagctacagagacctagtttggcacaattttctggaacggcaagatgcagttattgcagatatcaaattaccatcagtcaataggtgcaggttttactaaagccaaaagtacatcaacagaaaaaagaagccatgacatgcactgtttataatagaaaaatcgaagctccatttatcaattacttctgtgttgaactgaaaccatccatgtccgtgtaatatacaacttaaaaacaggcaacaaggccattagttgatccatctcaattgatttaatcttcagactgacagaccatattaatagcaaagcacatagttacctatgtaaaacattctgcatctgctttcaattcgcataatctatacaatacaaacgaaaaaacagtaaaaaacatgacatgtggtcaatggtactctaacttctacacctactgaaaggttcaatctgaggcaaatacatgatcaacaggatatattagatttgtacccttatggagagctcgacagctagcttctgcctgatcaagtgatgatggggatgggccaatatttggtagcgctataatcatatactcgatatgtacagagagatttggaatacctatcgagagggtttaactgttaaaatcagggagccagttagagacccattaacttgtcttatagaatagcatcattcagtggaataaaacacagatgtattgagctctttcttagccttcaaaaggttatcaatttttagacaacaaaagatatagataagtggcagtcatattaggaacgtcaagcagtagtcctaacccaacaaaataaagagcagcaagtaaggcatgaagagggtatggtcagaaatgaaaaatgagagtcagctgcccagcaacaagtcttgtaaaatcactttttattacacacactacagttgagtatttctatagggcaataaaaattttctgcaagtaaaataaaggtagcaaacaaatcaaatgtcagacaaaaaataatagtacctgtcgtggcacaattttgcattgtagggcttcgtacattatccattgaaagtaatcagaatgaacggctatgtcgtggagcacgattatggtatagaattgcaaatgcaagacactcttgtgcatcagtacaccatatgacacaaacttcacgcgaagccctatccaaagatggttcactataatgtctttgaatatatgtaagccatatagggtcctatcactaaacttgttgaacacctggcaaagatggttccctataatgtagaatcctcctagtccctgtatatgcaagctcaatatctatacataatgattcaagagtgccaccataaaacaaaataaagaattctcatcaatatgccaaatcaaggccaaaagataattaaatagccaatgcctgtgtctaaatattccctactgtagctgaaatgccatgactattaagaagtttacacttaaatcgttgccggctattattgtttgacaattctagtacaaggcatcacttctctattctcctctgtaagtattcccactgttggaagttagttcatattggatttgttataaaacagtgatttgctatacagccatgtgaatcgccggttccagattatatccaaattttggtacgaaatggcatattcatatgttatcttcatgatctgtcattgccaaattttactgtataaatagaaaagaagcttactttttaggtcaactgtagaaatagaaaatacatgttcatatatatgttttcttacttatctacatggctggattttaccatagaaatataaaagatgaagtgaagcagaaaacaagcttacttttaatttcaattgtttgcttgtttggttctttccctctcgatttcaatgagaaacccattaaaaaggaaccgaattaattacaaacttcagaaaactgtaaaatcctctaacgacaacatgcttaccagtgacaacaaattaggtatctgtctatgtgaagctctagttttctaaaaaaacatgaatatgtacttacctcatgatttcattaaacatggccactaaaaatctttatagtagatgagatttatttaatttctgtaacatcaaaatttcggttcaagttaatataacattgatttactcacattgcaaggtggtagaaacagaagatgaaactgaaactgcatatagttatacaaagtgcaacatcaaattgaatccaagccagacatgtgatgcctcatctgccctatgtgatgcttcagttgtagctcttgtaggtgtggttgtcggcagagctagaagagtagtgggctgcagcaatgaaatagcctgcaatatgaaacagaggaaccaaaaaacaacaaatttagtatttagaccattacaaagctgagaaaggtctgggtatgtactctcctaacaattgtttttgaagatccaattgtaggaggatcaaatgctgctccctaaaaaccaaaacatccattcaggataagaagctaagtaagtaaatatgcaacagttgaggcggaactgggaaaaattattattagaggttagaaagcagtacattgcaattagcctgaatttaccaccaagaaatttactcttctgaataattctaatagaaataccattagtccactaaacctacatagccattaacaaacaaataccaaacattaattttctgattcatggtgaaattagcattttcttattttgaacgaacctgaatgttggtactttcacatgtaaagtacgatgattactaacatacacaccaaccaagaaatttatcgagataaagtttcatgccttgatatccttaagatattcggatcagaaaagccagagaaattcctgtgtttgtcacgcataaaaataagttgcggacctagagttgaccatggattactacatattttatatacaataatcctaccatggcctaatacatctcaacaatagagtcaaataaaacaaaattatcaacacggagatcaaatgattccccctatgtgcgagttgtagatgaatctaacgtacactctatcagacaaatatataatgatataaaagagacagagaggtataggcttgcctccatggctatcatggcttgcatccctaccactgctattgtttggctaattgcctcatccagtcgaaccaaaagtaggtgcttgagaaaatcaaaatatcatgtctcggtgcgccagtaatggaagcaaaccaaacctaatggagtatatataaaggggattcttctttttcacctgggaagaaatcaccacaaacctatcctctggtctcctcatcacctccagtataccggccgcagtcgacggcttggaggcgatgtagccggaggcgtcgtccttcacatgggttgctcaggcttgtgaaggggatcaaagtgacttcagaggaggagagtcgcagaccagaatggcgtgtgccgcagctagtccagggaaagggcataccaccccggcgccgtcggggtagtccaggcagggctccagtggaaagggggaaccaccccggtgccggtgggggcagaccatggtcgcgacgacgggaagaagcgaggaagcgcggagcgaggtgtagcgcggggatgggaggagggagcgagtagcgcttgggggcgtagtcatcgcgtggggacgggaggaggcggagtcatcgcagcgcgcgggggcaaaggcggagtcatcgcgacaggagtgcgagcggtggggaggatagggtcgtcgaaccacgaattttttttaaaagcaatatgattttaatggaaaatcgcaaaactataggtcagttaggcaaaatcgcaagtttagcaccctgtcgaacaaccgcggttcgacagggatacctatcgaacaaccacagttcgacaggtacatgtcgaactacgtgagttcgacagggtaggtggtccaaaaacaaataaaaaattacatgaacagtatcactacaatgctagtcagggacatatcgaacagccaaagttcgatagggttgcgtgaacagcgtgctacagtgatgctacagtgctcgcaggcacatatcgaactgccttagttcgatagggtattgtgaacagtgtgcaacagtgatttttctcttttttttaattattttaatcacctgtcgaactaccgcagttcgacaggtacccctatcgaactgtggttgttcgataggtaccttgtcgaaccacggttgttcgatagggtgctaaacttgcgatttcgcctaactgacctatagttttgcgattttccattaaaatcatattacttttaaaaaaaattctcgaaccactagggcgcccggacctgatgagattagatgtgatggcagatggacgaatgagatgagatggggtgatttcacctttaggattggaggggtgcaacttcgaaaaagctaatcggcgaccagtcgcgcgcgccctcccctgcacaactggacacgtgtcgcacgcgaaggaggcggcgaacggcgcccgcgcgtgagtctttttttttcggtttttctgttttggttttttttgtttctcttccgtttttttgggttctctttctgttttggtttttttttgtttctcttcccttttttcggttctctttctgttttgtgttttggttttccggtttttttctcttccttttccggttttcttaagatgtacatatgcaaagtttatattcgtatgtatactaaattttgtatttgtacacatacaaagtatgtattcgtgtttttttctcggtttttaatatatacatacaaagtttgtatacgtgtatgtaaagtttatatattcgtatgcaaagtttgtatacgcgtatgtaaagtatttttttagtacacataatttttttatatacgtatatatatactttgtatacacatatataaactttgtattttattaatataaagtttatatatatgtgtatacaaagtgtatataaagtatatacatacgtatatacacactatacacatcgtagtagtattgttgtagtagtactactactgtagtagcagcagcagcagcgcgcgccagtagcagtagcaggagcagagtagcagcagcagcaggagtaggagtagtagtactactagtagaagagcagtagcagcagctgtagtaggagcggactggtcgcgcgaccagtcgctcgttagggattcccgtgcaactcatttttatattactccctccttctcataatagggattttgagtttttatttgtaacgtttgaccactcgttttatttaaatttttttaaaattattatttattttatttatgacttactttattatctacattattttaagcacaacttttcgttttttatatttgcaaaaaaaaaattgaataaaacgagtggtcaaacgctgcaattaaaaacttaaaattccttatattatgggacggagggagtagtacggaagtactccatttttcgtgtacaactttgactgtatgaaatttttttataattcgtatttttatttatgttagatgataaaacatgtttaatattttatgcgtgacttgtctttttaaatttttttcataatttttccaaataagacggacggtcaagtgtttggcacggaaaccagggtttatctttttttagacggagatatatattattatccattattgtaattgtagtggggaaagtatttcgtagtgctagagatgggactagctagctgtctttcgacagatttcacagcccatatcacacggatttatcgatcattagattagaatccaacgtatattaataaacaactatagtaactatctaatggacctccatatgaacgaacccaataatacacatatgggttgcaaaatatttcataatgcaccagtctattagtaaaatatatatcatgttaaagttacaaatgtaattacactatagttacgtggacttacatcgtagttacaaatgtaattactatgtagctaaattgtagttacgtggtagttacaaatgtaattacactatagttacgtggtagttacatggtagttataaatgtaattacactataattacaatgtagttacgtggtagttacaaatgtaattttagtatatttacaatataagttctaaaattacacatgtaagtctctaaattatatatataattttaatgtatttataatataagtcataaaaattacatatgtatatccctaaattacatatgtaattttttcatgaaaatacatgctggcgaaatgagaaatttaaatttaattgtttggatctcttaaaatttggattgagtggatccaaatacagatatattaaaaaaaatgatgcatctttctttagagacatttttttgaagcagtgttcccgacctctgcgctaggagcgtgcaaccaaattgcattccatgaatctaattaattttgccttcatattggcttgctattttcaaccttgattggcatggtccagcatagtagtagttctttaaatttcacaaatacaaaaaggtaactactgtttttcttgatattgttgtctgattgctcttatgttgtcccccttgactttttcttccgtttctgagcaagcaaatcaatgatgtgttgaagaatattatcattcagctgcaggttcgtggtacctaagtggtccttatgtgtacaaggatcaatctgctgatgatataaagattttgggctgctattaaaaaaaagtgtaacaggtacccaaatctcacaccttattatgacatagctagcagaaaatagcttgaactgatattccagtatcacacaagtataagacctcatctaatataaagatctacggttgccaccttttctttcatcacggattggcccattggattggttggttctgagtcattcgctacctgtaacctgttgacctcaataaaagttttagcagttgaactacagatcataactgattttaatctgaatgttttctaaatgcatccttgcttgatggatctctttagcataatctggtgatcgatacgatgcatgcacttcataagtacagtgcaagttgtgttagtttttcaatgttgctagctagcttgagggaatggtttgtttcaaaacaaacgagttagttgtattttcaattcttctcattcttcatattctgcggaattgttcattaaaatctctctatgttcaatcagatattggccaatcaattcactgccagtggatggatgtactgatattgaattttaagacttgtgaaatgtgaaatgcatttgatattgcaatcatttgtggaatgttaattcatttgaatctgattttgtatgtactgaaatattgtatctgggctgaattgtatgggctgaaaaaatcagatgagttgtgtgggctgaaaaaattatatgggctggaaaaatatatgggctaaattgtaggggttgaaaaaatcatatgggctgaattgtgcgggctagaaaaatcatatgggccgaattggtgtgggctgaaaatttgtacaggctgcactcattaaaaagaagcaaataatatactgggccagctagaaacaaccccagaaaaaaaaattttgtagcccgtgagctacatgggctttagcaagccgaatcttattttgtgactttttttttcaaccatgtcaactgccaagtcagctgccacgtggcaagccccaggattttgtgataataaagcaatgtcatatgcttgtgacaatagatgtacaaacgtcacatactaaatttatgacggtggctttttgacgtttgaaattacgtcaacttcatatattatgacctaataaaatgtcaaaaagccacacacctctcgtagtgttagctgtgggattgcttggtatttattggatgcgaatccgatcagcataggaatcagccggttcggtgaatagtagtagtaatctgtaaaagtttttgctgtaaaagttttggccataggaatctctagaaaagctattgcatgtgaatccgtgtattatagcgtttcgtagtagtatttttatgtcatgtgacaggagtagtagtctgtaaaagcttccaattccataagagctattggaatacgtgtaataaaccttttcgacttttgaacttctaaaccggttctgacttgatattaccttttgtccggtttttattgttgtgtatatactttgcgaaactctgattaaatcttaccgctaaaatctagatctattatgatccaatggtttagatatttttctttttcttcgattaatgtgggaatttttagcctgcacaataaatacggtgtctcctttaattttaaggctgttttaataatttaatttaatagatagatagatagatagattttttccaatcataatttcagtttacttttcttcaatgttaaagttttaccaaacatagaccatactagtgtaaaccgaatcgaatacccacgcctaaaagcaacgacgatatgctggcgcgtggtagcccaacaatcccaatccccaaatcatcccaattttctggccacacttgcatccctctgccgccctcctctcttccacctggcctctgccactgctcccagctcccttctcatccactgtcactgccactgctctctcgctggccaaaggagaaggagaagaagagaagagaagagaagagatggcagcgacctcatcatcatcctccccctgcatgattgcctcgctacgcagcagccatcgctgccgcctttcgccctccgccaccgccacgtcgccgccccgcctccgcacgcttcctccccgccgatgccgacgcaacccctcctcctcctcctcctcctcccgccaagcggcggcaatctccatggctcccgccaatcctcgccaccgcctcatcgccccgatccacgccgccgccgccgccggaggaggaggaggaggcgcgggcgccacctctccctcgggcctacccagcgtgagtcgtcaatcagtcaaaatgcacgcagcctcgtcgcgatttcgcatgacctgccgatcgaactgacatgcgtgagctatgtatggattttatagctcgtcgggatcgcgcacctgctggtgtcgctggggatcgtgctggcctccgacaagttcctgaagcaggcgttcgcggcggcgtccatcaagttccccagcgccctcttcggcatgttctgcgtcttctccgtcctcgtcgtcctcgacgccttcgcgcccgcgctcgccaaggggttcatggacttcttcgagccggccaccctcttcatccagaggtggctgcccctcttctacgtcccttccctggtcgtcctgccgctcgccgtcagggacgtcccggctgcttccggcctcaagatcttcctcatcatttgtatgcacatcactacgctcctatcgttgcatgcattctgctacttctttcttcctcctgatcatcgtgcttatctgctccgcctctgcttcctccggattttacattctactacttcgtatttgatatgctgatcaattaacttgcagtaaatattaccacaccaacttgcattgtggattggccccattcataaatcacaacaattttacttagagggtgtttagattcaggggtgtaaagttttaccgtgtcacatcggatattatatagggtgtcgtaatagggtgtttggatactaataaaaaaaactaattacagaatccggcagtaaactgcgagacgaatttattaagtctaattaatccgtcattagcaaatgtttactgtaaaaccacattatcaaatcatagagcaattagacttaaaagattcgtctcgcaaattagtggcaatctgtgcaattagttatttttttagcctatatttaatacttcgtgcaagtgttcaaacgttcgatgtgacagggtgtaaaattttagggtgggatctaaacatgcccttggtttcagattaatttgcattcaatctgaaaaaaccgatggtgtgatgttatctggttttcatttcccagttggtggctggtttgcttcactcatggtggccggatacacagcactcaccgtgaggaagattgtccagacacagcttataccagctgagccgatgagcaagccgtctccgttcgcgacgctggaattctgggcctggggtgctgtctttgtcgcatcgtttgctgttgcgtatgttaaccccacagcgcttggcaccacggcaagaacatgtcttcctttcctcctcgcttcaactgtactgggatacatggttggttctgggtaaatacatatgctttttgtatacacttaatctgtaagatctgacgaagccaccagctgccttgtttactccatttctctaacaacatacatgggtcttattgattacttggcaggataccatctggtgtcaagaaagtgcttcacccaatcatttgttgtgcactctctgcagatttggcagcaatagcatatgggtatctctcccggtctggagttgatgcagtgctaggttgtaaactaaaccctgatcaatagtgctctaatcaagttgtgaattctgaaataagttggttttaattgccaggtgattacctcacaaaggcgccatctaatcctggagctggtgacgtcctgatgggatttcttggttcagtcatcatatcgtttgcattctcaatgttcaagcagagaaaggtagtgcttgctgctgtttctgcagaattattctcagttagcatgcatggttatggtgtgagatgattcatatatatcctgaggctctgtgtttgttgttgctggtgtgtgttggctaatcaactaataatgttttgcggtgggtaaaactcagcttgtgaagaggcatgcagcggaaattttcacatcaattgccatcgcatcaacattctcgttatactcaactgccatcctaggacgggtgatagggctagagccttcactgaccatatcaatattaccgaggtgcataaccgtggcgttggctctgagcatcgtgtctttctttgaaggtacggacctagtacatacttatattgctggaaatcaatttctgttcttgctggtcgatcagctagatatataatatggagtactcagctagcttattatatatggtatggatgacttagtttgtgtgtcccgggcatgcaggtgtaaattcttcgctaaccgctgcggtcgtcgtcctcaccgggctgatcggcgcaaattttgtgcaagcagccatggacaagcttggcctcaacgaccccatcgcgcgaggaatagggacggcttccaggtacatatatacctttgagttttacttttgagatttgttccggtccaacaaaaagtatttcgagataccgatacctcacgggttcacagtatcaaatcgtttccgatcgttagatctaacaatgtccatcctacataactagatccaatggtcggaaacgatttagatcaaatgatcgaaaatgatttggtataccacgagatagcaaatttctttacttttacctacctgctggctgctttttttagtaagttaagctgcatatatatacatacatacagcagtatgctctatgaataatgtttgcatttacgttgcagtgctcatggactgggaacagcagcgctgtcggccaaggagcctgaagcgctgcccttctgcgccatcgcttacggcctgacggggatcttcggttcgctcatttgctcggttccggccgtcaggcagagcttagtgttcatagctggctgacaacacgcacggtacatcagttttgtttttgtttgttttttctttttcactttcttttgggtcgtcgtgcgtgtatagagcgatgctcgcaagattgcaagaatatatgtatacagacacattttttgtgattatgtctccgttgtaataagaagcaagagagtaattttgtacccctcggtgctcactaccactaaactagctccaacattccatgaagcagcagcagcactgcagcagccagcaggtgagcagggtacagacagtgtcgtactgctagagcttgcatttgaccattttgtgacccaacgaactaaatgcttgtaatgtcttaggtcaaacatcatgtggcatatatacgctaacaaaaatcttgaccgtagcaaatactccctccgttttttaatagatgacgccgttagactttttcttacgtgtttgactattcgtcttattcaaaaaatttaagtaattataatttattttgttatgagttattttatcactcataatactttaagtgtgatttatatcttatatatttgcataaaatttttgaataagacgaatggtcaaacatgtgagaaatgtcaacggcgccatctattaaaaaaacggaagtagtatctacttttcagaagcaccaatgatttagccttatagcaaaacttgaaatttactgaagaatcaatagtcgtgttgtgtggagttatggatgcatcctaatcggggtttaaattttgatgcctacaaatattacaaacatgcagttgtgctttaaataggaactagcatggtggcccgcgcagattgcgtggttagcatcattatattttctctcatgtaatagcatatatgttttctcattatattattcaaatatattaaaataacaatataattttaaattttgcaataactttacaaaactactaatgtgtaatattcatatcatatttattttaggggtaattgtgttcttacccttgctttacagttcaattgtgattttaccccgctttacagttcaattgtgattttaccccttttttttttagggtttgtaatattgcccctgcttttttaaatgaagcagctgcttgcccctactatgttacctcatgtaatggttttaaatgtgtagtgaatggacaaatatacctctactataattttggcatgaacaccggacatgtttcaagttaaatttgtgcgtatttaatatgggacctaaatgttagacaaattttgtacaagttgacagaacactatatttaggatagttttgacagaattttagcaataattttgacacaatttaaaaaagatgacagaacacattatttgggacaatatgtacagcatctccgtcatatgattagaacacattatttgggacaataaactcctccgccgtcgccctgccgatgccgctggcgccgccggtgatgacggcgaccttcccagtcagcctacaaacccgcaaatcacattcacatccatccccgattcgcaatcaagaagatgaaatcagcgtccccaaccaatggctcaatgcaactccaagctgaatcgatcaaatcacctctgcgaataggaggcggtagcgaaggcactgacggaggaagacgaagctgcaggtgtcctcctccccctgaattacaaaagttttgatccctgcgcgtgcgcccgctgctccgcgccctcctgcgcactggccgcggggctgccgcgcctccctgcgcgtgcgcacgccgcgccgcgccctcctgcctgtccgcctagcgcgcgacgatgccgctcctctccccagcgcctccctgcccgcgcgcaacaccgccgcccttctccgccgcgcctccctgccgcgcgcgtcgccgccgccgccgcttgtcgctaggttttcgatttggggaaatcgttccagcaagagaagtggttactggctagcccttttagtgaaccaagggatggtcattcacaaactataatatcattttctttcttcgttttattgggaaattccgggcccatcaaactaccgtgaaaactaggggtaaacgggtgcttcatttaaaaaaaagcaggagtaaaatcacaaaccctaaaaattaggggtaaaatcacaattaaactgcaaagtagaagcaagaatacaattgcccctatattttatatacatgttagttattaattatttttactatcaaattttagttatttataaattatatatattcctatatggactctagactcgtcttttaatttctttttttattctgaattttctgtaaattgtatttctatatagactctatgctcttcttccaatattatttatttttatttatgaatttttatattatattttatatacgtgttagttaataattttttttaatatcaaattttagttatttgtaaattatatatattcatatatggactctagtctcgtcttttaatatttcttttttttattccgaattttctgtaaattgtatctctatatacactctatgctcttcttccaatattatttattttatttttgaatttttattatttctaattgtatttctatatggactctaaactcatctttcaatattttttaatttttaatttcgaatttcacttacttctaaattgtactctgaccttaaactcttcttcccatgtttttcttaatttcgaattttagttatttgtaaattatatttttatatggactctaaactctacttttaattttattatgtttattccaaattttagttagtttttaaattcctatatggactctatactctacttctaatattccttattttttaatttccggatttctattttttttcttaattgtatttatatatggactctgtactctacttctaatattccttatttttaattccaaatttatattatttcctaattgtatttctatatggactctatactttacttctaatattccttattttctaattccgaattttagctattttctaaattgtatttctatatggactctgctttttctttttctcctattaatgtaagaatttttagactatgggagtgaacgtggaggctcctttttctattctgaatttcaactatttctaaattgtatttctatatggactctagtctcctcttctaatattccttattttttaattctgaatttcagctatttctaaattgtatttctatatggactctgctttttctttttctccgattaatgtgagaatttctaggccatgagaatgaacgtggaggttcttttttctattcctttaataatataatagatagatttagtgaggttttgagatttgctgccgacctctggctatttgagcacgtgtttaggggtgggttcgtggatgtgtgaatatggtaaaccttttgtataatcctcacaggatattgatgactctaatcttactcctccatccaacatatgaaataccccatgcttgcaggataccaagaatcctttttaacagaatttcttaggtcgccttagtacagcgactccatatgtgacaagccctagctcagttgctatccttagagcaaatcaatctaaatcgttttcgcaccagtattttgaattttttttaaagaaaacatgaatacacctagaagggaaaatgctaaagctatcttcacgaaatctaagacaaactatgaagtccaagggaagagccaaggtagaacgaaactagtggggttagaacgttaccaagagatattaaaaaaatatatcctcaaaaaaaaaatttgagaaccctaaacagaatttgatgcatgaaaatagtcgtcttttccaatggatgcctaaaactgattccctacaattgataagtgagctcggtagagaagaaatctgatttttcaatataaaaaatcacccattcctaccaacagttcctcgtgctcgcgttcggatccgtggatagaaacaaggaggactcccaacttatggagagcgagatatgtggagatggggtttttaatttttttttggcacctctctagtggaactggaatcctatttaacacatatgcactagcaagataagtagcgcacaccttatccaatctcctttttctcttgttgaaaatttttaactcggatttaaaaaccttcaacttaagatttgaaaacttttaagttaagttaacttaaaagttttaaacttagatttaaagactttcaggtcaagatttaaaaacttttcaactcagaattgaaaactttaagtcaagatttgaaacttccatttcagatttgaaaacttttaaatcaatatttgaaatttttaacttggatttgaaaactttcagctcagatttgaatttttgagttgagagttttaaattttgagacgaatgttttgaaatctgagttcaacattcgaattgaaaattttcaatagaatattttaaaatttaagatgaaacatttaattataaaatacaatgaaaaaattgccaaaaatcggcatgctaacgctaatcgctattaccttaacattaatctctactagcgctaagcgtaggaggtatgctgcgggcgggcttgctggtgtggtgtgctctaggaaaatgcggaaatccaaaattatactccctcagtaataaaaaagtcaaatctagtccataaaaaaaatcaaatctaggacgtacaacgaatctggacaatcagattcattatattaaacgggaaatctatttcgagagcgctctcggtttagctgtatagtgcgacacatctcagagccgtctaatcgtgcacgtcatcgtggcgtccatccacgtgggtgtctttttcctcttcaaataaagttttctctcaaattacttatccgatctataatccgattataccattgtgttcgttacgataaatcttcacaacaagatattacatgattatattacgatgaaaaaatatttatatttgttaattacttttattatataaataagttacttttatcatatatatataagttagttttagatttgactaaattactttttagacatataaaagtaaattcaataaagtctaaaagtaatttacatatattataaaagtaacttaaaacaaaacggaagtaactttgtcacaacattagaagtaaattcgttgtagggataaaaatatgactttatctagaaattaaatttaatcagcacagatcaacacacgtaagtttaacaatttttaaaagtaacttcaatgtttttcaaaagtaacttcaatgttaattggaagtaacttttgcatggttaagaagtaactctctataaatatgtttaattaccgattttttttcctttcatttttgtttttcatgtagaaagagaaaagaagataaaacctttgatggattgtaaataacattgatggaataactaatgagaattaaccatgtataagatgtaatagttacttcctgataacatagaagttactttctaacatgtaataaattacttttaaattaattaaatgtttgaatatattcaataggaaaaagtatgaattaccccctcgaactatcgcggtcgtctgaattaccccccctgaaccacaaaactagacattcttcacccccaactatgcaaaccggacgaattacccccctcgacccaatccacggtggttttggtctacgtggcgtacacgtggcagtacagtcagtgtttttttaattaaaaattgtgcgtcccgcatgtaatactcttcttcctctctctctctctctcgcagcgcgcacggcgaggacgagtgcggggacgggcggtcggcaggaggctgcaccgcgtcagcaagaagcctttggctgggaagaagcctctgctgctaaggtggattcagacgaggatgacgcggcggaagagtgcgacgatggtgcggtggtgctcggcggcgttgagcgagaggtagcaggcgaggaggtcctgcaggtcctccagccaccagacgccattggtgcacagcatcttgatcatgctgtccaccagcttgatgaggacatcctctactattacccactggcaaagacgcaaaagtcgagcgctaaccgtatgagcctctgaataatcctaccttgcttagcttgggagaaggaagacaccttaaaagggagagccacccttcccctattggactatttttttaggggagattgggcctttccccgagtgggtgtgcctaagaactgttggggtctgggcaaccttaatttgttgggcctcggccaaccccacctgggccagatctttatcatttggtatcagagctgggcccttgttaagagggtgggaatgatgaggacatcctccactattatccgctggcaaagacgcaaaagtcgggcggcgaccgtgtgagcctctgaataatcccaccttgcttagcttgggaggagaaagacaccttaaaagggagagccacccttcccctattggattagtcttttagggagattgggcctttccccaagttagtgtgcctaagaactgtttgagtccaggcaaccttaatttgttgggcctcggccaaccccacctaggccggattgttatcattttggtggagatgcggggtattcttgaatacaaagaatacaataccgtgaatagattattccaatttgcttgcaaagctgaaagagaagtgcagggacgcaacaagcataggagttcttttgcaggtgctacttccacacgacaatcaacaccacgtcaatttactacggccgttcgtccacctacctccacgccatcccatgctcaagaaacaagcaaaaatgcttcagttcagactccagccaagagtgcaacttcggtagcttccactggacgtacccgtgatattacatgtcataggtgccatggcattggacacattgcccgcgactatccaaatcagcgagctctatttgtgaatgatgatggtgagtatacttctactagtgattgtgatgatgaatatgctttagttgccactgaccatgtaggaggacaagataacgatgacatcgaggaagtccatttgcatccagagtcgctagatcagtatcctagcctaattgtcaagctagcacttagtgctaaagagaagtgtgaagagcaaaaccaacgccacaatttattccaaagcaaagttcttgtgaaaggccataccgtcaaagtgattattgatagcgggagttgcaacaatttagcaagtgaagagatggtcaagaagcttggcttgactacccatccacatccacatccgtatcatattcagtggtttaatacatgtggtaagatgaaggtaacccgcttagttaaaatactttttctataggctcctaccatgatcaaattgaatgtgatgttgtgtatatgcaagcttgttctgttattttggggcgaccatggcaatatgatagagaagttgtttttgatggtaggactaatacatataaatttatattcgatggtaaaagagttgttttgcattctatgactccagccgctgctttgaaagatgatcttgcaagtcttgaatgtgaaaagaaagcgaaaagtgaaaatcagattattactaagaatcttgcttcacctagtacaacagaaccaagtgccacaaagaatgaaattaagttgacgggtgctttgttagcttctaaatataatatttgtgcactagaagagctagattcttgttgctatcctctattttgcaaagatcatatacccacattggctactgcttccagtactttatattctttgctactcgctgttactaaccttttgcaggaatatgagggtgcttttcatgatgagatacctccaaggatgacccctggacgacagagtgaacacgatcaagaagatgggattgagtcgaggacgactccaattcaagaaggggaggatgatgaggacatcacttcgtcggaaacgcacataacttcacacgttccaatgataattccaagtccaagtccatttcggcctccggagacagcactgacttcaaacggacctagcgccttcttgccaactccgatttgggtgatcttggactttgtggaaagctatctcgctacctttcaaacgcattcggtctcatgtccaaattcatctcgagtcaacgggaatcaccaaaacaagacagtgatgttgctcaaaccgaacttgggtcttgggccttgtaatagactaggcccatctcggaagtgtctccctccacctccacgaattagcacttaaccctagctttattttcctctataaatagctttgtacatccttaaaaacaattgggttttgtttagttgaattttgccaagtgccattcaccttgtctctagtcttcattcgattagtcaaggactatagattcagagcccctaatagtttgtgtgttgatttgctgggtcgattagatctaccacttcaattgcaactattcatttgtgcttaattacctattcgcaatatttagattgcatcttatcttgttcttgcagtgttctctcgtttgcattgcagggatcatcaaccgcgcgtcacggttgatacgacatcgtttgtagtgtagcgattgcaggcgtcctggacttgttctggttggtagccacatcgcaaacgtcgcactcgatcaaagcgagagttatccccctcaccagaagattgggccacgagagaaagcgtcatcacagctccagctctgctccgtcgactccatcaccaccgcctcgctctcgcgcagccacatccgccaccaccgcggccgccggctcggcctccccgcgctcaccgacgacgacgacgccggcaccggcgctggcactagtgtgccggcattgttgctgtcgtggccgccgccgctgctgccgacgcacgcgcggccgccgacccaagctccatgtgtcatcaccgagctcgcatttggatctggggtggtggagcgggattcccggtcgccattcacgcctgcgtcctcggtggaaccgcgtccgccagtctccatcgccgatcctggcacggggaggtgggatggggcgcggcgcgacggctcggaggaggagctgcagtggcggtggtgtccccgtgcgtccccgtgcgcccacaacgaggagggggagcctaccggccaccgcgcgtccccgtgcacccggttggcctccgcctccggtggccgccgtcgtcctcgggcccgctccgccacccacaactggctccgccccccatgcgccgccgtcctcacctcgccaatcgaatcaacgatgtgtccgcctccgcgccgccacgctcgcctcacctcgccgaccgcccacaccgaccgcccgtccccgagctcgtcctcgccgtgcgcgctgcgcgagagagaaaagagcgagcgagagagagagaatagagagagagagaggaagaagagtaagataggcaggccccataattttttattaaagaaacgctgactggactgccacgtgtacgccacgtagaccaaaaccactgtcgattgggtcgaggggggtaattcgtccagtttgcatagttgggggtgaagaatgtccggttttgtgattcaggggggtaattcagacgaccatgatagttcggagggggggtaattcgtacgttttcctaatcaatatgaatctcgttttgtcacatattttgggtggagtacaatgatgcaaatagatcttaaaaacaatatgtgatttaaaatatataatttattaaagggattagaaaaagatacatactattgcatttttcaagttaaaatgtgacattagatggagtacaaaccagctatcactaactgtgtagtcacgtccacaatgaaaaaagtatgcattaaagttactttctctttgttataagttacttctataatatatgtaaattacttttaggctttattgaatttacttttatatgtctaagaagtaatttagtgaaatctaaaagtaatttagatatattataaagtaatttataatttttcatcaaaatataaccatgtgagattttattataaagatttaattgttacgaacacaacggtgtaatcgaatcataaatcggataagtatttaagagaagattttatttcaagtatagatggatagggtttctcatagatgatgtggtagttgatttagacaaaacaattaccactagatatgtagtcacgtcctatattaaaataagacacattcaattctatatttattttttatgggatggggtaagtatgattgagtgttacatttaactatttgccttttttaagatgtgacaattacggatttaacactcactatttatgacatgtgtaccatcatgtgtctataacatatgagtttaatggcaaatcctttatgaccattcgtaaaagtggaaaatagttaattattcctgattgagtagtatagggcgtg

SEQ ID NO: 47160 - DNA, 4692 bp, Oryza sativa
  unsure (1)..(4692): unsure at all n locations
cctatactacttacacgagattggaggcactaggcctcagtacatggcacgcgtgtataccttattaccgccgggaccaactgaaagaagtcagtcccggataaagaggggaaaaaaaacccgggcgagggacgagcgtcgagtctagggggtcgaaccagactcgtaggctggtcggcacggagcgagccactggctcctgccacccgcgcgtagcggtcctcgaatcaatcaatttcctcccacgggacttccatggtgatggtgggctgggccagtccgggccgtgttaccatctgcaacttcgtgccggccgggcccagtacgggaatcccatcccaactccggcaggagcccaggacggcacggcgcaagtatccttgttcctccggctntgctcctcctcctcctccttccaacaagagttgattctacagtacagatccctccctcctccaagctttcccatggcgctgcagtacgtggaggcacagcgccaggcgcgccccgacctcgccgacgcctacgccgacctcgccgacctctaccagcgcaagctctggcaccagctcaccctcaagctcgaccacttcctccaactccccgccgcccaggtctgcacttttccccttcctcttagatgcgcctcttctaggttagccactgccccccatacggatctcgccgcaaaccctacccgccgcgtttgtaggtgctcgatctcagccctagttgagttggccctgccctgataccgatccggccgccgcaagaagccaccactttgtgtagacttagctgaatgtttcaatcttggattacttcaacaaccatatgcttagggttttaactgatgggcaatcctgcaattctaacggcattcattctcccacagactggcgacaccatcatacagctctacaacaatttcatctctgacttcgagacgaagatcaatcttctcaaacttgcccacttcgcggtcatcgcttcacgccagtaccctgacaaggatgccgcgattagtttcctcgagggggtaaccgcaaaactgcgcgagacgagggaacggcgcatcgatgaacccgttctctatgtcaagatgcagatagctgcaattaaccttgagaagggagatcaaaaggagtgcaagaagcttttggatgaagggaaatccacccttgatagcatgactgatgttgatcccacagtccatgctagcttttattggatatcatctcagtaccataaggcttgccaagaattcgctgaattctataagaatgctcttctttatctggcctacactactgtggagtcgctctctgagtcattcaagctggtattaacaatgccaattacataacagaaaaaaaatagcatttcctcctctcattagttagtttaataacaacatactgtgcatattgtttgtattgataatttaccctttgacactgtcatgtgtcaggatttggcatttgatctctcccttgcagccttgcttggtgataacatatacaactttggggaattattagctcacccgattgtaagttgggcttttcttgggcatgatttctttgttcccactgcctacctttcatttagtcatatcatttgtgctagttgattacttgattatggcattaactccacttgcctctataaacgttacatgcggcttgttgtcatcctcaggaataatcagtttacaaattatgctttgtaatgtgaactgcagggctcccaaagaagttgcatgtgtgttatagtagttaggcttcgtggttttgtagttctgtacgcagattaacaacatttattgctaaattggcaacagtaatttcatgagttgaatgtatggagttaagattgacatgatttttgctatgtagcgaatataaaatacaatgaaaaatcatgtgataacttgtgattgttttttggctgaaatttcaataatgtaaatgtaaaccactgaattgttattacggaagctttgtactttctttgaatggaaacagcgtaaacttaattttgcataaattaacggcaaaccatctttagttgaaaattaacttaggtgtactaattttttgttgggaaaattgatattgacctgtggaagccttcagcccccaaacagaattattccacaaatgcgtacaaggtgtttttttaatgcttgaatggcccctaaatctatgtcagcatatagttgtcaatttgatacatctctgttctgaaactgctattttttaatccttagatcaacagtctaattggaaccaaggtggagtgggtctatcatatgttgcaagcattcaacactggcaacctagctctctaccaagaactttgcaaggtccacaacgctgctcttagtgcacagccagctttggtgcagaatgaacgaaaactgctagagaagatcaacattctatgtctgatggagataatctttacgtatgactttgctacttgcttttatatgacaagaacaaatgccctattccatcgttttctttcttctaaaccttgtgttctttttcatattgtagccggccatcagaagacagaactatcccattaagtgttatagctgagcgcactaagctttctatcagtgatgtggaatatcttcttatgaagagcctctcggtaactgcatttcctactttctatcttccataagatattatttgcattttcatggaaattcattgttgttatgcataaattgattttaagcttgggagttgctgccggtttatgttgcagctggatctggaatagtgattgttgataacttgtgatgcatatcactgctgtcaattccttgactttcttaacttgtaatttacttggtgattctttatggtttgttttgtgaacctttagtggtgagtaatgacctacgagtgtgttggcagttcaactagtcctgtgattcatgtcttttcgtttggatgatcacagccctgtttcttttcttgttgcatgtcacttccttttgccttaatactatttcagtgtttgcacaatgcatcagccagtattcctagtgctaatgcatcagcttcattaccgttctttccagttccacctttttcagacttccattacagtttctttctaatcattagtacatgattctcaccctgaaaagcaggcatctagtacttcctctgtttcacaatgtaagactttctagcattgcctatattcatatagatattaatgaatctaaacatatatatgtgtctagattcattagcatctatatgaatgtgggcaatgctagaaagtcttacattgtgaaacggagggagtagtcaaatattgaaattattttagtcgctagtgtatcagctgccatgcattttctccactgcaggttcatcttatagaagggataattgatgaggtggacagcacagttcacgtgtcatgggtccagcctagagtacttggaattccacaggtgaaggccttgcgtgagcggctggacgcatgggtcggaaaagttcacactacactgttgtcagttgaggcagagacccctgatcttgtggctgcataacttatcgaccacttgtcctttcgctatacgagcttggtcaacaaggctgcggtgcttaatgagaggtgatctggctgtggtgcttatagttttctggagaatgagaacatgttgccttggatatttccctgcgtcctgttgatcaggatctgtaatttcaccctttcttttatcctttgggcattgagtcctggagctatcacggaaaagatacaaacgggccaaaagtttcataccggcaagatgttatcgtagttcttttagtcaaatttagattgtaatgcagaggatattttccccttttatttttacatggatgcaggaaactctagctgattcccgttgtgttaagaggctggtgcagtagtgcatgacgtttggactggcaaacagggagcgcttattcgttgtgcgttttggtgaggtgctgcatagtgcttacaatacttttttttcgaataattataatttaatgaaattttgcaaaaaaaaaaaagaaaaaggaccaagttctaaaaaatcagtaacctatcggcaattgggtgccgacaaggaaaaagatcccatggggcatcgctaggctaagtgtacaatctatgaaaatagagctataggaatgcatgcacatttcaatccatagaaatttttcaaaaggtttgagtggatgaaatttttcaatatgaaatagagggagtagattttgcaccctacacgcactcgcattctgaactttcacttttttagtctagccaacaactctatcgacaaccgttagacgagcttttgacatcacacatccagctaatcgtatggtgaccgtctgatgtaacatgttcgaactttgattattcgatatggtgttacacttgtgatttccagccaaccgacttctatttttgggaattgctaaaaaactatcgcaagtttttctttaaaagaagactttcaaatataattatagtatattttagactgtcgacctatatttttggcaaattttaaataaattgccgtaagtttttttagataaaaagctaagggcctgttcagattgtagccaaaataaatcttaccaaaattttggcaaattgacaatattgctaaaa

SEQ ID NO: 47161 - DNA, 926 bp, Oryza sativa
tgttgagtagaggcaacacaaacagaatcgagagattttcaattttagtactatgttcatagtagtatttcgtaaagtacattctcgtaacatacagctcactctgtaagtagtcgtctgtaccagtaattggagacggtcatgtttgcatatgcatgttattcaacattgatacgaataactagctagctagagtgaccatgtcgatcatcaacacaaggttgctcgacatgatcaagggtgcgagatgagatcgagccagggtttgaaatttcggaagtaagatttctgccgcaggtgggcgaaagaactgaaatttccaaaatttcggatttttttcatacgatttttttttgaaattttgactgattttaaataaattagaataaattttgaccaaaattcataaaaagttataaaaaaccgaaaatttcggacgagatgtgagtatttcggtggggggcaaaatttccgaaatttcaaattctggatcgagctcgatcgctagttagctatactaagaataagatcaggtacggttggagcctgcagcaggacggccggtgacgacgacgtccttcgcagtcgacgacgacttggcctttggctttgcgacgccgccgtagcacgacacgcggacgctgtcgacgtcgccgtcgtcgctgttgtgctggtcgacgttccggcggccgttctgcctgggcggcgtttggtcgtcgtcgtcgaacaagaagttagctcgccgagacttctccatcacgtcctgcatatacatcataaccattaattaattactttctctttaagatgatataattaatccgccctctacatccaatacttcagatgtatcgggcggccccagcagtatcgatcatgcatgatcatatatatatatatatatatatatacacgtatatatatat

SEQ ID NO: 47162 - DNA, 8528 bp, Oryza sativa
ccttttcatttttacgcgtggaattgaagcttgatcgaatgaaggaagggatcgaaacagagcaaaagtccaacatgatcgacatatgctttttgatgaaatttccccaaaaagcaggttgtcgtgtggcataatatgcattatattcaagctaagtaaagcgcaagtgcatatattccttggcgtattccactctagctataactcaatcttttcctctcttttcgcgatgatcaaaattcagcgcgtctgatggtgttggcagaaacgaatacagccgcacgatcgatttacgggtacaattaattgtcccccttgcaagtggagcaaacgcctgaaatgaatcgactattggtggtgctaagcttctttcaaaaacactattggtggtagcggttgcactactagagaaatgatctttgctgggtcaacccaaaaccacaatagtcccggttacaaaaagaaccgaaactaaaaatgatttttagtcccgattgaaaaccccacagccattttatcatctttagtcccagttggcaatcgggactaaagatctcccggttcatcctttgtcagtggcctgttagggggccgagaatctttagtcccgttcgtaaagatgatctttaatcccggatggtaatcctaaccaggactaaagatcaatagactaaaatttaatacgtagtatattatccctctcacttatcctctcctccacaatcgcaccactcacagatcccttcctcttccccttcctcgtacttatcctcttcacagatccctctcctcatccccttcctcctcccctcccctctcctccccctcctcccttcccatccagcggttggcggggccgcagcggcggcgaccggcggggccgcacccggcggcggcaggcaggcggccagcggcgccgtgcacagctacgggcaggcggccggcgatgccgcgcgccctctcgtatgccggccagcatcctctcttttttttggataatttgtgattaattgagatgtataattttgtgattcattgcatggatctgagatgtataatctgtgatgtatttaatttgtgtgttattttttaggatttttgatgtatctgatttgtgcgtatttttttaggatttgtgatgtatttgatttgtgtgtatatgtaacttaagatttgggatgttactttgaatcgggggatttggggattgatttggggatatacatggcactagattcgggagaaaatatagggattaactttagccaaagaaacaataaaaatgaaaaaaaaaagaaaaggggaccatctgactgccgctatccatcttttgtcctgagtatttgaaccgggactaaagatcactatctttagtcccagatttttactctcggttgaaaaaccggaactatagggggttatcaactgggagtactatagggggttatcaactgggagtaaaaagggtttctccaccagtgtcggtttcgcggccacaatagcggtatcgatcgggaccacgacgaggagatggtgcaaaatggaggccaggctggaatactgcggccacgacagtgacctcataaatgaaatagcgatagttagaaccaccacgaaaatcgacaccatcgaatttaggaaaggtcacgtttttttagtggtattaatagcggccgctgtttttgcacaaaagtctggtgccgttgtgaatgtaaatttgtgaggcatgcggttttgactgcgctatccaaacacgagtcacgcacacatatatcttttacgcacgctagctttatgaaatattttagaattttgtaagtagtaacgtgcgcacaatttttcaaagtcgtaacatatataatgtatacaattttaaattcataaaataaaaactgattagggtgtcatacacattagcttgctgttttgtcgtatattactaataggcgagaccaaattcgggttacacttatatgtgtgtgtatatgttgtttcctccactgtagcttcctgtccgctaaaaaaacatatttctaaacttcaagaaaggtcttaaaaatgcattactcacgccactttgtgtgactaacttttcacttgaaaagtagaaagaatatattgagcgtgcatcactaagatttcaaaagctatagctctccctcaattgacatacagctcaaagtttttttctgagcatatattccttgacgacattatatctccttttgcgttcaattcaactgccaatgccgtactccggagaatcgaaggtactactccacttgtcaaaaccacctcacgattaccgagccatgtcgatccacaggtggatatatatatatatatatatatatatatatatatatatatatatatatatatatatgtgggtgcaattaatttccttgattggagcggtatatatatatatatatatatatgtgtgtgtgtgtgtgtgtgtgtgtgttagatgataaaacatgattaatactttatgcgtgacttatctttttttttttcatattttcttcaaataagacggacggtcaaacattggacacggaaacccagggttgtctttttttggacggagggagtactcaatactactggccacaaattaagatgatgggtgtggaagaatttatttttaaggtgattttcaaatcaccactgcaagaacagtttcataagtactccccgtcccacaatataagtatttttaaacttcgacatagtttttgatatgttattttgaccaacaatatctatgaagttaagatgctttaaacaaaaatagttgtatattatgatagtttgtttaattataaatatagtaatatcaattttacatgatcgatcaattctattttttggatattaataatcaaagttaaaaatatttgacttagcactgttctaaaaatgtttatattttaagtattttgggactgggggagtaaatatcaagattgttaatttggagcggtacgatacggcgcccactcgttgcataccctttttgctggcgaaattgtacgtactggccattccggccttgagacatttctaaaatcataatgaatacttgtgtaacgtggtcgagacatttttgaaggaggtttgtagccaaaggtgtttttagaaatatgtgcagcatggttagagactttttcttctctaattaattaagggcattctcttgagatgtttttaatttgccccatctaaagtcatttttaataggttagtttttattaaatatctaaatataaaagatgatgtgtcactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgatctttttttttttttgcatggccctgttgctgcatggtatatatatatatatatatatatatataaaccatgcatatatatgtttcaatacatatatatgcatacatatatatatgtatatatatatatatattatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttatgtgtggtcaggttatccctcatacgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaagtcgaagagtaaaagcacccagtggaatctgcaatgtgcgtgggatgcattacatatgaaacacttagcaagttcgtacgggaatgaaatttggcatgtaggaagacagtaaaattaaactaactctgtgttgtatggcaacagtatgaacgtcttgtaatgctgcgccttcaggagatggatgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccaactggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacaggtgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcagagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgttgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctgaagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccagttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcatgttatcccgcacaacccaaccgctgtgacgtacatagttcttggcggcttcggccggggcactaggacgtccatcttcttgcacttccgttatgatgtgccgactctcaagcttcttcgctgcacctcgttgcccgcgtgccctcttctgtccaacggagggttgactaccactagcctcctcctcctggttcccctccacatccctttccatgtgcccctgctggttcccctccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagactacaatagtcaattgctacttgtcgcaccaattccgtagtcaataattatacatactaagtcaaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatacgaagtaacatatatatatatattgcatttcacgttaacgttcgtcctcgttcgttcgc

SEQ ID NO: 47163 - DNA, 1728 bp, Oryza sativa
aagacgagggcgcaccgggaatatatatacccccggatctttactcccggttgttgagaacaaccgggactaaatctttagtcccggttgttgagaacaaccgggactaaagatgatctttagtcccggttggtattaccaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatatatatatatatatacttagcatatatatgaatgatattattatattggtaaaaactctaattaagatatgtatgtacatattgcatgatttaaaattaataaaaattgtaatcatcatatatacttagcgtaggaattatattaaattaaatgctaaaaactctaattaacatatgtaaatgccacatgcatgatttaaatcttttaaaaattcgaatagtcttatataagtagcatatgaaagatagtaaattaaattgtgaaaaactctaatatatgaatgatagttttaaaaatatattaaatttaatacttttaaaaattctccagtcaattataatttgcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttcataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttagttcgtgctcttcatgtcttgggctctcgtgtagaatgtgtacccattgatctcatatccctggaatgtcgtgatcgacccagacggtccactcgccagga

SEQ ID NO: 47164 - DNA, 1403 bp, Oryza sativa
tttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggctcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccaggggggaggttgtagatacacatcgtaccgggcccagtgctatgg

SEQ ID NO: 47165 - DNA, 9159 bp, Oryza sativa
cccggttggtgttcccaaccgggactaaagatcccgggggggcctgacaggccttgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtgtgcatcttgactcttgacaattatagggttagtttcagatactacgagaattagtttattaaagataaattgtacttcaaagagtcatgaattcaattaggtctacttgaaaggcacattcttactactgggctgttcggcatcgcttcttcggcgcttgctgcggctgcgttgtagtaagaaaccttaggaccataatatataatatatagggttatgtacgtaccatatacggtttgtgaaacttgggccataatagatggagttttgaaatttactcgaaataataataaaataaagctagtatacaatcgtttttgcaattccaaaatgatggtatagcaccccgattgaacaatacatacattactctggtccataatgtttgttcagtacttactccccgtggacaaattattttcagcgtgatcatcgatgaacacagtagtctagctctaattcattctatgagcagagtatatatgtaggatacaacaataaaatctacacatcaagacttgctcctagagtctttcatgcaaagttagactaactataaagcataacttgtgctactccgatgagatctacacatcaaacaatgctagccagcagcacaccaaagaatgctaccctccaaagccattgttgggatttttttttttgtggatttgctcttaatccatgaacttgatatttgagtggtttttatatacaattcaatacatcatctattctgagctgagaagttgacttgagggcatccaccaaaaataaatttctaaataaattgaaagccattggctttaatattatctgccctataaggtcattcctataagaatgttttgtaaatttgatgtatctgatgcctattgcggtgagatttggtggcatcatcaagcatggccacatccagtgcgaggatagccatccaaaggcaagaggagatggaaatggtgaagaggaggcagcaatcgagtgggtggtggactgttggcggcggtggggaagagggaggaggatgacttggcacattagttttgcattttgactctcccctttcacttatttagatgtttgaaattaaactcttgagaaaacttccatacttgacctaaaccttttctctctaacacaaactgccagcccttattagcttcatgcactggtagagaaatgttctttattcccggttgagaaccccctatagtcccggttttctaacggggagtaacaatccggaactaaagatcgctatctttagtcccggttcaaatacccgggactaaagatcgatcttaccaaccgggactaaagggttagtcctagtttttttttttcattgttcttttgaatattgatttcacaccaatctctccaaaatcataaaatcaatcgcaaattccaaatcgaaattgagatgctccctacatccccagatcaaatagcaacatcacaaatcataatattcacatcacaaattgtcagaaaaaaatcacaaattctaaaagaaaaattacatcacaatcaaaatcacagatacatcacagatcacaaatacattacagatcaaataacacagatccagatccagatccaatgaatcacaagttattaaaaaggaaaaaaaaagaaaaatctggccgccgagggcggccgccgccacctcctcctgccgcggacggccgccaccgcctcccagcacgggccgccgaccgcgcccgggtccccgccgccgcactccgggtaagctcctcgccggctaagtgttgagagagaagaatagaaagagactgagaagaggataaggataagtgtgagagagaggaggaataggaaatagaaatttttgaggatagcagcaagggattatatacggtatatttgatttttagtcctggttgggaacaacaaccggactaaagttaggattttagtcccggttggtaccatcaaccgggactaaagatctctagggactagcagcctctgacacgacatgaacggggactaaagatcatctttagtcctggactaaagatgatttttagtctcggttgataacacgaaccgggattaaagatgatatagtccccttacagttataaaccgggactaaaaatgtttttttagtcccggtttttaatggaaccgagactattgtggatttgggtggaccgaccaaagatggtttctccaccagtgatgggctctggtccaagcaatgttgcggatcatacatgggccatgtatgggcttcttggcccattccttgcactcgagatgggatgcttggctttggaaaaagtatgaagactcctctttaatccagatgtcaaaattggggtgaattggagctccctgtcaagtctcatgcccaaactccaacaattgagtgattattggcaataggaatgcacatctttagtaataaaacatatcacaacaaaaaaataatatttatatactttttaattgaaaaaaaagatcaaatgtcatataaaaagtcaatacacaactcgttgctacaaggacaagtagaatgaagcagttggagatttatcttggggaacaaagcatcaccgaagattcaattctttgcctggttcctagcgaaagagcggctaccaactagacacaacctcacgaagaattgcatcgtcgacactgccacttgcgagctctgcaaaatggccgatgaaaatgctgcccacctctgcctccactgcccaatggcaatgcacttctggcaggccattggaattcggccgagcatcatcgctacatgccaccttgcagccttcaccctacagataggatctcgacctgcttctggaatcatcgacataatgttgtgtttggaaatctgtcgccgtccttacatgtatactaattagccactttccttccactaaccagactgaggcccaacccaatgaaagatatgcagagtaggattactaagggtgcatgtggttggggtaatttttagagagtttgagagttaaaagagatatatctattaactgaaggaatatggagttgggaggaaatttctcctttacgttgtgttctgtttagttgaaggaatatggagttgggaggaaatttctcctttacgttgcctaaacaacgtacccgtcgatagcgaggcgcatgcagtggcttcgttaatctcaaggatttgccggcccagtcttcgaagatgctcataggggtagggttgcgtgcgtgcgttcatagaggtgagtgcgcgtgagttatgagtgtctgcgttgtactgtgtaattctaaaaaaaaatcagccatctattttcattaaaaatctagtctatatatattaattcttgccaattttaatttcactacctctaccaaacaaaaagactagtattaaaaatcaaattcattcatgtattaatcttaccatcaatttactcatccaaactcccgatactcttgccaaacaagccgttaaaaagcaagaagccaggccaaggcatcggcttcctttcttctgcacagtgcacactacttttcctctccacctgattctttcttatccctttcttcacatactaattgcttcttcgtgttagccatcgcaaccaaaatcgtgttagccatatcttagcaaataaggcacgatgtgagtctatgtctaatttctggcttgaaaacagttgtaatttcatctctcaccttgtttgtgaggagtaatatattcccttttccccgaaaaaaaaattgcttcttcgtagtctatgcctctaattctcttatatatacttgtaatttatccggtttggtaatagatttctcatatggatcgtaacgatcttttctgtggatgtattgtcgttgatcgtttcaatcctcctttgttatcgctgtggttgtacgtatgtatcttcgtggagcaagcctcttccacttctcagtcacgattaagtaacacaatttgagaaagaaatttgtaaattgtacaagttatatatgtcaaatatatcaaacaagttgacacgattatatatatggcgatagtacaatattcttgcataacattaatatctaaacacacatacacaatcacatgtagtactatctaatttcttttataagataataatcaacatattcatcccagtctctacattcatgtatgcatggttaacttaacacacatgagagtaattggtaatcaccggtaactggcggtgccactagtacatataagatcaaatcacagctggttcaaaatccgacatcctaaaacataacaacttagtatataatatggtatatcctactactgtaaatctaagcatacctcaaatcccgaatcgtagaactaggatgtgtgtctcattttgtactacgacttagttaatttcgccgcggtccacaacaacacagcaagcttgccagcaacccggaggagcgatccttactagtgtcgtttggtagtccacgacttgtgaagttctcattgttattcttctccccagctcgattaacaggagtcctctcctttttttgtttgtcgttttgatcctcatctccgtcgttgtcgtcgaacaagaaatttgctcgtctggacttctccatcagatcctgcaaaatatttactagtttatttacatgtgcatgcaggttaattattaagtgatatatatatttattcttcctaatcaattaatttgcaaactaaaaaaattgtagtagagcacacaccaatggacaaaaaaaagtgagtaaaagtatagtattgaagatatattaccatggctgcaggctttagtttggagctctcagatgatataagatcaacctagagaagaagaagagcaccctgcagctttcaaaagaaaaatggaaggaactctgtatatatatgtgtgtgtggtgtgtgggttggcttcagtttgcacacttgcactagggcatcagattcatgagaggtttcgtaggccgcatggcatatgcacgcgcacacacatatatatagtgaagatgcttcttgtgttcttgaattttcatgatttctttaaatgttgtgtttagataaatttatgtatatgctgagtgtgcacgtgtgtatgtgagggtatgcgtttgtactgtgtttgccaaaaaaacaaccatgtgattttgaatcagtaatatatacatttatgatttatatataaaatcgatattggtagattttgtatggcaagtactcctacttaattagctagttatatcttccataattctcataattaaatgattcaaaaaatataatatatgtgcactggaaataactatgtcaatgtccagaacgcaactgccgaattaaggatatactagccacgtagtcgtgctctgcgcgacttttgatcccgtataagaacttttgtatccgtatattagtttatagaaggttttagcatgagttgattgatttacaaagtatcaattggtctagctaactatagatttaactaagctgtactatatgagaaatcactagaagcctcctggtttttttatttctttatttattatctttgcccctctctcgacactagaaacctccagaaattaccatacatttatcccatttgttgttttttatattgtatatgtacccttttgatccaatggtccttatttatctatccgacggttaatatatttttgatgatgtagcgcatcatcgtgtatgaaagtttgttgcttttactatatataagatgccttgggttaggatgaaagctttagctagctagctagctggagtggggcagcatgataataattaagcgtaaaagtcacagaagctatgaatatagctagctagtacatacactcctttcgttaacaaataaatataagtcgtttaaactcgtgcatttaaacctcaaaatattaaatcactaatacaaaaatattaagatttgataagtaaaagacaatattattagctagatttatcctaaaagatcgatacttcaatgtagtgatattttcaatagttttgatacaaatatatggctagctatagaaaaaaggtgatgataaatcatgtgcatcgaaaattatatagatgtcctaaccgactagtgaaaaaggaaccaagaattaaaggagatgacgatgctgatgctgatgctgatctagctatgagaaagcaaagaaaatgatatcgtcaaaggagaggaatacgattcctttgaatgagaaaagaatttgagtggcttaattggttggcacacgaatatgattccttgccgtggaatgcactcatcacaatatgtacgtccaatgcaacgcatatatgtagattacttttggaaattatgagctatatatagcttttaagtccctatcacatcggatttttggatactaattataaatattaaacatagactattaataaaacccatccataatcttggactaattcgcgagacgaatctattgaacctaattaatccatgattagcatatgtgatgctacagtaaacatgcgctatttatggattaattaggcttaaaaaatttatcacgcgaattaactcttatttatgtaactagttttataagtagtctatgtttaatactctaaattcatccgatatgctagaagttcctggatccaaacaccaccttagtatatatggcatcatgaacagtccagtacgtatgcaatgcagaccgtcgatatgcggacttgaacggccaggattgacccggaagaggagcgagcgaggcaccgtgttgatatcacagtagcacatattcttgcatatataacgggctatcactggcggttccaagtataccgttcggataacattcaaattgatggtgctttttttttaatataatggaataaaatattattgccggcatttgtttaattaagagttacagccaattattacaaggtttacacaaaagcaaactcacgcaaatcgatggtgctcttttaatggtgataactattgaacagtacaagaagagatagctaagaatatacgatgattagctagctgggaatcgctcccttgtgaattgtatgaaaagaatagtatgataacaatggaacaaagctgaactttttcttattcagtttacatctgaatcatccccttgcattgcgaattgtgatgactgaaagcaaaatatgcacttaggatatgttttgcattatggttaggatagaaacggtcggaaaaatgcttcaacgagcaccatcgtctgccttttggtttattagccgagcgtaaaatttgaattgtaaaacttaaatgtttgagctaatttgaagtatttatctagtttattttccagtgttgacttttatttaaatcattaaggacaaatatataaaagtttttatcaatatttttttaataagccattttacaacttatcaattgtaggctagatgatattaaactacatttttgttaccaatttttctctcagaaacataatcggagtggtagtatcggaaacaataacgatattggtacataccggagcattggaatatatcaaaaacggaattatcgggatagagagcttcaaaattaaggcatcaaaggaataagcaagttatggtgcctatggactccaatttatggggtctatgagatcggctttcagccaatccatttggaaagcatgggcccctccaaaatgcaattttttctcctggctcgccacccaaaatagactctggacaactgatagactcgagaaaagaggttggcaaaatcagaagatatgcccgctatgctgcataatcaaccgctatgctgcataatcaacgaatcagcgatccatctgctggcgcactgcagagtcaccaagagggtatgggcggaattacaaaggtggacccaaactgacctccaaatgagcaaatagagtgactgcgactcggtggagcaatggtggaacctagtggtagacactcctaacaccccccgctttcctttgcgagcactggtgatcttggtttcatgggaagtttggtgcgaatgaaacgcaagaatcttccgaaacaccgcctcaacaccggcttccatcatcgccaagatcaaggaggaggctcgagcctaggtcaaggctggagcctcaaggcttcaagagtttggaattttgggagatatcacttagtctctttgtcaattcttgcgggtgtagctcttttggcttgccctgtaaatatttccctttctgattttgttttgttttttctccatctctattaatatacgagacaaagcttttgccctcctttcaaaaaaaaataagcaagttatggtcatgtttacatgataaattaatgtagacatatattagtgaagattccgatttaaattttcataacgatattataacatcaacaataacaacacgtaagttttatggttaagtttttatattttgatgggttgttggtattatatagtaattcattcggaacttctgcatagaaacagcataccactaaaacacggttgtcaaaacatataccatttccatctcattttagacaaaacagaaacggaataaaacaattggtataacagaaatgatagctcacacggtcgggaatttccataccattttcatatataattatagagtaaatttcacaaaacaactgatattttaactaaattatcatagaactacatatttaaggtaatatatcataaaactatagatttaacaataaatttatctcaaaactacaagtttaaggctaaaatacatgtagtattgtgataatttggttaaattttaaaaatcaaactgaatttgatatataactcttagcttatgtttatataggtataaattacacattgtataaaaactaatgattaatccatatcgctataa

SEQ ID NO: 47166 - DNA, 14886 bp, Oryza sativa
  unsure (1)..(14886): unsure at all n locations
tttcttcttcttttattctttttttttaaaaaaaaagaacagggagcatatctccggcttcaattgaaagtatataaagttcacggccgggcatgccctctttgtaaatattcaacaaaatgggagaagaaggttaacaccttaattcatcgatttcacaaaattcctactaaaatgtattcacatttgcatgttcaaacctcaagccgggcttcagggcgggcaagaaaaagcccggataaaaggctaggcccaaattcgacccgagaaataggctttcctaggatgggatcttgctggattttcatgattttgggttgtgaaatctgggcccgagcctagctagcccagtgcattatcaggttggaccgggcttaacatttttaggctgggccgggtccagtttgaataggccaacccataaacaccccccacacagggatgcatactactaacatggtgccatatttcagaatgcaagtaccgaaatttctggatttccccagccccaattttataattaagcaaaatttgttcaaatatcaaactatttctgtcctaattttctgaaattttgcttctatcagctaccccaaagtttttattattatttccgtggtatataacccttactactgttggttgatttttcatatactccctccatttcacaatataagtcattctagcatttcccacatttatattgatgttaatgaatctagacatatatatttatctagattcattaatatcaatatgaatgtggaaaatgctagaatgacttacattgtgaaacggatgaagtatttgcatttttcccttttcaattttaaaaaaagggtaaactctacgcttgatttgatttctactatttaattaatttatacacggatagtgggagttcctatgtgaaatttgctctgttttcttcagcttcagtgaacacattgatgattggtgttggatattcaactgtcttaatcttggacggctgaaaagtccagctcttaactattccttgtctctattgttcaatccattaattttgcttgctgtttcctcacatgatgctatcatcagcaggattattttgacttccctgcagacattggcagcgactagatcacatagcttagccagtgcagtttttatcagggcagggatttgtgggtcttaatcacctaaaatctctctctgtaaccatatccatgctctgacttttgaaagtaaaaactgaccatgtcatgcagtgatgtgtgtgcttctgtctcaagttatccagaagcaagcagtgtaaacgatacgaattttcttcctttttcttgttctttgtgtgatgatagaaaaatggtaggaagtattggaatttcctggttttgttttgttcgtcgttgaatgattgaatcccaagccgtttgaatggtacatgttcaaaagtgcaaaaggaatttggtaaaattcagacatctacgatccttagaccttaggtgtacgttaatgttgtcacacaaggaattcagacacaatggtccaagaggtcaaaacttcatttttctgaatgtttgacaaaaattagaatttcttgtatgcttacttacaagtaggatgctttctacaaggactactttacaccatgatcagatgaaagaacttttaactgaaaaaatgaagtacatcttggaatgaacaaaaatgtcaagattgtccttcagaccattgttacctggcctgtactccactcactgaaagctggtttagcgagaagggggacttgtctgagcttgacttcaaagacgaagaacccgagctgtcgctcttcgcattcgacccctttatgttgatgaatgggggctgggtaggccgaggaagctcattgttcctactacccaacatctcgaccaccttccacatcggtggcctaaggttcggtgaagcttgcgcacatagtagtccaacatggaacaccttgagagctccctcctccgtgcattgctcttggaggtttgggtccaatagttccatcagggtgccttcattgtagtgcttccatatctgaagaatgcaagaagcagtagagtaacttcattaggtttttcgggaatgctacagtgctagtactttgcaataggatggaaatttagcaaaattaccagtgacatgagggaatgcccttctgctgatgaagcaaccgagttgaggctcttccgaccggtgatgatctcgaggactagcacaccgtagctgtagatgtcagccttctctgtcagttgcccatggacaatgtattcaggagccatatatccactgtacaaataaaaatgcatggtcagtaccattttttcagacaaattgcacaatttgatgacaaaaaattcttgttccatccaattaaatacaaaaattcactacatttttaaatgatacgacttacaaagttcccgcgaggccagtgctgaggtgactttgatcttccatgaagttcctcgccaaaccgaaatcggcaatcttaggcctgaacctctcgtccaacagtacgttacttgcctttatgtcccgatgtatgatcctgatctcagaagcattgtggagatatgacagaccctctgcagtcccaaggatgatctcgaaccgccgttcccaatccaatgcggtcttcttgaatgcatctgcaacatcaaccatgaaagatctgaatctatctacattgtcaagtatggcaagttcaaaaattcagaatgcaggaattcttcttcagtgttctagcttagtaccaaacaagtagtgatcaaggctggtgttgcagaggtactcatagaccaggaggctctccggtccctcgatgctgcatccgagcagcttgacaagattcttgtgctgcacctgactgacaaggcgcacctcgttgaagaactgatcggcccactcccgcgtgttgaagaagaggcgctttacggcaatctcccggccgtctagtagcacaccctagcatcatgtcaggagcaaattcaagccgatgcaatcaaattactgttgtacatctgaacatctgatctgatcatcaccgtttcatacatacatgcacacaatctgatcaacagttcaggaagaacctaataaagatcattgtatcaatgttgtttcagaattcagatatagtatatgacattgtaccttgtagactgatccatatccaccctggccaagcttgttgatctgattaaagtcgtcggtcgccttgcacaattcttcatacttgaaactgagctgcgatgcggcgatggtgcggatgatctcactagaaccatccatgtctgaaaatcccaaaattacacaacagagttaaagacttccatcagagattcagacttcagtgtgtaaaaatgtaatagcatcatgttgaagttcacatatgtaccatcatggtgatcatttcttctgttcctcatttttgcccagaccaatgctatgccgatgacagccagtgcacagaagactgaggcgatcaccacgataactatgtgccgtgctgcatgcaaagaaagtttcagaaataaaacgtcagattctttacaatttgttcgaaatggacaatgtttttctacggaatttgcatcttcacaatctgacaacaccaattttcttttctgtttacaattaaattcccatcaacagaagcttttttctgaaaaaaaattgagatgaataattgagcagatcctgttgctatctccaaaattcagacacggcacgcacctcgccggccgtcaaagtttatctccttttttgacagattccccgtgaacattcatgagcaaattgccacgataaagaccaaatttgacaacgttggtacgaaatttctcaagaaaaatgtgacgtgtcctaaatttcaaagggaagagattaatttagatggacttactggatgacccggcggcggcggcggcgttcgccggcaagtagaacggctgcgtggagtacctgacgacgcagccggcgttgagcccgtagccctcggcggcgcgcggcaggcagcgcccgacgacgcggtcgcgcgcggtcgccacgcacgccgcgcacgcggtggcgttcagcgacctccagcactgcgccgccgcgtacacccgcggcgacaccgacggcaacgccgacgccgacgacgacgacgacgcgctgtagtagtagtagtccctggcgcccggcgcggccgccgtgacgttccgcagcaatgcggccgacgtcgcggcgaacgacgccggcgaggagacggtggcgttggagcagacggcggtgtcgctggcgtcggtggcggcggcggtgaagttgtcggcgccgtagcggaggaagcagccgtcgaggtagatccggccgccggtggccgggaggcagtgcggcagcttgacgcggctctgcgcgtagcagagctggcagtcggtcggcgagaggtagcccatgcactggccgaggccgtagacggtgtcggcgccctcgccggaggccgcggcgccgaagccggagcgcgtgacgttctggtagatgagctccagcgtgttgacgaagctgacgtcgaagccctcctggtcggccgcggtggtgttcccgcacaccgtggccagtatcaccggcttggccgcggcgccaccggcgtcgtcggccgccgcggcgacgacgacgaggaggaggcaccggaacgcagcagcggcggcggccaaggagccccggcgttgcatggcggcggcgagcatggactgcacgtgtgggagtgtttggtctctagcttagcttctcagcgtgtgatcgccatggccgtctcggttttgtacgtgcgtgttgatgactaagctgagaaaataaaaaagagagacgtccctccaaacattttttaaaataattataagcgtgttaaaaattaagcgcggaatgttaaaattaaaatcacacatttcttatcattacactatcaaatacggagtgcatcttaagtctaagctgagctaaggtcatttgcactgatcagtagccggatggaatggacctgaagtggttaatgtttacatcgtatataataaatatgagaagagaaaaacaccagcaaatttaagtacaatttgtgaatttagttgaatattttgattaagatgtactagattttatcttaattttcgttagcacgtttttttaaactactaaacggtagtagcgaaaacttctgtatagaagatactacaaaaaacgtgcttaaaatttatcaaatataaatcattcgataaatgatttatctatatatcagataaatcatttatcaaatttaagataattaaaatttaattaattatatgcttatgtgaactcaaacgaggccttgtgatgacatctggatggatgtacataaccgtgagtgcgatgcttcaccagacggccgccgccggcagaactccggtggcaccggctgaggatgacgccgccggcgcgggcccactttaactcgcgcgcgtgacgtgacactgacacgtacgtacgtaggtgcactgtatctctgcgttgccagcttatgcatatccatctcggggccatcgcattctgtctctgtttgatgcaggtgcagcagtgaacaacactagtgttacgtgactacgtgtctgctggcttaattactactccctccgttccaaaaaaaggtaaaccctgggtttttatgtctaactttaactgtccgtcttatataaattttttttataattcataattttattgttgttagatgataaaacatgattaatattttatgcgtgacttgtttttttaatttttttataattttttcaaataaaacggacggtcaaacgttgggcacggaaactagggattgtctttttttgggatggagggagtacacgttgacgttgtggtcgccgtcgtgccagcacgtacagccgccgcccctcaccggccggtcaccagccaccgccgccgccaagcacacgtggtgaaatgtaagtgtaattaaccaagagctaattacaagagcaaacgtattccagtgaacaaccaaattaatcaatcagtcgcgatgaagcgaaaatgtcgtctcgctagctatctttttcttcttcataaatctttcacctttccaaaaaagattgtatgattgtcttcttggattttaaaaatgtgcatggttttgattcatctgttactgctctacttggatttttaaaagattaattgtaggattgtatgattgtcttcttggagaacatagttaggtggaaaatgatggagaaaattatacagagattaaactactttattacagccgtcacggcggatactatattatatactagtctgcaacatatatctaaccaaagttttcaacgttattgaacttgaattcaagcaatctagaaacgaaacgaattttttgactcgttttcatgcagtcagcagcctcggtgcgcttggttggtggtggtggtctgattcattgtctcgtccgcacacgtgggtctaaaaaaaacattccacggtactgggtatgcagagaagaacaaaacagtccatttcatcatcaatcttcttcttttttttttcttttgatcatcttcatctaaggtgcattcatattcgtctccttacgtattacttcgctattggctttttacataacgtttaactattcatattattcaaaaatttagtataaatatgaaagtataagttaatattatagtttattttataataaaacaagtaaaaaaataaataatatttatatattttttaataaaatagatagtcaacatcacgttaaaaatcaacggtattatatattttaggacgatatgatgggtataaataaaggccatggcgcccatgccttgccccaagtaggataaatgtcacgcatggatacatcgtggtaaagatatactctagttagtagtataaaatatagagcaatatacacaagtgaagttgtggatatatgatttttcacattcttgtaagtataagtatagttgtgcgtatcctaagttggtcaagagggttgaattcatacttttattgcttttttaaaagaataccaaagcactgttgtcatattgtggtaacagtctaacagagagaggggcgctcgttactcataagtagaactcttcaaccagcaggagcgaagattcaacaaaacggcaatgcgtgagttaaaattttataaattgctacagcttgcttgatgtctccaacttaatttgctcatctcgtttgatgtggaaaataaatgcaaaatcgtattccatgtttgtaacttgctcgaagtcaaagtgtgcccaataaatacaatcatgcatgtaaagattaagatctcgcggatgatgggtccacgcatcgatggataaggaagtcagcagtagtgcaatcctactcactctttttttttttaatatacgaggtcgttgaatttttttatacttctaaccattcctattattaaaaattaaagatttatgtaattattatttaattattatgactttatttattatcaaatattcttttgtcatgactttaattttttttatatttacatagaaaaattgaataagacaaatagtcaaacatttataaaaattaacagcgttataaattaaaaacgtatgtacctttcggatattgcagtttcaaatgatgtgatagattagtggtggttttaggaagtagaaactctaaattttattcgaaatttaattgctggacaataacttttaaactatatgttcctatcatatcgtggctttcgctgacgtagatttacattggaccagtagttagcctactagtaccatatattagctcacgccaacataaatcttggatatatatatatatatatatatatatatatatatatatatatatatatatatatatatatatatatatatatatatatatatccatggctgaaaaataccttttgaggtttggactttggattgaacattggaagccgaaaattgttttggaacacatgagtttcaaacttttttttgaaagcactgagtaaatcagtacagctctacaaaccgtgcaaaacatgacggaattcacaacatactagtacaattcattcggaaaaaagaaatactcctactaagatattagtagatatttattatattattattttcatataaaaagagacaagatagaatattgcaaatggagcccatcgctggcctcctcattaatggattaggcccatatttaggagtttattccccctagtcttggacccgtgcgatcggtgggcttgggacatctcggcccatgaaaagcccgtgcagtttttgcaattaggtccccgatatctccggaacattccagaacccccttcccttacttttgcccttcccctcccctcgcttcgccggccgtctcgccgtcggcgcgcgggacaacgccgtcaccgccgccgcttcccaccctctctctcgattccctgcctgagccggaggcacgctccggccgggccctctcccccgccacgccgcctcggacgcgcgcggccgaggagctcctcctcggcgttagcaccgctgctcctgcggccggttggatcatccgcgggaggcgacgccggcgaggtgtagcaagaggcgacttggggatatggtacgagctctcatgacctctcctgcccctattaggtttagtaaaacttccctctccctgtagcttcattcactgtcacagcttgggtaaacctagatttttctctctctttttttttttggtttacccaatgtatgctcgcatggaaagtatgaacgtatgctagtgaattggtctgaaatgtaggttcgttttaatggagcatcaggttcacactgataattgtttctttttggtggaattaacttgtctcgatggcatagttcgaggttacttttaggatgcatcaactaattcgatgcgattgcgcaagatgaaaagatgtctccaattcgaacctatatatctattgtcagtgtttgagtttgaaatgaagtggtttttctcttgtgtctgggggttttggttcagtaataaatcagaatatactgtctgcaggaagctagggcaaggacatacgggtcttcaggagcttccccaggaaatctgggtgatcggtacgacaattatgcgaactactcaagctacttaaatgatgagccaatgcctgatgccgcatcagaaaaggaacaggttgggattaagtattgcatctcttgctactctgttcaaactttagactgttgtagagggacaatcctttgaagctaaaacattggttgttctgtttgattttttttcagggtaatgagtatttcaaacagaaaaagtttgcccaggctattgagtgctactcaagaagtatcggactgtctccttcagcagttgcttttgcaaatagagctatggcatatcttaaactaagaaggcaagtagctgcaacactgtgtttgcattcgctagactatggtgttcattaatatgattacagatacttaaaaaccttagttggatctctattctggaaccattatttaataagtactagctaccaacaatttcagactgtagatatgcttttatgctacttgtgatgcgtttcatatttctgctgatatacaatttcgatgtgcttttacatttgctcttggtgtagtcttatatttttttatgtgatattcactaggtttgaagaggcagagaatgattgcactgaagctctgaatcttgatgaccgctatgttaaagcatactcacgcagaattacagcaagaaaagaacttgggaagcttaaggaagcaatggatggtatcctatttttggccaccagtctttccttttttagcttaattgttgtcttgatgaacactgacaagcaggtccatacagatgctgaatttgctgtcagtattgatcctaacaatccagagctcaggaagcagtattctgagataaaagaattacacatgaaggtgaacaatctttacttcagaattttcgtcagacatctgatttaaaatagcttttgtgttactaacaaagttttgtgttgattcctatcctacgaaagtcaatattaatgtgttttaattctgcaggaagtggctaacagaagtaagccaaccaaacatacagtttttaaatttgataaatctggagataaaaaggacacttcccatgcaccaagtagttcccagaaggtaggtttgtagatttacagcttcatgatacttatgtagttttcattgtttatcatcatgtgtaataattaattttctattaatgaggtttaaactatgcacttattaatgaggattaacatgcctgccctaacacattcaatgcacctagtacatgtcgtgcacatggcccaacacttttgaactcaccttgttctgtttatttatagttggttatgttcatcatgggtataatcagctaatttgttttgttgtgtaatacctgatgcatttgcattctacaggacagtttcatggaagttgatccgcctagtagagttgcagtggagattagagagaaagcagatggtacatccaaaggtggatctggagtaatcttcaaagacagtaccgtacaggtgttcttttgctacattgtttttccagctatataacaaacatgcactttgatttgagtgttggtatacttctctagttataccatgcatagttagcgccatctatgataatgtgctacatgaggcagtttgtaggcctcatgtattacctacatatcaagccaccagtgacttagtaggcctgctgtcttcgtaccattgactctgcatcatgtctgcttgagttccagcacagcttgcatcacccctttacttttcctgcttggtttacaccttgcctctgggcctctggcgttgccactatggctcacagtcagaatttgcacttcttatttcatcgttatattgtgcttctcatgaaagaactggcccccactgaaaatggacaagcaccttcatgtgataatgtcagaagaggacatggttggtggtagcatgatctgttgcaaccttaggttgtgaatcagtgtgctagggctgtaggcaaagcaaaggagttctgcaaagtttgcaggcttcgtgttaaacaatcatgatgtgcattctgcttggtcgttggacctaagaaccattggtagtacaggtagatttttcacagttctgtgttttcttatgttatgtttcaattaattggtgcagccatctcgagatgctaaacagaagcctggaccagaagcatcaatacaagatcttgcatctcgtgctgcttcacggtatatggccagcactgtaaaaagtgtgaagacaccaaaaacagcatatgattttgaggtttcttggagagctctctctaatgacactgccaagcaaacacagttattaaaggtttgttcctagtccttctgttctctactgttggatacctttgcttgctcattcttgatgtgcaaatttcttatttgttttgcaaccagtcaattccaccatcaagcctaccagagattttcaagaatgcactttcagctgcttttctgattgatatcgtgaagtgcacaacctcaattttccggtgagcttatctgttttatgcttggtactggtttggaaccatggctgcttttgttaatactaattacatacccagggaggacacaatgttagctgttagcattttggagaatttggcaaaagttccccgttttgacttgataatcatgtgcctttcatccatgcataaatctggtaagtttgatcttgcaaccctttgttatcttcatttgtccatcatgcctggcagttacttattgtcaggacattcatgagaagcataggcaaataaaatgatttttggaatgcgatagtagtaatttgttgtgttcggccattcctttatggatagttagtttaaactttgaagtgcacaaagattattcgaaagttttttttaatgtagtcagcacgacatctttagaaaatactctacttgctgatgcttttttcttttcttttgtcacaagaattacggaaggtctgggatcaaatattccttgctgaaactgcatcagcggatcaggttgaagccctcaggcaacttcgagccaaatatattcaggaaggattgcaggataacatgttcacttcaaattaatgatgctgatgctgagacagctcgttagaaaccttttacgctctagccaattgatattgtgtaacacccttttcctgtagaaatgaaatgctaaactcagtgtggggggtagtcaattaatggtggaagttataaagttgtctcagaaacatccatcaaagcatgcgattgtgaagctcatggacctttgctggctgaaaaggctgtaccttcatattcttgatgcatatgtgcccctggggccagggttgccgagttctgcctgtctctataccctgatgtagcggattccctgacactgacatcctgttatgtcgacacaggtggattcggcagtaattttgttgtgcaaattttgcatggataagcattcagtcttttaatagaactttaaatatcaatatatcttttttgaaatttaatctgacatgcgaaaatcatagacgtagatttgtttgaaaagagctctcataatatcatagtcctgatggaatttacatatattgttacagtagatgttagtagtgctcgaagttgcatggggaagataatatctatgcctaaaattaagtgattggagataataaatcttaccaagtttattaaaattgagcacatagtactacttacatgcattatatagacccccaaaaaagtcatgatagaataatttgccattagcatttccctacaacagtgttcttgcatcagagaagctgcactcttggaccatgaaagataagcttggcaagggagatgcagacactgggagctcctcaagctcatcaaagaagtcacagctctcctcttcaccggacagcttggaggatgcaactgttactacctcagcaagggacatgccattgctgagaggatcacttgtgtcaggattatgtgcctgttcttggactgaatttgtagtagtagcagcatagttgtcatggttgtgatctgaggtgtaggtgatgatgagcagagatgcatcattcctgcacttgtctacttgcttcctggctgggcatcccctgtaactgctgcacttgtagtagcctctggatacagcatgatccacaaaaagagcaaagataatggattgatacaaggaaaaaaatcgtactagtaattgatcagacaacctgattcttgtgaaattatcagtgatgtaaagaatcagtgcacatgcaaaagattgtgatattacaagaacattcggtgcagtataagtatgaggaattagtgcaaggtgatgataccttggatgaggagatcctttgattggtttctgcccatatttcctccaggaccaactgtcagcaggtggcccttgctcaaccttatgatctttcaaagacaccacaaccttctgaacatcctgcctcctgcaacagtaacaaagatagacagctgcagtgacaacacaatcacaagagaatttgcagaagcagaagcaaaggatataggtgctagctaacactaccttctcttggggacactgccatcagctttcatgctgctcatctttgtcatttctgcaacactgactacacaagcatatggcagcaggtggaggaagaagagatatagctggtgaagagataatagcaatggcactattactctgaagggcacagaatatgttagtgaacagtgagatgatatagtgactgccaagtgccaacaccacaccacaagttggctgaaaaaggctggagcaagttgctgatctccctctctgccttgctactcttttcttttctatgttttcactgtccaataattgaatgcaatactgaaaatgttcagggttactgtttcagagcctcaccaccattttcctgtgagttcaatgatgatgtggactcctgcaagcctctcttacaaagtagtggttgcaattttgcaggtgtgatccttgtgattttccatgggtgaaccaaattacttaatgacttgaatatatgatatatctatttaatgaagctaaaataatagttttctttatgaacattttgattggccatgcacaaacaaacagcatgattagttatttagtttgtcttgaagagtactctagtactaatatattactaatcctgctagtattattaggtcttacaaatattctatgttctgtagaaagctacgtctatatcaaagcaataattatttatgacttgggtgaatagtattaaacatgtaaaatcacgttgcagttggaggctagctagctgtcaactgtacctccgttttgttataatttagaacatcgatatgatctataacatgcacctttaatggttacttttcttattcatttatccgtgaagatataatgaaagtacattgatatcaaattatttttcatgagaaatctacttatatcattttcactggacaactctcgactttttttgtatgttaatgacaaaacgtattcttaagatttgattgtgcagtaaaaatgacaattgctcgaaaatggatgtaatataaaatagagtaaattataaatatctttctcacaatgttttttttaatccaaatcgatgtatttgagaccattttgaaagnnnnnnnnnnnnnnnnnnnnnnnnnnnnnnnnnnnnnnnnnnnnnnnnnnnnnnnnnnnnnnnnnnnnnnn

SEQ ID NO: 47167 - DNA, 3586 bp, Oryza sativa
atataaattaatcatttcagttatacctactaatttatcttttaaatgatatatgatcatattcgtttcgggttgaagggagtaatatagatatgctatggaatctcatccaaataacgctaagcatgtatacctaacggtaccaaatatgataccctgtaggtatcgatgataccccgtcagtactagctccgggtacctattagtaccgggccgatatcctatttagagatggcaacggggctgcccccaccaggtaatgctaacccacctgtcccaaatacctgaaaatcgaactttagaatcagagaacacaacaagcaattaatgaagcgatacacaacaccatactaaacatgaagggatgatgagtaaccaattaatcatcaccaacaaaaactacgtagaaaaagcattgatgcacataattctttagcgggaagactagacgaagcaatgcaacgcagtttggagttgacatagtgctagcattgcttggagacaggcgaagccatcgagtacaggaggaagcaccggtggcctggaggatgtgaggatgcatggtgtggtgcccgcgtgtgtcctacaggactccttgaggtggcgcggatgtgccccaatcccttgacccggaagcatcgcttacttgtcatgttagcctggacttctagtggcagctctgtagtgcctggatttggaccggagtggaggagagcattctctccccaatttatttgtgtgagaactagggttgtagtgtttgtatctatatgtgttgtacacgggggacatagcgattcggggacaagggtctagggaacgtccccggaaccgatccatcaaatgggggagttttttcatgtttagagcctcatggatcgggatagtggcccatttgcagcccctaatagatgttttacccaccagggattagggttcaggccccattaacatccctaatcccatcggtaataggctaataccccatcattatcaagcctaatacatgtgataccaaacctggtacatgcagatctggtgagtagtactaggcctagctaattattaaggagataactagttgaaactattcctgatacgtttaatgtttttttggttatttataagttcattagttttgatatcttaaaatgttatattttcgtgcttcatatagctatatccatgttcacaatttcgtaaaacttactaattcctaacctttgatcaattcaatttctttcacagcttcttatatgcacagttcacaagcccaaattatgggggcgtttgttttgtttggttaaccttgccatgccatattttagtcatgcatgttacaatttgttagataggtgtttgcttcaatttaagcttgtcagactttaattttcttttacttggccttatatgtcacatgaacatttttgttggctaataatgtcacagaactatttaatatataagtatatgtattactcaggaagtatatacctcataactaacaaaattggtatgtgtaccttatatacttcccgagatttagaaaagctttgtcattgtcaatcataaatttatcttataatatgtttaatcaatttatttttttagggaggtatatacctctccaaggatatataagaacctctataagggtctttacttccgtgcggttaatacgtgcgtagcgctcagtatatcatagtttaaataatcataaaattataatatttagagcatcattaaaaataacttgtgcaacacacgggttgacgactagtattacataatcacattatttaaaatatcaatcaaggcccaaattgtaggtgccccacttatttgatgtattaaattattacaacattttggtaacaccgacaaaatatatcactaatgctgaggatctgaactccacgagcgcgcacacaaattaatccacacacatatatatgtatagctaagatgacataagataattaccaatagggtagggtttatttttgaagctgaattaagcttttaatgaagccttaaatcttcgaaatgaacttaaaagttaggtagtactagcattattccaagtaaataaattttatccaaatttgaaagttaattaggagcgaaaaataactgatcataattagttgggcatggaatgaagggcgaggtgtatcatttgggatagaaggcgacggtagtctgcaagacagtggagatggcgagaagagtggagacgatgagcgcgaggattttgacagggctgtccatgtacttcttggcctccgcccagtaacgatacgctttgttctggctgcaatccctgagcccctgcagcaccttgccgatgtgtgtcttctcctccgtgccgctccgctgattacctcggcataggttcttgaagtactcgatgatctgcatatatatatatatatatgcgcgcggtaattaactgataacgaattgagaattcagatacatgtatgtattcgtgacgagattgatcgaatgataagtatatatatactgaccgtttcatggcttccgaagttgttgaggaggacgccctgctcctggagcacggcgatgtcgtccgtggagctgacgaggttgtacatgaggaaggcgtaggtggtgaagtagtcccgggggtgctcgtcgtcgttgctcggtggtggcgtgccctgctgctcgtacgcgacgaggttctgcagcagctgcaccgtgccctggtcgacggtaagcgccggcacctccagaaccggcgacaagaggccattcctgagccgcacgtccagtattccgccgcgtttcgtcggcgccttgctgatcttgacgccgaggccacgcagctgcgccgccgacacgatgttcgccttcgccttggcgtcgtcgtcgtccttgtcgtggccctgctgctgctggttggtggcgctgccgtcgcgccggcggaggccgaggacggcgcctttgtcgtcgtcgacattgacgaggtgggcgtgggcgaggtgcagcaggtgcagcaggtggtggacctccttgtcggcgatgagcttgtacagctcgtcgctctcgtcctcggggaggacgaaccaccccttgagcatgtaccacatcgccatgaccagcagcttgtgcctcttcctctgccgcatcatcgtcttgcgctggaaggtctgcggcgtgatcatcatgccgtcgtcgcctacgtcgcgcgtgatcttccgctggagcttccgcggcgtgaggtggtagaagatctcctccagcacgaagaaggggatctggttctccagcatgccgaggtcgatgcgcagctgcgccggcgaccaccgcgtcgcgtacagctcctcctcgttgtacccctgcacgaagttgtagaggtgcttgatgatgaagcacccgtcgtgtagcagcatcctcaccatctcctcatccttcatctcgcgcacgtactcctcctccgcgtaaaacctaggacctccacgaccaaatttcagtttcgctattcttgtcggggatttggattgtttttgtttttttagcaaaatttggtctaacgagcaaatctacggttcttgaggag

SEQ ID NO: 47168 - DNA, 6730 bp, Oryza sativa
gacagagaacatttttgaaacataaactggaaataaagctcgcacagatgcgttgacatcttatttgttgttcaagggaaagaatggtaaaataaatcatacatcactatatacacggtaaggaaataatgtaaattatctaacaataaaaaaaagaaatatattgcctaaaatagatggtagattttaatatactactaaatatgataagaataagaatatctctcatatttaaataaaaatcccgttgtcatggtcatatataaactcccctattgttattgtttcaaaagctatatgcatttttaataaatgaaatgacatattccacttctatgtataaatagtctaaccataccacttctatcggataatacaataacaccattaaaaatagacatgaatatctctctaacggatgaagccgactgtaactactagagctttcttatgtaatgccctgaaacatcggacctacatcgacgtagccgtgcccccaaagaccagcctatagcatcattttaacacttaattcactatcgtcacactcacaaaggattccattagttagtatttccctttagatacattgcctacagtagcctttcactgacaccaccttaacttaaccatatgtatacccttgcaatatttacgatagcatagtaaacactacaccctgcattgaaggacagagagggacagaaaggaggaggtaatgaaaatagttataatttttgcccctacttatttgtgtgtagtattatttttaacaaaatcgtagtttaaaaggctattgacaacacataagtgccggactgctgacgttgatgatttttcttgattagaactatttctttgattttactattgatattttttttgatttatcgtttttctccatagtatatgacataggtaattaagtttttttttccggaaagtgagatgatcgtacgaagtacacatacgtacgttattctttttcgggatggagattagcagcgtgggagttttgatatatctaaactaacggttaaaataacaggtccaccaatttaactgaaaattgaaagttggatgtttttcttttttctctgattttttaggatttctctaatttattagagtgccacgtggcgacgtaggaacgttgcaggaagtttaatggacttttagtatataatagatagattttgaaccatgtacattatcacagtcaaaagcggatccaggataagatatattatatgaatttattttgggactaagagggtactgtatatatatgcctgtgtcttaactccgacggggaaaaaaatataagactagttcatactctttcaacaattgagctgtaaaattagtacccctactgtttttacctgacgattaatttggagatctctatacagtttcaactgcacatattgatcaatacgctttagaaatatatttaaaagtttttaaaattatagcttcataaaagtacttgtcataatgaatttattaacatcattttgcataaagtcttaatttttatacattaatgatttaaaattttgatgtttcacgcacaagttcttgaacgccgaaaacccgtttttcattttctagtttggttaccacaaatcatgtgtgcaatacctatactaattcggtactcaaaatgggcaaagctattgaaaagtaaggaatggattctaatcctgggatgtcccctttgtttctttttcttccgaaacctatgtaaatagttataaaaaaattaatacaaattgaatagtgatatattgaactccaccaaaaattaaatttaaatttgatctgcacattaagaaaaaaaaacaaactcaactatgaatatataataccactattattcatatgttaaatttgtcttttttatatctcaatttgtgagtttgactttagatctaagattatatataatggcacatatatgttgtatgaatgttatatatttttttcagaatttttcatagttatttgaagggtttttagataaatgagaggacattctctcgagggtttaaaacagtatatatcgcctgataaagatatggttgatggttagaaggatcatagtgtcacaattggattaattaatatgctgttgaaaatagtactagtacacttcaggtttttttcattgtcattatatattcaattttagttgtcctaaatatagttgttcctaaattcgagattaatatatatgaaattgcatataggttggactcgtgaattagttttttaaaataattatggaatcgaaaataagttgtaactgacgtcgactttctaatctaatctggtataatttggaaaagaacagtacattgtgtatgcgattgaaattttaatgtttattcaaactagagtaattatcataaaacatgaaattacataaaccgcttatgttatggcttgtggcgtataactacgggttttatggtatacatgtttttgaaaccctaccattattcaaatctcatttgcatatctgaaaaaaataattttcaaaatagtgaagctagaatttaaactaccaaccttaattaataaatcaacaattataattttcatatacaggctatgttttaaaattttaaataaatttgtgctcaacatacatatgcatggtgtggttttgtgaaaactttagaaccattataaatagggttcacatgtcattaatcataaagctttttatgcaacattcatagtaaaacgtgtggttttctgaaatttcacacttgcccgggagtatattgcatttctatgtaagcaagggaaaaaaagtttaggcaaccaacaacaatcttctgttatatactgaaaagcccactaattaaaccttttacaaacgcttctaaaccagcacgtggcactcgtacaaacgctcctaaactgtcacatgtcatgtctataaattaagagaaatttcaaaaattcttaaaatggaaaagtacccagccgttgatattcacttaaatccattattttaactattaaattagatatctctaccgttataaaagttgaagatgtttttgccggtattttggtacgtcatccgtgtttgagtcagttttaagttcgttcgcttttggaatacatatcagtgtttgagtcggattttaagttcgtttgtttttaaaaatacgaaaagagtcgtataagaaattttgtaaaaaaaaaaacttgcatactaacttgagataaaaatcggactcccacagtgaatttcaccttagctaaccgtataataataataagattgaaatagcatccacccgttgcaacgcatgggcatcttttatagtattaaataaagtaaatcccttcctgctaacacccgtaattagcatgtatggtagatcactctcgaaggagtggagagacgtgctacgacgtacgtactcccacggtcatataaaaaatcaacttttggaatgaatttggacaagtatttgtcaggtttatccccagaagttttttttttttttgtgagggggaggggggggggatgatgtaggtacttaccaacgaatatcgtccacaatctcctggaggctgcttttgcagcgttggaggatgcctccatgcttgtggtcgtcaggctcgacgtccctgaggagctcgtggaggtagcgcttcttgagcttctcgccgcagaggcggttgcgatcgccggcgccggcgtgacgacgatggtacgggccgacggacacgaacttgggcgcgtacgcttcctccttgttgatggcgcgcacctgctccgggactcgccacagacggtacttcttcgtcttccaccggaacgacagcgacgatggcgggaggtcgccgccatcgtcgttgtcgtcgtggattatgttcaccctcacctccggcagctgctgctgccctgcctcgtccagaaaaaccatttctgtagtagtgtcatcaccgtttcccataatatgtatcttattgtacgtacgcagcatgctgcatgcacttagttatccaattccaagtatatataggcacgtcgtcgatcgatcgtccgaccggaatttgagatggcgtgtcgccggcggcgatcgatcggcgtgatggtggtgcatgcgacaatggcataaaataaaggaagaagcctcttctctggcctaatcgattctttttggttggcaaatggacgtatcaagcgatcagtgcaagctttgatgttctcatgcatgcatgctgatctgtatgtaagctagcccctttaatcttcttctttttttcctcttcactaatacagttagcatctcaaccttttttcctcttcactatatatatagctagctagaatcgtcaagcttttccttatgttgctacctgctcatgaagtaagctcaggttcttcttcctatattagtctatatacagatagtgcatacgtacgtaatagaaagagccctgtagatggaaaggttctttttttttcagtcgtatggacatacgtcgtttcatgatcaatgccgtcaaaaaattattttttagaaaaatatactaaaatagattaatatgtgatattttgctatataaaagtgcaagtaaatattcgactcatacaaccagaaacaaagacaataacaaatatcaaccatgaattatacgcacacctttttcatggtcatatatattggttgtttttggttcacacacatttgtaatttctagttgtgtatattaaatctaaacttgcatgcatgtttgtgaagtgatatatctcacatattgatatattttgtaaaaaaaatattactttttatgacctttttagttgacatgctttagttggcatgcgcgcataaaatagtctatgtccactcaaatgataaaaagactttcatatgtacatgggattttacatggatgttcagcaattactcatttcatctacttctggaaaagtcatttcatcttaaagaatgccctctctttttatatccatccaaataattatgatttatttaagggaacatatcatatgcacacaacattcctatgcatatactccgtgcatatcaactaacaaatgtcacagaaaattctagaaaaattggacacatacttctaatagtattacatctacgtgtgaaatcttatcttcaaattcgttatattttaaccgtaacaaaaaagacaaaattttgatagatttttacccttaaaactgtcagatttttcactttttggttacagctaaaatataatgaatttgaaaatgagactttgcatatatgtgtaatactattaggagtaaatgtccaattcttttagaatttttcgtgacatttgctagttagtgtgtgcggagtgtgcacggaaagcttgtgtgtaagatatgttccttattttgaagagatatatcactccacgaacattgataacatgtgtttgtaagttttaagctatgtagaggtagcatatcaaatatttaatagagttatatacattgaggaaaggtcctgatctttcgataggtatgaataactctcgatttggtggaaacttgatacacatgattcggtttccgatcaacacgatctaaaccctgcaattgtagcatcacggcttctctggttatcaaccatacgctgctatggttgatctcaccgagaaggctaatctctgcatacgaatcgaagaatacaagaaagaacagtatagattgcaactcaaggtgttgtcgtttcgtgttcaacagaaattaattcaccctttaattggttgaagcaacaaaaattaatcttggttgcctgtgcgcacacagggcattctatggtgcacatttactttttgtccaaataaacaaagcgacgatttgtgatatggtgattcttttgagaaaacataaaaaattctagatgataatcaaactgggatggagggagtagtactttaccgtacgcagcatcggccgctgaattgaatgcaaaagaagatatattgtcatcaaggaatatatgccagaaaaaaactttgagctttatgccaattgagggagagctataattttttatatcttattgctgcacgctcaatatattctttctacttttcaagtgaaaaagtagtcataaaaggtggtgtgaatctctttttttcgataaagctaacgcccactaaatacataaagcttaacatgcaagtatagtatttattagcactttaaaacctacatacaagcatgtcatatcaacccattaagcatacaaaacttaacatgtaagcatatagtaattatatatacaatttatttcatgcacaagctaaatcatcattctcaaaagcacgaattaccctcccccgaattatcgcggtcgaccgaattacccctctaaacccgaaaaccaaacatcgttcaccctgaacttgtaatatcggacaaattacccctcttacctaaatttagagcggttttgtcctacgtggcgtacatgtggcggtctagtcaacattttatttataaaaaaaatatggaacacacctgtcatactcctctctcactcttcctctctctttctcgccggtcgacggcggcgagcgacgccgagcggcggcggccgtggccactacaaggagccgcccctcggcgcgcggacggatggaggctggtgcaggcggcggcgcgggacacgaagacggaggcggaggtggcggcggcgga

SEQ ID NO: 47169 - DNA, 30327 bp, Oryza sativa
taggcgagctagctagctagcacgtcttcttcctccgccacggcccaacgaggcagccggcaaagctaggcaggcgtacgaactcgtggccaggaaagctgccggcgtcgcgccgtgcaggggccagcctgccgtccatcatcaatgcctatgtcagggtctcgggccggctgcacatgggccgctaggcaacccgtcgccaagaagaaacagaacagaactggcaatcggcggcttcggccacggcggcggcggcgactaggtttgggcaagaaccttgtcgatctctctcccttacttctccttcttcctaccagccactacactcttcttgtctccctctatagaaccttctagaagcttgtaatactcagctacttcgctcaattccacctcaaattggtttagatactgttgcttgctatttgcttggtgcatcgggttgctaacagcctaaagggatcctatgtctcgacgcaagcagctagcagcacagtgcagctctgctctgctgctctgagagattcggtcgtctgcactgccgcgtcttacttacacggggcacctcttcaacgacgacgacgacgccgccgccgtggcaccggccaccgccgagacgacgccgctttggacgctagcccgctcccactcccacagccctgccccggcggcgccgagccggcatcacggtcgcatcaccgaccgcgaacaatggtgacgacgactactcggcggcggcgtgcagcagcaggtggacaggaaggctgcctccgtgtcacccgcggccgccgccgctccgtgtcacccgccgccgccgaccagtgagagaagaagagtgagacagagtgagagagaggaagagtatgacatgtgggtctcatatttttttataaatagaatgctaactggactaccacgcgtatgtcacgtagattaaaatcaccgcggattgggtcgagggagataattcgttcggtttgcatagttgggtgtgaagaatgtctggttttgcgattcagaggggtaattcgtacgttttccttttcataatatttcaatccaaattgttttattatttctccattatctaacatatatctcgcagcaaagcgcggggcatcatctagtatatttatatgggtgtgtagcccaaatttagtaccctattcattagtaatacatgaaactctaatcagtgtctgttttcttaatttaacaatataattaattctgttataccctaacttcaaaaagttgtaaagaagtagtacttgcaaaattgtaaaatatctcatgaatgtaaactgtcgccgcgcggttttcaatttggaaaaaaacaggtttcctttagtttgcagtgtttatacttttgcgcaaatcagcggccgctttaataccactcaaagaacttgacctttaaatcagcggccgctttgttccacttgcaagtgggacaatggtagccgtaaattgatcgtacgtgcggctgaatttttttctgccgacgccatcagatgcgctgaattttgatcatcgccagaaaattaagagagaaaagatcgagttagctagcgtggaatatcgccaaggaatatatgcacgcttgcgctttaattacttgaatgcatattgtgccacacgacaactaattttctgtccagacgtactgcttttggagagaaatttcatcaaaaagcatatgccgatcatgttggactttttgctttgtttaatttcgtcgatcccttccttcactcgatcaagcttccaccgtaaaggtttcacgcgtacgtcgtgtgttggccgacgtgctggccgtggctggcatgtatgtcttgatagatgcgtttttgtgcatcgacctagcaaacagcagctatatatatatatatagagagaggagggtcttgcaatatcaatccatcatcacaactcatcaaactcagatcgattgtcattgagagcgagcaactagcgctagctactactcgaaggcaaaatggtaagtaaatctcgtatacatatatgaagtaattagttatttggcaattagatgttgctgtaacccatttccattatctaaaaaaaaaagatgttgctagctagtgcatatatattcatttatatgcatgatcgatactgctggccggggccgccggatacatctgaattattagacgtagaggccggattaattatgtcatcttaaagagaaactaatttaatggttatgatgtatatatatgcaggacgtgatggagaagtctcggcgagctcacttcttgttcgacgacgacgaccaaacgccgccgaagcagaacggcccccagaacgacgaccagcacaacaacgacgacggcagcggctgcctctgcgtgtcgtgctacggcggcgtcgcaaaaccaaaggcgcccaagtcgtcgtcgccggcgaaggacgtcgtcgccggcggccgtcctgctgcaggctccaactgtacctgatcttactctaaccatatatagcttgctagcgatcgagctcgatctcatctcgcacctagcttgatcatgtcgagcaaccatgtacgtgttgatcgacatgatcactctagctagctagctagctacttcatatggatgttgaataagggatcatatcggaggaagacatgcatgagtgcttatgcaactatgcaagcatgcccgtctccaattactggtacagactacagagtgatgtatgttacgagaaatgtactctttacaaataccatgaacatatattatgatcaattacatgacagttgtattattaattagcagcgttctgaattcattctgaaagggtgtgtccggcctttcgaatggacaaccagctgctgtaattaagctgttcattgttcgatctcttgccgaatagtataacattttttttggggggaatgggcactcatttattctttacaaatgaatatatctccgtaggagtataatggaaaatctctcgattttgattgtgttgtctctactcaacaaaagctgagtggaagccgggaaatttcctgcacaagttcttcaacttctgttgcaatccactttattcgttttgtacctgcatccacaaagacatatctagctcctcaaaccacatagtatatcttgagagtaagtttaatgcttctatatgctcctcaatgaaaaaactgcacaatttttaaagaagatgagaggcccagattagaaggtactgatagtgtaaacttcatttagggagggtaattttgtcctcgagggagttaagtctagagcccacaccaacagtaatcaccgcaacttttcacaaactgaaaaccactaattaacaaccgtgatctccattgcatttgcatcgcatcacaaacacaaattgttcatcacctgaaagtttgaaacaaactaaaaacgaaagatgcatgcattccaagctgcaatcattcttgcgtacaaaatgcatccaaaagttacgcaatggcaattatgggcactgcaccatgggatcgaagcaaacaagcaccgatcgatgcgttcgttcacttttccctgataattgcctttctcatctcctctccacttaaactgccatccaagcttccaattcctggcgatgttggtccggaatcgatctaaattaaaagagaactggccggattactcaaccgtactgccattgaagcaaccaaatcaaggtatttcaatgcaaatattgtagatgagatgagtgtgaaggaaaaatataatagggctttgtgggcgtctggagtatgaactcccagtccagatcaatcttgtgctagccaaaaggattgatccgttgagtgtggggatcagtctgcggttctaaccatgatgacgggatccgggtagacgctggcaactacaacagctttgttcatgtaacgctccgcttctcgtgatacgttaaaaactaattcggcaaaatcctatatgcgaaaatttcgttctttgtatgcgagtctaagttgtgccaaggatctcaattcaatctcttgttgttccctctcatcgccatcaaaatcgtccacctcaagattccaatttcgactcaagtctccgaaatcaaactccgaaattcaatcgcatcctttgaatccccgccaaatacctatccccatttccgaaaatatcaaattcccatctcgaatcctttccttgagtctcccttgattcctccctaaacccccgagatcgaatctcaaatttgaaatttaaacccaagtcccaaatccctccaactcaaattccctataaaagtctactttacctccctgtgtttttggatggaccgattttcctcccctcggcccaccttccccgccgtccctccccagcccatttcctccctctgccgtcctccaccctcctctcgcacgtgccgagccgagccgagagaaagagctctctcgctctcgctgtttctctctctctctctctctctctcgttttctctctcgcgcgccgacgccgcttcccgccgtcgccgcccaaaacccgccaccgccttcgctcgttcccgcgcgcgctcccgccgtggtggccgacagccctcggtcaccgtccgccctggcccgcctgcgccgcgcagccgcccgcgcccactctgccgctgcccccacctctgcgccgcagcgcgcgtgtgtccaagacgcggaggcagtgcctctctctcccacgcgctctctcctccctcagctcgtccaaaatcggcaaggagccgagctcctttctccctcccctttttgctttttccccgatcggcgtcacgcccgtgaccgcctctaccgccgcttggccgctagctccgagcacgaccgccagctgccgccttgaccgccctaaggtcggtttgaaccgacctcccgcgcgaaccaacctcgcctccactataaagccgagtccctcctctcaaatccctcccacttcagtctccaccgctgcagtgccatcgccgccttgctgccgccgtcctcgccttcctccgccgtcgcgtgtgccgggaagccggcgtgcgcgcggaaccaaagagggctctggccacccttcttcttccccttccccggcccgacgacggggaactcgcttccgcgccgttggctgcttgtcaccgcgccgtcccggctcggtagtgcctccctcccgttccccttccccgctcaccctcgtcccctctagcttgcgtggtagctcggtagccctgccgaacgcgcgtagacgccgccccaaggaccgccgccacccggcatggccccgccgccattgccgcccacccccggaggccgcctctcatcgccggctgtcctcggtgctcctccgtcccatccggcgccggaaacggattccttgaaccccggatatgctcccaccccttttaatcgaacccccgttgctccagtgaagtttcccccttttctcgccgccggcgtgcgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccatcagccgtccatctcggccgccccttcttcctcctcccgccggtccgcgtggctgccacgtaggcgccacgtcggcaccacctcggctttgaccgagccgagccggtcagccgcctccttccttgcccccctcccgtgcacgcggtccacggtgcaccaaccggctgcgcgtgggcccgccgcatccctggtccatccggtgcacgcgcgtgaaccgcgctcacccggaaccctagagctgccctcatgcgccgctcccacggtgagccgcgccactgacaagcgggccccacccgggaccccgcaaggtggattcggtccacccggacccatccccctctctcctcccgcgcgccccgcccgcttgggccgcgccttgcccggccatgggccgcctcctcgcgcccgcgcccagcccattggctcggccgcgccgtgcttatctattgggccgcactcaagccgcccgaggaagtctaaatcacatccctccatccttttctttttcagggatttaataaatcctttttcctttgtcccataaatcaattccttattcccaaaattccacaaatcatttcctttggtcccgcgcgtcagtgactgtcaataatattcttgagaatattatttctataaattccataaatcatttctcctatttcggaaaatccaattaaacttcgaaaatccatatcttccgaaccgctcatccgattgactccgttccacttccaataattccgtaaattgagatctatttaatggcactactaattagtctaaataggatctttcttttggtcttttgtttaggtttttgattgtttgcgtatagttgcggttaccggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgtgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgagtttgtgaagccttcaaaacccgatatgtggtgtcggtgtgtttgaaaataaaatgaattgtgaaaactcgcgatgcgggggttgtgcctatgtggcactgtcccgtattcgcatataaggaccgattcctgtggaaaactcatcgaacataatcaaagtgcaaccacaaggtggaatgggacaccctggctaagtagctagtcgattcagggaaacctcgcatgccaatagttgggaacgccggggcggggtcggttggagccaaaccgggttcctggtaatgcaagaacgagaagtttgctgaattaccgatcgaggtggttggagtttgaattgtgaacgcctataatggcctatgtttatgtgaggatttgatcattctatgtggcatgaggtatccctgggtcggcttgggaaaggctttgtcgcgaacctctgacaccggccagtgtctggagtaagttcgtgtcttgtgggtaaagtgtacccctctgtagaggttaactaactgttcgaacagccgtgcccacggtcatgggcggatgtaaggtggttcccgttgcgtagatttgtttgcctgtgctttgtgaaaagttgttgtggtgtgggaatcgtaaccagaatcagcctatgtggcagatggatgacctgagtggtcagaaacaaatctgtgtgattcgggatgtctgtgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgagccgggaggtcggtacattaccaaatgagctgttgaaaaacatctcttaaagtcgaaacgagacgcaagtctcttttcggcccaaacttagaaagaaataaatcacttagtgttttcaaaatgtcttcaaataaaagatttgcaaaacaaccttgcctctcttccaaacttgcattaaacacctaagttcccgtgacttgctgagtacgagagtactcacccttgctctatataaatatatatatatagttcctccgctctgaagagaagataaagtgaagtgaaaattagagtttcgtcctggttcccagccgtcgcctgtggtgttgggtgttagaccgttggttccgctgctgctgctgctgctgttggtgtttcctcgtccacgtcgtcgattgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacagttcgagggtagtgctgccatggtgactttaacaagatggtcgagcgatggcgcaccaaatatggaaaattctactagaaaaatgttttctaccaacgatccccatactctgtaaatgccgtagtcatgatctacaaacatcgacaatacatgttaggtaccaaaggatttccgtcggtatcaatcgattcccattgttactaggccgattcccatgtagataccccgtcggcaccaagcctgatacgtgtgataccaaacccctgatatatgtagattcgattactggtatcaggactgggcaaggagacggtgatgatgacggttggcatacgccctccactacgacagatatctagagaggcccaattaatcttagaacaaactatgtctttctctatatctcttttttgtatttcggcctttgaaatggtttgctagttgaactatttatgactgcgttcgatgcttttgctttgtttgtaaatccactagtcccgatattttgaacggttctattttcatgcttcatagctccatatgtttaggtagggatgaaaacggtcggaaatgatcggaaaacagcctcaaccatttccgtaaccatatttttctcggaaacgaaatcggaaacggtaaagtcggaaacgaaaacgatatcggaaatatcggaaaaccgaaaacggaacaatacggacggaaacatgtcggtacagatcgaaaaccggtaacaaatacggaaacattaaactataaaaacatatatttaactttacataagtatgttatatatatacataaattcaagcttatactatataaattataaattaacttcattttagccatatacaaaagttagagattttattgaagagtcattcaatctataagctgtgggtcaagtatagacatgtcctataatatcgacatatttagaatacggtaattaccatattataagaaacggtgatttccgcgagaatacggtaaatacggaaacgatcggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctatgtttaggttcacaatttcgtaaacttattattttttaatcttccagttctatttcttttggcttcttaccacaagcaaaactaagggaatgtttggtttatttggctaccttgccgtgtcatattttcgtcttttcatagtttgttaaatattgtttgcttcattgctacaatattttaagtttgtcacactttttttattttacttggcacccctaaatgtcacatgtacattttattggcgaacgcacaattaacgtcgtgcaacaatttaatgccactttggtgccatagttaacctaagtataataattgtggcacatatgcacaccatacagattaaagaatcacacataatctaaaatatgtcagggcccaaaacatatgtgtcccctttattggatttattaaattattacaacattttggtaacaactacaaaacacagaggatatgaattccacgcgcgcacacacacaaatatgcacacatatttatggcatatatatctaagatgaaattagataatttccaatagggtagggtttatttttgaaccttaagcttttaatgaagtctatttttcactgtgaacttaaatttcatcataagctttcaaaaattaggtagtactagcactccaagtaaataaatttatccaaatttgaaagttaggagaataaaataaggtgagttgtatcatttgggatagaaggcggtggtagtctgcaggatcgtggagatggcgagcagagtagacacgacgagcgcaaggattttgacaggggtgtccatgtacttcttcgcttccgcccaatctcggtataattggtactggctacataccctgagctgatcgagcaccttgccgatgggtgtgtcctccttgctccgctgattccaccggcataggttcttgaagtaattgatgatctgcggtaattaacaacgacatcagatagatatgtatgtcctgtctaaaacggcatgtttttgtcacggagggaatgagtaacgtcattaaagaagtgtccaaaattccactttttcccccttttgttaaaagctatatatatatggttccatatttttctcttgattttccgattgcttctctcatgtaattaattgatacctctctgttttcttatatgtatgtagtaagtttctctcctatttcaagtagataatcaaattcttttatatgacatatatttagtgtaaaagttgaaatttataacgtaattatagtgtaaacgtatttatttaaactttttcttggaaaatatgcaccataaatatagttagtctttttctaaccagttttgctgaaaacatgtgccatatttttagttgattacggtcacttatttctcagcaccgaatctagtatgtggaaaaagtatcttaatttgcttcatggttggttaatttagcctgcttcaatccccttgcagaacttttgttatggtgttattggccattcacttcacatgtttcatccaaataaaaaaaatgtcaagaggtagatttccggaacctaacagtattagttgtttccatttcctcatttgcatttttttctcaaattttgttttatatccagggaaagcttatttactctttagtttgaaataattaaaagatatgattgacctcatttgcgtaaaagaaaacgcaaaccaagtttctttcctttgcctacattttctatcttctatctcatttatctactcttctgagtaggtaatcggttactttaaattataataagtatcatggaaataatctcaaaattattaaagcttataattaattatagtgtaaatataggtaattacaataaaaaagatttgatttatttaagatgatttgaaaatatgcctgcatatgcaatatttgcaagaaaacccctcctcatctcaaccatttttgaacatcttagatcgcaccaagattcgtgcaagcataatagttaaccttctcccttccccacttcccccttctcccgtacgtgatgcgaggtcaaacttgccacctccaacgccgctccttcctgttcagcacagtgttggcatcttcctttgtcgaagagaacccacctatttcctttccctgccatcaacctccccctccctacctctccttctccccgaactgagtggtatacgatgttccccgcggctccgccccaccgtcttaactgtcttcgacagctcccttgcagctggaaatgccccctcctcctaaacactcgaaaccgaatacttcctctactgtccccatacatcgcccttatccaaccgtacggttctgacggcagtgttacgccacccgcccgtgtccgccactcacaaacatccctttaagtcgtcccagcaaacttctctctcctccctcccccaacctcctcatcccaaaccctaatatattaattagtactctggtagagttagggtgtcgccatcgagaagcccggggggcatgaatctttgcatatatacaaccaacggtagatataactgtaagagatctcccaaaatgtggtgtagagtgctatttttttcctcagatcggcaagttcatatggttttagagagagatgttccctttgtttttgtttcatattataagacgtttgattttttaggtttcattaaatttatagaaaaatttaacttctacaatataaaattattatcattaaatctagcattgaatatgttttcataatatgtttttttaaatactaatatatttttctataaatctattatattattaagacagctcgaaaagaaggcaccacgttcgccgtgggggctagaaattctcacattaatcggaggaaaagaaaaaatatcgaccgcttgttcattgatagcctatattttaatggctgagatttaattaaattttggaagattagacttggtttcacgtatacggacataccaggcactagaaactggacatacgtatcagctttgaaaggagacaccacattcactgtgggggctagaaattcccacattaatcggagaaaaagaaaaaaaaagaaaaggaaagtccaagtagaaatacaatctaaaaatagttaaaattcggaattaaaaataaacaatattgaaagaagtttctgtataagaacccaatttgagattaaccgaaattcgaaataaaaataaaataaaatccaaaattagaaaaaaaaagagagaccaattagaaatataatttaaaaatagctgaaattcgaaatttaaaataaaatattaaaagaagtttccatataagaaaccaatacgagattaatcaaaattcagaataaaaataaaataaaatccaaaattagaaaagaaaaggatagtccaagtagaaatataattttaaaatatctaaaatttggaattaaaaatatggaataagagtccatataagaacccaaaacgagattaattaaaattgggaataaaaataaaaataaaatccaaaattagcaaaaaaaaaaataagagttcaagtaggaatagaatttaaaattagctgaaatttggaattaaaaataagcaatattgaaagtagaatccatataagaacctgatatgagattaattaaaattcagaaaaaaatatctaaaattagaaaattaaaatagagttgaagtaggaatacaaatttgaaacaactgaaattaaaaataaaaagtaaaaatattaaaagaacacaatacgatattaattaaagtttgaaaaaaaataaattctgaaattagaaaaagaaaaataagatttcttaagaatacaaattataaataactaaaattgtgatcaaaataaaggctattgaaagaaaataccatctaaaacatatgacgaaataaattaaataacaggcctataacggttgatacgacatataaaaattattaataaaacaccaaatataatcctaatgatgattaaaaggagggacgacaagcaggccgtgaagtaaacgagcaaggcggttaccgggacttttagaaagtaaaaaaaaataaacctcattgataatcatattcgatttttaaaatctcaatgacaataaaaaggagaagcagcgggcggggtgtataggagtatagttgcatagccgccgacggttgacggaacttctagaaaataaaaaatgaattccaacgatagttatgttcgatttttagaatcacaatgacaataaagactaggcggcggacgggccgtaaaggagcatagtgccattgtttgacgagacttctaaaaattataaaaaataaaactcaacaagacaattaactctaaaaactacaacgtccaatttttaaaggttcgaaacttctaaaaagtaaaaaaaacaatgataatcatgttcaattttaaaatctcaattacaatcaagaagggaggcagtgcgcgagccatagagaagtacaatggcaaagccgctgacggtttggcgggacttctagaaagtaaaaaatgaacccaaacgataattatgttcgatttttgaaatctcaaggacaataaagagaagtgacagtggacaggccatagagaagtataatagcaacgtttgacgggacgtctagaaactataaaaacgaaacccaacgttacaataaactctaaaaactataagatcctatttttaaaggttccaaggagaatgaatagaaatagtggtagatcgagcaagcaaataaaaaggagatgatataagagatagcaactgatgtgacttttaaaaaactatataattagaaacacaggatgataagatttggtctttcaaagtcttaagacaatgagatagctatttaataaattttaagtaaaatcatactaaaaaaatatatgattttatttgggtgctagccgcgcaattgcgcgggccacccaactagtttgattaaacttaacaaagtttgaccagtaaaaatgtgaaaacacgagaaactgagtgagagtatataataatgcggtgttgctgaccgtttcatggcttccgaagttgttgaggaggacgcccttctcctggagctcggcgatgtcctccgtggagctgacgaggttgtacatgaggaaggcgtaggtggtgaagtagtccttgcccttccgcccttgggtttgctggtcttgtccttgccgcgccggcgtgccctgctgctcgtaggcgacgaggttctgcagaagcaccgccgtggcctcctcgacggacagcgccggcacctctagctccggcggtattagtctgatctcaaggcttttcctgagccgcacgtcgagtatcccgcctcggtccctcttcgccatcctgatcttgacgccaaggccccgcagctgcgacgccgacgcgatgttcgccttggggtccgtcttctcgccgccgccggcggcgcaacaccggcacatgtggagcggcaagctgacgagaaagagtgggaggatgcagagcagcagctgtagggcgtgccacggccactgccagcacagctgccactcgcatggcggagacttggggccggcgctatcgaccttggcgaggtgagctatgtgcaccaggtgcagcaggtggtggacctcctcctcggcgatgagcttgtacagatcgtcgctctcgcgcgtggggagttggaaccagtcctgcagcatataccacatcgccatgactatcagcttgtgcctcttcctccgccgcatcgtcttgtcgtcgtccttggcgacgcggcgcgtgatcttgcccaggaaggtctgcggcgtgaggtggtagaagatctcctccagcacgaagaaggggatctggttctccagcaggccgaggtcgatgcgcagctgcgccggcgaccaccgcgtcgcgtacagctccggatcatcgtacccgatggcgaagttgtagatgtgcttgatgatgaagcacccgtcgagtagcagcatcctcaccatctcctcatccgtcatgccgcgcaagtactcctgatcctccgcgtaaaacctatatatctttactattataaaaattgaagatgtttttgtcgatactttggtacgtcatccgtgtttgagtcagttattaagttcattcgtttttgaaattacatatttgtatttgagtaggtttttaagttcgttcgcttttggaaatatagaacaagtcgtataagaaatctgtttaaaaagactcgcatgataaatcgagacaatcggactcctaattatagcttatgattttgtaaaaacaatattcaagcaaatttctacattaaattttattttagttaaatcatataacaataataagattaagataaccttcaaccgttgcaaagcacaggtatttatttagtatatctatacgtacacacatacaaggtaaaatgatgattaacttttgcccctcaagaaacatgtacgtacgtagtacacttgtttttttttattatgtcatgtaatcttggttataaaaaagatgctgaaaggatgagataacatagataattttgtgatgtatcactctaccaacacgtaagtcatttaaactcgacattaacaagttgaaacgtaaaatttcgacttagttcgtttcatggtaagtggagaatatttccggtgcacacgaaacaagaagactcattagccacatgatttattaaatattaattattgtaagcttgaaaaatagatttatttgatttttttaaacaacttctatatagattttttttaaaaaaaatacaacgtttagcagtttaaaaaacgtgctaacgaaaaacgagtaagttgaaatttggagttttgcaaatagaatggggccttatggtgtaattgttttttattttctcattttatggatcaatttgaaatttatttcttttgcaggacgatagaagacgactaagatatccatgttgtcaatttttttcagctttcttatagctgttttttaatttgagaaaataaaactaaaaatgaggagaaaagatgttttaatttgtttcttctatatttaacaatgaatcaaataatatgaaaaaactaataaatacttaaattttttgaataaaatgaacggccaaatatgtttaaaaaagttaaatgcgataaatatttagggatggagagtacttagagaaggaaacgtacgtaccggcgaacagaatccagcatctccccgagcctacatgtgcagagtaggaggatttcgtctcgtttggcgcgatgatcgtcgacgtgaggaggcccgacgacgtcggtgagcagctcgtcgaggtagcgctccttgagcttctcgacacggaggcgtctctcctcctcctcctcctcctcggcgtcacgatcgccgccaccgcggcggcggcggcggcgatggtacggcccgatgcacgcgaacttgggcccgtacgcctccttgttgatgtcgcgcacatgcttgggaactcgccagagacggaacgacgacgacggctgcttggaggccgacgaggcgccgccgccgtcgattacatccaccctcacctccttaggccagctgctcgccggcggcggtgacggcggcgccggcgtctgttgctccgccgcctcttctcccatgatctgattatatatatatatatatatatatatatatatatatatatatatatatatatatatatcttcttcctctcgacgtttattagcacgcttgcatgaatgtgtatatataggcacgtcgtcgaccggaatttgagatggcgtgttcgcgggcggcgatcggcttgatggtggtacgacgacaatggcataaaataaaggaagaagcctcctctctggcctaatcgattctttttggttggcaaatgggagagtatagtgatacaaacaaaaggacgtacgtatcaaccgatcgatgagtactgcaagctttcgtgttctctctgcttgcatgtagtatgtatcaagctaataacccctttattaatctctatctttttttcccctcttcactactacagttagcatctcaacctttcttcctcttcactatatatagccagctagaatcgtcaagcttttccttttgttgctacctgggcatgaagtaagctcaggttcttcctatattagtgtatacatacagatggtgcatacgtaattgaaagagccctgtagatggaaagtggtttttcttcccactcgcgtggacatacactcgtttcatgaatgccgtctaaaaatattaatttttcaaaacataataaaacagattaatatgtgatatgttactctataaaactataagttaaaattcgacttatagaagaagaaacaaaaataacaaatactctctccatcccaaaatgtttgtcgccgttgactttttttaaaaaatatttgaccgttcgtcttattcaaaaaatttaagtaattattaattttttttcctatcatttgatttattgttaaatatacttttatgtacacatatagttttacacatttcacaaaagtttttaataagacgaacggttaaatatgtttaaaaaagtcaacggcgtcaaacatttagggaaggagggagtatcaaccatgaattgtacgcacacctttgatagtcatatatatttgttgttttcggttcatacacatttgtttctacttgtgtatattaaattttaacttgcatatgtttgtgaagtgattatcacatattgatatattttgtaaaaaatattatttttcatgactttattagtggacatgcatgaaataaagtgtatatccactcaaatgacaaagggacttaatatgaggatgcgattctacatgcactactacacaaaagcaaatagctaggtgtccgcactataggtgccggaacagctaaaaccggtgcttttcccttccaaaacacgcatcgatgggacaccattggctagaaccaacacctttatgaagataggtgtcgattctgaataaaaactgacactgacggagcgtggggctcctcaccgggagaccgcgcgggcccccctttgccggttcggccgggggcgctaggtgaggttctaagccctcgatctgtggaatgtttcgcgagagagcaaatgcctaagacacgggcgatgtagacaggttcgggccgctgagaagcgtaataccctactcctgtgttctggtggatctgtgtatgaaggagttacaaagagctggagagcaatagagttcaaactctagagaccctcttcctctttctctcctctacgagctcaggtgttctcccctttttttcccttttttctcttaagtgggcaaggtcctccttttatatctcaaggggataccacatgcaccacttctacctactcttcttttgggtggggactcaccctatcttccaaaaaaaagactggcttgcgccttcgcctggaagctaaatcacagcttgtctttgagtgaggcccagcgttatcactcgcctggcaccgaggatctccctgttactccctcattaatgggcggagatttgccatggctgctgtccgaatgaccctccgatgggatgggccatacctacctccactccgccggaagcaggcgcaacgtgggagcacggttgtctgccgatgacgtgaccggcgttagaccagtcacaaaccggtcattcttgtctaccacgcgtcagtttagcatgccacacatcagcccttcttcctaaaatgacttccttgtaatggttgcgatgaagcctggtatgaatctagccgggactgacgtgctaactccaggagttagcacgccggctccggttagggacgagtgcctagaggctctcatcattccgacgggacggggcgaggcgtgcgaaaggctgcctgttgccacctaacccgcgatctgaccggtctgtgaccggtcacacactgtgacctgtcacggaccaaacgagtgtgctgcgctgcattaaatgcgccgtggggcgctcgtccaacccgcaataaacgcggttaggtgagcgccgctgtgctcacctaacccacacacgtggcgccaaacccacagggggtcggggcgccccagccctcggggccgaaacgggagtggcccgaccccttggggagacagagggaggggcggccacatcaccctcgggcccgacccccccgagggggtcaggccacgtgggtgaccgcggctgccccaaacctctagtcaagatacccccggtcccatgtcaccgacagtagcccccggcgttatgccagggcgatcgccctcctcgaggaaagcgctcgggcgtgacgccactccttaggcctggtgacaggtggggccggtctctacaggcgggcaggaatccagtggtcgcaaatcgcgcgcatcggcaagggaaaaccgaccgacaataatgagcggctttcttcaagaccgctacattacttgagtagcgcgcgaatcgggacgagccggttcgtttcgcctggagatgtgatgatggtgcatcggtcggcgagcgtagtttaacgcgcgcacgatatgtcccatctcgactgccacggccgcacatccgcctcatgcgccgcaaacgggcgagcgggattagtggaggagtgggcgcgagaaacgagggggcgagatagtgggcgcgggaagcgaggagccgggcatagcgttggcaagggtataaagacgccgaggaagagattcgtttccttcctctcgccactcttccccttgcctttgccacttgtgctctgactctccgtttccggcgccctacccttgccatactcactcgctctcaagcccctcctccgccggcgtcatggcacggggctccgcaccgctcgacggtagcgtgctgccgccttctcgcatcgtgagcgagaggcaggctgggctgccgcgccgattcatgccggaatctgccaccagccgggaggtggtcgcgctgggtgagggacacccggcgccacactacccggggcggtccgtcttcttcctttccttcgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccaccgtcggtagtcggtggctgctacttccagccgcaggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtctgcgattccaggggctcacgggggccatggtgtacggcgattaccttcgtcgccggatcgcgccgctccagcggcgcgcccggggcgcctgggagtacaccgggtccaaggactacacgaggacccaccagggggtcaaatgggactgggtccctgaagacttcaagatggtgatccaacgggtgctgaatctcagctccgtggaggcatccctcatcccccaaggtgtcctccccctctgcagcgatccagagcgcgccaacatcctgaccatcatgcaggcggtcggggcgttaggggagcgggctcctcgaggccacgatggcgcgggcgggagccacaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcatagcccgagggggagcgaaaaaagaagcggctccgcaagatgggggggaccgaaccatgccggggaaacctcatctcccccccaaggtggaagtttagccgacctcctcgcaggttcgtcctcgcgcccactgcggccgtattcattctcccatctcccaaggcaagttttcactcacccgtttttcgtcttctggtttttcttctgcctcagcgagatcccgtcgcacccttcccgccattccaagtccggccggtctgaggccgaggagacggcgaccgcggaggcccggaggtgggaagctgaccggtgagaagtcgcagaccgcctccgggaagccgaggaagctgcccaggaggccgtccgggctcgccaggctgaggaagccgcttgggaggaggccaaactctgccgggccgaggagtccgtccgggagacggaggcggcgcgcgcacgccgggcggcctgccaagcccccgacccgactccgtccgaggcgacaacgacttccgaggccacccacgacgaggccgcgggcgcgccgctcggacccgacccctcgggcgacgttcgggacgagcccgcttcgggggacgcccccgagttcggcacgtcgatcggcgggccgagccgcgcggcgcccacaccgaggcgggtctcccctctgccttccgctgccccactgagcgcagagcccctcctgcaggccttggccgctgcgaacaccacggtgttggacgggttaagcgcccagatggaggtcctgcaggcagagcgggcgaaggtcgatgcggcgtgggcgcgcgtcgaagaggggcggcgctcagtggaagccatggtggaggcgggccgcaaggcacaccgccggcacgcctcagagctcgaggcccgtcgtagggacctggcggagatcgccagggaggtggaggaggagcgggagactgccctcatcgccaccgccgtgttcaacgcggcgcgggacgacctctgtctccaatacgggagccgggcggcggagctagagaagaagctcgacgcgtcccggcagctcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccgcgaggacgagctcactgagcgggagcgagctctcgaggaggccgaggccgcggcgcagcggcgggaggagcaggcgcacctcaatctggaaggcgcccgcgccgagagggccgcactggatcagcgggccgctgaattcgaggcgcgggcgaaggagctggacgcgagagcgcgcagcgacggggcggccgcgggcgacggcgacctagccgcccgcctcgcagccgccgaacacaccatcgccgagctgcagggcacgctggactcgtccgccggggaggtcgaagccctccgcttggcgggcgaggtagggcccgacatgctccgggacgccgtctcccgtctagaccgtgccgggcggcaggcgggcctctggggcgggcggaccgcgaaatacgccgccaaccaggagggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctcctcgtgggcagcgctggacgagttccctcctggaaccgaggatggcgcgcgcgcgcaggtccgggactccgccgaccacatcgtccacagcttcgagggtacggcccctcggctcgcgttcgccctcgactccgacgaggagggcggtaacggtggtgcggacgacagcgacgacgaggccggcgacctgggcgcgtcggcgtgagcccccaggcccccgccaatcttaaatagctttttctttcttcttctgaggtcttcgggcccccttcttgtatagactgatttaatctgtaatcaagtaaagaggaaatttctgcgtcagttatgtttgttgtgtgtatgagacgaggatggtctgtgccgcggtccttctgtgtcttggcttgaacgagggctcgtgcccaggtcccaacctcaagcggcacgggtcggggctagtgcctggggagatccgcgtgtcgagactggccaggccgggagcgtggtgaccgagggttatggatgacccgattgtgggcctttgccgattcccccccggagttcaccacgccccggggcacggctcggttctgggccccgtttggcaattttagccggcccgggccaccgagggcagggtcgagcacgagcgtgctaattcaagccaagattcttcaaaaggaaacgatggcacagacacaatcctcaggaaatcgaaaatgcttttattgaaatatggaagagaaaaaagataaggacatgcatgtggtagcccccggccaaccctgcacgcctgggggggcgcggggttggcccgagcccgagacctgacacccgacccccactaggggtagaagcgacgaaggtgttcgatgttccacgaattaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcgactcggagggccgcgcgccgccttcgctcttccaagtagtcgaggtcatctctacgatgctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcaactcctcgatccacgagtcgccgtgcttcttgaggatgttgaaggttttggttttgaggcccttgaggatttctgcgttggcgcgctccacttggccattgcttccggggtgggcgggagaggcgaagcagagcttgatgcccatatcttcgcagtagtcaccgaagagttcactagtgaactgggtgccgttatccgtaatgatacgattaggcaccccaaaccgagcagtgatgcccctgatgaatttaagcgcggagtgcttatcgatattgatgaccgggtaagcctcgggccacttagtgaacttgtcgacagcgacatacagatactcgaacccgcccagggcccgcctaaatggacccaggatatcgagcccccagacagcaaacggccatgaaagaggtatggtctgcagggcctgggccggctgataggtttgcttggcgtggaactggcacaccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatgcgttggacgtgttcactcccttcgcggtcctcgggtagagtcttatctgtgaggtatgcctggatctcagcgatccaagcaaccaatctaagggagctgggagcgctcccctcgggtcccgaggcctggactccgacgggcctcgggggccgttcaggcgcgtccgtctcccctagggggtcgggccgcgccgacggctgggcaagcctttcttcaaaggcgcccggtggggtctgggctcgcgaggaagcgagcctcgagagttcgtcggcgactgcgttatcccgtcttggcacgtgccgaagctctatcccgtcaaaatggcgctccatacgccgcacttggcgcacgtaggcgtccatctgcgggtcagagcaccggtactccttacagacctggttaacgaccagctgggagtcgcctaacaccaggaggcggcggatccccagtccagctgccaccctgagtcccgcaaggagtccctcgtactccgccatattattggtcgcccgaaagtcgaggcgaactaggtatctgaggacgtctccgtttggcgaggtcaacgtgacccccgcaccggcgccctgaagagatagggagccgtcgaactgcatcacccagtaggcggtgtgaggcagctacgaggggcccgagttggcctcggggacggagatgggctcaggggccggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctgcaaaataatggcgcaacttcctcgaagccatcagaatagcataaagcatcttctgggcctgagggtatcgggtcttagcgtcccggagggcctcgctaacgaagtagacgggccgctgcacctttcggcggggccgatcctcttcgctaggggccgcatctccagggcgctcttcgtccgagaggccgcgcggggcgcactcggcttctgtgccgacgacctcggggtcggagggcgacaggcgcggccttcccgcagtggccccggggccatcctgggggtcgggggtgcctggcaccgtcggacaagcgggcggagggccaactccggccgtcgggtgcctcgggccgccgttcgactcgggggcctctcctccctgctctctcccgggtcgagtcgacacagggtggggatgcgcggagtgagggttgtcctcgtcgcgctccaagaccaacgccgcgctgaccacctgcggggttgccgccaggtaaagtagcagcggctcatctggctccggggcgaccaggactgggggagaactgaggtacgccttcaactgagtgaaggcccgctcagcctcctccgtccagataaacggcccggagcgtttgaggagcttaaataagggtagcgccttctctcccagcctcgatatgaaccgacttagggcggccatgcagccggtgacgcattgcacatccctaagcttgctgggggggcgcatccgctctatagctcgtatcttctcggggttggcctcgatgcctcgggcagagaccaagaacccgagaagcttgcccgcaggcacaccgaacacgcacttgtcggggttcagttttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgctgaaaagtaggacctgcattctttaacccgaaaggcattgtcgtataacaataagttcctatgggggtaatgaaagtagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcaccttgggaacgacgaccgggttcgccagccactccggatggataacctctcggatgaatccagcctccagaagttgcgccacctcctcgcggatgaaggcttgacgttccggggcctgccgccgcactttctgctggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgccgtccagaagaccaccgattcgtgtggtcttggacgggccatcgcccagggcaacctccttgaccgggacctcgtcgcacgtgatcatccactgcctcggggcggctgggacggaggtgctgagcctctcattgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccggggccttgatggcgtcaaaggctgcgggggaaaggatgttgagggctgcacccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgcccgccgcgtcgcctcatgggtagggcccgcggccagaagctctcgcttcatggccttgaggctccgacgagaagcgtgagcgcacgctcccccatcgacggtggcgatggtggccccaggctcctggaaccctaagtcatcgtcgccatcgtcgatgtcctcggcgggggccttctgcttggcctcacttcgccggttgccggagggagccgccggggccttgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctgggagcgccggctcgctcgcaggcctcccctttcgggtggcccgcgaagcgccctcgacggcgaggacgtgaccctcgtcgtcggaatgggccgacctcttcttcctcctcctgtcccgccgccctgaccgagcggcggatccgggggcggccgaagctgccacaccggaaccggtggagttccaggtccaggcctcctccttgcgagccacacgatccgcgagctgaaaaagctccgcggtggtctggggctccttggaggcgatcttttcgagcatgcggttgtgccgcacgccccccctgaacgcgtagattaccgcgtgtgcagggatgcatggtatggtgttgcggacttgacagaaccgctgaatgtacgagcgaagagactcatcgtcccttcgctgtaccgcatgcaagtccgcttcttcacctgggcgcggatatgtgccttggaagttcatggtgaactgctggcacaaatcctcccaagagtggaccgacgcgggcggcaagttcattagccaaccccgcgcctgtcccttcagggccatggggaagaaattcaccatgaccctgtcgtcacccccggcggcctcgatcccggtcgtgtagacctggagaaactcggcggggttgacgcttccgtcatatttttcggtgatggtgggccggaaccttgggggccaacggacgttccgaaggctcgccacaaaggctcgacagccgacaccaccaaccgggggcacggggggctggcccccgcgcccgaaccgaagtggcgctccggacgaggaagcgccttccgttgcgtgggcagcacgacgaccattgcgccggcgcttgacactgaggcgggcatccggccccctacgcacatcttcttgggtcggaggcgttgacgagggaatggcagacgaacggcgggtaacggccgccgctcgccgcgccctccgccttgacgacacggagccggcggtagcagcgccagaggccttggtggcggaggaccgcccaccggcgcctaggcgctgctgcgccgtcatgaccaagtcggccacgtcatccagccaacgtcgggctggagtctctggatcggggacgacgggcgggtgacgcaggagcgcgcccgcagcttggagcacgccctggggcgtgctgccatcgccgtagacgaggaggcaacgctccccgtctcgccgtcgttctccatcgctcgtgggcggcgaagtcgcggatctttcgaccccctcgagcgcctcctcccgcctaagacttcggcgagaggggggcggtggagtacgagctcgtcggcacgggttctgctccccgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagccctcgatctgtggaatgtttcgcgagagagcaaatgcgtaagacacggacgatgtagacaggttcgggccgctgagaagcgtaataccctactcctgtgttctggtggatctgtgtatgaaggagttacaaagagctggagagcaatagagttcaaactctagagaccctcttcctctttctctcctctacgagctcaggtgttctcccctttttttccct

SEQ ID NO: 47170 - DNA, 15568 bp, Oryza sativa
cccttggggagacagagggaggggcggccacatcaccctcgggcccgacccccccgagggggtcaggccacgtgggtgaccgcggctgccccaaacctctagtcaagatacccccggtcccatgtcaccgacagacacctattgtactagtgttggatttttttttggaagaaccgatacccatatttatattataggtgccggttttataaaagagaatcggctgacatcgaagtttagattgagggggagtgttagatcataacatattggtgtacttatctatgtgtgttagttgagatacccggtagtttagataagctaatcatcccatgaactccctcctttcttaaatgtttggcgccgttgacttttttaaacatgtttgaccattcgtcttattcaaaaacttttgtgaaatatgtaaaactatatgtatacattgaagtatatttaacaataaatcaaatgataggaaaagaattaataattacttaatttttttgaataagacgaacaatcaaacatgttttaaaaagtcagcggcgtcaaacattttgggatggagggagtaaataggatccgggttatccatgcaacacacatatatatgcctgtacttctcccgtgcgatttatgcacaacaaaattaacatgtagcagtagcgtcacaccgatcgacgttaactcagattagattttctttcaatgtgatgtggggatttggggatttcaatttggtttgggatgtttggggaaatcaatatgcaagcagcaaaaacattgaaaaaaaggaaaaaaatatctgtagtcccgctaaagattgcagtgtgtcacacacgttatcaatgtcgaactggacgatgacatggatcaagagctgatcgaaatccgttcttgatcagggcgaagtgacgatgtgttctgcgccgactcgacgacgaagcctcaccatgatcagcctaaaggtcatcgacgtgccccgcgcgtcgccgagctgtgtcaccggagaggcgcgctggtgtgcattgacagcacgctggcgtcgcccatcaaccacacaagtctctcaccctcagcgccgcggcatcatcctccacaccgccacccaccaccaagtacatcaccggccaacctagacgtcatcgtcggctgcgtcagcgggctcagaggcttgggccatagcgccggagctcactaccagcaggtggtactcgccggcatggagacgaggagagaagagaagaagaggtggaaagtagaaggtcatttacacgtgggtcttacattatttattttatttttgacattattttattttatttttgttgattagggtgtcacgtcagcgaaaccacctatacatactgtcacgggacttgacttaaatggttttgtcaagatggagggtgaaaaatgtctggtattacggtttatggatgataattaaactcggtgtaaaaatgagggatgccaagagaacttattccttcaatctatgccctttctagcgttttggcccattttttagcccatcgcacacaatcatttccaagctcattttggactttttatttttcagtaacaggaaaaaaaaagaaaatcaactacaatttgtggcatagtagtttgatcatgctagataagtgtttccattattgatgcaggcttgtcacatttttaaagttcatattcccacgtgtcatactcacacacttccttgttaaagtttgtcatgtttttttttattcggagatctgtcaaatttataatcactaactttggtgtcacacaaattactgcatttgcgaaaacaacttttctggcacacattttttttcaagaacacaatcacacaaacattcctttccttggcccatctacatgtttatttgggcttagactttgtgtatggaaactttcttcttagatactttctacatagaaagtctatacatattcaaaaactttctatagttaaattttaaacggatttaaaaaattagtttaaaagaaaaggaaatattgtatgaactttctattggaccttaaattagctcaaataaaaactaggtccatatgcatgtgtagttaagcctgcgagcgatgataacgcgtgtatccatgactcgattctatagcaagattagtaagagaaaaagataagccattcttggttgatatggttttatttggagaatagtttatttactttagttacctttatcttgcaaaagaatggtccttagttttgtaagtccgatcttatgtgatgtgccagagattattcgatctctgaactctgtttagcatgtctctcctacccgacatcgacattgatattactgcctccattctttgaactaagggttgaatttattttgagactgggagaatatcatatgcccttgcatgtttcataccccctccgtctcataatataaagaatttgggttggatgtgacacatcatattactacgaatttgaacaaatggacaggaacaaaactagcatcaaaacaagggggtgcactaccattgaacatttagaaaatttcactccaacactgtacattctagtgtttttgagtgagaaattagaaatttgggggttcatgtgcaccccctccccccccccccaaagaactctatagcttcgccactgcagatggagtatgttatatccatattcgtagtaatatggtgtgtcatatctaacccaaatcccttatattttaggacggagagagagtatgttataaagaaatacaatatttactatttaatggatcgttacatgtggcattaattaccacgaaatgtttggcacaataaggcgtgcacaatgtttgattgtgaaaagcagcatggattgaagaagagcattgcgtacgtacgtgttgcatgaaaccagtttggacaaaatggagcaaaactcaacatgtacagattcataaaacaatgaattaaatccaaggggatattaagtcaagaacatataacaaattctgtcattaaattgggaaaaaaaaaggcaagaaagaaataagctaaaaagatcggagtagctcgctgcgtactctatccgtcccataaaaaactagatgtgatacatcctagtactacaaatcagtacatacatatatctagatttatcgtactagaatatatcatatctggtcctagattcggttttttatgggacggtgggagtatcgatggattaattccatggcggtcggtctggacgagatcatcctcctttctgcttgaaggaggagtacatctggacaatggtggagacgaaggtgacgaaggcgacgaactcggcgaccaccgcccatggcaccgtgaagtagttgcgcttcacgtccgcccacatcatgaacagcgggtgccggctcctctcccggagctccaccaccatccctcccaggtagctccgctccagctccacctcgccgctcgccgccccgacctgccggaacagcctcaccacctcctccttgccctcgccgccgccgttcccgtgcaccaccgccaccacctccgccgccgccagcgccccggcgtcctccgccgactgcaccatcttcgccatgaacgacacgtacgccgacacgtcgcgcgcctccgccttcgccgccgactgctcgaacgccatcaggttcagcagcagcggcgccgtccggagctccacccgcagctgcggcagccgcagcttgtcctcgtgcgccagcttcaccgccagcggcaccggccccatcaccgacgcgatgcctgtcaccgccgccgcgccgccgccgcgcggcttcttgaaccgcacccacatccgcttcaggtcgctcgccgacggcacgtcctcccgcccgtagctcgcccgccacttgctctcctccggcaggatggggtacagcagcggcaccagcagcagcagcgggagccgccgcagcagccgcgctccgtcctgcgccgtcccgagcaccgcgccgtcctggatgcgcggcggcggctcccacttggtccgcgccgcgacgatcatcgcgtggagcaggtggaggatgtgggacacgccctccgcgggcggcagcgcgtcgcccaccatgtcgcggcccttctcgccggcgaggtagtagagaaccagcttcacgatcagcaccggcggcgggtggccggtgctcgcgaactccggcaggtcggtgatcctgaccaggtcgacgaggacgaagaacgggatctggttctcggcgaggatgaggtcgacggagagctgcacgggggcgaacggcgtggcgtgcagcgacggctcatccctcccgatggcgacgttgacgaggtgctcgatgatgaagcagccgtcgagcaccagcatcatgatgaactcctcggcgtacatgtcgacgtcctcgctgtagaacgcgcgcgcctccctctccctcgccgcgacggcgcggatgtactcctcgatgacggcgagctgccgcgcctggtcggagtggccgcgggagatgaggctgtggaggtacgccatcttgaggcgctcgccggcgccgagccgccgcgcgtcgccgcggtggagcgggccgacggcgacgaaccgcggcgtgtaggcgtcggcgttggcgtcgcggaggtgcgccgggacgcgggacacccggtggctgctcgccatgatccggtgctgctcgtccgacgccgccgcctcctgcctctgcatcagcccgcgcgccatctgctccacgtgcaccgtgatgccgtcgccgtcaccgttgccgccgccgctgccgcggcgcgccatggctcgccggcgagctatggcgccgtcgaactcctccatatctgatcagtgagcaccaataccagatagcattacgtatcagcttataaatacaagccaggtagacactagtgtacagtgtgcagttcatgaacgttattaaggtcttgtttgtttcagcttaagattattgtaatccagattattaaatcagattactctaagctggattataataagctgatatagaataagttgcgagttgtttgtttctctggattattggaggcatctaagggtagtgggtctttagccactcaataatctagaaaaagctccttcaaaggagattattagattatactaatctggcttatagattataataatctatcataataatctacttgtttatttcggcttactcatgataatccagattataataatcctaagctgaatcaaatagggcctaagtgtcagtgatggattaggaggcttaattaacacgacttacagttacaaaagggtagtgacatggacacgcaagaatttgattttgagtatattttatcatctggattctggaagtagcttgcattggggacaaagatgacgctaatttatccaagtcatgaatgctgataggctggtaattccattctttgcttgcagtgtctgcagacgatgagattctttttgtctccaggcttgctaatctttagtaatttccaatcaaaattcatacaaagagaaactgacacaacctagcaatgcagacaaatcattcacatgagcatctctccaaattgatttccaagtagaattgtgttacatcccaaaaatataagttgttgtttgagacaacagtgttagtattgatatcagactatagcagttaagtctagtggcagtaactgaaaaaggggcacaatggctgtatgcccaggcatcttcagagactctgcagtattctcctgcagtagaagtcactgacatctgggctcttggtaagtgtggcccacatgtcagtcgcagtactgcagaggatctcattcccatcttcagttatgctgtccaaactttcaaaagcgtctcatcaaacttgggggcattgcaaaccatctgtgctactaccagttccgagctctttccgtcttctcgcgttcgtgcatatgtccaagcagggctcctttagggctttgtcggtgtcaagaggtggaggtgacaccccaaagttgaactgaaatgaaagacaacatgcgcctgagtattccattgtgcttcatcatgacattcggttttgcaaagaacaaaacttagcatgtacatatctagtttgttggaaagtttttgtttcagcatagtaagattaatcatgaaatgaattacctggcagctatagtcttcaaagtttggttccatatacaaatcaacacccatgtgatccttgaagaatgtctggaaaacagaaaatggcgttcatacaagtaatgacagaaaaattcagaacaaaaaggttttcaagatctatactccaaattaatgtgacatcaacagtgatagtgtacataaaagtaggtatcccacacatctgaattatgctaaacgatcttacaatcaaacctgagttggcagtttgcatgtgttgatacaaacaccaaggcatttgctctcttccaaatatttgcacttctcaacaaatacctgacagtttccatcacgcaatgtccgtgaactgtaaaatctcactgagtgaaggataaacaaaaaaaacagtaggaatatattggtaccccgcttgataatgattttccattggataatgttatggaatttaacaaacatggccccatcagccattggcatgaaagtgctgttgctctagcttcacatctcaaatgtattaaaaaaatcagtaaggccaatcacactacatcaaaagcaactactgcaatgaactcaccaaccatcgattcctattgtatgtctaataagtaccaacagaggtggcaaaaaatgtcacttgagtgaactcaccaaccatcatggaagccaattgaccattagcaattggtgctaaaagagctttgaagagaacaagcaagagagggggaaacagtgatcggagtactcggacctgaaatttacagagaagagagtttgattttatcttctaaaggatacggttttttccaagcaatgagattgtgcatgagaaatttatatatacagctgattgctctgtctccaacgcactcttccccttgatcatgaggcggttggcaacttcaatcagtccattgtagccaggcttttcagaatcccatccaacctcctacagctttacagagaatgagagaattaccaaatgtacaaataaggagagcaaaagtgaaaaatatggatccattctcggtattgtataacggtagagagctagaaggagaattgatccaatgcatactcctaccgatcatgatacgttacaaatgtaaacacatatatatgtgataaactctaactgggtcagctatacacagggaacagaacacgccataagcataggacgtacacacgcacagagcagtatggcacacgttcactaataggcaattaggcatacaattgcagttgcagataaacgctatacaaaatcatagtaataagcaattcagcgatgccgattatgggagttaggaatagataatttatccacgaactgatcaacaccacttatcaatcatttttgttcgactctgaacattcatcaaccatcaatatgacattgtcagattatttgctagtagtagtaagcatcttccttttcgggaggataatcctatcgcaactcccttgatatttctgctagtaatcacccatgctactaaaaagcaagcactaggaaggggcaaccattgttaagctcaaaaaggggaagacgaagaagaactgaagaagagtttggggtgatggagcttgtcacctccaccatcttggcacggaagaaggcgaggaggaagtcgtcggcgaaggagggctcgtactcgcggccaccctcccccgacggcgacgccgcatccgcctgcacaaagtgaaacaaatcaatcaagaaacactagcagcagcagcagcagctattcgcatcttgcttaacaacgaaagggcgtatcattaccgacggcgaggagcagcggagcaaggaggtagtaggccggcggcggagcccccgagaagaggaggaggcgacagggaggagggcgcggaggaggcagggaggagacggcggcgccatggccatgggcaagtgcagcggcagccggcgcgcgagacggacagaggctgaggcaaatcggtggtggatagccggctgggaccacatgtcagctaccaaggccgtagtcaccgatgtccacaaaccaatctaacatatatgggccgcgcgaaggccggaatctcgttcaggcccatattatattgggcctcacgttgactggaatagcttctttcggcccaaccaaaggaaaaagtacactcgaaggtacctcaacttgtcaccaggataaaaaaacgtcctcgaatcgcaaaaaccagataagcggggtcccttgactatacaaaatcggtcacccgaggtcctttggtggttttgaccccggttttagtctacgtggcggctgagtcagcgtgggacccacgtgagccccacatgtcaggtgtccacgtcaccctctctctttcccctttctttttttctcttctttttttttacttctcgttccttgctactcacccggccgtgtgctcgcccacctgccaccaccgccgctccatgcctccgcttcgccggtggctgcgcgctcgcctgccgccttcgttggccgccgctcgctcgctcgccgtgaacagcgcgaagctaatgtcaccgcctacgcgtacgcgcagctgcagagtatccccgtcagccacgcacatcacatcaccttctcgcacgccaggttctccagcctcagcgcccccgccgcggtcaggttcatccgggggtcgtccgcgccgtccgccgcgtcagggcacacgaactcccacagccccttctgctcccccgccgccgcctcgctgccgatgggctccttgccccagaaccatgggtggatcagcacgatgccctttaggcggtgcgggaggtgttggctggtcaggccatggtgcatggcgaggtgatggcagatgttgccgccggcgctgtcttccgcgaggaagacgtgggagaggtcaccgtgcgcggcgagccatgggtcggcggtggagagcacccaggcgagtgtcgtggcggagtcctcatacgcggccgggagcgggtgctccggggcgaggcggtatgtcacgccccgaactagtaccgaccggaactagcccgtgacgctccaaattaacctgtaattcgataccagtcccaggaaacagtgctggtatcacaggaagacagattatcacagcaacagaggtctctttattatagagtagaggtacagtcatgttgggctgcggacagatctcgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatacagagcaagggtgagtacgggagtacttagcaagccaggggaaataagtgtttaatgcaggcttcaaggagaggctggtgtttttgcaattgattttatttgaactcttttctgaaacaactaagtgagtgcttctcaaacgacacggatgagacagtgcgtctcgtccggtcggagtatgtgcaatgtatcagtctttagatttgaatcaaggttggcacccggccaacagcttttcaaacggccacccgggccaacaactttcaaacggccacccgggcctacctgattccatcagttacagatttttcaatcatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttgaatgaaattccaaggaaacggtccttaagtgcaagagcgggaaaccgtacacccggtacgttccccggtccgcggttttggaaattcatttagttcgcaagcaccgacccaggtgtcgggttttccaagtctttcgtaaaacccaagttttatccaagaagttttttattagattttaagtttgaaggcgtccgtcgatactcgcacagggtgcacgaatatcgagacgcaactagatggttaccaggggacacgatataacaattatcaaaggaaggatcaaatgcaaccaattaggtaggtccgccaatctgccttgcaggcgggacaacagattaagtgcgatcctatcaatgcataatatttttcaagcaacataattaatttcaaatataggctcaagatgttcaaaggtggcttgccttgctcgagatctggagcttgatcctcgaaatcctcgcactgcgggtcttcgggctccgaaactacacgcgaaacgggaaaactcaacaaacggcgaaaataaagccctattaatgacctctaagcgtgccattagatagatctcgagatttgaggaattttggaagttgaacggagtcaaacggatttacggttgggaagatattgaatttctaagattattggatttttgggtctaaaggaaaaaagatttaattaaatcctttttgaataagaaaagaaaagaaaagaaaagagggagggaaactagacttttcctcgggcggctagggcgcggcccgagagaaatggagcggtccggccgagctaaatgggccggccggcccaaggcggcccaagcgcgcgcgcgggagggaggagagagagagccggtggaccgggctcaccacgcgtggtgcccgggtgggacccgcttgtcggtgacacggttcaccgtgcggagcgagcacgcggcgcacgcgcgcgggcgggggagggacgcggtgcacgcacacggttcgcggtggatgcagatgcggcgggcccacgcgcagcctcacggctcgcggtgcaacgcgcgcacggggagggactgaccggggtcggcttgacccggtcttggccgaggtggcgccgacgtggcgcctacgtggctgccacgcgggccggcgggaggtagacgacgacgccggccggaacggacggcggacaatagcggcgagcggcggagcgaaccacggcgatacaggcaaaagcgagcacaccgggtggttgcacgagacgaggggagacgagccaacggctcggattcgccggagggagcttgacagcggcgaatcgcggcggcggcaaccggcggcgggagaagggggaaacgacgacgaggtcacgaggggccaattcccgacggcgagagcatctacgcggctacgggaatccgatgctagcgtcggattgggcagagctacgccgagcgaggctggcgacgagcgggtgctacggagctcgggcggtgacggcggcgagcacatggcgagcggcgacaacggtcggggcggcgccggctagctacggggaggctactcgtgctaccaccgaaaactaagggggggagatggagcgaggaggaagaacggagggaggcattaccgtgcggacggggcgcagtgacgagaggccgacggcgcgggagtaatctctccggcctcgggccgaggaagaggaagaagagggcgcgcccggagtccccttccgcgtccttgctcgtgccggctcctccgacacgcgcaacgacgaacggcgacggcgaacagagcacgggaggcggcggcaatggcgtggaggcgaatgggagaggaagggaaagggggaagcttgggttttaagggcggcaatgtcggtttggaaaccgactttgggcggtcaaggcgcgagctggcgctcggcgctcgcgtccaaattggcgacagggcggagggaggaggatgacgccagcgggaggaaaaaggggaaaaagagggagagaaagggggctcgccccttgcttctttgggaaaaggaggaggggagcgggggcgtcgcggcagagggaggagggctctgcctccgtcccttggcggcttgcgcgcggagaggcggggccgaggcgatgacgacggcgatgacggcggggcggtttggagcggagcggcgacacgggcgacaggcgcgggcaggcgctgacgacgacggcaaccaggcggtcggccactcggcacgcgcgcgcggcttgcaacgggaggcgcggcggattgagcggcgcggctcgggcacgcgcgctggctgcggggccgagcggctgcaggcgcggcagagcagcggggccgggcggcgcagacgcgacgcgggcgacgaccacgcgggcgcgcgcgcgaacgatgcgcggggagcggcagcgagggagcgaagaggagggctcggctcggcggctcacgcgcacgcgcgcgcggcgcgcgggcggagcagagggggagggggagagggagaccgccacagagggcgagcgccccgcccccgggggagatgggccgagagaaattcggcccatcgaccctgggggaggcaaaatagacttttgcggaggaatttgatttggaaggatttggattcgggattgaacttgacgatagatcggggattaagatctggagagggcacgaacactagacaacaagcaagaaacaatttcgcaattagggtttttatgaaataattttcccgctaggcgctacacggtagttgacggagacgacaacggcggggtaggcgatggcgaggtcgttgaggcagcggtggtacgcaggcgatgtggccgacctgatcacgaaccccccgccatggaagtagaccaccacggggagcctctcgcctccgacagcaacagcggcgggctgcggagaaggcggagaggcgcacgtccctggacaccacgtctcctgcaacacgcaatccagatggccgtgacgaggtgctcggcgtggtggtcgagatccaggaacggcacggcgcctccacctccagatggtcgacgtcgaccgccgcccgccgcctccgtcacctctccacccacagctctgcccccaccaccccgcgtatcctcgctcacctcgccgccgccgggtccacgccggtgagctcgcaagagcactgcctccctccttttcaccctcggccaaagcagccgccacagagccagccgtcgccggcaaccggacctcctcctctcccgcctcaccccgccggcctcttccgcacccgtcggtcggccgtcggcctgcccagagtccttgacaagaaagtgatggagaagagaaagggagagaagataggaaagagagagatgacgtggccagtctgacatgtggggcccatgtgggtcccgcgctgacgcagccgccacgtagaacaaaaccaggtttaaaaccaccgaaggacctcgggtgatcggttttgtatagttaagggactccgcatatctgattttgcggttcaagaacgtttttgtatcccgatgacaagttgagggaccttcggtgtactttttccccaactaaatgggtagcacgtgaagcctgaatcccgttgcggactaacatgtatatgggctgcacagcagcacgagggcccgttgcattcattttaagagcgatagaagttgttgactcgtgaggaagacaattacgatcggatacctgaacatattacggtgatataaagtggtcaaccccctcaaattagtaaaaactagattaagatgggttttgatagattgaaccggctagcgaagccgatttagatggaataaagataaattacccatctcgtgagcgaacgaaaggtttacgagacaaatctacgaagagatttcgcactcttacaactaatgcggatgatttacggtgcaaattgacaaagatggacaaaactaggctaaaaaactagacggaaattagatgcaatattgaaaaatcgattcaattggataaattgtattgagagtagattgtattgccctatataagggggttggtcttgccccctacaggtcctcctccacgtctaactcgggttagaaactaatggaaacccgaaacatacattcccgagcaaggaagtccgagacctgacgaaaacagctcggagtcggactttgccagtttgaccggctatataccgctggtcaaatcggccgacaggcagcggtcagatcagctctatgaacgaaacccgactcttttcaaactttggcaatattctcctattttaatcctaagtgctaaatttaggtgtaaacacatgcctcctgcctttttgtgaactttgtgaacctaaaagcataaaacacgtgatcttagggcaataatctaattgccggccatataactccctaagcgtcatgccaaacactcaggaagtatttctacaagtgtttcccattgatcgctctctaatatcgctctccttacaatgtctcgagataatatgtattccctcgaacgattccacatatgcgataaggatccttccaactaggtgaccacttactgaagtccttagatttagaaaccaaaggcaaaattgtcttccataccaagtctattacttgaaacaattttgctttcactcttttattgtaggctttaactaccttctttttctccttttttatctctcctaaagctttctaacgtttatcggtcacatcatcaagattatctcttattaatgttttgtactctccaacccataaatcatctttctttatgtatctataagagagccaagaactacctctaccagtaaaacggtttcttgcctataaacttactcaaaggggataactttagtagcaccatatttagatatcttatgagcccccaatatctctgaaagcgcctcatgccatctctttggttggtcctcaatctttttcttgactaattgtgttacatttgagacagaagtggtagtattgatcatcagacgacagcagttattatgtctagctagtaatagcaactgaagaaggggcacaatggctcaactcctctgcagcagtagaagtcgctgacgtgtgggcccttggcaagtgtggtccacatgtcattcctatcttcagttatactatccaaactttcaagaacatctcatcaaacttgaggacattgcaaactatctgtgctactacccgttccgagcactttccatcgtcctgcgttcgtgcatatgtccaagcagggctcctttaaggctttgtcggtgtcaaaaggtgaagtggcaccccaaagttgaactg

SEQ ID NO: 47171 - DNA, 1037 bp, Oryza sativa
tcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatatattgaaactcgtcaagaacattcttccggggggaaacaaattgcccgagacaacgtacgaggctaagaagatagtctgcccgtta

SEQ ID NO: 47172 - DNA, 13104 bp, Oryza sativa
tagttgctatcacggacattgatgataacaatgtaagctttctgataaacaagagatcaaacaagctgctcgcaatcggattgtagtggaaggagaatgcttccgttcattgtaagatgtagatgcaacaaaaaactagtgtttgttagctgtaaagccttggaatttactgggattaggctgacaacattgccagcgcgatattgttttcctgtcctatttgtttggatgcaaaaggtcatgtaattcatgtaaagcagcttgggaattgcttgatttgaaggtcacattgtaatctgtaaacaagaattgacctgctgtaatatgattattgttgtcctcttattccatgacatattttcagggaacaaatccaagtttcaaggagaacttgcagtggcggtataacttctatttgactgtataattcatctaaaaagctataaaacggcataccgtcaggacggtacaagttatgcacgatatcaaaccgtccaacccagcatcgcgataaactacccatctctcctcccgcatgggtcccatgagacccacggattaactctctgcgcatgcagtactagtatagtagtactacgtactatactactgactgccatatactactgcatgcactagtagtactggaggatacccatctctcctcccgcatgggtcccacgagacccacggattaactctctgcgcatgcagtactagtatagtagtactacgtactatactactgactgccatatactactgcatgcactagtagtactggaggaggagtacatgcactactagtctactattgtcgatgtctgacggtctaatactactcctgccttgatgatgccatatgcatcaaatcgaagttaaaattgccagtgcccatgagcaagagaaaatgacttgattctctattgctatatgtgatcctatgtgacctgatgatgaacggtcctgtttcaaggtaaaatagcgtgagtatatgagtcttatatatctaggtatcatgtctggtacctacatatatcacgaccgatatttgggtatcatttatggtacttataagtatcagacttggtaactacatgtatcatgaccggtacctaggtaccatgtctagtacatatatataagtatgagatctggtacctacatgtatcatgtctggtacctacatgtatcacgactgatacctgggtataatgtacggttcttataagtatcagacttggtaactacatgtatcacgaccggtacctggtatcatgtctagtacatatataagtatcagatctggtacctacatgtatcatgtctggtacctacatgtattacgactgatacctgggtataatgtacggtacttaaaagtatcagacttggtaactacatgtatcacgaccggtacctaggtatcatgtctagtacatataagtatcagacccggtacctatgggtatcaacctaatacatatatgtatcatgcttagtaccacaaatactagagctaataggtatcatacgtgataccttggtatcatactaggtatatgttaaaactgagacccacatataccggctgatatgtgcttggtttgctacccacatgtatcatgatagatgctttacgatactttcgaggtactattatagatagtcatattttgacatgtaaaaaatagtataataatataagatactgaggtaccagcccaaccactgagtatagctacaataacaacatcatgtcgtatagctaagcacgcaattatagaggagtttgtagttatgtgtgaccaaaaggataggcattcataatctatgggtgcatgagtgagaagcacttgtcatgtcatgcatggcagatgcacagagtagtagtaattagctagtgtttgtgaattgcttccccaaaagaagtatacagtaatcacgaccagcactagcacatgcacgcaacctgatgcgcgcccgccatcgcattagggttgaggtgtccgactaatgattatgtcgttccaacggtaagtggcacatgtgcccagtgttccaaaatgctttttaaataaattgagtatcaaggttcaagtttggacttgttcgcaaagattatgagttttagaatctttacctcgaatagctatgcataagctttgatattttcattcttgatgttatgactaacttcaatgccttgcaaaatttggttaacatcatgttttagcctgaggatctttagataccttagttatccatgatttgcttgggttcttatatcttagtatcatttttatcctttgcatttaagtatgcctacctcctttacttgacatggctagctatgttctgtatgcttcaaactcagtatggttaattttgtaagttcaagctaacttcaagctaatctacatgatgttaaagttcactaaatgtatgccatgagacttatcacattcatctgactagtttttgtttaccacattgcttcttcctggttctcgaaacttattgttcatttacttgaggacaagcaaatgtttaagcatgggggtatgatacaatcaaattttgcatcattaatctcatgatcttcctcttgttttgctattgtgatgggctaaaattaatcctaatgcatatttcagacattatttgtggtacaatatgtcccttttatatggtttcatacattatttaacttttctacagaatggcgcgatgaggcgcgtaatctgctattttggtctccaacggcaaacaaatgtcagtttttgtgtggcaagacaaaagaagtcaagtgaagcaaggacctaaacataatttctggggagatgaaggttgaaagtgccaaagagcgaaccaaatcgatggggattaaaatccctagaaatgctactgtacaactgggcctggcattttctttctccccttctcttcttcctcgccatctcctcccttctccttcttccccatcccatctatagctccggcaccagcgagggccaggcctaacctcgtcggcagccaccatctccagctactccacatcccctcccaccagaaagttgctccaattcgcctgaaaacgtcatatacatcctcctgcagctcttccaaatcgaccgggacagtggagacaacctaatctgctactgctactgttcttcctctactacttccttgacaactgatctgtaacctgttgctgctgcatcctcttcttccccttcttctttttccttcttactgcacgatttctatcttcttcctcctacttgtactgtttcagatttgttaagaatttaatatttggagcttgtaatttctgtcagtgctagtcaaatgcatgaatctctggttatgatatatgagagtattaagatcctgcgatagttaatttcttcttcatcctgtttaatttcttccgagttctcctgttgtttatttctattttttttctttgttctcaattgttgtttgacctagctttagctaaacactagtagccatggcctagtccctgtggataacacgacactcgccactactcggtggcatccgtgcgcttgcggggtgcgtagcacaatcaagatcaaatttttatgagaactgctagatcacggtatcccgtgtaacgggatagattataatgagttaatgacgagacgttgcccccaccaaccatgcgcatgtgtccccacgcgtttgtatctcttcctcccacacgtacgcatcgctctcccatacccttcacatgtttgttgcgctcccccacgcatccatgcgctcgtattgagtacctacacaacttttaggtatcagatccgatagttgatacctgaggtaccatatctggttgttacccgtattagatctaatacttgatacctgttgacagaaaacacgaggcctgggagatctgcttaactccagtgcaggtccaaaactcgcctttgggtgtatgagcgtgccagttgatttgatcctgcaatcaacaagaaatagaacaaaaaaaccgcaattaatcctataaatgatagccgatcggctaggtgccgatggcatatcatttatttcaagccgatgtcatgcgtacatcgatcggcaaatatcaataagcaaatcagaactaaatctacttgatcggctgtaaatattaatgatatataatccttatatcgatatatacttaaatcaagtgattgggatagatcggtcgccttgccgagacagtataaatcacttaaatcgaaatataaattaataatgggattatatacatttatagtatagccgatcaagtgaatctagcatgtatcggctaatactccgatatcactctatattaagatgttaaagcaagtagaatatactaaacataagcttaatatacttagatgcgacaagatcttaacataaagggcagatttaacatgtcaatccagcatatagaataaaagtagctaaatcagataagatcggctgaaactccgatactaccctaatcagcaaccagaaagcaggctagagattgcaattctaagcacgacttaatagatcaaactcaactgatgcagcattaagtatgaaaagaaaaacaatatctagacaatcaagccgctggaagtttcatagagtggtagatatatcacatgatctaagttaacatcattgtctaacctaatcggctgccttccattaacagatgttagctgattataggttaaataaagatattatcgaaaattatgtgagatatatgataactcgacaaattgtatagacaagattagagtatcataaagatggaagcactaatcctgagaacataagtcgtcatgacaagttttacctcttgttgaagatcgaaaccgatgcagctcaacccgagagcacgaactcgtcgaaataaaagtaaagcaaaaagggtggcgatgcgcctagattgtattggatgtcgtccattaacatagaccccgggtgtacatatttatacccatgggttgatacaagtccttgtcggacaagaaagaaactttcctaaagataaaaggaaaagataaagtccttataggacactaaacacactttcctaaagataaaaggaaactgacgaactagtcctaactaataaatacaattgccttcccaggactatccttgcgtggcaaccatcttgaagcacatcaacttgaacccgatgacgtacaccgagtcatattatcggaatcggctgtatcggctagccccgtccgactcgaactctgccgacctgaccttagctgatttggactgcagccgattcttactctgtttccgcagcgatctacatcttggattccacttcgatctgatcctcacctccgatgccaatagtgatagaatttaccaaatttggtcgttaacacatgcccctaagtccggaatattggataatgtttcggatttgccatataccgactctgagagaaacccgcacttgctgttttcccgtccgttatcgctctactttaaatactaatcgttgccccaaagaatcttcacgccgtgattttcgttttcaccgcttaaacagatcctgtcctctctctctccggcgacctcctcaacacgcagggcgatttccaggcgattcaactcccggccagatcttcacccacgacgatgtcgacctccaccaatccgaccgccgcatcatcagccgaatatgctgaggtaagtccccatcggctagatccccttttccgttcatcagaccagttttcgctcaccttatcttgttttcttcttctctattcttgtagcatctttccaatcttgttgcggttcccagtctgttgcatgaccaacaatactttctcggtccaatcggcaatctagaccccactgagtttatcatagccgaaaccaacagaatcccttttaggtcggccaatccaaacacaagccattggaaaaacaccttcaaatcctggccttctctggagaaaagttggcctgtatggtataagcggatatcagccagcaaacaagccctagccctcacagtagcaaattcggccaaagatgaacccctgatggctactgcaacttatttctggtccaacactctcaatgcttttcttttcaaccaagggccgatgaccccaacgctgctggatattatcatgcttactggcctagatgtaacctcatcagctaaccccatgaacctgaacaccaagaacacttttgagttcaaaactaagagcattgggggttggtcaggatatatcacagcatatatgggcaaagggccagtaactcctagagagcacgtagcttttttgctgatgtggttggaaaaattccttttctgcggatcaagctgcggtcctacaaccaactggcaattcttagccgaggccctagtaacgaagaaacaatttcccttaggcaaaatccttctcggctatctataccagatattaaacaacgcatcggccaagataattatcggctcagtggttggaacaggtggaccatggtggctcttgcaatcctggctgaacctggtagtcatgaaagttgtcaatcggccatctgtgacagaagctgaatttccaaggttggagccgattgtggaagatgatggagaagaacgcacccatcgcagatgtatgtcatatggagaatatgtatctacaccagccgatgcaggaacaaagttatcggctgaacttctgaaggactggttcttcagcttttatgacggattccaaaaagatgcccgagtttggttcttctatgccgactcaatggatttcgaactgccagccgatttcaggttcgaggatattaatcatgaaaagtttcagcaatccagagaaatctttactactgctatcagcccatgtatccttccagtcggcatccatcaagggagaaatatccaagtctcctatgagttttatcatccgatgtcatcggccagacaacttgaaatgggacaacttgaaatgggagaaatatccaagtccttatagtacactaaacacactttcctaaagataaaaggaaactgacaaactagtcctaactaatagatacaattgccttcccaggactctatccctgcgtggcaaccatcttgaagcacatcaacttgaacccgatgacgtacaccgagtcatattatcggaatcggctgtatcggctagccccgtccgactcgaactctgccgacctgaccttagccgatttgaactgcagccgattcttactatgtttccgcagcgatcttcatcttggattccacttcgatctgatcctcacctccgatgccaatagtgatagaatttaccaaatttggtcgttaacaatacctgaagttccagatctggttggtacccgtatcagaggtaccagatctggttggtacccgtatcttgatacatgaggtatcagatctggttagtacctgtaacggatctagtatcataggtatcagatccgatacttgggatactagattcaaacttgaggtatcagacctggtacccatggtactatggttggtggtacctagtctggtatcggtacttgatatctgaggtaccagatccggttgatacccaaggtatcagtttggtaccataggtatcagatccgatacttaggatattagattcgatatttatggtatcagacctggtacccatggtactaaggttgatggtacctggtctggtatccacgaggtgtcaagaccagtagttgcatattaggcttggtaccaacaaaaaaaaaagtatcaagcctggtacccagaggtatcatttgtaccaaacaagtcatcttcttcctctctccaacacactatatcctcatccatgtgttgattccttagcatgaaatcgaagcaacatcaacaacaagaacaaaaaaaatagagatgagattgtgagtagatgcaggcgacgaactactagaaaagccatatcctcatattctcccttcttcctgtggacatctagcctcatacaggctctgcaattgttgcactcatgtcggcttgctggggacgtcgccgatggccggctcagatggcgttgcggtcgatgcggcgagaaaacggctcccggtggccagcggctagtggtcgtgggcgtagagagggggacagaggatggagggagtagcttgcgcgcggtgggtggtggacgacgctgcataaacgagccaagatgaggtgtggggcgttgattattagtctatcccgttcgaacggtatgccgttctatagattttctattcatctaatcatccatattccgaccaatcacttgatggtacctcagtccgtccaatatctttattccctttttcttagaggattttactctacttttgcataggttaaaggaaccagattgacccatatggcaatcatggattgataatttgtatttttttttcctattcccctcttgtaaagtctcttgtacataaactatatgagcctcttctactgtttttccattaaaaaaatcctaaagaggtcaaggaagaaaagaacacgtgtttaatgattcaaatggtagaaaaccaaagaggttagagttccacaataatttggctattcttacacattggtggatccaaaggctggtccccggaccacccaaatatttgccggtccaaaggcccaaatagcatgcatatatgatagtaagaaaaaaaaaaccccctgaatcccagctgttaaatcgtgaaacagaaaagccgcgtcattgcttccgctccctctccacagcccgcctcacgtgatctcgaattctcgatcaaccgtagcagcgtgcgactgacgagtgcttagctaggttaggactcctgatcagctgtttccttcccgacgacgacgtccggcgatccagcggtgacgacgccacggaggatcgcggcaaattgccaatcgatggcaagccagcaagggtagcgcgtgtgtgggtgccgcgaccggcggcagcggtggcggcgagccgacgacgatggacgaaaatcctgcaagatgcgtcacctacacgggcagacggccggcggcggacaacatatcacggcaagcagctaagcaaagcaagggagctaggtcgagatctagaagcaagcaaaggatagccgatggaaatctgtaagtaagcaaagcaagaatagatgattaacagcttattgattattttgttagccgattaactactctaaagttagtaatcttttttcagcttttagttgacccttctcatattatactattgtattacagattgttgaaagtatggcaatcttctccaaacttgtgtagcatatctatttctttaactcaaatttcttatataattattgattttaaggtgtttgtaagatactttattaatatatcatgatcaacttttgactaattttgttaattatacttggattgtatatattagcattgttactttacggtgtttcaaaataattgaagtcgggtcacccatatccaaaattctagatacgccattgtaatcttatatgagggatctgtcagcatcgcacacggtaggagtagtagagagatattgaaccgacttgggctgttaccctctgcccatgtggtgtaattaagaaaaaaggtacaccgaaggtcccttaacttatcatcgagttacaaaatcgtcctccaaccgcaaaaccggatacaacgcatcccccaacttataaaactggtgcaaaccagatcccttagcggttttgtctgatgtggcggctgagtcatggtgggacccacgtgggccccacatgtcaggatgccacatcagcagaccggcctctccccttcctctcctttcctcctctctctctcactcctctctggactctgtgcagggccggccggcggtggggaggaggtcgccggcgcaaggaggtccgacggccaaccggcgacgcggcgatggaggcacgggagaaagggagggcggcgacagggcgaggcggtgtccgcggatgcggcggcggagaggcggcggcggctacgacacggggcgaggaagtccgacggtcgggcggcgacgctgcggtggcgcgctcgtagtagtcgtgctcggcgcccatgagcccgccccaccgctccaagtccctgacggcgaagccgctgccgtccgccgccgtgagctccacgctgatcgccgcgtccgtgccggccttccagatccacccggtccccatgtagtacagcatgtacacgcacttgttcttgtcgttgtccccgccgtcaaccagctgtccacggcgcggcagcgccgccacgccgcccggcgatctcgatccggcggcctgcacgcgcgtatgcaattaacatgatcagatcaactcacaggtcacagcagagcagagagacgatcagaaaagaaaatgcatgtaccaagaccaccacggaaacgagcgaggcgaagtgcaagaatctgtcagcagccattgtcaaaggcttgaagaactccctctattccagagcagatcacaagcaggtgacaatcatgtaatgcacaaggagagagagtatgggaagtaaagtcaaacaaacgagtactacatgatgagcatttttagatggatttaggacttcacgagttgtctaaaaaactgataaatcaggtacgttcgcctcctccagctccgcgtatgtgaacctcgccggcaacccggggatgaggacctcgtcgccgtcgccgtcgtcttacttcgcgctgctggtcctcgctcacatacgacgcctgctgcgacgacagcatcggcaacttgaaccagctgcggttgccgcctagctgtggccatggcgccgccgctcgcccgccgacgccgtgtcgccgccgccgcatcgccggccggccgtcggacctcctcgccctgcgtcgcagccgaagccgcctcgccctaccgccgccctcccctttcacctgtgtctccgccgccgcgtcgccggccgaccgtcggacttcctcgccccgtgtcgtagctgccgccgcctctccgccgccgcatccgcggacaccgcctcgccctgccgccgccctccctttctcccgtgcctccattgccgcgtcgccggccggccgtcggacgagtcctgagaggagtgagagagagagagagaggaggaaaggagaggaaggggagaggccggtctgctgatgtggcatcctgacatgtggggcctacgtaggtcctacgatgactcagccgccacgtcagacaaaaccggggtcaaaaccgctaagagacctgatttgcactggttttgtaagttggtgcggttggaggacgattttgtaactcgatgataagttgagggaccttcggtgtactttttcctgtaatcaaacacgcttcctcactttatgaaaggggcggatgtatattagtatcattggtctcagatgacacagatgccatccaaccaatccagtgtattgctagcatttatacacacttaccccgacagtgcaagcttgttgaccccaaccgctaaattgcagctgctcagaggctaaacaatatagctccatctttgaaaacttaaacagtttaactggtgtggtaggtgttggagcctgaatctattttccaacatccttcctatttcacattataagatcttttagattttgaatagattcattcatacatccatatgtgctacatatatatgtttaacttcatatgtatgttagaaaatttagacaagagataaaaataccataacgtttataacatgaaacggagggactatatgttttggtaccgtcagccaccactaatgtcacagtttaaaatatttgatccgttgactataattatttcttttagctaatgtttctatccatgtaattaggccaataattctattatcaactattaaaagttaaccatatttttacgtattagtgaaaacaacttgaataacttgttgtctgaccaaaagaataaaggatttgtatttcttattactcttaagagttagtctgaaataaacatgctcattgaaacaacagcaatattctaccggctctagctaaaaataacagttcaaggacaccttagcttacaaaatatttagaaatgaagcccttccaaacactatataagtataagtgagtgctgacattggtgccctaaaatcctagatcagcaagggagtccaagtcaagatggaggtccacatcaagtcgatttcgagtacgtttcagagtccaggaccaatctacactaaaacgggtgtccaggtcgcatatgtgctcggattggagcgttctttatatggatggaaagttaagaagataaccttttcaatggttctggtcccatatccaaattcttttcgagtcattgggaatcgaccgaacaagttgatgttcagaatctattccgatgctgcgtcgccgtattttggtctttgggccgtgtatcgtgttggagctcgttaggattgcgtcgtcaagggttatttgcacgaccctaaactctatatattagtagttgtcaccacctttagggtttgggttttgcttagattaatctgtcaagaacagtttcgccaaccttcggtttgtaaaaccccaacttgtgagcttaatcattcatgcacaatttggttgtattctttcttgttcttgtttgtgtgttcctcaattcacaaacagagattagccttatcggcgaggtcaactggttttcgacacggttgataatcagaggagacatggtgctgtgactgcggggctcaagagcgtgtttgtttagaagccggatcgatttgtgtcgcgactccaccaaattgactgtttatcagaacctctcgaaagatcggaaacccttgtccacatcactttatgaggatgcatgataagcatatagaaaaattctaacagaaagattaaaaaaaatgagaatttccaaaaataccgtgaacactattactaaaactaggaactaggaaggtaacccgtgcaaatgcgcgggcgctttatttaatgttgcttgaaatttttattacgaatggttatatgtggttga

SEQ ID NO: 47173 - DNA, 11807 bp, Oryza sativa
  unsure (1)..(11807): unsure at all n locations
taaaatagatagatagatagatatagttggtgtgtttgaccctagacagggtggtagtgtgcacgcaggacgcatcagctggcggcgatggtggcatggggttgctaagctaatttgaccgctgaaagtgatggaaagcaagcaagcaagtcagagttgccatctccaatcggtctccttatccccatttttctctctgtgctgtactacagtggagtaccacgactgtgtatgtgacagcttagctaactcaatgattaaaatctcgccagatccctcctgcgttatcaatccactgagaagtaagcgaacgagatcgcctgggccggctcgtcggagaaggctcacacgcgacgcgcgccatggcagctgcaaccgcagctgatgttgccgaggatacggccagtgtgtactccggcaagcttaccctctacgtcttcctcacctgcggcgtcgcggcgaccggcggcctcatcatcggctatgacatcggcatctctggtaaacatgcgatttatctcatctatcttttagtatatatgtactggttagagggaattatacgcatggtgacttgtagtgggagaaaaaagcataggagaaaagagcagtgctagcctttgcttatacagacttcatgcaaaaactcttaagataatcatttggaccttctatatctatgctatttctaaaagacattctaccaccaccaccactgatacgtggaccatggtgttcgtataagttgagtgcttggtcaatgtttgtctcattgtctgtacttttgtggagtagctgtgtgctttttactctttatagctagtcttgcattactctgtgagctgcaagtctttatttttctattaatttacttcttgccatcctaattaaaagacctcacaatttaatttaggtttccattaataggcaacacaatttattgacgagtacatattttaacatcatatcaaatgacatcttgttaacatgattggagtcattgatctatactgaaaactaataatgacatttatccttttgtttgttaagaccaacaaattaatactttcaacagggataccttttgctattttgaataaatcgttgcaaagcacggatatttggctagttcctactgaatatatctgttgataacttgatatcgatgatcagcatgtctacacttctttatgtggttaaaccttcgaggtaaactcaggtcggctgatccggagactctagccggttgagtagttcagaattgctcctgatcgaaaactgttcaattgctttcgaaagatgaccatttcttgaagttggtgtttacagtacaaattacctacatttacacatcccttaaactataaatttgaaaaagtatactatgattacattgttaattttaaaaattaagctatgttttctctaatacacaatatataagagattaattaactaatttagaagagaagattggcttgatacaaacatacttacatatatataaagaaaagactgaaatcaattaagtaataaaagtggtgccaaattttagcaaaactagctagtataatgagtgtcgacattcaggtggtgtgacatcgatggacacgttcctggggaagttcttcccgtcggttctccaccaagaacagacggcgcagggcacaagccagtactgcaagttcaacagccagccgctgaccgcgttcacctcgtcgctgtacctcgcggcgctcgtggcctccttcttcgtcgcgtccttcacgcgcgcgctgggcaggaagtggtccatgttcggcggcggcgtctccttcctcgccggtgccaccctcaacggcgccgcgcggaacgtcgccatgctcatcgtcggccgcatcctcctcggcatcggcgtcgccttctgtggtctggtaagtcgttggagaaatcaaattagacacacattggcagcatcaacacaacacattttgacagatcgttcttgaatgtgtagtccactccgatatacttgtctgagatggcgccaccgcggctgcgtggcatgctcaacatcggcctccagctgatgatcaccgtgggcatcttctccgccaatctcgtcaactacggtgcggccaagatcaggggtggctgggggtggcgtgtcagcctcggcctcgctgccgccccggcatgcgtcatcgccgtgggctcgctcttcctcccggactcaccgagctccctcatcaaccgtggccgccacgagcaggcgcggcgggtgctgcggcgcatccgtggcaccgacgaggtggacgacgagtacggcgacctcgtcgcagcagccagcgagatcgaggtgtattccggctgctccgcgagacgacggccgtggcgcgacgtcctgcagcgcaggtaccggccgcagctcgccatggccgtcctcatccccttcttcnnnnnnnnnnnnnnnnnnnnnnnnnnnnnnnnnnnnnnnnncgtgctgttcaagaccatcggcctcggaggagacgcgtcgctcatgtcggcggtcatcaccgggctggtcaatatcgttgccacgttcgtgtccatcgccaccgtcgacagccttggccgacgcaagctcttgttccagggaggctgccagatgcttgtgagccaggtacacacaaatatatatagaagctgatatatatacacctatgacctactccctctctgttcatattattagtcacttttttcctagttaaatttagtcaaactttgattaaatttatagaaaaaattagcaacattttaaacaccagagtagtttcatcgaatctagcattgaatatattctgataatatatttgttttgtgataaaagtgcttctatatttttctaacataaagaagtttggctagaaaaaaagtcaagacatatcgagtgcctgcaaaaaaaaaaaaatgtatgcatgcatgcttatgatcgattcctacaggttatcattggaacgctgatcggtgtggtgtttggtacgagtggcgatggcaacatctcgagggcgttggcggtctgcatcgtggtgttcatctgcgtctacgtcgccggcttcgcttggtcgtggggcccgcttggcgtcctcctgccgagcgagatcttcccgctggaggtccggccggcggggcagagcatcagcgtggccgtgaacatgctctgcacgttcgccgtcgcggaggccttcctcccgatgctctgccacatgaggttcggcctcttctacttctttagcggatgggtgctcgtgatgacgctcttcgtctcggccttcctgcctgagaccaagggcgtgccgatcgagaagatgaccgtcgtgtggagaacgcactggttttggggtagattttactgtaaccaggatgcagatgcacacgttcaagtggcaaacagcaaagtttgaaatgcacaatgccactgctgtctgattttatacagatgtagcaaatgtgagatgcgtattttgggactggttaatttgctgctgatatccagcatgcgcatctcgaagtagcgcggagcaaagttcaaatatccataggaatctcaaagcaatggttttgtttatcgacgtttttaggaaagctcacaccccactggtaataggaaaaaagaccaattaatggtgttatgcgatcatagggggtgagcgcgtatatatatatgaacgcttacgtccgtactgtatttcgaacacaaaaagacaaatggaatggcgtgaaattaaattctgaatcagctaggaactgccggaaagataacaggcataatatgatagcctagttaaaccaaaatgtatggatgggtttgtcgcgcgattcctgtagttgttaaggattgcaagaatgaatttctgaatataaacacaatgtcgtaaatataaaaagccagaattgtatttccctaatacaattaattgtttgaagcaacaatgggaaatagatatagatattatatatagattgatggtcacattaacttcaatgaaaatttataacacaaatatgatgcttagcgctactgatcgatgttccttttgtatctgaaattccataaactcaccaaatgggggaggaccagaggaggaaaaatcatcgaataataagacagaccgagactcaagaatataatctatgagtgataaaggatgccggagctgtagagtctatgagaaccaataatctaaatcttaccagtgggtatgtaccatgcttgttgggcacggccatatatagcttcattatttgtttttgtttttgtttttgttttttttttttgcctgtgggcacgcctcaaccaagctcgaatcccagcaggcgtggcgtttgcattatgcctgtggataacacatgccttttgctcatccctgtatcttgtcccatttgtcccatctaatcatttttttagatataatagaatagaatatcttgacttttgctcaacgagttacagccaattattacaacatataattacataatgtaattatcatgacatgacatgatatgcggtatatatacttgacatggaatgtaaccctaaatcaattcccgttctattttctatccactcactcctctccatgccaccgtggcggcgctcatcatgtaaactagatgattccccgcgctttactgcgaaaattcctaagtaacttttaatatatttttaataatcgagctaaaagtaaaaaagtatattagttattaataacaaataaaactgggttgtcaaactatgttaagaaagaaatacatttagtagaccttgtatgagattatatatgaaatatgatatcccgcactttgattataggggcaattgtatatttgacaagctaactaccaatttgatcctatttttttaagtttgcttttttgaccctactttttaactatggacatcagacatgaccccatttcgtgaaaccaatttgacggtgttaatttgaggtcgaaataccgtttatacccttgctcatttgaccctgttatcttagagtttttgtatatttaacctaattttatacacttggtgtacatgatgcaatttctaaaaaatttcacttggaattgatatgttgtgtgtgaatttgaattagatttgaattttagccaaaaaaatacaattgggaatacaaatcagatcgccacacaaatggatctagaacaatatgacagcattgattcaaatccattttcaatacaatgcctttaccactgattgttaacagaggcttctcagaagaagaagaacaaaaagttgtttcgaaaaattcgagtaccggccacacttcagtatccatagacatagatagtatcaacatgcaaagaaatccttgccaagaacatcatccaacaataacatttcaacaaaaatttcctcaagtctggcaccggcgcatccagacaccgccgccgctccctccacgtcccaccgccgccgccgtcgtcactccctccaccgcaagccggcgccgatgtggatccatgcccctccgctgccgccaccgctccctccacgagtcggcaccgacgcggatccgtgcaccaccgtgtcccgccgccgccactccttcccttgacgagccagaaccggcgcggatccgtgcccctctgccgccgccgccgctccctccctccacgagctggagctggcgcggatccgcgcccctccaccgccgccgccgctccattgacgagccggcaccggtgcggatccgcttcctctgccgccgtcgccgccactccttcccccacgagccggcgccggtgcgaatccgcgcctctccgccgccaccgttggtcccttccgtgtgccgccgttgtcgcccctcctcctcgtcgtcggccgccgccaccgctcctcctcttcatcaagctgccgccatctctcccatgccgccgccgctcctccacctcgtcgggccattgccgacactcctcttcatgtagccaccgccgcgcggctgccgttgcacgaggagggcggcgggaggaggtagggagaggataaggatttccagtctggtgagagagaggagagggagaggataagggaaatgtttatgtgtgcaagggtattttggtcacttgtggctcaaaaaacattttttttctattttataaatgaaaccctaacggtgtcaaaaatgaaaccaaggtcagacggcaactccaattttgaaaagtagggtcaaataagcaaactgtaaaaagtagagtcaaattagtagttatgcttcaaaacatggtcaaaggagcaattgtcatggatatatgttaaggattaaaaaaatgatggatatatatattttaaaaatattgtgaaaaataatgtgaaggaaaatgatttgtagaattcaatgaattctagatgatgttgcatacttgtataagttttgcatgttattattgctaatggatgatgaagtgacatgtttgcattttgagctttagaattagtgagttataactttatagtaagataggatatttacctcttaattgttaaatgcctgtgctgcatgagtatatgaacatccaaccacatcaaacttttgattgaatttttagtgaaaaacaaagaaaacgagtaataactattattagatgattcaggtcacaatggtcttggcttgattcagcacatatataagatagaaagtgtcatgtaaagtatagtcacgcagaggggaaattaaaacacaaagaaaatagcatacaaaaatcttgcgtcgaattaatccaagtttgcagaatcagcagaagatccagtgccgatgaccccaggcggccaccagtgcttgccgacgaatcacaccactaagatgcataacttgttttcccaatggttactgacgtctaaaattgtttgtacacatgttttacccaagctctctagaaaatttctaaatcacccgttggttcagatgataacaaggagaagaaatgaaacttctgaacccaaattatattgtttagcccagattgttctccattagttttaattgttaacttatataatatgaatacccagaaaacattataatcatgcattaagtgatcataagtttttactgatctgcacgtttgtagctggaggcacactttgttttagtcagcacgagtccgagtcccatggaatggaccgattgtgtgggatcgatgaagcacaatgtacgggtggttcatggcgcacatgtaggtggcatcgaaagactactatttttagtcgttcctttttttcttcttaaatagagaagcgctgcaaagtttggtggcacaaatcgttcgttttgctttttctctccgctttcatcttctaggagttcatccaggtgttcaggtgtgttagattggcttggagtggtgacaactggtagcagagcaatgtcatctccacttgccggttgttcctggtatgtcgagggatactggtgctgacattgctctgataccaattgtcggcactctaggccaatcatacacacttgactaccgagacgaatacttggaagactaaggcggaaaggaaaaacaaaacgataataagaaaatgctgcaaagttggatgcatagacaatgcatcaacaacatcacactcaatggggtgcggcaagagatgtagttgccggtgcacttcctcctcatgtttagctgcatcaggcatgcaaagattgtacagccacaaaaaaaaaaccttgatggttggagtatatggtgatgtgggacatcgtcttcgatgagggagctcggagggactaaatctcggaacctaattgaggtatgccaaacagtacctcgtgcatgtagacgaagtgtttcttgtatcactaggtgtaggtagcttagcctattcatgtcatccttgattagtttgtcttatccctgaacttctccctcacctccgtttgggctttctgcatgacttgtggatatttctcattagctcagatattgcccactaacgtgtcgttgagctgtctcgctccctgctgaaaatatttcctgagattaataggcaatttgtaatggtgactttgccaaatggtcattttcaattgtaattctgaaaacgataatgctgaaaatgcagtacagtgctgtgaatttccagagtgatttttttttctgtaagtgtcgtgagttcgtaaattgtccatgttgaaaaatgtttcggccggcctaccgcagcgcgcgaacgctccggctgcaacgctcggccggcctaccgcagcgcgccgctgagccagctcgctggcgacgacgatgggtacaggtcggccaagttgaacccgcccgcgagcctgacggagacctcgagcttgtacgtggaggaactcgtcgcgccgcgcgcaccggctcccgatggcggggcgcacgacggagtcgttcaccatgcgcgagatcttctcgctgatggggaccacggcgccggcgccacccggtgcgcactcgccgaccactgcgtggactaggtaccccgcctgctagtcctaacggacgtggcgaggcgactggacgcggcgcgctaaagagctcgagtaggcagatgtatagatggtcatatggcccgaggcctgatggcccgtccaaggtccggtgattttggcctggggcaggcatggcacggcctgacttgggtcgtgctcgcggtggcccggcccattgtgctagggctggtacctcagcacgctggacatgcatggttcagcccgaagttaagggatgcgaaatagacttattctcagccatatgtaaggcacgtcacagagaatagggagaaaaaaatagacatattatatggcacgacccatagagtagggatataaaataaacttattttagctatatatatgtcacagccaaaaaaagagagaaaatagacttattttaaaaaagacataataggccgcctgtgccttcaggccggcacggcacgacccgacaactggtgggctgtgcctgggcctggtgtgcagcccatgggccagcacggcacagcctgaagtgtcgatcgtgccgtgccggcccgatcgccttggcccgtgccggggccgaggcgtgccgtgtgggccttatggccatctataggcagatccttcggagctagcaccacatgtcaccatggggcatagggaaagaacagtgtatcgattacgagccattatagacgaggggtcatatgtaatggcttctagttttgtatcgttagagataaaagtgattacatctgtaatagctgttggttaagagccgttacagaagaggaggcttcaatgatggctcaagggtgctttggtcatctataacggtcatcaatgccatccgttacataagtcaaaatttgtaacagttttaaccggtccatggcacattatagatgtgagaatccgtgctactgaataatagtgataatgtacaaagacatactaatttacacaggtttagatttattcggagagaggtatacttacaaaataattaattgtcatcataaaatggtgcacacttttatcatatatcaaaattacatatttttggtactatctagttcaaatcaatacatttcacatcactcaccctagggtgacattatctataagtaaccagagaattaagtttagtctaccagataaagaggagccataagagcatggagaacgtgcctagttatgcaagagttcacatacacaaaacagttaacccaaacatggaatacgttgtgtagcatacaccatgagcttcgacttcctctttgcagtgataccaaatgtctcggacaagtcaatctcgtcattcctgtctcgatcgaggaactcccagtcaaaatggtataggaggctggcaagcatgagctctatattggcaagcccaagtgcaatcccagggcatatcctcctcccagcaccgaaaggaatgaactcgaaatctatacccttaaagtcgacacgattgttctcgaacctttctggtttgaatacctcgggatcatcccaatactgattgtccctagctatggcccaagcgttcacaagcactttagttcccactggtatgtcatagcccataaccgagcatggctcacggcactgcctaggaagaaggaatggtaccggtaaatgtagtcggagtgtttcccgaatcaccaagcggaggtagcttagcttgtccatcatttcctctgttagcttgttttctcccctaaatatctcccgcacctctgattgggccttttccatgatgtgtgggttccttactagctctgttaaggcccactcaagtgtcgtagacgaggtttcactcccagccgcaaacatgtcctgtggttttgtaagcaataatgagttcacagagtaatcatttggatttgaagcaatgatgaattcttcatttctctagaagaaataggtaagcatcattgtctaaactgcaaaatgcaaacaaattcaaaatgtagatctgatgatgttactagttgctactccctccattccaaaatataaatatttttaaaatagtgctaagtcaaacattttcgactttgaccattaataacaaaataaaaaaataaaaaatcaataatgtaaaattgatgttgctagatttattattaaacaaactatcataatatgcaactctttttatttagataatcttacttttataaatgttgttggtcaaagtagcatcttaaatactgtgttgaggtccaaaaatgcttatattttgggacggagggagcagtaagtttgatactagcgtttaattgtttcaaaattaactggtataattatgtacctaatatggaatagtactgcacctaaaatacacaaaatcaaatactacttccgttccaaaatataataatttttagctataattaggacgcatagttattcagatttatagctagaaatacttataatcgctggactgttttcgtggatgtgtgcgtacggtgcatgtgcatagtaggacatgtcttctcagtggcggaactgggcctaggtaacttgggcccgggccctactcgtgaaaaaaaaattagtacctataccttgtgaatttttcgatgatggtgtgtaaagaaatatcagatgatggtgtgtttaattaccaagacgacgttagtgatcaaatcggtggtgaggggacactgcacatcgccgttcctctgcaatctgaggagtacgccgaggaggtcttcctcgccgtcgccgtgctcccggatgatgtcgtccatgatggccatcaagctccgattgcaccgctccgtctcccgcatcgcgccgctgagccggcgcgccagccacgacgacgggtacaggtcggccaggttgaacccgccggagagcctcaccgactcgtcgagctcgcgcacgaactcgtcgcgccgcgccgaccgggcgccgacggcggatcgcacgacggagtcgttcaccgcgcgggagatcagctcgccgacgttgacaacggctgcgccgccgcgggcggcgcactcggcggcgacggagcggacgaggcgcgccgcctcgtcctcgcgcccgtggcggagcgactggacgcggcgcgcgctgaggagctcgtgcacgcagatcctccggagctggcgccacaggtcgcagtagggggagaagaggatgtcgcggccgccgcggctgaggacggccagggtcggcgtgaggtagcggctggcgaaggcggcgtcgtacgtcttgagcacctccctggcggcctcggccgacgacacgacgagcgtcggcacggcaccgaagcgg

SEQ ID NO: 47174 - DNA, 9051 bp, Oryza sativa
gagctcgcgcagcgccctgtgtggcaggtcggcgtggcgcgacagcaggacgtggtgcaggctcccgacgagcggcagctgccacggccccggcggcagccgcagcttcttcttctccttctccggcggaggccaccaggagcggcatgagttcttgatgttgacgaggacgaagagcaggaggaaggcgaggacgacgccgatcagcaatggcagtgatacctccatcttgcaatttctcactatggctgtcgctgtcgctgctgctcctccgtctcaagaaggactccttcgccgtgttgtgaaattttcagcagaggtgacgaattacgaagtggactcgctcttggcttctttgaagcgattgctacccaatcttagtttttgggtgtcgtcttcctccaggagaacgggagaagtgtgggggtttcttgttcgcagaatcgcagcgtggaaatttactcgtatttgtgggcgcgtgctctgctctagcgaacgtgacggtgactagtatttgtttgttcatgttttcgctttcactgcttcaaacaattatgagggttccaaggtaacgtgtggtttgtagcatcccgaattccattcccttattgtttagctctagctagcatggtgcactatcgtatatatatattttttctcacgtagcattatgtatttttttatgttttattataattaaaatatattaaaatcctaacataattttaaattctatactaacctgacaaaactaatcaatgcgtaatattcatattgtattatggtagaaaaaaatgctcgtgcattgcaacaggtgaagacgtttttttagtggtacaatagctattaagagctgaacaataaattgaaacattgaaacattaggattgttacatatacattataattgaaaaaaattaatggccattcattcttggttttgggccgaaagcccattccttcctttttagcccgaggctagtccactatctccctccgcttggccatcctctctctttgtccgagcaaccgagcctatagtggagccgcctgtccagcttgcacagcaactgtcgtcttcaacctccgaaagacagtcctgagcctctatgccagagtcgatcatctccatcaaatccagccgaatccttctcaatctcccaaaattggtttagggcttttgatccactcaatctcgtcttccccctttttccccccaaaaacgaagcgaaactcgggataaaaacagctatgaaagctcgttggccagccatcatcggcaactaaaattaaatccggcaaattaaagacgagttgaaatgggaaatcatgaggaaaatgatgatgatgattggggaatcgatttttgcaatcaattggaagaaaaaaaaacaatccacaaaattgtttttgtgggcgagaacgcaccacaaccatcgttcttgtgggatggtgacaccgccacaactcattcttgtagttttgacactcaagtaacttgagatgcaagaggaagaaggaaatgctcaaatttgagacaagatcatgaaagaaactataggaggaggagaaacactcaagagcaaactactgcaacttggttcggggcaatgagagctagcaatggtcatggggtagcttttataggggagagccacccctggttcggccgagccagggggttggccgaccccaagtgggcacctatgctgccctctattcaaggtaagaataatgacacccttgttgaaggaaaacatggcgccctgggaaatatgcttcactctagtgcaggtccaaggcttgtgttgagtgtcaagagcgtaccagctggtttgatcctgcaaccagcaagaaagataataaaccgtaattagatgaatgatagccgatcgaccgatagagccgatgacgtatagtcgggaccagccgatacgggcaaaccaaatcggttgtggctttatgatagacaaataaagcaaaaccctaaatatgccatatcggctgtaatactatctcttttgtttttgtcgattgccttaagacaatattataaaaatagccaatagatcaatatttagaacaaagatagataatgtactagctaataatccaatacaaacttatataataaatcaatctatataaacatgtcaaatagcaatcgatcaccaaatatagagtttactcgagatcaatctaacttgatatatttatatagagcaatctatctatataaatggcaaacatacataaaacagatcatgaaacatgcattatcatgcatattaggtaaaatcggctgaaaccccgatactatccttagttatgattaattctaggttagtttttagggctctagacaatactagggttgatgcaactcaaagtaaataaagaaaccacaagtctaaacaatcaagaaattaaccacttttcacgatggtagataccttagctaatctaatctagtaaagcgatttagccgataccggcataaaccctaaagcgagaatcaactgatatgactaaattgagatactaaaactaaattaattaagataatgtgataacaatggtcacgataaaaggactaatacatataaagcaacataatagccctgatagtgcaagccatcgagacaagttacctcttgtcgagagatcgtagtcgatgccctgacttgaagcaaagaactcatcgaaaagcaaaaagaaaagggtggtgatgcaccaaaagttgtattgattggattgttgtctcctattacaacgatatgggctttatatttataccctcagtgcaaaacttgtccattctggacatgattcaaactttcctaaagataaaatacaaacaagtccacatggcggactcttaccatatctctaattcaatccgacattaatatcctagtgatgtccatcattcgaattcccatagatgatggtaaagattttcctcgtcgagacaagaaaaaggattttcctgaaccatgcttattaattcgggacgaatctcaaagccagttgtaaaaattggctccgatgaaggaggtgctcgtaagattcaccccgcggagcagataattgaaaattgatgatggctccattggtcgagaaggttttacaggaattcttctctcggatagcaggggttaaggtagaagaaaaaaaataaaaaaggatatgaggatgaacaaggctcagagataaatagcaaccgttccccggcaacggcgccagaattgcttgttggtatttcttaaccttacagataaaattcgcaagcgcacggagacccttggctaccgattccaagagtgtagcatcattgcgccgagtatcatgctcctcctgtggttgcatcgtagaacaaaagtggagccaataggaagacatgaagataatctacatagggtcagataattgtttaccattaaaaatattatcattacgacaacgccaaattaaccaacacatacaatactagttccaaatagaatcatctttttaatggacgtagatacccctctaagctaattaccaaaaatatttttggtgttacggggtggaggaatgttaaaagcaaaaaaacacacatctccaaacaaattgagcaacatgacactcaaagaaaagatgttggattgtcttttatgcatagcagaaagaatagtgcttgtccccctccctaaacaaattttcttttagtcaggttatctttcgatagaattattttcttgtgaaaaaaccacataaagaccttgatctttagtggaaccttgaagtcccatagaattctcttttggatccgaacattagagttcatgatcgtggtatacatagagttgactgaaaattggccattcttatgtagcgaccatacaaaacagtccttttcatttgacagagttatattagaaagcctggggatcaaatcgtttcactcgattagattttaaccaacaatggctctcctaaaagaaatatcctgcgacattgtgcccataacctctgccacggtagactgcttctttcgagctacattatataaagtagggtattgaacttcgagagcacgcgattccaaccacgtgtcttcccaaagtcttatatctgtcccattgcattatctaaaagacccaaatctaagaaattggtctttaactttcattaaaccggcccagaactaagaaatacctatcttgctggacataccagagaatgatttaccatttaagtctttattttgcaaaaggtcttgccatacgccttcaccattaagcaactagaaaatccaattgcttaataagtagctaattttgatatcaatgttatggacacatagtccaccttgatgttttggtcgacatatgttttcccacttagttagtctatatttttcttttccggtcatcattactccaaaagaaagtgacataaagaaatataatctttaaaacacacctagtggaatttcaaagaaagataacataaacagagaaaggctcgaaataactgagtttagaaggaccaatctcccaccgtatgatatgtttttgccctttcatgtgctgagttttctctcaaatctatctttaactcctttccaatcaacattccggagttttcgataatgaataggaaaaccaagatatttaaaggggaaagatctagaattacaacaaaatagttgtctatattgatcctccacttccttggcctccccaaagcaaaaaatctcacttttatgaaagtttattttcagctctaagagttgttcgaacacatacgggatgaccttcatgttttttggcctgttcaaggtcatgatctagaaaaaatattgtatcattggcatattgtagaatggacaaaccatcctccactaaatgtggaatgagtcctcgaatttgaccgtcgactttagctctctcaatgagaaccgctaacatatcaaccacaatatttaaaagtataggtgacattggatcccttgtcgcagggctatgtgcgtttcaaatttattacccaaatcatcattgacttttatacggacacttccctcttcaaccattctagaaatccagtgacaccactgctgagaaaatcccttcatgcgtagtgttattttcagaaaatttgaattgtagtgaagtcattttggaccattttagcatgaagctgcctaaccatctttgaaacacgcaacacaagtttcttgctcctgttctggttttgggccacatgatcagggtttccattggctaataacaacaggggaaaaaacaaatccattcagtcaggcatatacatgacaaagcacaagtcacacatcgataaaaaaaatccaatcaagaaaatcgaaaatcccaaggaaaggagaaaaaggaacagaaaacgtgaaggagatacatccatctatgtgtctctcttctcatcccgttctcgagatcaaaggcatggaaaaaagagacagtcaactcgtctagatcaaaggcattgaaaaagaaacaatcaactcgcctagatcaaaggcatggaaaaaagacagacaacttgctatatggagccatcctcatccaagaggggcacacagaatcacggtgatgctatataactggcttcattgcctcttgggttggacctgttgatggaggctgcaaattaaactcccgatgagtggtgcatagtcttgggcatgattactagcgtgagagtaggagaaggcgtgagcgatggccggcgtgggaggacacggcactgatgcactgtcgagggaaagagacagagaggcgcgttggattaattctcgatgtaaggtgagggggtttgtagatgagaccaacttgtatatgcctaaatttgaggacatgggattaagtcagtcgagctgagctaggctctccggttctctaaagttaaagttcaagcgcaactcaattatactaggcattttacactttttttttctgaaacagtagggcgaccaccctttccatttcttgtttttttaaggaaaacaacggcagaaggactgccggaatatattaggagaaataaaatttatgttcaggcaaacataaaaagggcaaacaaaattatttacaagagaaacatcaagggggttcgaaggccgtatggcacagatcgagatcctgttgaattagggaagtcactttgtcggtcgtcgtgcatatattttgaaaaatatgttgattccactccaaccaaatgttcaaccagaaggtgattaggcaccctagagttcttttttgctggggttttggtcgaatggctgagagcaaattccaccaactttttaaatctaaggtgttaggcaaagtattttgacctaaacccttccaaacacaaatcttgttccacacgtcgatgaagattttgcgcggtttagagttttttggtatagaatgagccagccaagaaagcgatgttttggcttagtaggagctgaccagattttcgtaaaatcggtggtggcgaatatgccctgaaattgcatgctttttgaggtgtaaattccgttagatgagaacttccaaaggatatcatctggcaaacttgaaaagaggtgcatgttctgaatgagggctcctagagaaataaatgcatggatctcctcaattgtagtaatctaccgaaaggagaagatccaattattgttagtcagctcgtgatgcactgtatttctttttcgttttactaagctgaaaagccttggagtaaggtgttttgggcattggtttgagagccagttgtcatcccaaaacaacgcttttttttccatctcctagcacgatctctgtagcaacttggaaaagactcttgtcaacattgtcacaaggcaactctgagcccaaccaaggcttgttttcctccttccaactgaaccaagaaaagcgaagacgaatggctctagagaacttgttgaggtctacacttccgaggcctcctaaatttttcggcatgcaaactgtgctccaattaactaggctgtttcctgcgctgatattctcggggtcgtctcttttccaaaggaatgctctacaaaaacgatcaatgtgtttaataaccaacttaggtgtttgggttcctatcatatgatatattggaaggacggtgagaactgatttaacaagagtttcacggttttctgaagtgaaaaactttcctttccaacctggtaagcgtgcaccaaatttgtcaatcaagggaatgaagtccactttcctcagtttgcacgtatgcagcgtcaaacctaaataggggcaggggaaagtttttattgaccccaggagaacttgcgttatatcttgaacatccaccccctcacaagctattgggaatatttcagtctttttaatgttggtgtgcagaccgtatgctctggcaaatgaaattaaaatctggcacaacatgtcgagatcttgttttgttggcttgacaaaaatagcaacatcatcatcataaagagaacagcgaaaacggctcattttgtttgacaccggtatgagaatagacaattcttcagctttacgaatcattctttgcagcggttccatgacaagaataaataggagaggtgaaaggtaatcaccttgtcttaaacctctgcaatgctttatttcctctcctggtgaaccattgaggagaatctttgaagaggaggcaagcaaatttgagacccaattgtgccatcttgtttcgaagccaaaacgttgtaggacttccagcaggaaagaccagcttaccaggttcatttctattaacagaaatggcagactaccaggttcattattacagctgaaattgaaagacaatgcaagaaaactataatgacatctatgtgataccatctcatcacacaaagatatatagccgctgaaattaacgtaagttcaggaattcatcccgctagaactactaagatctagcaacctagcactctcatcaagcagttcaggattatcacagtccagaacacaatagaaatgcgccatcctgcctcaaaaaaccatctcagcaaccatatttctcttgctttcctagaaatctcctctttcactgcaactttctgatgccccatctccagctgtattttcctatttggtgatgtagatttcattgctactcgcttagcagcggttctccccttgtctgcgacttcttcagaagtgaccaggacgaaatccatggcaaatagcgaacgtaattcaactggtaggttctttgtggtggaatcagcccacctgcgttcaaattctagatttaatatgggttctcatatttacggctatttattctttcagtggtggacgacgtactccttgacagcgaggcgcccgtggtgacttcatcatataataaacaggggcaaaagagtagttttaactttaattaaataaaattggcaatttatatatattagctttctcttatgtgacatttctggatgacgtactcctcgaccgcgagatgtccatggtaacttcatcatataataaacaggggcaaaagagtaattttaactttaattaaaaaaattggcaatttatatatagtagctttcccttttgtgacatttctggacgacgtactcctcgaccgcgaggcgctcgtggtgacttcatcatataaaaataggggcaaaagagtaattttaactttaattagataaaattgccaatttatatatattagctttctctcatgtggcatttctgtaatgaaatttggaagagtggtatctcaagagtgccactatgtaagagtggtagttaataacccccctcccacccaagaatagctgcaagacgcataacaccagttattttctctctttgctaaactatttatttcggcgataggcaaaagcttttcacataaatattttcgaagaatagcatacaaccgtgacataccgaggcggtcattggcaggttaggaggagcgcatagcccattgaacataagctactctaaaccaagcgaagctcctaatataagctaagacagagagaaagaagcg

SEQ ID NO: 47175 - DNA, 8430 bp, Oryza sativa
tccctccgttttctaaatatttgacaccgttaactttttaaatacgtttgaccgttcgttttattaaaaaaaattaaaatttaagtaattattaattcttttcctatcattgattcattgttaaatatacttatatgtatacatatagtttaacatatttcataaaagtttctgaataagatgaacggtcaaacatgtgctaaaaagtcaacggtgtcaaatatttaaaaacggagtgagtatttagttggcatgccacttcttatatttagttggcatatgccgctttgccaaagaaactccgcacattggaaggaatggcagcaaccagacctcaaatgtactatggtgaattctttctattttcccaaacttaaaagtgctatttataaacactccagataaaatgagccgtatgacatttcaggaataaatgctcaattctttcatcttctgagcaaaacaaacaacttttctctttacctttccatcctctcttttatcaagttatctctaagttaggatgcaataatttccatcctctccttaagtagtagcggcatgaacactttgattttaacaggaattttgaacttccaaaacttttttaaaaggaaaccgtaagttatgaatttgtaaatatctataaaaggagcttacagaggagcccaccatcacagaacaatgagttgtaggttttgaacttccatgttttcattaagatcaccaaattctgtccctttcactagtcagaacaacgttctgggacctactattcagtaatttccattggattagtttgtcaccagagatgcttcttctgaacttaagcactccaaaatcagtattagaaccttaacaaccatcacatttcttgtgtgatatgttaaataaggaagggagttgatcacctagggattgactacgcacccagatatcttcccagaatagagttcgttgaccatttccaggcttccttgtgcaatttttttttgtgaacccaaataaggaaactagctttgaatcttctttgactaagatttttattgttcaaatatatgttccccaagttaccattctctttattctcaccatagccatttaccttacaaggctttgttcatgatttctaaatcaagtatccccaagtcaccacgaacttttggtctgcatacaacagaccatctcaccatatatatgatatttcctggcttccaagtcttcctgccacaagtcctaaagtactccatttctttttaacctcttgaggcatgaaataaaatggcatcatataaatatgtattgaagcaaaaaaaaaatgtatgctgctgagagcctgagactagagttaacaagggtcaatctccccacaactacgcagcattccttgccaacataggcttagcgtctatgtttctgcagcttaatttccaatacttattacaagtcctttatttcatcaataggaatccccaggaagacctgtccctgagcacgtacgagctatgccaccgtacaaggctcaaaaaattatgtgtgtttcaatttaaaacaatacgttccgatatatatataaaatctctcgattcctttgtttccttcaaatttcactttttatgttccattgaatcagcgagaatgagttgttttcttctcaactccacgaagtgttcgatggcaatcataactacatccaagaagtgtatttcatgacaacgatgtgaacgcacgttctagtcattgaggattcatttttctatttagtaagaaaaaaatgaattgttgcaattattctttttctgcttagctggaacgccactacatatgtacgtgggtgggcttgttttcattggttgaaaacaattcttgcttgtttgatagcagggcatagttaaagaaaggagtaccggacttatgctacctttcgtaacatggttggaaggcagttgagatatagaataaagcagagtgacaatagagacccaccccatgtattataaacaatacgcatatcccttatctattatgcaattagctagtatatttttaaagataaggactcgtttatttcgcacgagactcccaaattgttaaggtaagccgtgtccccggatatttcatagtaaagtaaccaatcttacaagttagtatcttgctatacactagttctttaattttttctttgcagccacaacaagttagtatctggctatacactagttcttttttcttggcaaccccagatagtacaagtcacttttatgaaagttgtttttcagccctaacttctgctaaaaaaattaaaataatatattgaggtttttaactacataaaaagtcattttagagtagaaaaataattaatgtaatctgcatgttagaggattggtatgctttgttttaagaatcctggtccgaactgcactaaattagtgtatttggaccaagctgcaccgattgattcgttttttatctgctgaaaactgagaatttctacccgaagagcagtaatacgagtaactgggaagaaggcaagacagaatctgtctcgcaacttttcccaactaccgtttatacatccaacggtagaggtgtaccattgcttcgctctctcttgaagagagaatggaaacaatctccaccgtacagtctcctgtctcatgccacgaatcttaaggcatgagcagatttgctcaaagtctcacatatgatggtaggtattttctagatcaaagccagaaaaaggattttccttaaccatgctgattagttcagggcaaattttatagccagttgtataaatgggctccgatgaaggaggtggctcatagaattcgcccctaggagcagatagctcaaaaagaggttgctccatagtcgagaagaatttaacaggaatacttctctggttagcaggggtaaaggaagaataaaaaaatgaaaaagagatacgaggatgatctgggttcggaaatgatcagcaactgttccccggcaacagcgctagaaatgcttgttggtattccttacgatcacagatgaaatccacaagcgcacggatataccgatgtagcacttcctctacggagtattccaagggtatcgaatccaagggaacgtgtgtggtcaggtcttcttccggttcatccaaggacactaagcagatgataggccaggatagagaggatttactagcgagaaacagtgtctatggaaagcttaactttaatcctaacgcaatacttcaggcactggcaacccgctgttcccagatatcgctctactacgcacccggacagggaggacttaagtgctcttgaggactatcaccacctctacacctacctcaaacatactgtgggatacacagcaatcactagagattaattaccaagacaccgcgtctacgcaattaataactactctagtgccgatcaagcactaaagcaatcactataaataaatggactatagtgaacaatgatcccgtatgctatttaggaactaaccaagagataattctcacgagataaatctaaattactcaggaagaatattatattgaattcagagtaataaacagaataaaataaatgaaagaagattaccgacaacttcagaattcttccgacttcttctactctactctcttcctattctaatatacaatatagtacaatagagcctcttataattcagctcaagcttggaagtgtgtgttgaagtgaggtctttatatagaggtagatatgatggttagcgaagcggaaatgtccgaactgccccgcaaccgccatcagggagtgatctggagcgtccaagccaaaacctaggatcaacggtgatcaccagggttcggccgaacctgggctgggcccccctggcctgacctttggcctggctcctcttctggtacttctctatccattccttagtattttgggctgattctatggtattttgatgaagttcacaacccatccttgtatggatatatatttctcctcactttagtctagatttcctcccaacctcagggtttatcaccagcatacaaatatacaccaacacttgtggaatatgtgagattaagcacctatcactatgtttggatattttattatctgaactttatgcagatgttggcggtatagaattggcatttaacaaccgccaacactcatagggtctaacaaatttcttactatccttaacccggctttcctgagccagagctttttgcaagagttgactaacatcaagaaattgttggctttctaatctttctttaataggagcaattaaaccattaaaagcaagatcagccaaatctctatcaattatattcaagctataacatcggtttctaatatccctaaatctcttaatataatcaatgatagattcattgtacttttgcctaaccgatgtcaaatcacttagcctaagttcagtttcaccagtatagaaataatcatgaaatctttgctctaattgaggccaagtatgaatagaatttgtcggtagagaagtaaaccatgtaaaagcagtaccagacaaagataaagaaaacaagcgcaatttaaaagtatcaaaactactagcctcaccacattgctctaagaacggacccacatgctcccatgtgatcctactatcctcaccactaaatttggtaaatccgagaactctataaccacgatgatatgggatattgtcatagtaatcaggatacggcttttgataaaccttagcacgatttcctagcttcaatcccgaacttatccctaataataccactaatcaattcctccatattctcaggcctatgttgatttggtggtgggtttggtggcctaagaggtggttgttgcggcgcaataaaattatattggccatacctagtatcgggatgatatcccctagtagtatcattgtaaacattagggacatgtgggagagcttggggattaacagtagatacaaggggatcatgtgctcgaacatggtataaaagcccgttatttgtcattggatctaccgccctgtattgggataattgcaccggtctgaccggtccagggcccggtctgaccggcatccaaaggcgcagtcagaccggtttggggtccggtctgaccgccgggagaaaacccggtctgaccggccatctggctggtctgaccggcggaaaacttgcggtctgaccggccatctggcccggtcgaaccagctgagtgcgcagcccatccctcaccggttgtttgcatattcgctccatcggttttgctatatatttgatctataggaggtttgctagcactggtagaggctttatctttagattagaaatcggctaaaaaagaaccgagcttattcctcaagaaatcatcaaaacgagattcaaaagatgcatctatcttactatttaaagcagcaatggatgaatctattgtacttgctacatgttgttggatagggattgatacctcttcggtacttaccacatcaaaaataggtttaggcaacggtccaggcttgagaaccacaccttgacgggtcctagtgcatgttctcatcagtgcctcatgcgtgatcgccttaatctactcctccatggccttgcgtgcttccccatcaagattctccaatgagattggcatgatattggatggttccacctccgacttggttgatggcggctttgtcatggcggcatcgaagttgagatggtgttgagcagatttccccagtggagtcgccaaaaatcgtgttggcgactttttgtgacaagttgacaagcacgatcacagcacctaaagctttgcggtgatcctagagtcgccaaccacctcaatctagcaaaagctaaatcaagatgggttttgataagctaaaccggctagcggagccgatctaaatagaacgatagataactatccgtctcgtgggcaaaacggaaggttttcaggacaaacctacaaagaggtgttgcactctcacagtggcggcggacgatttacggcgcaaatcgacaaagatagacaaactaaactagaactagaagcaaaagtaaaagaacgatacgattgattgatagttgattgattttacaatgaaccggccttaccccttatatagggattggtcttgccctctacaggccctcctccacgtccaactcgggatataatccaaaggaaacctgaaacatgacttcctgagcaaggaaacctcgagacccgacgaaacagactcgggtttggactctgccagtcagaccggccacacaccaccggtctgaccggccctgcatcggcggtctgaccagcctatacacggcggtcagaccggcccaatcagagaaaaaccggcagatttccaaactttggtaatttttcctattttatccctaggtgccaaatttgggtgtaaacaatatctataagttggaataaccttgaaagccattaaggaaaggtcaaattccacttggcactccacgatataagacgctccattagaaacctcgtgtagctatgattgcaatttgtactgcaattcagcaaatgcatatgtaaatgatgctggactgtactgttttatgatattgcctctgtgtgattaatgtatgtatctactggcccattaaggattgctgatcatacatatccaccatttgaacagatatcattgcataatcttctttatgtgagtctttcacccaacctgaaaaacacaacatgtaatatttgtgatttgttgtaatttgtgaagttatatcgtgtcagctttgtgcacactctctaagtttgtttttttttgttgtctttgtatttgtatttgtctttgttagatttttatattttcatttgctccaagacagttattgacatgatacatcagtgggcattgttagatcaagaggtatctatttcttctctacagattatatgtaaagtgtcatggacatcatgcaaacttggtaatgagtactaactgaatagacaagcatattcacactgttgtgctgctactgccgctttcatggctcaactttctgctttttgtttttgctgctacttcatattgtgcaaagtgcaaaggcaggaattgtttcaattcttatgttcagatatacctgatcattgtgcaaactactattttgttctatgtttttgcggtgagcatttgtaagcatcttgtattttgtcttatttgtctttgactttgtctttgtccctgcattttttaagtcaataggttggtcttggcactgggttggttttgtctttgtctttgtcaacttttataaaatttagctacatatttctattgtttttctctgcaggagttcagagcaagaggagcctagggggccatggccgatgatgcctatctggagacccaagcaattccaaatgtgccaaagtgagcaattcctatgtgctacttcacattgtgcaaactacaaaggcaagactgttgttcaaactatttttgttcaaatgtttctgttcagactgtatctttcagttttccgatatgcctgaccatttctagtagaatctagagttctacacactttcggttctgctgtaattagcgttcaacaaattgactcaagattgtctttgtctttgtctttgtccctattaagctactaaaaatctgaaactaacatgacctatagaaataacaatctaactcatgtgacactctgctctccagacaactaatggaattatatagtttgcaattttcagttgttttcattgagaaactgaacatctcagaggctctaagaactagtttgtgtcttgatctatgttctgatctagtgatgggtcttgaataatgagaggattggaacaacaaatacacattagcccccaatgcatctacagaagtgtttttatcccagtaacaaacagccgatggtcagactactgtatggagtctttttgagtatgtatttgatgtatgcatactatatgtaagtttcatcaacttaattagttgttaaaagctggcatggattcaagttcttctttgctttattatggttgtgcacttttttgatttcccaggggaggtctcttcaaagtggcaaccgcagcaaatttcttgaaccaacaagcaaggaatcagggaggtggatctttgtgttttgctcatcacgtgaaatcaaaaaaaatttgttgaagcagcacacgcaagaaaccaaagagaagcaccaaaaagttgaattcaaagaaaactaaatgggatttttcgtcatagtgatttgtgttcatcttcggctcatctccctgaatctcctcatcgtccatctatttgattctctcctcttcttttctctttgatctggattttgatctggtttgttctcctttctcctttattcttggttactaagcccttttctat

SEQ ID NO: 47176 - DNA, 10392 bp, Oryza sativa
tgctgcacgtgatttcttcgtatttgggctttttaatcccatcatgggctgcgggctgtgggctgtgggccatgtgaactagtgggcttttttgtttgtatttttttgcacaaattgtgacgggctttttgtttcttcaaagaaaagaggatgtgggctgtggcctaacaaaaaaacagaaatggactgtggcctaaaaaaaaattagtaaacagagtcacgctactttttttctgcgcgcatcaattgtctgtgcgcggatcgcacggccagcggaaaaaaaaggctgacaaaccaaaaaatttcagccccatgttacatacacaatccctattatactagaaaaaaaatacacgtacgttacaacggataaaatatttttagatcgttatatatgttactctttcattttataccaaaagcttattccttccttcattttcagtcctagcttagcccgctaccttcctttgtcgaccgccgtactcaacctccggaagaccgtaattgaaagtgaaaaccatgaggaaaattaggaagaaacacatgccggagaaaaggtgatgaaaaaaaagtaaagtacaaacagcggagggagataaaccgaaaaaaaaacgaagaaaaaatcagacagaaaaaaaaagccaaaaataaaaaggaaaaaagggtgaaaaaaacagagggaaacaatcggaaaaaagggaaaagagaaagcggacagaaagaaagaaaaagaaaaaggaaaaaacgaacgggaaaaaagaaaaaggaaaaagcaacggaaaataaaaaagacggaggaatttttagcggaagccttacgcattttttaattgagtagatagatatagatataggtacacgtatagttttttatgagtaaatttcataaaactccatctattacggttaaatcacagggattgtgacacatgacacataactctacatattatggttctaagggcccctttgaaacaatggataggaaaaacacaggaataggaaaaatgtaggaattgaagttgtatgtttttccagtcctataggaattgaaaacacaggaaataaagagaagagccctttgattatagggtaaattggaaccatgccattataattttgtaaagtttgagatatgccatcggtatctcagtgacatgtaggacacacatgagtcaatgacatgtgggtcaggatgacatatcttaaattttgcaaaattataatggcatggttccaattttctcttgattataccacaggatacactcaacaaaggaaagcttcacaagaggtctaacctcttgcttattttcctatggaattgatcataggaatgcaatcctatggaagttttcctatctcttcctatgaatcaaatagctctataggaaaaaatccttaggaaaatgaatcctccaaaattcctttgctaatcctccatttcaaaggggccctaaatttggaccataattagtggggttatgtactctaatggtggtctatcagtttaaataaaaatcagtgattgagtttttttttcttttcaattgaaatttcaaggattttatctaataatttattagagtaccatgtgaacgtttataagagtaccttgtgaaggcttaggggcgtttgtacaatctttactgggcttttagtatataatagatagataattgatttccatttgatttgcttgtcaacatggatgcttcttctgaacttaagcactccaaagttacttagaaccgtagcaagaactttgtcatgtattccctccttttcaaaaatataacatctacaatgcattctgctactataattctaaacaccctaatacagtatgacttgataaactttagttatataaaggaaaaagtacgaattacccccaaactatcgcggttgactaaattatccccttgaacccgaaaaccagacaatgctcaccctgaactttcaaaactagacgaattatccccctcgactcaatccagaacggttttgtcctatgtggcatacatatggcaatccagtcagcattctctttaaaaacaaaacaaatggtgggacctgttgtaaaccaacgcgcctattagcggatcaccggatccgttccttgtccctcccacagcagtagagacgtgagatgatgtagaacacccgcgcccatcccgttgccctcaagaacattgcagaagtagacaatgaacacaaatatagggtggagctctctcttcattatagatctcatctgtagtacaagccagccattagccattagatgtcacaccctgcccctgtatatataggggtcttaggaggagatagatcttatctctactccggtttggattggcccacaagaaacttatctccaagagatttatttcacaacactcccccttgggctaatccgcgactaactcatgcctcgtcaaaactcctaccaaaacccagtgggaaaaaggctaggagaaagagtgcatagttatcgctcatgcattgcacattgttgcctcgttaaaaactttatgtgaggaacaacagctccactcactcaagggaaaaagagtacaacactaaggactacacagtccatattgtgggtcatgttcttgggtgctctccccctgaacctagcaaacatcaaagtcttctcatcccaattctccggaaaagcttccgagaactaacagttgggagagactaggtgatcaatcctctagattatcactaaacttgaattgctactcacctcacctcacctcaggagtctgtgaggtagcccacttgtatttggtgtcggtcaataaagacagatcttattatgataggaccttaggaacaggtctaagtgatcgtcatcgagtcaatgccctgggcatactctaagacatttcaatgtcttgcaaatgacaatcaacacatagcacatactccccctgatgacaacctttgtcacagaccatgttcccatagcattaaacatctctcagatgtatgcgtaggcaagaatccttcagatcctcaaaccattagtcttaaaagacttgtctcatttcaccgctaaaacgagaatagggaacacagagagtaatgcattccatcactatcatataccataataccatactgctgtgcaacgcaatctgtttcatccttcagaaggattatggggataaataagtcgcaacggcacgcacctcctcgacgtgactccatcaagaactagatcttgatcattgcaactttctcagacgatgtcaacaacaatgggggatccacaagatcaaccacaagccttccaaagacatgttgtaacgatcagagtaactagctagtctgaaaatttaagcactgtgggggataacacacggccaacaacaccaagtataccttaataggtattagaggacaccaccgttcctaccatcgggtagaacagatatcacgagtgtacatactccagtgataatcgcgagatgcacatgtgcctacagacctcgtctgtgatctcatcaggttcctcattgcaatcttaccgggtcataaatgggccatcattcctccaagggattatacaatatggtgtgttcaaacttactaattattttgtatctcagaggaaaattcatcaatgaggtctccccctcagagaaaattccgtcaatgagattttctcccaacgggagatggtactcttaccggaatacctattggtacgagatttgcatgctgcaacttcactaccgagtctattcaagacctcacggatttcctaaatccgttaactgcatatttaatttcatgctattttgccaatacctttatttagcggaacattcagctcatgtgggagaggtcacgtcaaggacctacttgaaccatcgcacatcaccacctcattatctcaataatgacccataagaatccgaacaacgttcgcgattttcaattggcgattcaattccgcctcaattgcatttccatttgacccgatttgagcaccgcatgctcatgccatggacttgttccggatccgggttctctctaagagaatcattagcaagaggcaacatagtgtcgacacatttattcccacttacacatttaagcagatcttcgttatttcccaaaacgatcgatcaatggttgttccgtattcctagcaccatatatgcgcgcattgctaggaatgtcgtctccacgacgaacatcattatgaggtatatcaccttccaaaggtgaattctccaccaggagaatcagaggagtatgctcacatccagtgagaactcttatgctctgactaaggcctacgaatcgtgttagcaggcgtccccgcacaacatgatcaaatgccataagtcttatgtggatacgatattattcccgggtctatccacatttaccacaattgggagcattactctttttaacaaatatctagttgttcctcatatgattttgttggcaaaaactccgtgcaccaagcaaccaggagtatgaactaaacatgcaagttcagctcatttagtgcgttcactcaaagaaatctccaggcattccaaaatgggcgattctctccccttaatgccgagatatcttacaatagcatactaccaatccccatatcgtggcacaagattaaggcatttcacctcaaacacatgtgttctcccacgattgtatgctacggtggtgatatatttgggaaatattacgcactttaataggagagatttttccattatatgcagtgagcctggacatataccaatacagtggcatgaatactgtattcttccttctcccgaagggttatccttaacctcccagttaggatatacaggtttgcaaaaaccaccattgctatcaaatgtatatgcaaccaacatgcaaatactttagccaaatgcactctccatggattaatgctcacctagtgccattcaaactcacaatcgattccgggtcgacgtgcattagacatcgcatgtcatatgcttaagaaggcaacctatgatggcataacgcattccgatgcgctcaacaaggagtatgatagaaaaatgcgcggccactagcctgcgctgccaagcagatttttgtggtgcagagttgttttaaagtccatctcgtttaatgcccaagtttgaccccaattactcataccaaactctagaattgggtcatagttaagcagcatgtattaggtacgatccacgagcgaattatcaaaccacatttgctaatgtcccctggacatagccatcgagagataatccatacctccgacaatggtaatattcacaataaaaccattatattcagacatatccacaaaaatagtggaatgtgtcggtgcaaccgtcattggcataacgagctcaatgcatgcaacatgacgaacctttgcacggcttgcacacgtccacacgcgaaaaacgccagtgtgtgacaagcatggtcattaacccatggatgaccaaccaacacaaccagggaatagtcatcgactacgagagtgcgataaaacgcaatagtgcatagccaacatttgtctgaaatacagttacgtcgaactgtgtgagtggttgtaactcctcagattatacactaattgttcttctaaactaaagcattttatcaattccagcatgaagataagctttagaatagaacaggaaagaccaagaacgttatttatctgagaaatatcaatctaatgcaaagttccaaactaagcaaaagataaactgcttggcaacagtatagtcgaccaatgtcctcctaggacatgctctaaactagccatataactcccattgtcaaaacaactttattagacaaacactaccaacaattggtcaacaaccataggtggccatttagctagatccacacgaggaccgagactgagtcaacacccaagtcaagctgttggcgctatagtgaagtgggaatcatgcctattcacagcatctacccttgggcttattcctctagatttgcctcctcttttctggtgtccttgcaagacatcaggttccaaataatattgagaagatatgtgcacaccaagggcaaccatacgaacaatgtcattccaccacatggaaaacactttacatctttcaccgggccaggtgaaaaatatctcaaattattgaacctcgcaactccacgttgccaaaaaattgaggtataatcatttatctccaaatcagaaaagcgtgctctcaaccattgggaaagcaaaaaaaatgtcaaccgtagtccgaccatactctgattgagatgttaagccactagggaaaaaggcacaatgaatcccaaacacattgtctaattccatacatttcaatgacttagaatcccattcttgagtgtgatcatagggatagagtgatctacattaatgcccaaagccatataatagtcattgaaggcctttacgtgaaatcacccgcactatctatccgaatcgtttcatgcggttctcagagaacgcaacatgcaaacggacgatatgtgcaatgaattcggcaaaagtatggatctcatacaacaagtatacatgactccatcttgtagacacatcgatatcaccatttatgtatagaggagtgtaccagtaaagagtggtcttatccatagccatggatatttaatttcccagaatttccatgcattaggtgattttctgttatttacttggtcttatttggcattatattcccaatatttatgccacacagaaaaccatcacacataaatgcaggaaaataaacccatcataatgcttccaaggggggattctacactatgtgaacacaatttatggaagcatcataacctagaaaaccatctctagattatttagttggaattgcatcaattttaaaagcaaagcaatgcttaaaaaacaccattacatagttatttacgagtccggagacccacacgcaaaaccaaactatacagggcctaagcaacgagacatagccacacaaagaaaattaatataattcttgttaattataaggttcaaactgtaaaattgcattaaacagtgaactatagcataaaaacccaacactccgggggcttaaacacaagttgtcaataaaccgaaattaatcgggccgaattaccgttcaggccacgatcttatttgggctagcaagcacagtgtagcccaaaatgcctaatgggccgaatttccaaaactctaggcccatgaggatttccaggtttattatttttattaatttgtttgggctgtctcgttactgttgggctttattcggtcgggcggaggcagaccagcccagccggttcgcctaagtgaccgagagaggtaaggggggaattagagtttctcctttcccattcattgtccgcaacggcgtccaccgcccggtgcaccggcccctcgggcacggcggcagcgttggaggccgtcgactgttgactttgaagggatttagggcggtgcacggcgaggaggtcatcgacgacccatccactaccctgattggcaggacggcggtgacgacatcactcccgtgtggcaatttggtgcggtggcggctcggtggcacacgacggagctccgcgtcgacccgcgcatcctcatgacggcggcgaggcgaactcaacgacggcaactgagaccctaacaatggcaaccaaattgcatctggccatatcgtctcggcggaggttaatccggtagtggacagccgacgacccatcatcctcccaccacggctcgacggcagcgtcgatgggaggtcaacggcggtggcgcctcgcttcggcattaactccagcggcaacggcgatatgggtttagggctttctccaagacggcggtttcctgcgatggcatcgacgcaaggccgacggcgtacccaacagcgacggcgaatgatggccaatatgtctctaagtccgactacacagactgagaatatgtcaccgcgttcccggcatggcatcatcagagaaagagagaaatagagagatgcgagggaggtgggcgagtcggccaattcggcccagccgaattaggcacttctccaatccagggtttcccatcaattttaatgatttctctcacacggttttcttcagttttcatcaaataaaatagatgcatatatatatagatcaaaagcaggaaattaatctactgctagatcaagagcaggatcaaggctactgcaaataaagcatctataatatgataaaaacgagaaaatataatctatctataaaaacatatagatttcatacctgaatagatacatggatgtatctatgaattagtaaattagtttaggaactaatcatactaattaccgtgattagtgtgcttgatgaggatggttgcacactttaatctccagggatctgtgcacgtggccatctggtcaggtgcatgcaacatatctctacaacttaaaagtttcgtagcggtggcggtgactccaaccttaacagacacgtgaaatatagaacgtgggatcgcctaatcgaacggctcagattgcctttctcttcctacgcatccagcgcacgcgtctccctcgaatctcgatcgctctctcctctcccctaccctcaaccccccgatccacgccgccgcaaccccctcaaccgcccgcatccccgatccgttctctccccctttcctccttccccaccgtcgctgccgtcctccccggcactcccatccctttctcctccatgccgcacccctccccatcgtcgcagccgccccgtcgcccctgctcgcctgcatccaccacaccgcctccctccccagtcgagacggtgtcgcctcctcgccccctccgcagctagattgacactgcgccattcaatccaccgcctcaagcaccatgcatcgtcgtcgttgcaggcgtcggcacgggcgcgggcactgccgatcccgagtcgagacgacgtcgtccgctgctgcttctccaccactgacggttgccctgcgtatatcctccctattatcgcggtccccatctgctcctgaatcctgatccacaaaaacagcggagcgccgtcggcctctctgcctccctgcgaccaccagtggcatctgccccgccgtcggctctccctcacccgcgactcgccgacatggtgctccacaaaccattcaggccgtcactggtctccggagcgcccgaggccgacgtgtctcgcactccctataatcttgctttgctgcagcagtaacaacatcataacatatcgtggttcatacaatggatcaggctggtaattcgattccaattcttgctcctgaacttttttattggtgattccctctaatgttcagcagattgggtttggtggtggcagtgcggcaccactgatttgtgttagacattggtccttatccaaccctctaatctcttgattatgctcacttacgatgacttcagctcaggtggttgcaagaaacactcctagactgctatttagttttacgttacagggatttggctacagatagttgcaagctgcaatgttctgatatttgttatgttttagagcaagatctgccttatatataatgatataattaggcttcgaatttcttgcttatgttctttaaaaattccaagtaaccttttcagttctttatgtcaggttaattgacagatcgagttgcacttacacatatcttgttttaggaaatgctccaatggcccttgaatccagcaaagtaagtatttttttatgcttgatctgtgactgatctcaaacagataaattgaaatgagtaacttgtacacagataaaaaagtgacatgggacttgattagagttacggtatttttatcttacgaggcgccagcattatttgagttttatgagtcaaatattcttccattttttcctgtcatttggttgtgtcatgtcattatttgagttttattgggtaaattgtgtcctgactggccctgagctggatgcagtgcttaattggtgcaaaaactgggcttaatgcagtcaatttccagtcatgtgtttgaaaccattgttttctgattactttaattaaataatccatgatcacaatataaaccatatgtgcaaatatccagtcatgtgtcatgtgcatgatcagatgactgctattggctataatgcagtgattctgaaattgctatttgccaaggcttcctatttttgctgaactgctgcagcagaatagtgccaccaaatgaaagtgaacacgtaagcatattgtttgggagaagatcacagttcggaatttcagattataaccaagataaagaatcactcaactttatgatcgacttgctattcatgtttattactccctca

SEQ ID NO: 47177 - DNA, 3484 bp, Oryza sativa
tttgtaaacatgtttgaccgttcgtcttattcaaaaacttttatgaaatgtgtaaaactatatgtatacataaaagtatatttaacaataaatcaaatgataggaaaagaattaataattactaaatttttttaataagacgaacggtcaaacatttttaaaaaagtcaacggcgtcaaatattttgggatggagggagtataaaatagttcctactgaacattgtcggctacttgttgattctttttaggtggtgtttgttcctgtgcacaaataggtctacacatgcacatgcgatttctcttacagttattttggtgctttaaaatgctttacgtattggtaatattagagcctagaggtcaaaaactattttgtatagagaaaattatcccacatagccatctgttgtttattcaagaaaatattctatgtatcttcagggaaccatatgtgatacacaaattcaattttatgtccattgttagagaatccatttgcttgaatcaaaattagagaatcatatatctgatggaaaattgtctttttaccaatatgtttgccttgcagattggtagttcctctcgtcctccaggcaccagctatggacaatatctatacctcaaggaagcctcttcatgttcccctcaatatttctttctgggtgcatgcactctatgcttgctatgcaaaacccaatgtatgtgaatgtgatccttatgctgcaaaggtgctactataaacacttcgttcttttatctatttatttaaacattctttgttggtgtcggtgcattgcctctgaattttagatccttttttagtgcaaaatgcatatgaatgtgtggcattgatattcccttggagatgaaacaaggtattcagtgtttgcaaattaacatttacgagtaggatttacctagctagcatggcctctttcatagccacttttgcatgtatgaatctttgtgaattgtggtcctataggcaaatagaaaggtaaaattacgtgatcaactcgagctctttttcatatttgtgccactcatatttgtcctaagttttaactgtattttaatttaatcttaaattcaggccaactactcttgcggatgttatttaatgaatttggatgtgattgtactgcaagttaatctagaaattcatttccctgttttcataacaacaaaacttttaaagatgatatccctttattgtcattcaagtcagcattaagcttgctggttgaaaatttgaagtttttttaattcattctgaagtatgaagtagtatagaactttctgattttctattggtgtttagctcttaattgttgttttatctgagaattcactgctgactgctagcttaaccatctcaataaagctgatgaagacaaggtgctcgatattcagacgatattggtcaagtataacatatttcatattgaccagtgagaagcatccagaagaagtaaacgaatgagcattgagttccagaaaatggtgtatagtatagatggaattatgaaaagcaatcaacctcatgttttatgtatagtttttattattttgtgaaaggatggtagtgtcaatatgtagagtttttattaatttgtgaaaggatggtagtgtcaatatttagttccagaaaatggtgtattgtatagttggagttagcaagagtaatcgtctagctcatggttttgggaaaggattttggtgttaactattttttcgatcagattatcaaattcaaaactgcaagtattttcacccgaatgttgttcgtgaacccgtgaactttattagcttcaaatgtttttattttctgatacaactcacatgctattttattcaccaactttcgttgtttgtagatttgtattactaccatatgaaaactataaacatgtgatataattattattcgtgctatattaaagtttttattataaaggaattacacttaataattatttaacattatcttactgtgtgcttttaaattggtttataacttttacccgttgtaacgcacgggcatctatctagtgtgtgcatgttttcactattcgttccatcaatccaaggcgtgtgatcccggcggcacgccggcacagccgatgacccgcgcacatgcgggtagatgcacgtggtttggccaccagacagaagcgaacggcatcgctgcgtcgtggcgccgtgcggtagccattgcccatcggccaaatcgcgcaggaccgaaacaggcgctcggcatggcccgacctatccggagcggctgtgctcccgcagggcgcgccgcacatatgcgcgacagcaggggccagcgggcatcgaagcgcttcaagcgcacacgggtacgccgcgtctctgcggtcgctcgacttcccggcacttgtgtatggacgccatgcttgctggcgtagtgtcgtcccaccggacgatggccaagtccaagctcgggtcgacgctcggccacttgatccgatcttgtgcgcatgcatgttgccgcggccacatgtccggccggcgtacatgcaaaacaaacaaatccaattagattagcatcaaggagttagatatgtatatcgacacaatgatgcatattaaatccatccatccacttgtccaacgacatgcatgcatgccgatccatgcatggttgtagcgatcaatacatctcgtcgtgcggctgacacaccggcatctcgatcaccagcggtatatgcaaacaaaagcaataccggaacagatcaatctgtgaatagaaattaatctaataataaaaacagattggaacgacaaaccggtgatggaagagctgctgataacgtgttgtaaaccaacgcgcctattagcggatcaccggatccgttccctgtcccttccacagcagtagagacatgagatgatgtagaacacccgcgcccatcccgttgccatcaagaatattgcagaagtagacaatgaacgcagatataggatggagctctctcttcattatagatctcatctgtagtataagccagccattagccattagatgtcacaccctgcccctgtatatataggggtcttaggagaagatagatcttatctctactccggttcggattggcctacaagaaacttatctccaagagatttgtttcacaacaggacccacctatcatacctcctttccccttttcctctctttttctctctcttgggcaaaaggcatgcactgcagtgctggaacgggcagtggacgggcggcagcgcgcggggatggtcggctcggggatgggcgatggatggcggtgcgcggggatggtcggcgcggggatgggcgatgggtggcggtgcgtggggacggacagtgagcggcgacacgcatagcagcgcgcggacgtggagaggatgggggagggagagtggagatggatggggaaggggaggtcagcgcacatggtggcgtcaccgggatccgccatttg

SEQ ID NO: 47178 - DNA, 4783 bp, Oryza sativa
ccatcccttccacctcccagcgcgctgccgttcatgtcgtctgcctgcccgtccatgggcgccgccacccaccgcccctccccttccatctccatctcctccccttccccatcgacctctccctcccccatccctccacctccccgcacgtgaccgcgcacccgtccacgagcgccacaatgtgcccactgcctgttcccgtgccgactgcccgcccgtccccgcgtaccaccgtcggccaaccacccgtctccgtgccgccgtgcactccttgcaactaagagaaagagaaagagagaggaagaggggaagatgaggtatgacaggtgggtcccaacatttttttaaaaaaaaagaagtgctggttggattgccacacgcacaccacgtagggcaaaactattctagattgagccgagtgtggtaattcgtccagtattaaaagttcaaggttaaaatttggtcgaccgcgatagttctgcgagtaattcataatttttccttactagaaaaaaatacccgtgtgttgcaacaggtgaagactaatttaaacttattatttttatatggtttaattaagattaaattcacagtgggaattcgcttgtatatatatatatatatatatatatatatatatatatatatatatatatatatatatatatatatatatatatatatatatatatatatatatagaaaaccatgagctgcagttaagagcccgatcatctcaagttagcatgcgagtttttttaagagatttcttatacgactcctatatttccaaaagcgaacgaacttaaaaactgactcatataagaatatataaggatgacgatccaaagtaccggtaaaaacatctttaatttttataataaggatagatttaaatttagactaaaatattttcttatggaatgatgattcgcaggatcaggacaaaacgaggcatctcttctgttgtgctttcttggaaataaattccaatgattggccttgtgatgccatataattggattcgtcctttgtcatggtaaccgatatatagtactcccttcgtttccattctagcttattcattttgtgacgagtgggtaagcgttaattttggtagcaatggatgacaagacgagaagattgaaaaactatgcagaaattttgagagattgtcgattgataaaggaacacggcattggcatacatgaaggaacacggctcgttacaagatactttgttttgtttttttttttctaaaagatgtactacctttgtcttagacttagagtatagcaatctaaaattagacataactcaatccggtactacaaaactaaacaagtcacctgtccagatttataattctaggttaattctctattttagcttattatattctaggatgaagaaattagtatagttataaatccaagaaacatcctagcctccgccttcttaaaatatgtacatagctacattattacgagataggaacatttattcgacagaagaactaaatttcatggtaccattattacacggcttctatagattaattaatcaatacgtggatatatagggaactcgaggtattgcgtgcaaccaaagcttggacttccttcttaccgtgataccaaatacctctgtcatgtctagctcctcagatttgatgccgtcgggaagctcccaatcaaagtggtaaagaaggctagcaagagcaagctccatattagctaaacctagcgctataccaggacacatcctccgcccagctccaaacgggatgaactcaaagtccgcccctctaaaatcaactgtactattctcaaatctctctggcctaaatatctcgccatcgccccaatattcgccttccctgcctatcttccacacgttgacaaagaccttggtgccctttggcacatcatagcccatgacctggcacgtctcgcggcactccctggggatcaggagtggcgctggcgggtgtagccgtagggtctccttgatcaccagctgcaggtagctcagcttggcgacatcatcctcggttagcttgtcttgtcccttgaacgtctccctcacctctgattgcgccttccgcaagatccgcgggttcttcatcagctccgacatggtccagtctagcgtcgtcgacgacgtctcgctcccggccgagaagatgtcctgcagccatgagatcgaccagacacgcatcatatatcatgcatgatgcatgccgctgtcacgctaaaagattttctgtttgtacttgggatttattgcaattaagcaggtgttaattactggagtacggtgtgagatggcttacgaaaatgacggtgctgatgatctcggtggtgagtgcgaacttgaggccgccgctcctctgcagccggagaaggacgctgagcaggtcctcctcgtctcgctccggcggcggcgcgccgtcgcgatcgcggatgatgctctcggcgatgcggtagatgttcctctggcaacgcgccatgtcccgcgtggccgcgctgagccggcgcaccagccgtgaggacgggtacaggtcggccaagttgatcccgccggtgagccgcaccgccttgtcgagctcgtgcaggaactcgtcccggtggtcgcaccgcgcgccgaacgcggcgcgcaccacggagtcgttggtcatgcggcagatcctctcactgaggttgaagcaggcggcgccgccctcggcggaggcggcggagacggagcggaggagtcgccccacctcgtcctccctgacggggcggaaggagagcacgcggcggtggttgaagagctcgagcgcgcacaccttgcggagctcgcgccaccgctcggtgtagggcccgaagatgatgtccttgccgccgcagctgaggatgtcgatggtggcgctgaggtggcggccggcgaaggcggcgtcgtgcgccctcatgacctccgccgcggcctcggcggaggagacgaccagcgtgggcacggcgccgaggcggaggagcatgagggggccgtaggtcagggacagctcgcgcatggcccggtgcggcaggtcgccgtaccgtgacaggaggaggtggtgcaggctgccgatgagcggcagctgcgacggcccgggcggcagccgcagcgcactctccctgccggacggcgaggcatagcgggcgatgagctcgacgaggaagaagaaggatatcaaggccagaagcagcagtgtcgtcagctccattggtgctagtttgcaagtgagcgtgcagctgtactgacaaaagccagatcatattcatatgggtccctttatattggagcggtaggtggtcagtgatcattggatacaggatacttttacagtgacggagcttgagctaaatatgtgtgtggctagtgctaattgacacaggaatcactgatgttaaccaatatagcaaaatatctctcttgagctaaatatgtgtggggctagtactaaatttgcatatatcaaatactaatattttttaggttaattggattcataccattacaaatatgtcattttagataaatgccattactatggttgcgttcttctccctccttttccaactcacctctcttttttttccgcgcgcacatttttcaaacggctaaacgatgtatttttttaaaaaaaaattatatacgaaatttactttaaaaaaatatattaatctactccctctgttttttaatagataacgccgttgactttttctcatatgtttgaccattcgtcttattcaaaaaatttacgtaattataatttgtttttttatgagttgttttatcacttatagtactttaagtgtgatttatatattatacatttgcataaaatttttgaataagacgaatggtcaaacatgtaagaaaaagtcaacggcgtcatctattaaaaaacggaggtaatatttttttagaaaagagctaatacttaattacgtgcttatagagaaaggctattggcacatccatgtctcctaaaatcctgttgagagtacatccacatgggccgatattcgtgggcaccctatagtggatagaacgatgcacctataatttcaccatcatatgaccggtgcatctaattctattatttgaccatcatattagcggttcttctctaaattctaacactttcatcccgtagtgattcaagatactgtttgcttgcacgtattatatgacattaaccaaaaacagagtggtacaaaaagagtagatggatgcatagacgatagatgtatggctccgtgaaggccgtaaccaagtggcgtgaaaagaaaagttggatacacgtatctcctatcaccatacatatattttttaaggggaaactattttgatcccttaagaggatgtccccttgctatttacatcactactacaaaaacccttatagggactggccttataggtgccggttcatttataaccggcacctatgaaacttttcccacatccgcacattgaaaaatatacaaccgacacctttaaggattataggtgccggttcattagaaaaaccggcaccaatactatatgtaccggtttttaaaaagaaccgacacctataatatataataggtgccggttaattaaaaaaccggcacccataccaaaccgagccgaactgggcgagccgagccggcctcatctccggacttatctgcgcgtaggtccctgcttctcttccttatccgcgcatcttctcctccggccttatccacgcgcgagagagaagtctcga

SEQ ID NO: 47179 - DNA, 17153 bp, Oryza sativa
ccccttccagcacccgccgagtccccctctccatccgccctctctctctccggccggccgcttccctccccctccgtccccatctcctagccggcaagcagggacgcatggaccggcgcgcgacgaggaggagcacatccggtcccctctgcctctccctctccatcggcttcatcgaaggcggccagatctggagagggggaggtcggggtggtaggttggtggcagcgatgtccggcggcggcggtggccaagggaggtggcaagcggcctccccataggtgaccgggtgcagatccggtctccctcctcctctccctctccggtcggggcagcgacgtgcggcggcgacgtgcggcggcggccgtggccaagggaaatggcggtggcaacggaccccggctgtgattggcagcagcgcattgacgacgacggagtgagttcgtgcatttgcttctgttgttgatctgtgatttgtgattgattggattgttgttcactcgggacttgtgattgttgttgttgatcagtgatggattttgttgttgttgttgttgttgaccggattgaattgcatatgtgattgttgttgttaaccggggaattgcatctgtgatttgtgatggaatgcatctgcttgaatggtgtggctcaaaagcatcggctcagctcggcttggagccggcttcttcatttttttttttgaatctgggagagcacaaaggtgccagttctacaaccggcaccaatgacatagggtcattggtgccgaccaaaaggtgtcggccgggaaactggcacctattgccggttcccaaccggcacctataagggtttttgtactagtgcatgtcactcaaatggttatgaaaaaaatttgaggaggtgtattaacatgtgatatatcactccacaaacatgcaagttcaaattcaacttctatatctcgcaatggaaaaagaaattaaattaactatttgagtgacatgtaaacaacgggggacatctcgttgagaaattaaaatccacgccctttctgaagataatgacacacacagctcctcagttcttaggttatcaacagatcaatcgaactgacattttgcaggcaattattaaatagagtactacctccgtcccaaaatatagtattttttttggctatgaatctggacaattgctacattttaggacgaatgtagtacttaactcagtagtcaatcttcacacttggtacgtaggtattaggtactagtcagcagctagcacgaagtcttaaaataaatgaacaagaacatcacgagctagagaactacgattagaattgaacaacaagaaaagaacatataaccaacggtaggtcatcagtagatgccgtgcataagtcatgcgaaattatccctgctgagatatattgtagaattaattttattttcctagcgatcaaattatgcacgtagggccatggcgcgcgccccccacatgattatggacgaggtaacatccacgtgatctattatataatttataaaaacagcacgcgtggcctcgtgggaacaaagttaatttgattgctcttgttgcaggcacgaccaacaaaaatgaaattaaaaaaaaaaaactatgcgtgtctgctagactgctacatccaaaatatatgatgtaacaaacattatgaaaaaaaaaagagtgagtatagttgtcttcatgtatgtccgttgtgtatgctcacatgcgcattatcaatcaagaacaacccatgcattgatccactgggccaccaaaatgaagtatatgcatatactatctccctttttactacaaattgatctttcatcttattagaaaatatacatatttattattttattttattgtgacttgttttattattaaagatattttaagcataacttatactttatatattttcactaaatttttaaataagatgaatagacaaacgtcatgtctaaaagtcaatagcgttatatatttaaaaatggagaaagtattccctgtagtttttaaaaaatgatttttagaaacttgtataattttgttctcaaaattatctcattttgtaatgctctattcaaaacttgtttgcaataattgcattgttaggttgctatcaatgcttgttcatgatggcggcactgaacagttagttgtatgacctaatagcatcatcaagaaaatgagaataatccattcccaaaattttttattagattttctaaaatgaaaataggaattgaaaaaactcatccctctaagagaaaccctaaatttaattctcaaaaactaaaagtgagcccttctgttaaactaccaacagaaatctcccgttttccatcatccccgcaagaaaaaagatcgcgcgacccatcccatgcactcctcactaccctgacgctgtgtcgatctccctctcaagtgctacctggccccgaggccgatctccctcccacgtactccctgcccaatgccgatctccctcccacgcactccctagccaacaccaatctcccccggggatttttctcaactacaggtacttgtataggtcacaaggcaaatgttcagacattacaagtagatgatcaaatgaactcacaacattgactctttagcagtttgcctcatcatggtccaagtggcaagcaaagatggatgaagaaatataacattatatgtttcagttttaggactatattttttttactaagatttgtgctatttaatcaagttattgtgtagtaatacgttttagatggatgactctgtaacaatatacttgctacgtgcaatgacatgtgattcataataaagatttttcaataatgatttgtgacagcaacaagaaattatttcttaaactgtgtttgatgatgatactatcactgcggttactataatgaaaagtagtgttacagcttatcagaactcatgtgttaccagtgcaaaattatgtgttcctaggctatgcggcaacacatgttcttgtgttacaggagctaaaaatggtgttactagctaaaaagatggtaacaccttttcttagcagttgcaacatgaattatgtgctacaagggtcatactgtagtaacatggccaataggaatacatatcagtttgtgttactggagtcctcagtaacacgtttttgggcatgcagtagcgcaaagatgtgttaccagaaccctgttctgtagtggtgcaccatcccctgtcagctccccttcccctctatcccccgccactgttcttgctccacctctccctcccctcgctttgccacctctctctgcatgcactcaccatgctaaaaaaacaaggagacgagttgtcgaagcaatctcgtccagatgctactggatgatgagtcttcatcggatgatgaagaagaagaattttttttaggtggttcaaatagtgtactgtcagtacattgaagaatcgaagcgagacaggtctgtctttggacatgaggtgattgatagggaaagattggctggtcattggagattgtacaatgactactttttagaagaacctacataccttcatgttcattttagacgcaagtgtgtaatagtgaatagtatttttcttcaatcttgatttgaacagtgatgcatgtattaattcttattgctacttattgtgcaggtttagaataagaggacatctctatttacgcataatgaatgatgttgaagtgcatgatgattaatttgtgcagaaaagaaatggggctggtatccttgggctatcctatttgcaaaaggcaacaataatgtcgcgcatgttatgttatggaatagcaggagatgcagtggatgagtaggttcgtattggaggtaatatcattattgagaatcttaaaagatttgtcatagccgttgatgaagtttttggagaggagtacatgaggacaccaaatgagaatgatatagctaggttatttgcagttggagaaaaaagagtatttctagaaatgtgggttctttagattgcatgcactggagtggaaaaattgcctgactacgtggcacaattagtataaagggaaagagaaagttcctactttagaagtcgttgcctcacatggccgatggatttggcatgcgttttttttggtttacgtggaactcataatgatattaacgtgctccaaaggtcatcgttatttgcaaagctagctaaaaggcaggctcctaaactttattgtggtattaacgaacatgactatactatagggtattatcttgcatatggtatttatctttcataggcaacactcgtgaagagtattcagctgccacaaggcaataagagaaaatattttgctaaagcacaacagtccgttaggaaggacgttgaacaagcatttggggtgctgcaagctcgctttgctattgtccgtggactagctagtttttgggatgcagttgaagcatgtagatgtaggccctgtttgttaattctggtactccctccatcccaaaatataaccacttctagccctcagaatttgtcccaaatataacaacttctccaccaacattctcttcccaatcaatcatcaccctctaccattcacttttttccagcaacctccacttctcaaccaatcacaacctctccccatttaattcttcctactttcttaataatagtgtccaactctaaaacttcttatattttgggatggaggtagtaataatgacaagcgctaattgtggactaaagtgatataattgagttagaaccacatgatatacataccaagggtgattaccgcagattaaaattgatggtgcaaagcaatgggataaaggtggtaaatctagccttttattttaatcgatcgaggcattgggtgattgaatttttgctaggtttattattagctttgccgtactatcaaaaagggtaataactttactaaagaagtgatcaaaatgtcgcattatgtcatatgcataaggtcacttggtttgattatttgttccctccatcttttcaatctctagtcggtctgaccgtgggcagaccgacgggtcatggccggtccgactgggtgtttgtgagtcggttggatggtcacggtttggcgatccagaacagccaaagccaatgccggtctgaccgaagccacaggcggtctgatcggccggcccatggtggtctgaccagtgggtcttcggcggacaatggcttgtttctagcggttgccctagaggccggtttgaccggccaccccctagcggtctgaccggcagacatctgagagttggggttttgccctcaacgactagttttggtgagtggggggtatataaatactcccctaccaacagcgaggggacgctctaggaactctattcacttgcatagaccccttgcattcactctcacatcaattgagctcttgtttattcattgtggttgttagagagtagttttagcaaagacaagtacattgcatcattgattgagttagtgtgacacttgatcatctccgagccaggttgctacttattactcttggaggtagtcgcctcctagatagcttggaggagttgccctgtgacctctccgagaaggttgtggagaggtttagtgttggttctgagtggtttggagttcaccatcttgggagcgaagggagaactattctagtgatcgaggcttgggtagtctacttcgagaccagctcccaccttgcccaccccttgacgaaggggttcggtggttgttgtggttgttatagaccaattttgaccgtcaatatttctggaaataaaagagaactagcaatgcttgcatgcatatttaatcaagaataatatatttccacttgtacttggcaaagtatttgtatgcaagagatcttcatataaatggaggagaaatgatggaaaataacctttcagctcgacgtgtggcacacttatggatgaatgggcccacaaacccattagaacacctgtaaatgggcccaatcaccatgccactaagtttaggatccatcaagtgaagcaccagagaaagcacgggccagatgggccagcccagggttcggccgaaccgccaccggcgcttctgatcctggtcttccacgtggacatcccagatggcttcccaatgatggttgcggggcgtttaggacatttccaactttgacaaccgtcattggcagcctataaaaggacctctcccctctccatgtcaacacacacaaagaaggatcaagcaagaagctctctgtagtttatttactttgttttagtgcttgtggagtagaaatagaatagtttcttagttcttgaagtctttcggtgaattcggatatggctctagtagcttctctctcttgtaagactttattcaataataaaatattcttctctatatagttttggtcctttactttacttatataattatttgagtaccaactttagttcatacttgactcgtcataattatgtagctagcttattgaagatatgcaatggtattagttggtgttcatttatatgattgctctatgtcatctgcaaagatgtggagtactatttagtaatataaatgcggtgcttagattattagataccattaaatggtgctatatgccacatatctgtagaggtaggccgctgatggtgacagttcagtacgtgtattcctccacgtgcttatatagggctaagagaattttctagtgtgggtactcctccatatccattaccggttggatggccatgatggattatcgtaaagaactcgacaatcaagggttgtttctctatataccaagagagcatagttagagggtattggctgcataattgtaccatagcaaatgtagactaaaatgactatatactagaagtacagaaaatgatgcttttcttattctttctccacttagcttagattattattttagtgagaatattctggttagtttcttctatgtgtcaacctatcttacccttgaattgattaacccctgcattagactttgatctatacatgtgatgtaaatattagcatggtactctcttataatatattccctttggtttgaataaatacgataccttggaatacttccgggtgaaatgctaatatttcaagcgtcattgctgagaattatttctttctccacttaacttagattattattttagtgagaatattctggttagtttcttctgtgtgtcaacctatcttacccttgaattgattaacccctgcattagactttgatctatacatgtgatgtaaatattagcatggtactctcttatcatatattccctttggtttgaataaatatgataccttggaatacttccgggtgaaatgctacagcggtatatctatgcgcttgcggtttatatttgtaaccgtaagaatactgagtaatatttcaagcgtcattgttgagaattatatttctagtaaggcaaattttgctacaggacatcgcgacttcgtggttttagctgtaggataccgcgcgaagtcacttttaaggaaacacactcacaaaagttggatatttgctggtggacaccacacccattaaaataataattttctgttggagaagagagagaaatcatgtgaaatgtcagaaatacccctggccccacatgtcagctctccatctctcttctatctgtcctctcttcctcactgcttggatgtagagccggtgcggcgtatgctcccacggcatcaagaccggcattgccgcggtgttcacagcggagtgcaaggcgacgacgagtaggagagggacaacagcgatttcttgggcggtggaggtcggtggatccaacgacaagagagagagcgagaggattcgatcatttgagagaagagtgaaagatggcggcgatggaggaagaagacgatggaaatgagagagagagagagatgacaaatgtggtctgccggggagcccacgcctcctctgcggctgccgagcaggccgcttgctcgccctccggcctcggcacgccacccgccgcttccacatcactgccggcttgggagagatagagagaggaagatataaggggcaatttggtcaagccgtgtaaaaaagtggaccctctctcgcctagttagcacgaaaacattaatttaatggatggagtatcccctagcaaataaccacatttatagagtgggttcccccaaaagtgacttcgcgcggtgtcctacagctaaaaccatgaagtcgcgatgtcctgtaccaaaatcaaccgtgtctttgtggtttgagcggtgaagtttggtttgcctcaacggggattacgaaagcagtgaagtttaggagcagaagagggagattgttggaccatatttttggactagaataacaaaaaatatggattgggagtggattagaggcactgctggtgatgttctacaagcatatccagtagatgtgccatatgcccatagctaaatttaggcaacgaggacaaaaactagctccagtagatgcacaaaggttttgcaaaataaaaaacagaaccgaaaattcgattagtactttgaaccaaccaaatttattctggaataacgaagtaacctagaagacttaattttattataaagcccaaaagaaggcagtataagcccacgaaatccctaacctatccccctcctcactcagttcacaaactcatcacgcactcatgctcccctcctccccctgatcggcaaggcaatggctgctgtcgaagggtaaactcctcgagcgggggactgtgagggcccctttttggttcggaccaggggtgcgggtgaaggcttgagagatgaagggaaggtgatgcagaggcatagttattaagaccagaccagtaatcaaaccggtgaggctcttggttaaatggttcactggttcaaccgggtgaataggtggtctaacccggttcaatacttatcaaatatattaatcattctattaaaacacaagaggcaaggtagcctggtggttgagagagcactttcccttcctatcccacgcataattttccctcatttttcccccacctgcacgcgcacttccccttcctatcccacgcatagttattgaaccggcaaggccctcggttcactggtttgattggtcgcaccgttggttcaaagcggtttaatagtttaaatatataactgattcagttcattcaaaacgacaagcatggcctggtggttggtgcgctgtgctttcaatcaacccatcgtgggttctcgagtcccacccaacacctttattaccctatattttctccaactatcccccgcatgcacgtgccctctgagatagcagcggttcagtgccgatttattaaccggttttaggcggttttcacaaaaaaccgggcggtccagccggtttttaccggttcaatcgcacaagcggtcttttaactggaccagaccgatcctacgcagctgtcggagaatgaactcctccaccagggaaccgtgaggcccccctttgtaagttcggccgggggcagcaggtgagattcgagggcttggtgagcgaagctgtgtgatcttgagggggttcaatcccccaaagacgatgagacaaaaggggtttatataggttcgggccactaagtgtaacaccctactcctgtgcttgattgattgagtgtagaacataagtgcttggggttgcgagacccaagcgccagttcgctcggaagtccccccctttctcactaggcctggacctccttttatacctcaaggggttaccacataggcccaacaacctaacttcgtcgagaagtattacaatctttgcattaaatacatgtcttgttccttgacgtggaagccgcatacacgtcgcctcggtcgtggggcctaccaaaccatgccgcctgacacgggggatgcccatgtcattcaccatttaatgggtgaagatttctgggctcctattacaccgggaaacgggagcctagctttgaccggagtgggaggaccgactccggctaggataagaggatgagaacctctcaccatcattatttgatgagacatgtcaggttgcacgctgcctgacacacgagcaacgcacaggcgcactagccagtcccatcggtcattcgaccggtgacagaccggttgagtacactgcacgccgcattaaatgcggcgtggcgcgaccgctcgggtcgccataaatgtgggtaggtgggcacctgtaggcggacacctaacccaacgtacatggtgacctagagagggggtcgggggagcccaacccctagtcacgggagggagcggtcgccgcccgacctcgggcccgatccccccgcgggggagggccacgtggctcctggggcagccttctccctctagtcttggccagggagtggccgccaccctacctcgggctcgatccccctcgggggagggccacgtagcattggggggcagcctcctctgtccaatctctgggatggagtggtcgccgccctacctcgggcccgactcccctcggggagggccacgtggcattggggggcagcctcttccgactagtctttgggaaggagtggccaccaccccacctcgggcctgactccccttgggggaggccacgtggcatcggggggcagcctcctccgactagtctttgggaaggagtggccgccaccccacctcgggcctgacttcccttgggggagggccacgtggcattgggggaagcctcctccctctaaaaatgatacccctgggcccatatcaccgatagtagcacccggcgttagccctgaccaaaacctttcccaggtggtcagggttgacgccaatctgctagtcagttgacatgtgggcccgatcttctgtcctatcattctgggagttgggcggtgggagtttagtcacgttcaaacgtcgccttaacttcccactttcctcccggtttccgaggcgttgtgggctcgggagtttagcccgtaccttaggccgtgaacttatttcctgtatatagttagcaaacgttgttagattctctcgggcctgtgaccttacgccgtgtaccttgcttgcccctgccttttgttaacctctgttcgtgttctacttcatctattcaaacgattattttggcgtgagcgtgaggactgaactttccatagccagcaatcttcacccgcgatcaagccaagctaggcactgtagccagccggcggggctagagccaaccactacggaagagccagcacagggggccccgggcgtcgacggcgcccagagcttgacgcagggctaggagagagctaggaatcgtagcccccgcactttaagcaaagaatagtttgaatggttgaaacgaatacaaactttttgttaccaagggaggcaagccagcgcgcgacacgtgggtaccgcgggaccgcgaggaagagatgggtgagagataaatataagcaataataattctatgcaaacgattaccttcgcgtgagtgcgaggactaaattttccatagccaacaatcttcacccatgatcaagccaagctgggcgctgtagccagccggcggggccaaagccaaccgctacggaagagccagcacagggggccccagacgtcgacggtgcccagagctcgacgcagggctaggatagagctaggaatcgtagcctccgcactttaagcgaagaatcgtttgaatgaatgaagcaaacacaaaccttgcttgcatgtcgcgacctttcaaacctttagctcgaagagggcctcccaccatgggttcctaaccattttgggaagcctgcgaccacttagcaaatgaggtgaggttcccacgagcctgtgtcctcacgctacacattctgtttgctctttcctttcggtggcttccttccaatatctctcccttctacatcgacgactactttcgcacgagtgtgagagccaaaaaaactctagagccagcgatccccatccatagttgagccaagccgggcaccgtagctagccatcgggaccaaagctagctgctacggaagagccagcacagggggtcccgggcttcgacggcacccggcgctcaatttaaggccggaatagggctagaaaacttagcccccacacttagcgaggaaacgttcatgtagatgggagagaggttgggctcttaccaccgagggagcaaacaaatgcgtaacacgcgagcgtcgcaaggccatgagaaaagaacggggggaaaataaatataagacttcaagctgtactaagctgatgaattgaaaaattgaaaaatacttgaagcttgaaaggacgattagttgagccgggccgggcaccgtagcctgccggtgggaccaaagctagccgctacggaagagccggcatagggggtcccgggcttcgatggcacccggagctcaactacaagagtcctcccaggagtagaccgaggcaggtggcaggttcataagcgatccccgtgcttggccctggagggccatggggaagaaattcgccttgacccggtcgtcaccccacgccacctctaagatcgtcgtgtggatttggagggactcggaggggttgacgcttccgtggtacctttcggtgaggccggtgaagatgtggggggactagccccctgcctggggtggcgcggctctcctgaggaggctgcgccttcccccacattggcggtgcgacgctcgtcacgccggcgctcaaaagaacctcaaaaatcacgaacgcgccccctacctggcgcggcagatggcggggaatgaactcctccaccagggaaccgtgaggcccccctttgtgagttcggccaggggtagcgggtgagattcgagggcttggtgagcgaagctgtgtgatcttgagggggttcaatcccccaaagacgatgagacaaaaggggtttatacaggttcgggccgctaagaagcgtaacaccctactcctgtgcttgattgattgagcgtagaacacaaatgcttggggttgcgagacccaagcgccagttcgctcggaagtccccccccccctttctcactaggcctagacttccttttatacctcaaggggttactacataggcccaacaacctaacttcgtcgagaagtattacaatctttgcattaaatgcatttcttgttccttgacgtggaagccgcatacacgtcgcctcggtcgtggggcctaccaaaccatgccgcctgacatggggggcgcccatgtcatttactatttaatgggtgaagacttctgagctcctattacaccgggaaataggagcctagctttgaccggagcgggaggaccgactccggctggggtaagaggatgagaacctctcaccatcattatttgatgggacatgttaggctgcacgccgcctgacacacgagcaacgcacaggcgcactagccagtcccatcggtcattcgaccggtgacagaccggttgagtacactacacgccgcattaaatgcggcgtggcgtgacctttcgggtcatcataaatgcaggtaggtgggcacctgtaggcggacacctaacccaccgtacgtggtgacctagagagggggtcgggggagcccaacccctagtcacgggagggggcggtcgccgcccgacctcgggcccaatcccccctcggcggagggccaagtggcgcctggggcagccttctccctctattctcggccagggagtggccgccgccctacctcgggctcgacccccctcgggggagggccacgtggcattggggggcaggctcctccgtccaatctctgggagggagtggccgcctccctacctcgggcccgactcccctcggggagggccacgtggcattggggggcagcctcctctgactagtctttgggaaggagtggccgcccccccacctcgggcctgactccccttgggggagggccacgtggcatcggggggcagcctcctccgactagtctttaggaaggagtggccgccaccccacctcgggcctgactccccttaggggagggccacgtggcatcgggggcagcctcctccctctaaacatgatacccccgggcccatatcaccgacagcagcagccacgcaacccgctatttcttcagaactggacggtctaaccggttcacagcagggtcgattgcatgctggtcttttacctagaccggcaagggctctggttagttttttccggtccaaccgccagtccagtcttttttccagtccgaccgccaatccggtccggttttaataactatgtgcagagggggtcgggcccctcggaagcaatggggacgcaatcggtttatacaggttttggccgctgtggaagcgtaataccctactcttgtgtgtggttggttctggtgggaggatacaagtgtttttttctcttcggatccctctccccctgttgacggtcattagcgattagtttcgacctcagtgttaccaaaatagagaactagttatgcttgcaatatccatgttagaataataatattcctctagcatttggatcactaaccttttgcaaagaataaccataaaatggagaggaatctacatcaaaccagacaataaatcaatctgacgatgtcgaggatcagacttatgtatgaatgggccaagaactcagaaatgacacgaccaattggaccaaaattcacaagtctatagagaggagaagtccaggaggccgccaaccaaaaatgtgctggattggaccagcccatggttcggccgaactaaggggttcggccgaacccccatctgctccgttggatgcagggtttggcgtggacgtccaggattgctctccaatgacggttagagagcatttccgaccattccaactgccataaccgtcattgggaggctatgaaaggacttggcacaatcatatgcctttgtgagaaattatacactttgagtgatcgagagaatcaattgaggagcaaagcaaagttataatttcatgaaaagtaagggcgacttgagtcaagattgttccatttctcaattccccaagatcgcatggtagacactacaaagacccacaagtatagatatgactttgaataatttgtttgcataattataaggaagtcataaaccttttgtagagtccatagccttcactcgggacgagcaaatgttaagtgtggggatgttgttgatgatccttaaatcgtaatatttgaccgtcaatacatgcatataattaaataaaatatggtatctaacttagtggtagggattattactaatcaattccactagtgttggtaaaatatgtgtatgtaggtattttaaggagaaaacacacccggcatgtgaggaaacacacctccggccaatcagacacaagcacatagattggagggcccacaagtcaggtggaaccaccatggaatgagtcataactgtcataaccgccatcagggcccaccagtcagtgtccctgtcaaaggagaggccaggaggtggggcccaccatgggttcggccgaaccaccacagcctcctctcatcctgaccttcgacgtgtacgctccggttgaagtctcaatgatggttggagggcatttaggacatttcccatagctgtaaccgtcatatgaaggctataaataaagctcctctccctcacttcactcacacacaactttgagctaaattacaagaggctctattgtatcttttgtacattagaattaggtagatagtgaggagaagctctggaggagtgcctggaagtttggcgctcatccgacttctacctcgacgagtgtagctctctaggaggaattctggaggagtaccgaagctgtcggtacactctgctccgggttcggagaacttcttctattaagtaagcattcgagatcctttctcttgttatttaattacttagtctgagtaatacaaatttctatctttgcgggttcattgtttagtattcatactaagtgctctagtactatgactctggataaagaaggaagttcctgtataagtattagactagtaattaataacatagacgtggtgtcttggttagatattacctttgtttgttgtgtatcccacggatttgtcagaggtaggctgcaggtgatgacagccctgaatcccttcctagtaatcctcaacattcgaatacatcatggagctatagccggaaccacgctggcagaccagcaggggtcggtgcccgaaacaacagatagaaaactacctttgcttagcttagataattaaaatacatagaaaatcctctctagcctgcctagcctacctatagctgttgtccttggatcatcttagccttagatagattgtacacattttctgagttcgatatccttttggggtcacccgaaggtgaagtgttacagcggtattccgtgcgcttgcggatttatctgtggtcgtaagaaataccaacattgccgccacctgtcgccgccgatgctcctcctcaccggtgtccacgccgcctgccgccgccgcttgcccgctgtgccacccaccccccgccgccagcttcccgttgactaggattgttgaccctacatttttttcccacttacatgtgggtcctaaaaatttaatttttaatttttgcttactagtatgccatgtcagcaaaactaggcaaaaaaatactaccataagacctcctttgaacggtttgtgtgagtttagaggtagacatttctggttttgtggttaaaggaccttaaaaaaaactcgctgttaagttgagagacctctggtgaacttattccaaataataaagctcatataagcaaaaaaaaaaaaaaaaaaaacaagcccaaccaagaagcggcccgctaaactgcatgtttctccaatctattggactccgacgatgttctgtaggagttgagtaggaccatgcgtcgactcaagtggcagtaggtggggccgcgggtggctgctcgctcgtgcgcaccggccgcccccacctccaaccatggcgtcatcctcttcctcctcctcctcctcctccccctcttcccccttctctcccttcgcgcaaccaccacccaccaccc

SEQ ID NO: 47180 - DNA, 3131 bp, Oryza sativa
cccgcggcaacagttccagtccctccgcgcccccaccaagccccccttccacttcccccacctcctcctcccctcccgctcctcctcccgccgctgctgctgcgtccccgtccccgcccccggggcgaggtcccgcggcctgcccgctcccgtatccgcctccgcgctgcccctgcgggtgacgcctccgcccggggtggaggtggagggtggcgtggggagggcggtggcggcggcggcggcggtgaggagggtcgcggtggcgctggcgtgcggcgcgcttgcggcggcatggtgccaccgggcgctcgcggtggcgggggcggcgggagccgcaggggcatctggggcggtggaggcggcggctgggtttggcgggatggcactgcgtggtggctggccgagggtgctgcagattctgcagctgcttagagagcaggggattattctcgctgtgttgcttggcctctcggcgtttttctccatggctgagacttccatcaccacgctatggccttggaaggtgcgtctaccaactatcaagtgccatgatacaaatttgttacacaatgtctaattgttgcgtaacatcacttcactggttgaaaatttgttacacaatgtctaattgttgcgtaacatcacttcactggttgatggttgtaacataagtctagctagatcagtgattgtgcgcaactgggcatgatgatgaaaatgatagtatttggggtttaattttaaaatttccatggtgaattgagccatttaggtaggaaggacacgagtttacatgaggaaggtggaagccgtataaaaacatctctgatgttggttttgagtgttgacgggtgggtactaggccattaggcattactcaacaaagggagattatgtgcatcagatgaacagtttgtgcaggggcttagttgcttcctgtgctggtgttgttgcatgatcctgagctggtactgaccctgtaaatatttaccagctcccaaagtttcttttgatgtatttatggtttgaaagaaatacatacagtacacaccatactaacatatgcactacttcaaactggatgcatgcactgatacccctgtaattgtcaggggaatgtgcactgtcacagtgtcactgactgcccatgctaattcttattattttctttgtcccaacaaacaattagtgttcatccagtggtaggtcaagttatttgcacattttaagtttagtgcggctttatcttcattcttcaggatcatgatttaagctctaggttcaggtttagtaggtaataacattaatttaacattgagttttaagcttctgtaataatttagttgttacaatttggtctttgtgtcatcgtctcccaaatcagcatgctttggatggacaaaatttaattgaatccattagcaaggcatatgaccatactattgagtccatagtttcatgtgtgcatctctgctgggattatagtttgacataacatcttttgttgttccatggcaaatgcataagtccccaccttgtttatcatccattaaaccctgttggttgatggtagtccttttcatgtctaaacaattgatgcttagatttggttttctgttccactaggttcgtgagttggctgaaaaggaacctgaaaatggtgttttcagaatgctccgaagtgatgttactcgcttcctgacaaccatactcattggcacaacgtaatttattaaacctatgtgttctgccatgtttattatattttttttctataatccatattatgtcattgagttcaatccatacccacaatatgccactcactgtgagacaaacttttggccttttgggtcttggaaccacacatttggagatgccagtggtgtattgtggacattgagtgtaattcagtggcataaattggatccctccttattattttcttcctcacactggaatacttctgtatgaaagtgtggtcaacattggcgcaacagcaattgttactgaggcggcaactgcaatgtttggtgaagcaggtgtcagtgcagcaacaggcgtcatgactgtatgtcgtctcttttgcactgatctactcataataaaaaatgttctcttatgtttatatgacgtctaactgtggagccccaccttttttcaggtcgccatcttacttcttacagaaatcacacccaaaagtgttgcagttcataatgctacagaggttgctaggtttgttgtaaggtgagacagatgtaagcaggacttagtttcaaatatttgttgaaatagcctgcttgttaatacgatgtttaatgctgtatatctattgtaatgtatcagaccagttgcatggctttcattggtcctgtatccagttgggcgaattgtcacttttctgtccatggggatgctacagattctaggcctgaagggaagaaggtaggcatacataatactggcatttaatgtatattttctgcttgtgtagcattgttaattgttgttcttgattaactgagtaaccaaaactttaaaaatatgagtagcgtgtccttcataaacaactccaacaggttacaaaaagcttcttccttcatattttgctattggtgttaaaggtaactaggcagggatgtgaacggcatgggtggttccacaaaatatgcaccaatataaaaagccaagtcgatcaaactcatgtacaacaaggattcaaatatggattaaccgaataggtggttatcagttatcgtaagtattggatatttatatactatatacacaactatcactatgatggatttggattcaactgtatattttgaacctaatatctgtatgtgtattgttgtgcaatttaaacatgttcagaactcgaggtgtgaagatttttaaataatcatcagattttttttaaaaaaaattggtagggtagagttgataatttgtgtttggattggcgccaataagaaacaaatttatgggtaatgctgaaacatttggtagggcaaacttttgaggggatgtttggtacggttgcaaaccaaaatggacgtacattttttaaggacacggaattctgtgtgttttacacaattttttttttcagtgaaccatatgttact

SEQ ID NO: 47181 - DNA, 4521 bp, Oryza sativa
  unsure (1)..(4521): unsure at all n locations
caataaatgttctcattatctattattatttcttctattgaaatgctccgaaagaacgcttcaaaaagtaaagttagatgaacacaaagatataggtgcaatatgttttctgtatttctgtattgtactattcagaatttctgatccatccctgcttgtactgaactcttagctagttattcttgatcagctaaattcaatgagtgacatttgtaacaggatatgatcgagaatgtactagagataaaagatacacacgtcagggaggtaatgacgcctctggtggatgtagttgcaattgatgctaccgcaacactgattgatttcaaaaacttatgggaaactcatcagtactctaggtatctcagctgtgaacttttagtatgcatcttcaattcttgttgttgacatgtgcagctcttacttccagagttccagtgtttgaggaacgcatagataatattgttggaattgcttacgccatggatatgcttgagtatgttgaagaggtctgtctcttgtttaccatttgaatttttaaagtagaaaaggatgagtaggtgactcttatttgttcggattaaggattttctgaagaaagatgcattttgatttgaaggttgagaagttgaaggagattactgtgaaggaaattgcacatatgcccacatactttgttccaggtaaactttcacgaatgatactcattacaaaaatgtccattgataaatctaaaggcagatacagaacattacaagtatttgagtactgtcctttttcagcatccatctaacctatttattttctatttcaatggattttttcaaatccagatttgtgtagggcattgcattctttatgtcttaatgtttcctctggtccacatgtcattatgtaaaaatgtgatattttgtcttgacagattcaatgtctgtttggaacttgctaagagagtttcgcatcaggcaggttcatatggcagtggtcctcaacgaatatggtgggactattggtgtaagattttattaaccaatcctttgttccttgtactttctcaaaatagaattgactttctacttatagttcttattattgattccatttatcattggttatttgaaggggatcttttaattcatatttggtcaaataactggaaattcaatatttttagctcaacttagacacctttgctctttcatggtttgttgttcgataggaaaatcattttgttctctccaatctgcacagttcagtttcacctggtttctctgaaatataaaaataaagattgttttctcttttgttttgaacaaaacaccccagaggagtcctctgctgttatatgaagatcttttttttgttttgcttcacgaatttgttatattataactaatgattagatgttccaaactagagtagtatccaaaccaagaaagcaagaataaaatggactgtagtattcacaatctagctgacaaggcaagaataaacaaaatgagggtgtaacagggatgaaccaacctgattgcagaaagagggcaggttctggtttacgtgacagtaactgcctgactgtagttggttttatgaaccttgcttgccagcattttgatgggacagtgagtggtctgtatattcggaaccgcagatgtgtggcaatatttggagggaggattgacaattttccacactcatctttggcaattgaggattttccactacatatatccttgtcccacatgtcatatcagtggcaaattctcaattgccaactatcaggagtggcagagccttgtatcccaatattattgacattatttttaggttgtgttatatatccatagtttattgtcaatttttatatgcaaatacctcttgcaagttgtagggtcaaacgtgtttactctttacaacgatctgaaatcaaaatcattaaacatctttacagcacaaatacattcagcaactattactctatattgtacttgttgggaattaaacatgccttctggatgaaactcagttttattgtaaggtttcctatttcattaaataattattcacactcttgcaccagctttgtcctatgttctgtgaataatcagaaacagcttctgttcattacttatcccatgcatctcttactttcggaagtctctctgactagtgactactgctaaaaaattgcagattgtaacattagaagatgttgtggaagaaatagttggagaaatcttcgatgagaatgattcaaaggttggctatttcagtggtccttttgatttaaattttacaattcagagtctaatgccatttaccacacgctgtatggaagtgatatttgatttctgcttttcttttctctgatcacactaatccctccatctgtgtagcaaatcaaatgctaatcatcttgtataaggatttcatgagagaaagaaaacttaagcacacgtgctattatgactttgtgaacattcttataatcactgcagtagtacaactttcaagctcttagtatttatgtgtttgcattgtcttaagagttagtgtgttccataattagccttattaattagatcctggtcagttacatcccggtttgatggaaatcatccagcaactatctagtgccaattcttataattaatactacctccatcccaaaatgtttctatttctagcacagtacattgtcccaaaatgaatctatttctccacctacctcctcaaccaatcacaaccattctccttcacctactttctcttttcaaccaatcacaacctttcttcaatcattcccacctactttcctaatgcttgtgccaatctaaacaatgcttacattttgggatggaggaagtactatgtaatggtgggaatcaactggcatcatgaagaatcattctgaattaacataactcaagagtatcataaaaacttggcattgaagttgtcaaactggcagggatgaagtgctctgcctctgctactgtttgagctataactgcctgattcttgccagttctcttagttttaagtcataacaacatattgcatttagtagaccatgatccattttgctactcttttgcttaagtagacagttgtacccatttccttatgctactatgtttttacctttgcaggaggaaatccagaagaaaacaggttatatagtgatgctggatgacggaacatttgacgttgatgcaaatacatcaatagaccacctatctgaagaacttggtgttaaaataccagaggtgttatttcttgtttggtctttgctttttctacagttgctgtttacttctacagtcactataagtgttattttggacattgccatggcaatcaaattggaatcttggtcaccaacatatcttgaaaatctagcaaaaaatattatattttattttccaaggcaaaatcatttatatgatcgttataaataatattcaaataatttaactaaatgttcccatggtgacacatttctcactggagttaactatatgtgctccaagggtaaataaatgcattttccacatatcatatgcaacttgatatattcgaatcagttcatcccatatttccatatgtaaggcctatctcctgtggctgttccttcttattcttgaatatgaaatcctgttaatcattataatatcaatttcaagagttatcttgaacacatcaagtttgtctcgagctaattcctgaggattgagtgcttcttcatttacttaacagagctgattgagtgctttgagatttcttctgaattgtcaataacacatcttgctaggtgttagctttagaatgatatatgccacttggcttatattaagcatagttttcttaagtggaatgtgctactgcaatcaccatatgctggatatgaggttcacttggaatttggaaatgcatttgtttgcagggtcatcagtatgagacggtgtctggttttgtctgtgaatcctttggttatataccagaagaaggtgggaaaatgctagttatactcgaaaaggataacagagaagaaaatgatgaatataaagaagaaggatctgataaccaagatgataaagaaagaactcaggcttatgaacttgaggtaagtggtacaatcctctgtttacaatttgtttgcagcagggtcagacactaggtctctagtagagatgtatattagctagtgtttctaagatcattctagattttttttttttgccaacaccatcctggattatgtttgccaagtcctccgactagaaacaatgatgaataatcgctatatacacccctagggtctttacttcctacatgatttaaaatgattgttggtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47182 - DNA, 5826 bp, Oryza sativa
ccgcttagctgtagcaagtggcaagtagcaacccttatctctgtctgcgcataatttctcaagaattctcaatccacatttgtacagcaatgactgttgaaactcgattttatttttcttccaaagcaaacacttgcggataaatagtcccatcggtttgtctgtagccgtaacgtttattagcgacaacaaattatgtgcgaaaaacttttatatacaacctccttataatagatgacgccgttgatttttaatatttgttttattctaaaatttatttaattataatttattttgttgtgagttgttttatcattcaaagtactttaaacatgaattatatcttatatatttgcataaattttttgaatgaaacgaatgctcaaacatatgttttaaagttaacggtatcatctattaaaagacggagggtgtaagtgtttttaacgacttaaaagtcaaatataaaaaataatcaacaataaaaaaccattaaaaacaactctaacaatctagatttaaaacttaggccccctttgattcaaaggcaaattcataggaattttagaggattttattcctataggaatttttcctagaaagccctttgaatcaaaggaataaacactatggaatcctatgaaattgctatggaatgcctcttcccatacaagttttggaggaattttgaacctcatggaagaaatccgaagaaatcctttgagtctcgtcgaaacatgaattcggcaataataaaaggggtagtgcacgagacctaaaagtggatggatgcagagacaaaggattagacaggttcaggccctctcgatgagaggtaataccctattcctgtttgaggattttaatccgccgggtgtattatagatctgacgagatctagttgtctcatgccccctagagggcctcctgcccaccttatataggatgtggggcaggattacaagatagaaaccttaaccaatacggtatcggtttcctaaatctattttacaatattatcaaatcaggactttaggccgctccataatataaaaggaaacgtaatacccaagtcatgatctgttacatattctacagatataagctatcccctatgactagtcgataaccatgccgtgtgggtatggggtacccataatctccatagtagcccctgagaccttcacagtcggaaagataatcttctctcgaactagattactccaaagccgagtgcttcaatcatcttcgccatgatctcccgagtacttttaccaaatatgaagactgtggagggctgaaaaataaagtcaggtgcatcgaatagatgcacctaataggtgtagcccccgactatgtggttagctgaacaaactaagcatatagtcaaggaataaataatccaaccaactgagtggtttttgacaattatagtcaaccaggtgacttgataccaatatatagcatatgcggtatgaatccccgaataatatgatccaggtgatataccgactgctttggagaatatgatgcgtgcaacctaaagttgacaacatctttgaaaattcacatagcaaaatagctataaagaagagcttgatgttgtgaataaagaaattttcaaagtattgggcatacaccatgcgcacactgctttaacagatgtgcttaagtccctaaaagacatatggtttcaccacacctggaaatatatggcatatgtggtgtaacatccgagtaaataaactcataaggatttatcaaccgtctggaaaatgaccaaaatatataatcagcctaagccataatattggtcaataaaaatgcacacttacgtggcaaaaaacaatgatattgtatttaatcaatcgctttataaacccaaacaatgccttgactatatataaaaaagcagtgaggcagctatgaaaaacttcactgttgggcaccttttaaaatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcggcaccctttaaaggatgacgcatgtaacatgctcccgagtaataaatcttccgggtgatatagaccaagtgtagctcatatgaatagcttatggtctgagtgattatcccttatgggatactccaaaatagatataataattgaatcccgactggcgcaagtattcggttgatagcccttacggggaataataaatagtccagtctttgagcatagaaaaatagactcatgactatgaatccatattgaatgtatccggaacaagtccaaattggagatataatcctcacgcttgagttgatgagcccctgagcatatagcttgtccttctgtcatagtcaaaattgtccattggcaatagctgatgcagtcgatatgaaagcaagatgactaatatggagatgaacccatcaaagctgatgaagatgttgatggtggtaaagacaatgataccaatcaaaggtgatgaagtcgcatagccgtggatgcgaagaaaccagtcggcagcagacaagtcagccagcagtgaagatgaaggtgtccaacaacagcgacaaaatcgtgcagccatggtggcgaaataatcagtcggtgacagacgagccaatagtcggtgacgatgagaacaagccaatgatgaagatgtagacgcgcatcaacgacgatggcgaaatcctccaatcatgaaaatacaggaaacaatcgacgacaacaaatgcaaccggtggtaatgacgattggcagcaatagagatgatcaaatatgatgacgaagttgcccatcaatagcagtgtagcagccaatgataacgatgaagccctctattggcagttgcatagtaggcccaccgtgaagatgaaataacaagtcggtgataacaaaagcaaccgaaggcgaagacgtagtcaccccttagcaacggtggagacgtcagggccgatgaagcagaggtgttggtgatgatgtcagtgataataatccatcaaactgttgagaagatatcaaagctcgagtaatttccttgatgcgaagattgatgcaacgccctttgatttgtaaagatggcaatagaacttggtgctatagctgttgcagatgcttcacttggaggaaagtagatgttgttgaccaactcgtcgaatctgagttgattggttgataactctaaactcccggacatgtagattaaatctcaaacttgagaaatttggagtagattgtggcggcatgaagaagccaaaattgtcggtgtaataattggagtcgctgaaattaaatgtcggttctgaagcgaagatgaagataatgactccccgagttgactcgttgattgattgattgcttcatcttgacataaagcttgtcgaattttgagagtcttttatttgtgtagcccccgactctttggttagttgagaaacaactgaacatagagtcgagaactgtagcttgtcgtcgagtggccatcacttgagtgaagatacatgttgaagatgtccgagtagaaatcggtgccgaagacaatgaagatgaagtagctccaccatggtaacaaagttgcatagccgtgatgaagtgaacacgagtcggcggcaacggaagcaaaccggtagcgaagacgcgtagttgtgaagataaaaacatcagtcggcggcgacttaaccagtcgacgacggaagacgatgacgtccatcaatagtggtagcggtataaaccagacgtagaggcgagtgcactagtcagctgcagacgagatgaccgacggtgaagacgataaggccaatcaacactagcaaaatcatgcagccatggaagtgaagaaaccagtcggcagcagatgtagcagcttgtgttgaagatgatgacgcttattagcgatggcggcgacgtggccagccgtgaagacgatagcgccaattggcgtcatacgaagcggccggtcggtgaagatgtagacgtccaacaacggcagcataataggtcagtcgtgcagcggagacaccagtcggcggcggacaaggcggccggttggtgaaggtgtagacgcccaacaacagcggcatagtaggccagccgtgcaagcggagacaccagttggcggcggcgaaggcaagccggtcggtgaagacgtagatgcccaacaacggcggtgtgaccacctgaccgtataagcgaggataccagtcggcggtggacaaggcggccggttggtgaaggtgtagacgcccaacaacaacggtgtgaccacccaaccgtataggcgaggacaccagtcagcggcgatgacaacaagccgatggtgatgttctgactgatccattcctagagcgtaagagataagcttatagccatgaatcccttttatgcatatctggatctggatcctacagaacaaacatataggatgagtagtatctgatgtaaatacagtacttgagaaaaattcaagtattttaaaatatttataaatatgtatttctcctcttgtcaattttgatttccccgagcagatgactctgtacgtttaaacactctgtccgactagttatagccctcaagcatcgggagtcggcttaggcacttcccaaacatgcatatgagtgacatgagttcgtcatttatggaacaaagtttcacgaatcagaatttactactcgggtacttttacaattgttaagagtagaaaataaattatcttttctctatgcttttgatttcttctgagtaatacttagcaccttgcgtcactcggtccatccaacgagcctccgcgtggtaggaatcggcccaaaggcaactatttattggcaaaccaaacggaaagcatagtaagatggaactccatgactcgataggcacttttgtactcagattatgtcgcaggcaatcaagataaatattttataaaaattgtttaaaaaatatgatataacatctgtagcccccgactcactagtcaacggtgaaccagttgacatagtgaggcagaggaaaaagaaaatatcataaaaagaaaattaatgatgacttagctttctggtctttcccttggtgacagccgaggtggcctgtcacaccctgaagtttcccccccctttttcttgttttaaaaattggttaaataaattgcccgaagaaattatcttaattaacctagagctaaatccctaattaataaatgcatttaataatcgaattcggcatggtggaattttttttgagttccccatgctccaatgcagtaacaagatttttagtggaattttcagagccttggaaataattttaaccaattaaaattgagcaagtgctatatttttaatcccatgaaaatcctttttctccttttcttttcttttccctcctttttctttgttgggccgtcggcccatccctctcccgcggcccctcctccttgtgggccggcccaagccgcccctccctcctctctcgggacgccgacaggtgggccccacctgtcggtcgtctcccacctccggccgttggagccgaagctccaaccgctgccgccgaaaccgccgcgccaccgcctcctccgctcctcccgcgcccacgccgcgccgctcccgcgtcctccccacgtcgccgccctctcccccgcatctcccggcccgcatgtgcgctcgcaaggggcgggattcgaatttgaatcccccattct

SEQ ID NO: 47183 - DNA, 7445 bp, Oryza sativa
  unsure (1)..(7445): unsure at all n locations
ccgtgctcacggcgaggagctcctctcctccctccttccctatgtcccgcacggctgccgctccctgcgctcgccatcgccttcggccgccgccgccggcctgtgcgccgttcgccaccgcctcccgcgccgtcgcttgccgttgccggcgctcgcgcgccgccaccggtcaccgccggtgaccgcgcgtgtcgccaccggccgccatggccgccggtcagctttgaagccgagccgagccgtgcctagccgcctccccccggccgtccgatcgcctttgaggccgatccggaccgtcggtcccgtggaccggcggtggaccacccgcgtggtcctggtccacggtagaccggccaccttgtgccgctgccagtggggcccacttgcccgagccccctctccctccccttgtgcgctgacaagcggggcccacctgtcggcgcagccgcccccccttggatgacgtcagccctgggtattattgcgcaataaattgattaaggacttttctttattaataaaaacacagtttatcttctaaaattcataagtaattcatccgagctccgtttaagtccattcaagtctcagtaaattcataaaaatgcaaagaatccattaaaaatggttttgtttcctgtttcagtagtcttatagcatgttttgcttgtgtgctttgtttgtcgcgtagatttcggccgtttcgtcgatctgcggtttctcgaagacgttgctatggtctcatcagtgcaagagcaaggcaagtcatgcattacaattgatcatattgtacccaatttacaaatgtcccgcatttctattaaatgttgcattcttttacaatgtcatgtgggatgggtcctattactcagccatatattgtttaccatatgccattgataactgggggtatcaaaatgattagatgttgatttaggaaatgcttagccatgcttagctcaactagtacacaaaaaaggatcacattattacatagactttgtctattagcatagttttggattggtgccaccgcagtggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctaaagtatagctcgaccctttcctaggcaccggtggcgagggtgggcgtgatggagttgggtcggctggggtgtccggttgtccagctgccggattcaccgtggcgcaagaggggaccgcccactgccttttgaggggtagggtgcaaccttagcgtggtgtggatggttaggggagggttatgtggagggtcttgttacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcaccctagtttagcttaatgaactggtgtagttcaggtggttggttgggcctgttgcaacgtggtgtagcgttggacagtgattggttaatattgattaattactacagctgttttactgctttcaactactggttttaaatgctagctttgtgcaaaagaacccctagcctcctttggttatatcttgcatcatacctcctcttcctgtatgacttgctgagtacagtgggtagtactcagtcttactctcttctcccccgcaccagagctgaaggtctttctagttggagctgtcttgttgaagttggttttgtcgctgccgtcaaggattgcctgtggagtggagtcgccccgctgctgaagtcaagcttcccggtttagctcgcttttatcctttccgctgcatttgtaatctttatatttttgtaagacgtggatctgtatgtcaacaattgtcgtttgtgtaccctggctggtcctggatagggatttaatgcacattcagtttagaaattctggttcgtgaatttctgggcgtgacatggccgatgtgggaacaaagtcgtccatcaatggcaataaaaacaccagccatagaagcagcttgaggcgactgacgttgaaagtgaagacgcccatcaatggcggcataataagccagccgtctaggcagaaacaccagtcggcggcaacgaaggcgagccggcggtgaaaatgcagacgcccatcaacggtggcataataggccagccgtgcatgcggaaacaccagtcgacggcggcgaaggcaggccggcggtgaagtcatagacgcccaacaacagcggcataataggccagccgtacaggcggaaacaccagtcggcgacggcgaaggccagccggtcggtgaagatgtggacgcccatgaacagtggtgtgaccaaccaaccgtataggcgaggacaccagtcggcggcgacggaggcaggccagcggtgaagtcgtagacgcccaacaacgctggcataataggccagccgtgcaggcggaaacaccagtcgacggcggcgaaggccagccggtcggtgaagatgtagacgcccatgaacggtggtatgaccaaccaaccgtataggcgaggacaccagtcggcggcgacggaggcaggccggcggtgaagtcgtagacgcccaacagcggcggcataataggccagccgtgcaggcggaaacaccagtcggcggcggcaaaggccagccggtcagtgatggagtacatgcgatgatacatgcaaagacaagaaattgcacatcaacctgtggttagatatttgtaaaaagaaaataatttatataataactaatagatccaaacacatggtttgatttgtgcttgatgaagaggcttgcatgaccaacaacggtggtgtgaccatccaaccgtgaaagtgaggaaaaccagtcggcggcgacgaggctgccggtcggtgaagatcaagacgaccgtcagcaacggcataccatgccagccgtggggacgaagacaccagttggcaacagtagtgccgcggtattacatgtaaacatcagaaaataccaagagattaatatgatatttagagatcaatataataaatgatgctagattagaagggaaaaactctggtgatgtcaggattctaatgcccgcaagcaaccagaaactccgcagaactcggcgaccatgtgcacgacgatcgaaacgcggctgacgacagcaacaaacgcggccgacgcggggatgaggtcgccgcctagcagtatggagccagccggccggtgagcacgttgcccccggcggtacatgcaaaacaaacaacagaaattgattagcaccgtagagaacagatgcctatatacatatatacttgctataggcatgcatatatttgtgatgcaaggtctgtttgcatgctcctgtaatccagtcatgcaatgatcgttggcagtgcatgcattagattggtcagaaccaatttgtacgcttgctctggccattgtgtggtcgtagcatgcaccgtcgacatgtaggccaggtgtccgtgtcgtgtcgatgggcggcgaacagcgtgaggacgacgatggcttcgaccagtggtcccgccgataaccagcaaacaccccagccggcagtacatgtaaccgaggggaaaacatatcagagaatcaactgtgattatagatcaatctgataataatatattgaaacgacaaaccaattgatgttttgggtcgttgaactcgttgagattaatctcaactcttcttttggaattgattccatcgcgcttgtcgatggaaaactcgacacaacccctacctggcgcgccaactgtcgaaacatgaattcggcaataataaaaggggtagcggacgagacctaaaagtggatggatgcggagacaaaggatttagacatgttcaggccctctctctcgatgagaggtaatacgctacttctgtttggggattttaatccgcagggggtattatagatctgacgagatctagttgtctcatgccccctagagggcctcctgcccaccttatataggatggggggcaggattacaagatagaaaccttaaccaatacggtatcggtttcctaaatctattttacaatattatcaaatcaggactttaggccgctccataatataaaaggaaacgtaatacccaagtcatgatctgtacatattccacagatataagctatctcctatgactagtcgataaccatgccgtgtgggtattgggtacccataatctccacaagtctttatctctcctcaaatttctgtgtttttcctgtggtccaatcaaacggtcattcctatgttttttctgtgttttgcaattctctgttttacacttatattcctgtcagaattctatatttttcctatttctccgttttttcattcctgtgattcaaagagacccttaaattttggctgatcccatgattagtattctggtgctgcgttgttccgaatctcaaagcggcactcacgtgcgaagcaagggccaaaagcccaaaaccttctagaacgaaccgggtcgtctcctccaaaacccagcaagccaacaacctcagtggagctcacccttatcccccccagctccagaaccttctcctctctcctctctcgctcgctcgcttctcgcggttgtcgtcggcggtagcgagctcatggcgtcggtgcagctgtccgccggcccgcgggtgtcagtgtcaccggcggcggcgctggtggcgatgccttcggtcgccgccgccgcatcgagggggcgccgcgggtaccgggggctcgtcgtgagggccgccacggtcgtgtcgcccaaggtgaggcacagctgcaccccactcttattcgggagacctgtgacgtctatggtgttttgggtttctgtgcgtgcgttgctactgcttgcgaggtgcgatctggtgcctggatttggttcacagtgtggaagcgctctcaaagctcgcggtggcgcttgaagggattaggagatcatttcgttttgttttcaattgcagagcaattatcgtactggattggctggttatatcaaagacgcaaactaatttgttaacagatccaaaaataattgatgatgttctagtttcctccacatgtttgcggtgtcggtggtctgtgtatgcgtcttaaggaaccttagaatctatctatgcaaagttgacactgcctgactgccatactgttccagcaatgaacagatctgttagtaatgtttccacctaatcacagccaattcccacactcagcttaaagtttgagtctgaatttcaaattttatggtgatattaagacatgctgtttttgcaaagctggttcacaatagctgaattgctgttttggcatgtgatgctagtttatggtgatgtcttacatgtgtaaagctcctgctgtctatttggttcatcagctttattactttgcagctacatggagtggtggaccttgcgccaccagtttcattttatttcattctgtagcatatttttctcccctcaaaactgtttaggattaagttttgagcatgtaatgtgcgattccttgttcctttacctaagcagatggacttatgtcaaatttgcagtatacttctatcaaacccttgggagatagggtgcttgtgaagatcaagacctctgatgataaaactgttggaggaatattacttccaacatcagttcagtcaaaaccgcaaggaggacaagttgtagcagttggagaggggagaagcatgggcagcgacagcatagagatcagtgttccagtatgtgcttttatgttcaactagttttgctagtactcacagacacctgctagccatttatttaaaagaaactgttgcatggtgagataactattaaaacatccacgggacctgtaagagcaacaaggcaaatttagccaagtggtgcgtcattattctacttaaatttattctcgaaccatgaacacctttttgaagataattacccttatgctatctcaactatttctttttcctgaaactactagttttttgttgatacggttaccctaatcagactacttattaaatttgctggtcataaataatatataacctggttacaggttggtgcacaagttgtctactctaaatatgctggcacagagttggaattcgatgggtctgaccatctcattttgaaagaagatgacatcattggtattctcgacacagatgatgtgaaagatctgaagccactgaatgaccgtgttctcattaaggtctgtttaccaaaagctaatatagagccatgttttatcaccaagtgaattgttattgctcttttcctattttgcacaagttgcatctgcaaatcctggtccattccatactgaaactgcatccaaaagttgcatagactataggcttcatatctgaacaatgttcatgaatggcataaatggcagcacctgtcacattatttactccagtaaaactaggggaagaaatatattccttgggtcataaccttgatgacgtgtccttacatttgtgctttccagtctctacagggagtccagaacacttacgctcttcatggaagagattgaatccaaacctttggcaacatttcttgcaaccaatccaaatcttgtactaaatttgtctcctattggtaacaaactgaatatccctaccaaatactacctccgttttaagttataagactttctagcattgcccacattcatatatatgttaatgaatctatatatatatgtgtgtgcctagattcattaatatatatatagattcattaacatatatatgaatgtgggtaaggccagaaagtcttataatatgaaacggaggaagtaattagtagtgtcaaattcaaacttgcctaggttttggcaaccaaagaattggtagggtaaagaactaaccctacgatatattattccattctgccttcctgagttcaattcatctgcttaattctgagccaagcttctggcataatgtccgatcagtgaggttgtgcacatctcctaattgatttgtgctggtctgtcttatcgtttttcaatgggtctcttgtgttccagtctggaaacttcacaggttgatattagaccataaccattctagagtttcttttgattatgctcttgattgaatttcaatagcatgtgccgttgctttttgtttgatgctgcatattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47184 - DNA, 24254 bp, Oryza sativa
  unsure (1)..(24254): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctctgcctgcgcagcggcagcgcgccggaggccggaccggcctactccagctagcaacggtgggggggcactgggtttggggctagctgtgttgtgtgtgggcgcgcgcacggtgcgacgttcacggtcggcagcggtgccgcgcttgccgtgggccgccgccgcgtgctggctagctgggctcgcagcggagcctgcctgatctagtggcagacgatgacggcagatgaaacgaagcgagaacaagtccactttgattccttctaatatgagtccacggataggatagtcccttaaaagcaatctaaactatagatctagtagtatttaaggatctctcaactgcaataacacatcaactattaaaatcattataatttaatttcctcggttgttttaaatgtggttttcgcttatgtggctagataaattggtctagccagctgagccagcttatggagcccacatgttagcagatctatatcaataggctgggtataatagctcagcaaggtcatcgaacttgttagggatgaatcggctctgcgcccttgtcagctagagactcttatcttgattatgtttctcaatacgtaggatgaatttgaacttgttttttatagtattagatgtcaacatactttatattgctaatttcccataactatttatattgaatttagaaaaaaaaaagtacacgaaggatattcccttatcatattagaacccattccccatcttattggagtggtggagttttcacagggaccatactatattggtttccatgaagaggtcaattataaagtcactaacaatgttctcagctcaattaattaaaccttcacccacactctttgactcttctaggcttactctaagaaaaagagaaagagaaagaaaagaatcagaaaagctttgccacacctcacaccttgtgtccttgtgcctcctacaaatagctcttgccattcagtttcctctcagcagcccaacagtcgtcttaaaccatccagctagaagacaacatcctcttaattccggccttaatggaggtagcactctgtgcatcctttgttgccattctgctaaccaccatgctcttcctaaaagccatctcgacgaggtgccgccgtcgaaagtataacctcccgccgggtcccaagccatggccgatcatcggcaacctaaacctcgtcggtgcgctcccacaccgttccatccacgagctctcaaggcgctacggcccactcgtatacctccggttcgggtccttccccgtcgtcgtcggctcgtccgtcgagatggccaggttcttcctcaagacgcgcgacgcggcgttcatcgaccgccccaggacggccgccggcaagcacaccgcctacaactaccgcgacatcacgtggtcaccctgcgacgcgtactggcgccaggcgcgcagggttgtcctcaccgagctcttcagcgccaggcggatcgagtcgtacgagcacatccgccgcgaggaggttcacgcgctgctccgtgatctgcactacgcgtcgtcgtctggcggccgacgagctatcgtgattaaggactacctgtccacggcgagcctgaacatgatcactcgcatggtgatgggcaagaggtacgtgcagggcgaggtggtccatgaggagccgggatcggcgcggacgacgctggcgcagttcaaggagttgctcgaagagctcttctttctcaacggcgtcttcaatgtcggcgaccagatcccgtggctcgagtggttggacctacagggctacgtcaagaggatgaagaaggtgagcaaggcgttagaccagcttctcgaacacgtcgtggacgagcacagtgagcggaggcaacgtgaggggacgggtttgtggcaggagacatggtggacgtgctccttcgactcgccgatgattctagcctcgaggtcaaacttagtcgggacagcatcaaggcatttactcaggttagcgactgcatagcgtacatcgtagtactccctcgtccaaaagtctaggctgtttggatggtattttcagtacatgtcacatcgatcggatgcttaatactaattagatgtttaacgtattaaacgtagactattgacaaaattcattctataaccctgactaatttgtaaaataaatctattgaacctaattaatccatgataaacctatgtgatgctacagtaaacatgtgctgattggcttaaaaaatttgtcatgaaaattagctctcatttacgtaattaattttgtaagtagtttatgtttaatactccaaattagtgtctaaacatccaatgtgacagggactaaaatttagtcccggggtcaccactagtcctagcatggtttagtttccaactttttcttcaaacttctaacttttctatcacataaaaacttttccacaccacaaacttcttaacttttccatcacatctttccaatttcattcaagcttccaattttggcttgaactaaacacaccccaagactaagaatcaattaaatcactcacgttgtgacaaaaccaatgaacatgtaactaataagtactaaaatggtttcttggttctcatcaataatttaatttagcacataatgactaaaaaatagaacttagacttttagaaaaaccaaagaatgaaataagttttagacttttggaatgaggaaggacatatcaatcaaggggaatagacaattttgtcccaaatttcgtccacaggtcaatttggtggttgatttttcattttgtctaaaggagtcctccagatttgcgcaggaattaaggacaagctaatgcctaaccttatggtaaaatcccagtgaagtatattagtccctccatacttcctcaaatactccgtttcaatttacctatcacgttcaagatttgttttaagtcaaacattttgatctttaacttcaatttctacaaactcatgtagttttacatcataaaatttatacttttggattcatcatgagaatactttaatataatatataattcacatgttgttaaattatacggatttctaaatattaatggttaaagatagacatgtttgagttaattagactaaatctaaaatgataagtaatataaaatagagggaataatgaaaaggaaaagtcactccagcggtctcatctattcgttcccatcaggcttgctcaatgcaagaaggtgaacaacagtagccagtagttacatcatgttagggggggtacagcacacccaggaattatctgagatgttaattaaagtataagaacaaataagggcaaagttgaaaactcttttgttctctaatgaaatcatattagattacttccaaattactaccttcgtcccatattataaggtaataaggcatgtattttttacacggtctttaataacatactttgactattaatttactacatgttatgttctcaactatgaaattagcatcacataaaagtacttaaaaatatgaatctagtaatataacatgcataatataattagtacaattattaataaaaaaaattaccgagtttgattttctaaaaaaaacatatgtaatttggaacggaggaagtaagaattttccatgaggctaaatgttggttctagctttgctcacacatataacaaacttaaaaaggtgggaccacaggacctttctaaacctgcagatatagaattgtaggaatcattttatgaaatcccaaaagcaaaatgattacacggtaaaccttttgataggcaaaattaatcagttattctcctccaccaaaaaaaagttaattattctcccccaagaataagtcaagcaaataactggcttggacgttggaagttcaaaagttcatactaatatgctgtgcaaatttagtatatgagttgtgaagtgtaaatgactgaaacatactacctccattttttaatagatgacgccgttgattttttctcacatgtttgaccattcgtcttattcaaaaattttatgcaaatgtataagatataaatcacacttaaagtactatgaatgataaaacaactcataacaaaataaattataattacgtaaattttttgaataagacgaatggtcaaacatgtagaaaaaagtcaacggtgtcatctattaaaaaacggagggagtatatatgaaactagaatttcttacatgcatgacgccaaaaattattggcttatatataggagtaaatatcactataggtcgccgtgcataatattttttacttcagtgcaccctttttttcatagttgacaaatactaatccatttttttgtcaaaaaatattaatccaatttgtcttcacaaccaatcaatcacatacgtggacaactgcagaaaatgcacattttttttcaaggagaacacattacaagaatataatcaaattaagatgttacctcctccgtcccaaaaaaaaaaatcaaaccctaggtctgaatctggatatacatatgtccagattcatatccagggtttgatttttttgggacagactagtaagtcgtttctgagttaactagtccaaaacggcatgtgtaggacctcattgctggcggcacggagagttcatcggagacaatcgagtgggccatctcggagctcctcaggaagcccgagatgtttgcaaaggccacagaggaattggatcgcattgtcggccatagacgttgggtcaacgagaaggacattcttgatctcccctatattgaggctattgtaaaagagaccatgcgccttcaccctatcggacctttgcttgcgccacgcctttcccgtgaggatacgtctgtgggtgggtatgacatacctacgggcacgcgtgtattcgttaatgtgtgggccattgcccgtgaccctacgctatgggacgcatcggaggagttcatgccagagagattcttgggtaagaaaattgatgtgaaagggcaagactttgagctattaccatttgggtctggtcgacggatgtgcccaggctacaaccttgggcttaaggtgatccaattgagcatagccaatctccttcatggcttcacgtggaggctcccgaaggacatggtaaaagaggatttgagcatggaggagatattcgggttatccatgccacgcaagttcccactagaggttgctgttgagcccaagctctctagtcacctctacaaaggtgattgatatatgtctctatgtcattactcatgtagctggtacataaaaagtatatgtatttctgaacaagaattctaagccctcaagagatgttctattatgtgtatgatacaaacagtcatgaaagattctaaaatatttgattatacagagtacaatgatatctacaactccagaaaatttctagtctaaactcaatatatatgaagcgggaaaaatgaaggcaatcttagttgtatgtatcattcctgccatgccaatataggtgtggcccttttttctatagaaacacggttctaacataggcgctcacaatgtgagtgtactcacccttatgaacacatagtctctacccctatgagcacctccaaaagtctaagtcagcacatcttgcgattgataaagtcaccgaagacgtctcgtttgtcaatgggtatgtcgtctaccactgaaagaataattaactgtaaatgcgagtacccatgtcaagtccaggacttgaacgtagacaatatagagaagggtgatgtgcatggcttcccttctttctccatgtcttatgccagaatgatgaaccttccaagtttgaatgtttacagactgaacctacaatacaaccttgttgcatatgcaattaatgcaactatcatactcatgcgaatggcctatcatttggtccacaaggtactatcttttaggttttcttccacatttagagaggtatatacctctcctatttcaaaggtaaaaaaacaaatcagttgaagtaaacagaagacaagtttatgattagcaatgacatgacttctcttgttgttaggaggtacatcaaggtatatatataccacaaagtgtaagtctggaggtatataccttaaaaaaagatggaaagtcaaaaatatacttacaccatactctattagttttggtacttcctttcacaaagaggtctatattaaaaatgaagagatataagtatgggagaaacccttttatttttgtttttaggttgttgtaccatgattttttttcttgtttatcatgttaggagtatttggccttttgatggattctatgatagtgcaaactgtgtaatgattatgtacatcctagttagggcagagattctcccatcctatatttctagttgtcatgcttaacaatatttcactagcatactttcgggctagtatatatgaaaattaaactggaaatcaagatactaccactactggagaaaccatctttcgtgggttggtaaaaaaccacaatagtcccgattcaactaaaaaccgggactaaaaatcatttttagtcccgatttaaaagtgcaacgagtctatatgatatttagtcccggttggtgtatctgcctcccatgtcctaactcggccacgatcttatctctctcgagaccaagcgtcttcatcttctctctcgcctctctctctctctctctctgtcctctcctctctcgcaatggggtcggcagtagtgcggggtgggcagcgggagaagaagtggcgggagatgcgacggcagccgggcccgtgccggtggcaggacaagaagccacggtagggtggggttggcggcgcctctctccgtcctctcctctctcgcagtggggttggtggcggccaggcccatgccggtggcgggagaagaagttgcggccgggctgtgtcgacggcgggagaagcagtggcggccgagctggggaggcggcggcctcgccctcccttccgccagatccggcaggaggggaggcggcggcggtggagcgactgcaaccagaccggaagaagattttttttttaggatttgcgatgaatttgtttttgagaattagtgatgtttgatctgtgatgtgaatatgtgatgtatttgtaatgttttttttaaaatttgtgatgtgatttttttgagaatttgtgatgtatttgatctgtgatttggagattatttggggatttcacgatttggggatgtagtgaaatcaatattcaagcagttaaaagcaatgaaaaaaagaaaaagaaactctataccaggactaaattaggagcactagccacctgtctctaccatcttcaccaactagaacttaaaaatagatctttagtcccggttattttaatcgggactaaagatagtcttggattcgtagtaccagtttgcaacttaggactaaaggggttgcaaaccgagaatacagaccacttgttcactggtgtttttttttgcttaatatagagtgaagaagtttgggaatctgtggattgaacgccggccttctcaggtccaggcggttacgtgttgattgatagcacacgaatcggtgcgagattacatgtatatatagcacaccataccagccgtgattatctaacaaattaacaattaactgcatcctaaatcacagccggcatagtatcctatattgttacaatacggactcaacatttcaggtagttcaacactccccctcaatctaaaccataaaggttaagattgtatctaaatacagctagctgtttctcattcaagggttttgtaaatccatctgcaacttgatcttgtgaaggaacatactctatttccaacaatttcctagatactctttcacgaacaaaatgatagtctacttctatatgcttagtacgagcatgaaacacaggattagcagagagatactttgctccaatgttatcacaccatacctttgctgtttttggtacttctatcttgatctctttcaacagagtttgcacccacatgatctcagctgtgacattagccaaagccttatattctgcttctgtacttgatcttgacactgtaggttgtttacgtgcactccaagacacaagattaggccccaaataaacagcaaagccaccagtggatctcctatcatctaagcaacctgcccaatcagcatcagagaaaccactgacaagtaaagaagaagactttcttatcttaagaccaagcccagatgtttgttgcaaatatctcagaatcctcttgactgcagcccaatgaactgtagttggagagtgtaagtactgacagactttattaactgagaaagaaatatctggcctagttagagtcaaatattgcaatgctccaactatgctcctataattggtagcatcattaggtccaagaacatctccctgatgtattgagagtttctcagttggtgacagaggcgtactcacaggtttgcacttatccatattgattcgcttcaatagatcttttacatatttttcttgagataacagaataccatcacatacctttgttgcttctattcctaggaaataatgaagctctcctaagtcctttaaggcaaaagacttattcaggtcctgcaaaagagctgtggtggcatctggcatagagctagcaacaattatatcatcaacatatataagaacaaatataatgacatcacccttgctgtagaagaacagagatgtatcagccttggaaggcatgaatcctagctcttgcagttttgtgcttagccttgagtaccatgcccttggtgcctgcttaagaccatataaagccttgtctaacttacatacatgattaatcaaggatttatcttcatatcttgggggttgtttcatataaacctcctcttccaatatcccatggagaaaagcattactgacatctagctgtcgaaggctccaacctctagagatagcaatagacaaaataattctgattgtaattgcttttaccacaggactaaaggtatcttcataatctattccatacctctgtttaaatccctttgcaaccaatctagctttatatctgtctaagctaccatcagcctttcttttaatcttatagacccacttgcaatctataatattattagctttttctgcaggaactaaatgccaggttttattacccattagtgcctcatattcagcatccatagcatttttccaatttttatcatttaatgcctcatgtaaattttctggttcaccagaagctgtaaagcaagcatatttaactgtaccatctgtgtataccttttctttgcggattccactctgtaagcgggttctaggccgaactatttctggttgatgctgctcagccacaggagagctcgcggcttcttcatgcgatgcagaggattcagagacatcatcattacctgccatcgtcgtggcagacggagactgatcactcggctcgttctcaacacgcgtgcctgaagttgctgcatgcgtgtcactaccagacctgcgcacacacaagggtgtcacagatcccggcgactgcggcgatgatggttgctgctgtgacagctgctgcgtatttgcttcatccacccagtcctctgcacctatatttcctgtatcttctgcatgctcaacagattgatcaggcatttcattaggagaattaaacatctgatcattctcaagttctcccccttgatgagacgtgtgaataatgagatcagagggcaaaagagagatctcatgacgaatacgtgcgccagcattgtcatgcaatttagaaaaaggaaatacactctcatcaaaaatgacatctctggatatatagattctaccagaagcaatgtccagacatttgtatcctttatggcggtggctatgaccaagaaatacacattgctttgaacgaaattggagcttatgtgcattataaggacgaagattaggccaacaagcacaaccaaacactctaaaggatgaatagtctggtgtttgtttgaagagacgttccaggggagactcaaactcaatgactctactaggaacccgatttataatatgagtggcagcaagaaacgcttcatcccaatatttgagcggcatactagcatatgctagaagagataggccaacttctacgatgtgcctatgttttctttcggcagagccattttgttgatgagtatgtgggcaggagacatagtgagatatacctattttctcaaaaaaggaattgagtttctggtactctcccccccagtcagtttgcatggaaataattttacgatcgaacaaacgttcaaccaaattctgaaaatcatgaaatttctgaaaaacttcagatttgttctttaaaagataaatccaagtgaacttgctataatcatcaataaaactgacataatatttcttatttccaacagaaactggagcaggaccccaaacatcagaaaacacaagttccaaaggatgactcgatatactcaaagatttagaataaggtaactgatggctcttggcctttagacatgcatcacaaaccggctctttattggactcatctagacaaggtaatttattcttgctaatgactctggagataatgggtgctgaggaatgacccaagcgactatgccatctctcaaaggatggcgtgacagcacaaactacttttgcagatgatggaggagatgcagatggaactggatagagtcctttttggcgtctccccttaagaaccgttctcctcgtggcctgatccttgatcaaaaaatgttttgagtgaatttcaagaaacacagagttatctgcagcaagcttatatgcggaaataagatttttattggcttgagggacatggagaacattattcagatgcaatgggcgagtaggggtatgaactattgaatgaccaatatgtttaatctccatacctgaaccactcgccgtgtggatttgatcatgtcctttgtagacgtctcgagcggtgagtttctccagttccgaggtgatgtggtcggtggcgccggtgtcaacataccagttggagtcccgtgcatgggtgtggatggcagcagcaactagcttgtcgtcggggacgaaatcttcatcaaatcgatgccaacagtccgctgcaacatgtccgcgtttatagcagacctggcacaatggacgattgtcatagctgcgctgctgctggttgttgccgcgtccacgacctggtgcggcgctgcgcccacgagttgcgccgcgtcctcgcccagggtttgcgccaccaccccgtgagccaccaccaccacgtccacctctgttcgccatgttcgccgtggcctgcgcctgcctcattgctaacctgttttcaaagcttaaaagttgtgagtagacttccgcaaccgtgacaggttcaaccctgccaacaattgtggagacgacggagtcgaaatcttcgtcgaggccgttgaggatgtaggcgatcagttcttcatcatccagtggtttgccggctgctgcaacttcatctgcgagggtcttcatcttgccgatatattcagagatcgacgagttgcccttctatagagtcgtcagcgccaggcgcacgttgagagaacgcgcgcgtgtcctggacgtaaacatgtcgtccagggttttccatgcttcggccgccgtcttcacagcagctacttgtgagagtgtctctctcgtcaacgaggagaacaagaagccgaggatctgctgatcagcagcgaaccattcatcatagttcgggttggaggtcttgacttcctttccatcgacggtcttcgtgatttcagcaggaggagctgggtttttcccattgatgtgcccctcaagtctggcgccccgaattgccgtgagcacctgcgccacccagagcccatgattcgccttggaaagcttctcggtgacctgaactccgatcaagggattggagctcgcagcggagttggatgtagatgccatctgggtgctcttttcagatgcaacctcttcttcagatgactcggatgcaatctcttcagattcagatgcagaatcgatttcttcttccaatcgctctgataccatgaagaagtttgggaatctgtggattgaacgccggccttctcaggtccaggcggttacgtgttgattgatagcacacgaatcggtgcgagattacatgtatatatagcacaccataccagccgtgattatctaacaaattaacaattaactgcatcctaaatcacagccggcatagtatcctatattgttacaatacgactcaacattccaggtagttcaacatagagaatatctactagcagtacccatgaatctgtcttgtgcacaaatatcagagtccaagaacgaagaaaaccttattatcaagcatattattgactcactcttgccctattattccactcttacaaagacagaaaataatgcataagcaacaacaccagtactaatactgcaggcttaccggactgcagcgacgacagatgcagtaacaactgtaatcaacagacatgcaacacacagatatacatcagcaagcagacacatagaggtcagccgggagcttgggctcgacgacaacctcgagcgggaacttgcgcggcgtcgacaaaccgaagatctcctccatgctcagctgctccttcgtcatgccgtcgggcagcctccacgcgaagccgtgcagcaggttggcgaggctcacctggatcaccctcagcccaaggctgtagccggggcacatccgccggcccgacccgaacggcagcagctcgaaatcctgccccttcacgtcgatcttgctgccgatgaacctctccggcatgaactcctccggcgcgtcccacagcttggggtcgcggccgatggaccagacgccgacgagcacccgcgtgccagcggggatgtcatagccgtcgacggacgtgtcttcgcgggacaggcgaggcgcaagcatgggcgcaaccgggtgcattcgcatcgtctccttcatgatggcgtcgatgtaggggaggctcgggatgtccttctccgtgacccagcggccgcggccgacgacacggtccagctcctcggtgaccttggcgaacacctccggcttcctgagaagctccgcgatggcccaatccacagtggccgatgagctctccgtgccgccagcgatgaggtcctgtgcacgtgcagatgatgagcaacgttggagtttggaccggtgaatcaggtaaagaaacgagaacacagtcacaaactgaatattttgatcgatggtaaaatagcgtgcactgcactcggcacaacacatcttttcataatcttgtgttagttgctcgggttgcagtttatgttatgtaatccatgaacaatgtgtttcaccttctctcttcttagtataatacagggaagagcttccagccacttgcttaagaaaagaaaagaaaaagctctgcacaacatatgattaattagctagttgcggagacaatcaggttaatatttaggaccgattgggcgtcaacgaagtcaagatgtagctagtgcatggttatgtacgatgatactattataatccaactgactttctattccccataaaagaatataagtaagtacacatgcagtatttaaatttgtgtggattgttgcgttcgccagcagagactgtgagtgagtttgtttcgttttccacgcgcacatttctcacactattaaatggtgtgtttttttaaaaaaattctatacgaaaattactttaaaaaattatattaatccatttttgaagtttaaaatagtttatactcaattaatcatgtgctaatggctcacctcgttttgcgtatcttttcaatctctaaactcctaaaatatattggtttctgaacttgtcctatgtattatataaatccaaacagactccaaactgcttcatgtgctaatgtgacataccatgtcagtaggacttacatgtgagacacatataaactttttttttaaaaaaatatcctctctcctctctttttaattttattttttcaagataaaaaaatcattttctcctctctttttaaaattttatcaacatatggatcccaccgacaccaatatggcatgtccatgacaaattcaggaatccaaaaattccttttgatagtttaagaatggggcaattgtgttcttatctctactttcatatctaattgtgattttaccccctcttttttctagggtttgtgattttgccctcatttttttctgaaggaagctgtcgtttgcccctacattggatgaccgtttggtggacccaaaataagagtgtaaaaaatatagatgaaattactaagagaaaaacaatggaccattataccccagtgcaaagaacaacaccctgcattgcctttttcatcccacccgatccccattctgattacttgattagcctaaccctagtggcaccgccggcggctgtgcacaggcgagataggccggcggctgggcaaggctgtgatgcccagcgagcagcagcagatgcccacatcagcaaagctagtagggggtgttggcgcagtgagcaagccgcggcttcggcggagcgagtgaataggcggcggctccgagcctccgacggcagccgcaagcaggaggcagcttcggcggcacgtgcgagcccgcagcagcggcatcgcacgagaaggcggcggctccggtcgtgctgcagccgcctcttattttctttttcttttttccgatcttgtgctactttgtgaggagcttgtttgtttggtgattttttactggtgaatgcgatggatctttcgtacctggtgaaagttctgtgaaatcctatcaatgatatcgaagttctttcaaaatttgtccaagtgcgatcatatttttttggaaaatacacagatcctaaaagaaaagtagggccaactgtacagggttatacctgtctttttttagttttattgacaccgttaggtggttttaacagagtaggggcaaatcagagtttcgttttgaaaatgtgagggtaaaatcacaaaccctagaaaagaagggtaaaatcacaattgcatatgaaagtaggggtaagaacacaattgcccctttaagaatctagatgacacatctactataagattagaaaccaaccctacactacactcaaataatattaatatattgagatgctatttgactcggttaattacctgggtgaatgccttgacgctgtcacggctgaacttgacctccagcgaaggatcgctggcgacattgagcagcacatccaccatgtccttcgccacgaagctctccccctcgcgacacatccggttctcatgctcgtccaatacatattccaggaactgatcaaacatcttgctcagcttcttcatcctccgaatgtacccctgcaggtccagccagcccaaccacgggatcgaatccccaatgtcgagcacgccgttaagcaggaagagctcatcgatcatccacctgaaccgctcgggcgtcgtcaccacttctccctcgtgcaccacctcgcgctccaggtacttcttgccgagcaccatgcgcgagatcacgttcaggctcgccgcggacaggtagtccttgagcgccaccacgcgcccggacgccgcgtgcagatcgcggagcagcgcgcgcacctcctcgcggcggatgtgctcgtacgactcgatccgcttggcgctgaagagctcggcgaggcacaccttgcgcgcctggcgccagtacgcgccgtagggcgaccacgtcatgtcgctgtagttgtaggtggtgtgcttgccggcggcggtcttgggccggtcggcgaacaccacgtcgtgggtcttgaggaagaacttggccatctccaccgacgagccaacgacgacggggaaggacccgaacctgaggtgcatcaggggaccgtacttcttggagaggctgtggatggagcggtgtgggagtgagcccatgaggttgaggttgccgatgattggccatggcttaggcccaggagggaggttgtacacccggcggttgtgcctcaagatcagggttctaagaaataagaggatggtggcgagtgtgatggtaaggtaggatacccatagtagaaactccatctgaaaaatgtatcttggctggtgaagatgactgaaccacgggcgaacttttatagatcgcaagagggagtggcttgctaacgcaatagatataccattgagaattcaggctgcatatgggcattcgatcgatgttttgtttgcacttggcataaataaagacaatcattagtcaacttgtactggtcatgttaaaaaaccactgtggttaattgcccaagttgctaattaatctcgtgatctggaagggaatatatttcccgtgtacactcctaacacaccaactgacaaatgtcacagaaaaatccagaaaaaattagacacataattccaatggtattatacttacgtgtgaaatcttatattcaaatacattatattttagccgtaacaaaaaaaacaaatttctaacagatttttacttttaaattgtcagatttttcacttttttgttacggctaaaatataatgaatttgaatatgagactttgcagatatgtttaatactattaggagtaaatgttcaattattcgtagaaattttcgtgccatttgcttgttggtgtgcatggagcgtgcacgagaagtttgtacatataggatatgtacctctgatcaattggtatctattttacaatagaacaaattgcattgataaatggtgtactttttgtatgacctgttgaggtagtcattttcttttgagacagagaagctataagaaactgcaacaatgctatcaatgagtaagcaacagtaggtaggcatacagccgtgcaccatgtagagtaccccatacatctcaaaatataaacatttttaagaatacagtgacatgcaaactttattccaaacaagaggagtgtttaatttgcttcccatgtctaaccctctccatagacgatgtcttctgtttttatcaatttgctccacaactcttaactggaagtttcagttggcacatgtagaaagttagcagaaagcacatagttaaccagatcgagcctatttccataagaaagataaatggaacaggagacgagccttcttttaattctctatactattgggaagaaatcatgtatgagtggtttggtgagacttaaaggtaatccaaggtaactgaaaggaaaggatcgttgcgtcattgcagagtatttgtgggaatcttcatcttttcttctgacacattaattggcaccatgaatgatttgttgaagtttattcttagactagtcgagtccacaaaatgtatgtaaaaagctttgagtcaaaacaattgtctagagcatacatatattactaggagcgtgtcatccgcatattgtattactagtaagtcaagacacgtacaagttgaaattgtcagtgaagattgcaaggtccctctgttcataggtcatagctttattgtgaatagattgtaggaggtctgttgctagttaaaaaaggagagttgaatgagactccttgtctcactccccttctggattgagatttttttccctggggcactccattcaataaaatggaaaaagttgtagatttttagatttttttttctacccaatcaatccacagttgccaatccctttacatatcagaatctctaggattacactctattcagttttaccaaaatgccttctcaaaatcaagcttgagtgcaatcacttatttcttggattttatagtaacatatgcattcaaaaggccatgctaggcaaaataaacataatttatcctctgttaaaaaatatagctacatttctagtagaaatttgagctttttgattggttgtttatgacggtgggagtaattgaggacttttatgagaataaattctttaaatggttttaagagttgagaatgtttctttatacaatattaaagttaaagttaaagggtgtgtttggagtttggacttggggtggacaaaaaacttaaagctcgtagcgagcttggctcggattgagtcgaatttgtagtcttaataagtcgagccaaagtagacttttagctcatgaagctcgcgaactgctcgtttagctcgttaatacaagaaatcaacatatcttcatgtacttcgtgattttaactagtattcagtcatttaaatacaaccgaactatttatatttagtgaattatttattagttagtgtttattttcatgtttatatatgataaaatggtaaatgtgaaattatgaaggtagaataaatacgttaacaagcctaactaactagcttaataagtcaacttatgagactagccaagccgagctaagcttctggatcgttaacaggctcgttaagataacgagctcaaacgagccgagccagctcgtaaaaaataactagttgaggtgggcaatatggacttatcctacttcctacatatctgcgacagtggttttttttcatagggaatatctactgccagtatgatgaatctattttgtgcacgacactccaatatcgcataacaccttattatcaagcatattattgactcacacttgccctattacattcagctctacaaaggcagcacaggatgcataataagtaacaacgctagcaatacactgcaagcttaatgttggaccgcgacaggagcagtgcctacagtacagtcaagagacacagaacgtacacacgcacatcatcaaaggcatatcacatcaggcagcagcatagaggtgagcgggcagcttgggctcgacgacagcctcaagcgggaacttgcgcggcgtcgacaagccgaagatctcctccatgctcagctgctccctcgtcacgccgtcgggcagcctccacgcgaagccgtgcagcagattggcgaggctcagctggatcaccttcagcccaaggctgtagccggggcacatccgccggcccgacccgaacggcagcagctcgaagtcctgccccttcacgtcgatcttgttgccgatgaacctctccggcatgaactcctccggcgcgtcccacagcttggggtcgcggccgatggtccacacgctgacgagcacccgcgtgccggcggggatgtcgtagccgtcgacggacgtgtcctcgcgggacaggcggggcaccagcatgggcgccaccgggtgcagccgcatggtctccttcacgatggcgtccacgtaggtgaggctcgggacgtccttctccgtgacccagcggccgcggcccacgacgcggtccagctcctcggtggccttggcgaacacctccggcttcttcaggagctccgacagcgcccactccacggtcaccgccgagctctctgtgccgccagcgatgaggtcctgcacgtaacgatcgatgtgaattgctgaattgttgctacttagatggtgttgtaatggtgatcaacaatggactaagtaacactccagtgatatgatgcattgttataagatttaagacataatgaagagtgttgatctgcagtctgaaaattgttttttaatgttgtttttgttcagttataaacttattctgcactgtttagatcacaggagggggtcagtgctgcttgcaatgattgacgtcccatgcttatcagcaacggaatctgcaagctctttgggcagacaagatattcagacagttcatagttgtgtgggctagctctgtggcaagcacattcatttccctaatggatagtgacgtccatttgggcaactccgatcttttatgtaagtccgttttctgattgaaactagtaattaataatgtggtttggctatgataaatgacaaccctaccatacgtagtatcccaatatcctactaagaaataaataatttatgtcacggtcaagtttcagaagttgactaacaagaatgctacgagtacatagttgcagcctgcagctatcattctgagagtttgtgactgcacccattcaagattgttcctattaattacagtattagtatgtgattttccagtttattgaagcgtgtagatatttgaagttgatctgaaaacattttttgggggcagaaatgcagtgacagaaagactcacctgagtgaatgccttgacaccttccctcttgagcttgacctcaaggttgggattgtcagcgaactgcagcagcacgtccaccatgtccttggccacgaagctctccccctcgcggcggcggcgctcgttgtgctcgtccacgacgtgttccaggaaccggtcgaacatcttgccgagcttcttcatcctcttgatgtacccctgcaggtccagccagtcgagccacgggatggagtcgccgatgttgagcacgccgttgagcaggaacagctcgtcgagcatccacttgaactcctccggcgtcgtcaccgacccccccgcatccttgtccaggtacttcttgcccagcaccatgcgcgtgatcacgttcaggctcaccgtcgacaggtagtccttgagcaccacgacgccgccggccgcgccgtgcaggtcgcgcagcagcgcgcgcacctcctcgccacggatgtactcgtacgactccagccgcttggcgctgaagagctcggtgaggcacatcttgcgcgcctggcgccagtacgcgccgtagggcgaccacgtgatgtcgctgtagttgtaggtggtgtgcttgccggcggcggtcttgggccggtcggtgaacaccacgtcgtgggtcttgaggaagaacttggccatctccaccgacgagccgacgacgacggggaacgacccgaacctgaggtacatcaggggaccgtacttcttggagaggttgtggatggagcggtgcgggagcgtgcccaccaggttgaggttgccgatgaccggccacggcttcggccccggcgggaggttgtacacgcggcggctacggccgagcaccgctttcaggaacagcacggtggcgagcactacgccgacgaaggacgcccatggcggcagcatcagctccatcggtaaccggtcggtagtacgtggattggctgcaattcagttactatgttataggctgagctgcttggccggtggtggacaaccagagctcgagctagctacttatagaagacgacgagctcggaggtgtcaccatggcggtagtagagcgcgcgagcgtgtggaggaagttgaggtgtcatatggtgggaaaggacggggaaatcgatccaagacgattctcacgatgtctggaaagaaaacttggccgcgaaatgggccaaggcgtccacttgtgcaaattgtcgttttgccgagaaaaacgtggagagagaccgaggccacggaaccaccgctgctcagctaggctgcacaagcacaacgctctgctgcgtatgtgaagttgcaggtatccctctttgggggaaaaaaaagaacgtgcagaaggtgcaaaaaagtcagaatatttataccgtcatatttttcaacagaaaaaatagcatatatttatattggaagtttataaatttcatatgtaattttagtgtattaacaatgtaatttatatgtgtaatttgtaatttgtatttacactaaaattacatatgtaatttataaacttacatatttgtaatttgcggaaaatatgtaagtctgtgtaatttgtaatttgtatttacatatgtaagttatatgtaagtcaaacaaaatgtggtggttgcttgcatggtaaatgtcttggtttgtaatgctcaggtcatgcgttcaatcctgctcctctcttgggttcctttgatgtttttgtatgtactacacgaatcttaacgcatatcgtattatctaggaatcgatatatttttttgtacaaaatatggcgtcacctttttagactctgacctatcgctaatcatagtacatgccctccgttttcggggtggcaagaagttcctaattttttttccgaaaaacatcacattaaatctttagacgcgtgcgcgcgcgcatatatatatatatatatatatatatatatatatatatatatatatatatatatatatatatatatatatatatatatatatatacacacacacacacacacacacactaattgcacaggttgtatggaaatcgcgagacgaatcttttgtatctaattagtccatgattagccataagtgttacagtaacccacatatactaatgacggcttaattaaactcaaaagattcatctcgcggtttccaagcgagttacgaaattagtgtttttattcgtgtccgaaaaacctttccgacatccggtcaaacatccaatgtgacactaaattttttttttttgagaactaaacacaccctaactataaatggttgatcaggtttcggatttccatttcagtggctggcagtggcacaagtatatgtactatggacagtgacagatctttttggctctgcctgcatatactgtattatctatctctaatcagtgagcagacagagagtgggcgaaacaggaatacaagatgttgatcagacgcttatgaccacacagataggcatgcctcaccaatcatcaaccggtgtcacggtatggcaaaggaaatggagccgtgaaagctgacagatcttggagcacactccattttctctgggtggacagaatgaatcagagttctgccacactatgccttatctgtggatgagactcctctaacgttgtgcagtttatagttgtgccactgacatgtaggccataccaaagtgagacccacatgtccgtggcacaactgcagattgcacaaagtcagtgatctgtttcccttatccgcgtatgcactatcaggacctttacaatgatacgccgtagcattcagcctgagccgcatacgtcgacaatttctgagaaatcgaagccatgtttgtagccgggcccaccaaaacaaagtccacgcttccaactgaagcaacgcgttcttgggcaatatcgaagccgcgtgcggttgggagaaggggtggcaggcgtgttgtggggcgagtggcttctccctcgttcccaggcgcacgccccgacctccgcatcctagattcgccctcaccgtcaccctcgcctgtgcccttgccctcgcgctcacactccagatctttgttcaagttcaccaccaaaacaaagaaaaaaaaagaggtttatagtcgaagcgctaacaatttggacgtcgcctgtgatgctcaacagctgagctcagatgatttcactgtcatatgaacgtaagtcacaacaaacggggatcattttagttagtgtaacaggtagctagtgtgtcatccattaaatcatttagtaatttccccacgaaagaaaagaagcagggcatcctgtttcaccgcactacagagcaacgagatggatcgttactgtatcttcccctgcaaatgcatcgcgattagcagcaaacgacacggaaggttgtctgaactaaactgagactcgaggcaggcttgacttgacctgctcgagtttgattaaactaagaacaggcaacccccacatgctcgaccgtcagcaacttgcgtcgtccacagcaacgggtgctgcaagaag

SEQ ID NO: 47185 - DNA, 4532 bp, Oryza sativa
acataattggaatgcatacatcatatgttagagaaattatatggaagccacacgcacgtatctcaaacacatagtacatcatatgtttgaaaagatatattagtttgtgcattgtttcatgttttatgctttttgttgagagaatgttttgtgctctctattgagaaaggttgattatgctatttattggaaggatacagtaataattgaccgtagtttccttgaaacaaaatctgaaatttgttccattatctaaaaaaatcactttaaccagggcagtgccgtcaaatttggaggccctatacaagggtctaagtaaggcataaatcaagtaccaaatatagctaaaataatatatatattgtaaagcaaatgtgatatattaaaaatagtatttttttaactcttgttttgcataataaaaaaatgtcaaactgaaaacggagaatgttcgttgctgttgctagcttgctgcctagtgccttgcttgttggttgcttgctaagttgctattcgctggttgaatgaaaatataaaattggatgagttggctggcggcctggtgctcggaggagacgagacgtcgagactcgagacgaactgaataagtcacagatacgaaaaaaaagagaatacaaaacgccgtggggcctcagggctcagagttgataatacgaagcgccacgcacgcgaagtcgccgcgcggagacatgcgcggactcgaacggggttctgacgctctcacctcacacgaatacatgggccttcttcggttggactgatttttctgaggccctgaaaatttggaggctctgtacggtcgcacgggccgcacgcccatgtgcacggccctgactttaacacaaattcgcacactgggtggaccaggaggtgattccaccaagccactcttcatgtccactcctctcatctgtgctagtcgggtgccttcctttttgctttctctaccaactacctcccacgcacattaacagcgcgaatctagatgtagaagggccaaagtcagggatgggggcagctgcggtggcacctagacaaacggatctgatgtgtcatcaacggcttcactgtgatggctttgacggtgaaggaatgtggctatcgattgtttcagtgacgggatggctttggttgcatcagctaagatgatgagcggttgggatggttttgacaccatcgagctagttttggcagcttctgctatagcgtcgattgcacggcggtccaaacccctcctctcgtggcgcgcattcggtccgaattagtgcggtcgatggctgtctccgtggagctcatcatctctcctcaacggtctatctgttgtcggcatgtgaatgctccttgccacaacgtctttatcactggtcatcttggacccagtatattttagatgtgtgcctattgatcttctcacgatgttatccttgtaaaggtggtgtgacgttatccttataaaggtggtgtgtccaacgaaggttatagcttcgggtgttcattctagctatgcaaagaccgataaccgaaagtgattttaattagttggatcaccttttaatgtaattatttaaaatcaataaaactttatttatcataaaaaagatatatgagctaacaataaatccacgatcttactaatcctacttaaaatgcattaacatgcgattgtaagagctaggatttaattttctttttaacaataaaaaaaaaaggcaaagtcatacgatcataacggtgctatcaataaagttaaaaaatacatcaataaccactcgactatcgtggttatcagagctggtccacattggaatctcaataaatcgatcgagtttaaaaaaagtaaaaattaaaactttgtcaaaatttattcgaattttatcgcttttcgtccacaaaccaaccaggcgtccagtgaaactgttgatgggctatagccgatttgcaattgcattatcaaactctggataccaactccaatgctcagtcataagcatataattaacatgggttaggctgttagcgcacgcagggacggatcaacagtgttagcatcggtgtcagacgacaccgatgactttcggcaaaacctacagttaaactgcttatccatatattataacacactaatataagtataattagcatgctatgacaccgatagacatattataacaccagtgaatcaattttctagatccgtcgctaagcgcccgagagacacgctaaccagtcttctcttcggagaagacgcaagctcatagagcctcatatggaagagaactttgttgaagcgtccagccgcccacagtttctctcgagaggtttttgtcatatcaattttttgaccgaccttgaccgacgactagtcagtagtagtagtcagtagtcactcatatcgttgtcgtcgctcatcgttgggtggcaacgcaacacgcgattttgcaggtgcgcgtcgtgtgggggggacctgtggttagttggtgcgggtggttgcccgagtcattttgtgtgcttgccttgggtcggaaaatgttgctctctctatctgtggacgggcgtagggcacctggtggctgtgtttgctactagggatgaaaacggatcgaatacggtcggaaacaagctctatcatattcattttcatattttttttctcggaatcgaaatcggaatcggaaacccggatacgaaaacggaatcgaatattatcgaatacagatacagagcgaatacgaatcgaaacgaatacggtaacgaataattatcaaaatattaagacccctcaaaataagcttattaaatcgaggaagagatgtagccattagttttcaacaacaaaatatcagtattttcaaattttatctctatttataagggcaagggggagatagaaaatgttgtgtttacttttcatacaaatttatgttatcatgaaacaaataattaatgtgcctcactgaaattttcataggcacattgaaatttttgaaaattggttgaatattttaaattttgggttgaacatttcaattgaaagtttttaaaaatttgagtggttatttttcagaattgaattttttatttgtttgtatgtggaccacttaaggacccacatggaaaaatcaatttttccatataaaggtgacttaagaagccgtatgcaaaaataaaatttgagaatttgaaactagtttatctcactcatatgaactctaaattggatgattttctttctaaatgtttctaaaatcatgccctatcatgttattgtgttcttactgctattattttggccatttttttcttgtgactttgttttatcaattaaaaatttgaattttaaaacttcaaataatattttgaagctgtaattaattgcagctaaaaaagttgtgaacataaaagttgtagatctcatcaagacatacaacttttattttggtcatttcttcatccgataaagtgataataatattgttcacaaagtttacatatctctattgtagtttatagaaccagatgagatagatgtaaattttgtgaacaaaggtactatcactttgtcggatgacgaaacgatcaaaataaaagttatagatcttgatgagttatactattttgttgttgataacttttcagttaaaatcatttagtattgcaaaatgttgtttgaagttgttatattttgagattcaaattcaaccggttcaaacaaagtcatatagaaaaatgaccaaaacaaaagttgtatatgttgatgtgttatacaactttgtttttgacaattttttcatttgaaatcattaactacccgaaaaattatttgaatttcttatattttaaaattcaaattttatatagttgaatcaaactcggaaggagaaatgaccaaaagaaaaatggtagatctcaataagttatacaattttgtttttgacaactttttcatttgagttgatttagttccttaaaattcgttttaaagagccacatataaaaaagaaatcgatttttacattgaaaaaaatccaccattttttcccaaccttatctactcttgactcttcctctcctctctctcacagactcacactttctactctatctccctctcacttccctcatccacagcggcacggggcggggcaggcggcgaccggcggctggccgagagcggcgcaacgcgtggcgggcggcagcggcgggcaggctcgcgcagtgggcttgagcggcgggcggcgacgggcgaaggcagcgggctcgactgccgcgacggcttcggtgggcgtcgacggcgtcggtgggtggcagcggcagggggatccggcggcgccgccgccggatctggccagtccctccgccttttggccggagtgctggcggcggcaccgtggggcggcgcatgtggagtggctcggtcggtggtggggagggccgctgcggcgcgagacggcggagtccggcgcgcgcgtgggtgtcggccggtgcacgcgtggcggcgcggagactggcgg

SEQ ID NO: 47186 - DNA, 12330 bp, Oryza sativa
atccgaattcgtttccgaattcgagaagttccggatagttccgaccgaatttttccgaatctgaaaattggtccggacggacgaaaattatccgaaccagtttcatccctatttgctacagaatgctagagcgtgcggtcccgcggaacaggtgcgtgccgtgccgcgggggctgaatccacgggaaacctaggctcgcgtactccgttcgcatgcaggcctcgtgtgtggactttgccttctcgttagtttgggccgagcagcaagcatgtcacgggcgttcttctagaattttggtaattcctaataccagaaatcttcaccctcgaatgttcaaaaccgtgcaatcaaggtcccatggcagtatatatgggtggtttcactgatgtggcatccttatcagcaatctgggcccacatgtaagtaaaaaaatcatatgtggtctgcatcccttctttccaccattttcttctttttaattttttttctcttctctttttgttattctctttgtcggcatgccacggagggggagcgacgagcggccagagcagacgggcaagtgcgcggcggccggcagagcggagcggcgcggcggcgggcgagcacgtggccagcagagcgaagcggcatcggtgggcgagtagaacgacggcggcgagcgaccggagcaggctgaggaggagatcgacccgtccactccgctccacgtgttctggaggaaaagttgaatttaggtccctataatataagtcaaaatctacttcgtatcctcaacagcaaaaccaggtatatcaatccctccaactattgttacatatcataaggtattttagatttgtaataattaagtcaattttgtttatgtttgacaaagtttattagaaaaacatagcaacatgtaaaacactaaattagtttcattaattccaccgctgaatatattatcatagtatattgttttgtgttagaaatgctgcttaggaaaaattaaaacactttacaatatgaaacatgagttagttaaaagaaatatgaaacatgagtaattataatagttataaatagagtgaaagtacttgaaagtttgaaccaaatggtatatattttatatgcttagtgcaattgtatattattatttgaaaatgcttagtttaactttctaaaatcaaaatactacctctattttaatgtaggacgcttttcgacggactatgcgtgcctaaggtatttgtagagtttggggaacgttggaactaaggtgtatgcgagatcgtatctagcagacaaggaacaagggtttatactgatttggggcttcaagataaataacaaccctacttcagtttataagtatatatctgaggaaacgtatcacacggattacaatgaaggagcaaagtggctaatctgatctacagactagaatccaccaagcaccgctcggcacaatcttatcggtcactaggcttcaacttccttcagatggtctctcgatgcggctttggctgtggcttgtaatttgatgtcttcaccttcacgggggtttgtatttatagcgatgaacaccttttctccaagtagcactcgaaaaacttgattggagatggaccaaggaggccttttttttaataggactctcacactttctatcccaagaaaataatttctttccagatttactgtattttattaattaattataccttctggtatatcattaagtatgtgatactcctatatattacgaaaccaactataggatgtatgccttattttaacactgacaacactagttattgaattttggaatttacatttgatcattcgtctgattaaaaaactattgatttattttatcattaaagagactagactcgtatttttttgcatatttgcattaactttttaataggataaatgattaaacgtcatttgataaaacttaacaacatcttatgtttaaaaacctaggatggcatacatcttatttaaaaaggtagtggagggagtatatatttcctaaattacattgtcggtaacctatttgcgaagtagcaacagtactgcttactatacaccgactaaaataacccaacacgtgcaagctacttgattgcgaccatacagcacgagcacgagcatctccatgatcgccgatcaaacctccaagctatcatgtaaggagtaccaacaggacactaaatatagtttatataaacttcacattatcaagaaaatagtgctttctccgtttcacaatttaagtcattctagcatttcccgtattcatattgatgtgaatgaatctggacatatatatctatgtagattcattaacattaatatgaatgtggaaaatgctagaatgacttacattgtgaaacggaggaagtatacactactctttcaaggtaaacatcactttttcatacttaaatttaatgctactttatctcacatgatgttttcgatgttgtgtatgtctcatgtaacatctggttttcttttctttacttatttattcacttggtacatcatctttcattagaggtgacagtttatttaatactatagatatcatcttagtcattgtgatatgactggcctagtaccacgaagcaacggacaaaaacgacggtgagtatattttctcatctaaaaattacacatgtttagtttttttaaccgagttgttcactacatcaatgccagctcgacattttatgttcacaaatcacaaatggccagctctctttaatttgcatccaacgtgtagctcgatcatgttaattaagcgactttagcaagatcacttagaaccagcattaccggcaacaataatggagctacccccatggccctcattactggtcattgtgctcacagcagtcgtcttcttcctcgccaccattctctgccatggccgacgcgtgtataggctcccgctagggccaaagccatggccgatcatcggcaacctcaacctcattggcgcgctgccacaccgctccatccacgagctctccaagcgctacggcccgctcattcagctccggttcggatcatgcagggaggaggaacggcgccggcaaagaagaacgacgccgaagagggtggggcttcggccatcaatggcggatgagaaacgggcggcataaacggcgattaagagctctattgaaggggaaaacatagggaagataaagagggggaagaggaaaaccgattttcgcattcaattggaggagaaaacgcttgtggaggggtatcgacatgacggcggcgctagtttcttcggccgggagaggaacgggcggcggctggaggaagactgtagcgcccgttccgtcgtggcgcctagcgggaaaattatctcttaaaaaccctaattgcgaaatttgtttctttgcttgttgtctagcgtccgtgccatctcaagatctcaaatcctcgatctatcgtcgagatcaattccgaatccaaatccttccaaatcaaattcctccgcaaaagtctattttgcctcccccgggttcgatgggccgaatctctctcggcccatctcctcctccctcccgggcgctctctctctctccccctccctcttccgctctgcccgcgcgccgcgcgcgcgtgcgcgagcgccgcgccgagcgcccctccctcgctctgcccgcgcgtgcgcgagagccgcgtggtcgccgcccggccccgctgccctgccgcgcctgcagccgcgcagccgctcggccccgcgagccagcgcgcgtgcccgagccgcgccgctcgaaccaccgcgtcgcccgttgcttcccgcgcgcgcgtgccgtggtggccgaccgcctggtcgccgccgccgtcagcctctgccgcgcctgcccgcgcctgccgcccgtgtcgtcgcgccgctccaaaccaccccgccgtcatcgccgacgtcatagcccggcccccgccactccgcgcgcaagccgccaagggacggaggcagagccctcctccctctgccgcgacgcccccgctcccctcctccttttcccaaagaagaaaggggcgagccccctttctctccctccttttccccttttttctcccgccggcgtcatcctccctctgccctgtcgccgtttggacgcgagcgccgagcgccagctcgcgccttgaccgcccaagtcggttccaaaccgacattgccgcccttaaagccccgggcgccctccccctcttcgcctccacgacattgccaccgcctcccgtgctctgttcgccgtcgccgttcgtcgttgcgcgtgtcggaggagccggcacgagcaaggacgcggaaggggactccaggcgcgccctctccttcctcttccccggcccgaggccggagagattactcccgcgccgtcggcctctcgtcgttgcgcccgccctcacggtagtgcatctccccgttctccctcctcgttccatctcctccccttagactcgggtagtagcacgagtagcctccccgtagctagccggcgccgccccgaccgttgccgtcgctcgccgtgtactcgccgccgtcgccgcccgagctccgtagcacccgctcgtcaccggcctcgctcggcgtagctccgcccaatccgacgctagcaacggattcccgtagccgcgtagatgctctcaccaccgggaattggcctctcgtgacctcgtcgccgtttcccccttctcccgccgccggttgccgccgccgcgattcgccgccgtcaagctccctccggcgaatccgagccgttggctcgtctcccctcgtctcgtgcaaccacccggtgtgctcgctttcgcctgtatcgccgtggttcgctccgccgctcgccgctgtcgtccgccatccgttccggccggtgtcgtcgtctacctcccgccggcccgcgtggcagccacgtaggcgccacgtcggcgccagctcggccaagaccgggtcgagccgaccccggtcagcccctccccgtgcgcgcgttccaccgtgagccgtgaggctgcgcgtgggcccgccgcatccgcgtccaccgcgaaccgcgcgcgtgcaccgcgtccctccctcgcccgcgcgcgtgcgccgcgtgctcgctccgcacggtgaaccgtgtcaccgacaagcgggtcccacccgggaccacgcgtggtgagcccggtccaccggctctctctctcctcccctcccgcgcgcgcgcgccttgggccgccttgggccggccggcccatttagctcggccggaccgccccatttctctcgggccgcgccctagccgcccgaggaaagtctattttccctccctcttttcttttcttttcttttctttttcaaaaaggatttaattaaatccttttcctttagaccaaaaatccaataaacttagaaattcaatatcttcccaaccgtaaatccgtttgactccgttcaacttccaaaattcctcaaatcccgagatctatctaatggctcgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgatacgatcgcacttaatctgtttatcccgtctgcaaggcagattggcggacctacctagtttgttgcatttgatccttcctttgttaattgttataccatgttcccttgtaaccacccagttgcgcctcggaaatcatgaactctgtgcgagtaccgacggtcgccttcaaacttaaaatctgagtaacttcttgggtaaaacttgggttttacaaaagacttggaaaacccgacacctgggtcggtgcttgcgaactaaatggattttccaaaaccgcggaccggggaacgtaccgggtgtacggtttcccgctcttgcacctaaggaccgtttccttggaattttatccgaacataagacaagtacgaccacatgggtggaatgggacacccctggctgagtaactagcttatcagggaagccttgatgccgagagacatgtggattcgccggggtggtgtcggggaggacccctgggctttctggcacagtatggtctgggacctaacctgttgttggtctgggacccctctcgtcggcatatggtaaacctgtgtcggctttggaaatgccttgtcacgaaagcttggaggtctcccgacgtggctgatccccacgggctgggtgatccgggttagtaatgtcgtgtgggtaaagtgtacccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacatactctgaccggacgagacgcactgtctcatccgtgtcgtttgagaagcactcacttagttgtttttagaaaagagttcaaataaaatcaattgcaaaaaaaacaacagcctttctttgaagcctgcattaaacacttatttcccatggcttgctgagtactcccatactcacccttgctctatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagaccactgttgctatgataatccgtcttcctgtgataccagcactgtttcctgggactggtatcgattaacaggttaatttggagcgtcacgggctagttccggtcggtactagttcggggcgtgacaaagacgatgacggcgccttcctgggccggctgggccgcgcccgagcaagggagggggagcagatgggggctcggccgaagtggctgcagcccaagggacagagggaagaagaggctggccgaggagggaaggaaaaaagcggaaaggctagttagcgcgccggcggcgcgcgttttaggccaagaaggcccagcgccggcgcgcgccccctcctgcacgctctttttttttcctttttttcctttttttccctcactttttgtctgattttttttatccttttagcatgttttgagtttgaaagtttttaaattttgagttgaaaattttcaaatctggatttgaaagttttcaaatctcgatttgaaaattttcaaatttttcaaatctggatttgaaagttttcgaatctcgagttaaaagtttttaaatctcgagttgaaagttttcaatttttttcaaatctggacttgaaagtttttgaatctcgattctcgagttgaaagttttcaaatctcaagttgaaagttttcaaatctggatttgaaagttttcgaatctcgagttgaaagttttcaaatctcgagttgaaagttttcaaatctcaaattgaaagttttcaatttttttcaaatctagacttgaaagtttttgaatctcgattctcgagttgaaagttttcaaatctcaagttgaaagttttcaaatcttagttgaaagtttttaaaatttgactttaaaatttaaaacttaaatcgaaagttttcaaatctaactccaaaaaaatttccagaatattttcttaattactatcattagtgttaagtatattaactaatatatgtaattaagactaaaagggagttcgccaggtccttttgcggcgcgcacgcgcgcgctagcaatccctgggaaaaggaggcctgagaagaggggaaggggacctcagcggcaggtcgaggaaggaaaaatggccttaggatcggaagcgacccaaggataaagagagatttatttttagatttttcattttaattaactctaaatttggtttttgttgttttaaaattatttccggtgctttgaaaattcaagtaaaaaatttagggacccatttagagcatggaggatttcataaaaatactccaagccactttcgaatttttcttgtacatattttagtgcttgagatttcttttagacttttaataatttatattactcattttagaaagtgatttttaacttgggatgaatttatcaggatatgaaaatgttactcctgaaggtgaattctctattgtcatctctattttgactgtttcatgaagtatgaagtatgtacgactatcgttagacgaactctagtccctccgctctaaaaataaattaacataatacgagatataattagatttgtttattttaaagcagatgaagtataatttatcaacagtagtcacacatacttaataattcgtgaatatcccatagtatattagtttattttataacggaagatactatatattagtttattttggtacggacataacagggtagatagatacatagatagatagatagaaatagtcacgcttgctacatgtgaggagattgaagagtggacgtggactgaccgtttgaaacggttgattgacaagaaatagtctcttcttggctttatatctcgtggtgttaggataatgtcgtatttttatattagattggtttgtttgggatagagagagtaggggtagatagatagatataattaagtcacacctgctatagttttttaaacactgtttgaacaattgactgaccagcaatagtttatttctgtgctttgttcctaaaataaagggatgtaatatagcttaacactataaatctagatgaagagatgtccagatttacagtatatgatatgccaagtcctaccacggatggaatagatatctgttgctcgggtgatagagatagatgtctgtcctttttcttttggcaagaacaaactttaagtcgggtgactccgttaggatttattaacagcataaatggcattgcatattttgtatactaatgatgtcccgcgttttgttgcggacggatatatattagatgttggaaaaataatgaaatgatttggattgaaatattataaaaatgatttgagaatgatgatttagcatgtgtatgtttagtttcagaatgaaattaaataaatagtagatataactattatatgcttgtatgttgtgttttgtgtactaatgggttgatgtgacatacttgtatgtaggtttttaggagtgataataaatactatgcttgcatgttgagctttaagtgtttagtgggtattagctttatatagaaagaaggaatgacacatttgatatttttaatcagtctgacaattttaagattttttttcaaatagactagataaacattttttttccttttaccgaattggacgtagactcgtttgatgcatgtcaactataaagtcataaaaaaatctttaaaaatggaaatatagattaaattgtgatatttcgatctatagatttgatttatacaggtagaaaaaaaatcttaatttgatttatatttgataatttgtgtttctattgtgtgtatgtcgaatttgaatttgtatgtcatatattgatctatcttattaaattgtttaaaattttttgatagccttgtacggggtcgtggctagaaattgaagacccctgtgtgaaacgcataattagaacccgccctcctaagatttaaaagtacggcgtacaacaaaaacaacgaagatggtgtcttgtatgtaatgtaagtaaaaggaagagttgaagagataaataccaatagaaacaaaatgtagggcctttcttttttttttttacttgtgaagtatgttgtcttttttctctattagtttgctttcataattaatactaattagtactaatggatttgggccctaatttggggcactaaactggtgcgtagctcaatgttccggtcaacggccctaccttctacctcataattaatagtatatgcctgcagtactgtgtatgaactggggctgtatttagattaggggtgaaaagttttaattagtcacattaaatatatatagacatacatttaaagtattaaacatagactaataacaaaacaaattacagaatccgtctgcaaaatactagacaaatttattaaggcaaactaatctgtcagtagcaaatgtttactgtagcaccacattgtcaaatcatgtagcaattaggtttaaaaagtttgtctcgcaatttacacgtaatatgtgtaattagttatttttttatatttaatacttcatgcaaatgtccaatcattcaatgtgacggggtgaaattttttatcattggatctaaacaggcccggatatatatcttaatcttgtccagtccatcgtatatgactgtgggatggatgaactctgctactgctaccagccgtagcagatgcactgatcgagcattctagcgagtcatccatgcactcacattactgtatgtatatgcacatatcaatgtgatatcactaggattgccatttcgatgttaaaaaaatatatttcaatttgaatttgaatttaaattctatgtattgtaagatgaaatagaggagaaaaagaaatagaggttgttgttggagttagaaccatttttagagtctcgaggaaagggggacagcccccattcagggtttatcttatcatttgggccggggttaccgtcaccccgcaatagcgcgataaccgcgataatcacctaaaatcgcacaaaaattacatccaaaaattcgaattcaaaacttggcggtttcgcggtttcaccacgataatcgtacagtttcccgtgataacctcgatattcgcacggttatcgcgagctgtgtgtagctaaaatcatgtaaatgaaaaataaatatggaaaaaaaaatcaaaaatacggttgaatatgtgtagaaaactagaaattgagaataattggaagaatacgtagaatacttaaggcctaatattgtcttcctttttccaatttataaactattttcggtttttccctcaaatttgaatttagctttctctatttcaaaaaatttcttcactattagcaattacaaatcaagaaccacatccatgattttttttttcatttttttttgatttttttccggaattttgaatttggtcaaaattcatccaaactatatcgccggttttccctatcgtaccccatgataagcgcgataaccgcaataatcgtgcgattatcacgcgataagtgaaaccctggccccttttaacctttaggaactttaaaaggagctattgctgaagatgctctcaaagaggaggggttagggcccctcatatctggcacacaaaacgaagcacatattattaattaactattagctaaaaattttaaaaaataaattaatataattttaaagtaacttttctatatatttttttaaaacaaaatacaccgtttaacaatttaaaaacattcgcgtgaaaaatgagagtgaagtcgataactttagacataagaccacagccaaactgcctagtcaatttgcgatcgcattaccaaactggctacctaactccaatagtgctcaatcatgagcatataacacatggtgttagcgctgtagagcacgagactcacactaatcaatctgacgacatggagagggaacttaggtagcaaactcacaattgaacatgatcgatgcacatcaacagtgtgtacccatactaatttaatggaaataaggtttctaaacataaaaatgaaataataaaacatcttcctagactaagtgaagatatctcccccatccaattaatatcctcgcaatactacatgcgcagtactgctcactcacatgtgggtagtcattgagcagtcttgcagacgacttgtatccctccccatgaagcttttcccgtttatgtggctttgctcctatttgttatattgaatagtgctatgcacctaggtcattcaccaagaattaaaagcacataaaagtatggcactccagagggtgactagctggttcaggagcttgactgacataatgccgctagttgaaagg

SEQ ID NO: 47187 - DNA, 13377 bp, Oryza sativa
taaaaagtcaacggtgtcaaacattttgaaacggagggagtatatttcagtcttcatccttgtagcaacgccgaatcctagaagcgagttatagacatcgtgggtgctcacggcgttcttgcaaacgagtcggcgggccaccttgggtgaggggcgacgaaagaaccttgatttgtggccggagcagttgcaatggaagcagcgcgtcgagtctcggcaagccgctgctcggtggtctcgcaggcagttgaagcacctgcctagaatttctatctagaagaagcgcatcaaggtgggttcaacctagcgaagttgcgggcggcagggataggccgcgcagcccctcactcgctagacaagtcgcgcatgagccgcgtgccgccgagccacagtgagggtgggcaagaagcaggtaaggagctagcgtcggaccgagcgagcaagcggtgggcgccggggccgtagtggccactggcgcagagatggtcgcttgtcgcttgcctgctagtctcccgttatgactttaaaatccttcgagaagtatgtggtcgaacacatctatctattatatactaaaagtacattaatttttctataatactgagaaaataaataaatgatctaacaattgatttttacttaatccaatgatcccataatttgaatcattagattagatctactttaaaaaagcccgaagtatcctatccacataggtcccctcccgtgtgtccatatgtgcgacgaatctacaaacacccataagtaccggcctccccatccctctgcctctcgtttcccttccaaatttctaggattaactcaaacaaagaaacatcccgatccctctgcctctcgttttccttccaaatttctaggattaactcaaacaaagaaacaatcaacatttaaatttggtcccatatttttttagagaagggtatttttacccggcctctacatccaaccggacatatgtagcctttctaacttaggaacttagcttatcaaatagggaacttagccctcaaataacacaatctaaaattcgctcctatggatatttgaattcaggaccttagggcgctactcaagtcactgcaaccactaggctacatgccctttcacggtcccatatattcttaagttgtatattcaattttgaatatgtttggactgttattttatttataattagatcaacaatttaagacacattgatatcctacaaatactactaagctacacgtgaaactctagagagcaaaatttatactttacaggcaataaatgaatttaaatatttgagtccacagtccaagttctacctccagcaaagagctcagaaatgggatgcgtactctggtccagattccaaaggaggcagagctgcaagatgtgatcagcaaaagtggatgctgacctactacaaggagtttgtaattaaatttcaaaaaaaaagaaacattcaaaaataaaacaaaattttcattaaaattagaaataaaaatatgacaagtccatgtagaatataaaatatcaagagtccatgtaaaggtataagttataaatatcggaaatttggaataataaaatgagtattaaaagaagaacccaaatacaacacaacacaatttaaaatccctaaaaaagacaatttagaataaaaataattaaactacaaatttgatttcaatacagatttgaaattataatcactcattcgctaaattcagaataaaaaaatactttaaaagagctttgctatctttattaattcacatccatgtatatgaatcaattaaagagaggtaaaataaaatacatttatttagcaataaaactttctcaatcttaagaaaaaagacagagacaataaacattcaattaaaaacaaaaaaatacctcactttaatttaggcttattttgttagacctatttccaaaacaaactaatatgcatgcctacgatttatttttattttttaaaacatttttaatataatattttaataacagtctatggcaaattttattttcaaatctaaaccttttggtcacgccaagaaagctggcattgcaaaataaccctataatgccacaagtattggtgtgacaaaacatgtcacgctggatcgagaagccacattgtacggctgccacgctagttaaactagcgctgctaaaccatgtagcaacgccaacatgcatagcgtcgcttggcaggcctacgtgtaatgcaagatgaaggtgaagtactactgtagtattgctactccctccatttcaggttataatacgttttgactttggtcaaaatcaaattgctttaagtttgactaagtttataaaaaaagtagtaacattttcaacccaagataaatttattatcaattaataatttgatgaaactaatttagtattataaatattattttatttgtctataaacttagtcaaacttgaaacagtttgactttgaacaaagttaaaacgtcttataacctgaaacagatgtaaaacagatgtagtactgttttgtgaaaaagaaccttgtgtttgtgggttctacatcattttcttatgtttaattcgtaactgaagattttttggttgatctatctctcatagcatctatccagatcatggtatgcccacatatctatgaaatgagtttaatatgtgtgtgtatatatatatgtgatgactgattacataattattaatattttgtactttttaatgattgtgatgaaatctagctctttattcttatgatttgtatcacattgaagttactcaaggcgcagataaatggctttttccttgttaaatatatataatttagatggttgcactgttacagaagcattttcatgtgtgtatgtgtttcccaaattgtcggttcagcatggcatgtttcgtcacgtcaattaatgcttatggtgtgacaaggttattttataacgtcagttctcttggcgtgatcaaaaagtttagatttaaaaataaaatctgggcccgatctattattaaaatattttattaaaaagttttataaaataataaccatttcctacgatatttttatttaaaaatctcactagctagctatttatctgcattaaaaattcgctgccttacaactcctagttaacttgatagtaaaacgtggccatgattcacagaacttagacacatccatatgaccgtatttagtttgttattaattactattttactattactattgaattctaaaagttatagactaaatttagccgtgcaatttggatggacccttgcttgttacatggccagttacttgtttggaaggtagcaacagtacactatacactgactaaaataacccaccacgtgcaacactacagatgctgacttgattgcgaccaaacatcacgagtgagtaacatgatcaccgagcaaacctcctagctatcgtgtaatgccgcacagcaaaagataaaacgacagttaatattttctcttctaaaagttacacatgtaacttgcttattgtgtttgagactttgaggtgaggaacacactcctaacgcatcgccggcgctttgatttctataagatataataaattaagataataaatttgtgtgatatacaaatatatgtactccctttctcactgagtaagacgtatacatgttttaagatccaactctttgaccaataatattcttttataattaaattgatttttatttaatatcattgggttgatatttgaatttactttcgtataactgtgattgtgttgctacaaacatcgtaatatttgagaaattcaaatataaatattagttttgaataccatgccaggtttgatcatgccataattagtacggtgaagggagtatagttaaagtttttttttatagcttgtataaattgaatttaaacttacatgttttctagactaatatactattaatctatcttttatcctttttataactagttactctaattcggattaggctttgtttaggggctggtttgcaacaaccccgcttttttttctctaaatcttaaaataacttggtctggtctctttgcgggctgggcgaaaaaaaaatatgttacacatgtctagattttcaacacagttagttcactatataagcatcagcctatcagctcgacattttatattcacaggtggccggctctcttctgcacacaacgtgtagctcgacaatctacttagcaagatcactttagaaccagaatcaccagcaaccatggagatggagctaccatcatgggcctcagtactggtcattgtgctcgccgccgtcgtcttcctcctcgccaccattctccgccatggccgacgcgcgtataggctcccaccagggcctaacccgtggccgatcatcggcaacctcaacctcattggcgcgctgccacaccgctccatccacgagctctccaagcgctacggcccgctgatgcagctccggttcgggtcattccccgtcgtcgtcggctcgtcggcggagatggccaggttcttcctcaagtcccacgacattgtgttcaccgaccggccgaggaccgccgccggcaagcacaccacgtacaactacaccgacatcctctggtccccctacggcgcctactggcgccaggcgcgcaagatgtgcgtcaccgagctcttcagcgcgaggcggctcgagtcgttcgagcacatccgcggcgaggaggtgcgcgcgctgctgcgcgacctgcacggcgcggcggcgcccgtgctgctcagggactacctgtccacggcgacgctcggcgtgatatcgcgcatggtgctgggcaagaagtacgtgggggttgagggagcttctgccggcaacggcggcggcggcgaggggacgagcccggcggcgacgccggaggagttcaagatgatgatggacgagctgttcctgctgagcggcgtgctcaacatcggcgacttcatcccgtggctagactggctcgacctgcaggggtacatcaggaggatgaagagagtaggcaagaaactggatcggttcatggagcacgtcctggacgagcacgacaaggtgcggcggcagcagggtgataggtttgcagcgagggacttggtcgacgtgctcttgcagctcgccgatgaccctaacctcgaggtccaactccggcgtgataatgtcaaggcacttactcaggtgatcgatccctgctcatcatcctactgcagcttctttactcaggtgatcgtcctttccatggcacacggtgtaagctagctcttccatatgtggtgcaggacctgatcgccggcggcacggacacctccgccatcaccgtggagtgggccatttcggagctcctgaggaagccggagatcctcgccaaggcgaccgaggagctggaccgcgtcgtcggccgcggccgcttggtcaccgagacggacatgaccagcctcccctacgtggaggccatcgtgaaggagacgatgcgcgtgcacccggtggcgcccctgctggcgccgcacgtagcccgcgaggacgcctccgtcggcggctacgacatccccgccggaacgcgggtgctcgtcaacgtgtggaccatcgcccgcgacccggcgctgtgggactcgccggaggagttcatgccggagaggttcatcggcagcaagatcgacgtgaagggacaggacttccagctgctgccgttcgggtccggccgccggttgtgccccggccacagcctcgggctgaaggtgatacagctgagcctcgccagcctgctgcacggcttcgagtggaggctccccgacggcgtgtcggccggcgagctgagcatggaggaggtcttcggcctgtccacgccgaggaaggttccgctcgaggtcgtcgttaagcccaagctgccggcccacctctataccgggccctgatgtatctatatgtcagtacgtgggccattgataccaatacttcccatgatctctaccatggaataagtttgttatggaatattatctcctcgggagataagattctttcttgtgaaccaatcccaactagagtgagataagatttatctcctcctaaaaccgctgtatatggtaaacttgtaatcaagatcagatttataattaagagagatttcaccctatatatgtgttcactacttctgaaatgttcttgaaggcaaaaggaagggcatgagtgttctacacaatctcatgcatctactgctgtgagagggatagggaacagatccggtgatccactaataggcgtatttggtttataacaaagttcactctaggtcccttacgtccaattcaaatttcgtccttcgatgatatatccctcaacttataatactgatatacttgatgtcccagagcagtatagaatccaattttggttgatgtgatggctgagtcagcgtggtcctatatgtcagtgccccaatcttcttccacctctctcccctctcttcccatctcaatctaagcctccaaggcgacgagcggcggacggcagggagaagctcgacgacggcagccagtggggagaagccgctgcctaccggccaccgcccgtcgccaccgttgcactgtgggccacgcccagagggaggttgcgatgccactcgagctgtcgtggggtctatccttgatcatgggcacgcggaagactattcttccccatcaagcggcaccacttccttaccaacacccaccacacaacgacctcgttgacatcaccgccaccaacattgtcactgtctgcaccccaacatcactgccaccaatgttgtcgctatctacgtctcctgcctcaccatcctcatcgttcaccacatcttccctatgtaaggtagctcatcttcacaagaaaactacaaatggatatctcaatcatcaacaaaattaaattaccaccccaattcaagcttgatcatgtggacgccttcatggaggtagagcaacatacactcctggtcattcgagaccttgacagcaacttcactgtcaccgcctttaaagccagccacttccccagcaccgtaatgttcctcttctagggagactccttcggtcatgtcctccacactagcgactgtcacttgcccctcttccacctcctcactgactacgtcttcctcaaccgcaccttcgtcgccacctactctctccacttccccaccaagcaaggggaaaggaccggtagcagcaaagagaagaggaagggtccggtcgccaccgttgagcatctatctgctgaccgccacccttctcccgtcagtcaccgctcactgccatcgagcttctccgcactgatcgccctggaggcatagattgacataggaagagagggaagatatgtggaagaagattgggccgctgacatgtgggacccacgtgggtctcatgctaactcaaccgtcatgttaaccaaaaccagagactatattttcctgggacgttaattataccggtattgtaagttaagggactacggttcaatgatataattcgaaccatactttaaaattagagacctagagggaacttattcccgctgccatattggtggcgttccggctttagcacttattaggcctctttttggatcgacgtacatgtcatgtctcttattttctttgcttcgccgtgattaacagaagtacaacaccgtgaagtaaaattagctacaccgggagccagctgacggcgacgaactagagcggccttataatccctctttgggaaactcataaagctgaaagatatcaccggataacacataccgatgaccgcgcgcccagctagcttgccaggacaaccaacatagcaacacataaacgaagccagaattcttccagcctccggtcgaacacttccaatctcccatcttgcccgtcatgttagcatgctggttaattaatcgccgtaagcccgtaataatcgatacgtgtcacatcccccacgtgtacgatatcgggctgcgcacgtcgtgctcgccgttgctccaggtcagccacccgaacgcggcgtccgtcgggccaccgggcgtcgtcgacttgaacgtcacggtgtacctcagcttgtccccggccttcttgaacgcgagcctcgccggcttcacggccacggctatgtcgctcggcccggtgaccctcgcggtgtacaccgacctgccgtcgccgacgttggtcagctcgcgccggtacttgacggtggtgctgcgcgacgacgacgaccgccggccgaacacgacggagaacgacgggtagttgaggtccccggggctggacagcttccgctggcacgtcacgttgggcgccgccgtgatggcctggacctgcggcggcgacgtgccgacggagcacaggaaggcgacgtagtcgtcgacggaggtgtcgtagacgaggcccggggagagggccttgacggggtccacgtggccggcgccgatggaccacggcgtcgccgtggtgttgctggcggcgtcgacgatcggcgagccggtgttgtcgacggtgtatgcggtggtcatgagcgccgacttgattgcgctggggctccagtccgggtgtgccgccttgacgaaggcggcgaggccgctgatgtgcgggcatgacatggatgttcctgcgatatcacgattgagtctttaatcactctagttaattttatggctcaaaatatataattaagctgagagtgcagctttcagcaatgtaaattacgaatctactaccaaggttcagtgcaaaaaaagagagacatagccagacacatgtcagaatatcgtgcaactaaagtcatgccgactgtcgagcatatcatgccatttgggtgcatgcgaactgcactacagcacttgaaagctaaacagcaccatcatgaccaaatatgatcataacggcatcaaacagctactgttagctggtactgatctattctcgagcacgccggaccgtaaagtccgtgctcgaactttcggtgcaacacactaattactaattagagtaagcaacatactttcagtcggtatactacagtctacgtacagggctacttgcatggagggggcaaagcgtgcactgacctgacaagatgttgaacggcgaccgccgctcgtcgacggtgagcccggtcggcccgacggaccccgtccagccggcgaggatgttcacccccggcccgatcacgtccggcttgagcagctgcgccacctgcctgttcggcccacgcgagctgaacgcggccaccaccggcgccggccgcacgtcgagcgccgtgccggcgaaggttagccccacctcggcgtcggcgtccgactccacgtacctccttatggcgtcgccgctcttggcgccgacggccaccgcggggagaaggtggctgtcggccacgacctcctcgccgctctgcgcggtgttcgcgagcaccataccgacgccgccggcctgcttcaccaccagccccttctccaccctcgagttgccgccgcggtcgcacaggaccaccttgcccttcaccgccgccgcgtccagcgtgccctccatgcagagcttgctcgcattgctgccggcgcggatgcctttgttgtacacgaccgggagcttctcgtcgccgagcccgtcgccggagtagagcgacatgccggcgtgggtctcgccgttcccgagctcggcgtacgccgggaagttcctgtcgagcgtgcctgcaccgacggtgatcacccacggagcagtgttcaccagcgacgacggagaaggaccactgttccccgcggagcacgccacgacgatgccgcggcgagtggccgcgagcgcgccgaccgcgatggggtcacgcgagagcgggaacgcgccgccgccaagagacagcgagagaacgtcgacgccgtcatcgatggccttctccatgccggctagtatgtcggagctgaagcacccctgcctccagcacaccttgtacgccgcgacgcgcgcaccgggcgccatgccgcgggccgtgccttccgcgtagccgaggagtcccgcgtcggccacgacggcgccggccgccgtcgacgccgtgtgcgtgccgtgaccgtcgtggtccctcggcgaggagaactcgaggctgacgtgggaaccgttcccgccgccgccggccccatatccccggaagaaggcgcgggcgccgatgagcttgcggttgcacatcgacgacgggaagtcggtggcattggtctcgcagctcccgcgccaccgcgaaggcaccgggcccatgccgacgtcgccgaagctggggctctcgggccagacgccggtgtcgagcacgccaatgatgacgtcggtgctcgcaccgtcggcgtcaggggcgtcgtacggcgggaggtggaggaacagaggcgagcgcgtggtgtggagcgggaggatgacgtcttcatggacggacgcgacggcggggtggccgcggagcgccgcgacgtgcgacggcaggaggcgcgcggcgaaggctgacggcgcggcggaggtgtaggagtagaggagatgacgcgaggggtcgacggagagggaggccaggtgggcgtggtgccagtgtaggtgagtggcgtacggggccggcttgagtgccgggttcaggtagacaatgtaggtcgccgccccatcgccggcgccggagacgagccgcacgcacgacgagacaacgacgaggacggctagagcgaggaggaagggtggctgctgcatgctgggcagtgttagcgaatggagggagttgtctgtgcgagccgcgttcgattcaaatataggagtggcatggcatcaacctgggtagtacagcagcgcgcgtacagtcgtctcgatgtcctgctggtaatgtggtgatgtgccgtctcgatcgatcaccaccgaaaacgcgatgttcgtacgtgtagcgtccctagcgaacagacatgcaatcgttggagtcaacatcgacttttttttctccctggtgaccagctgcttcggcatactgttaaagaaaaaaaaagcgcattaagcactgggatcgtgttcatcatgcacgtcctcctccaggccagccttaacgcaattatttggctggcccttcctttacaagcggcacggtccgcggccgcgcacgtcgcggcgcccatagcactcctctccctagccctgcctcgttgtaacactacgacgcacttgagcggcgtgtgccgccgccgtcccgccgcgatcggtggtcgggtggatttgtggggggggggggggggggtggatcgctggtgcgcgtgcccgtgcgtgcgtgagcagtgagtgagctctccttcctttccaccgaggccgcggccgtcagcgcgcgcggggcgcggtgcgtcgccactgcgagcgaccgatccagcgatcgcgtgcgtgcgtgcgacacttttcgcccgcccgggcctggtggtgatctgatcgtcgcgctctctaatattgcgtcgcccatgcctccactttctcgggcgatgaaccgcgtggctccacgcctcggcgatcgatggcgcggattggcagctagctggattctgttgcgaaaggtggacatggaagatgcactttcttactcgccatgttggggaggcaaaggcaggggcgcgatatgcgctatatcggcatatccagtgaaggagtggagtgatcgtcagtgcgtgtctgaatgccgccattgctgttcgtttggtgcgtgattgcgttttctcccttggtgatttgtcaatagtgtctgatggtgtcgagggattatttgctagtaaatgcaagcaagcaggactctttgatcaggaagctgcgagagattggttgctgcagcaaactgaagattggtaggtatcattgatctatctatcatgccaagttgccacactaactttgcagaagaactgtactataatgtgtgattgtgttcctttcttggttgtgtttagatggtggaaaagttggaaagttgagagaaagtttgtagtttggagaaaaagctggtagtttatgtgggacgtgacttcccgttgggcgtccgatgggagccgaagtaatcaaggcaattagcttaggttcatcccgaatccattccatgtttcttaaacaagtccttcaaaccatcgtgctaacaagccattctcctccgaaagtcccagagctttttctggtccatatgcatcaatcatcactgttttgttctgtaattccatttcattttatctattttcttcaagaaattccattgatgtgcttttctattgctctcattcattcctattcaatctattcaaaactatgggtactggtctcaatgggaaagagccctaattcgatatgtccttccatgagtttagatatctatgtatgaatctcttattcaatcccatactttttctcatttcagaacgatcagcatactgtgtgacttctacgtgacagttcttgcatttcatttgttgctttgcatgaacattttatattggaaagcccttaattaggaatttcatagatagagaaggacgggaaaaaagagagagactaactaactacccggatcaatgctgattgacgactgaataaatagccggaagcaacaactgcacgagagagaaagagcggatccaactaaggaaatgcagtacctgggcccaagtaggacaaagaaatgcaagtaaatgccctcgattcattccttttatgtgagtgggaaagctagctagaaatcaatgacaaggagtagaggctagagcaaaagggcctggcgtcaggttagttaaagcaagaaagtcaatgctcagtgtattattcgggaattggtttggaaagccttggtagtagtgcactcaaatcgacattgagattgggacatagccgcccaacgattagaccgaccgggggactggaagatctggaactttcctttggccgcaaaccttctttgaatacgaaagaatgcttgttttaaggcaatgcgagagcttaccagagaacaaaggagagtaatgagttgatagataggaggcaggcccaatgatattcaataaaggatagaccgaattccgtccgtataaacataatttttattttcttgtaaagtatttcttttattttagaggagtctctaaataatattcatcatcatctctaaagataaaggtgagttccagcagaatgtctattgaacaagagcacagcgaacttcgaaataagagactgaacttactttctttcttgcttgcttacttcttccttgttaatagtagggatcaagctagtcaattcaaaccttctccgcttacttgtaaccgcttaccatttgctgatactctagaa

SEQ ID NO: 47188 - DNA, 849 bp, Oryza sativa
ctgatatttcgaacagtgatatatgtgatatcctgaggggatatgccatacagccgaggtaaactgcttgaattgtcactttgagattagcacatttttccttatttaggggaaaagtggcatccagcacgggtccaataatttgatcgatatgccctgtacttttttcttcaattgtagaaaccccgggatgagaagtactaggattggttctcataattaaaaaaaaaggaatttatcgaaaattttcttttattctgttgaataatgccaaatcaacaaaaaaaatatccaaaaatccaacaaaagtcaaaaggaaatgaattagttaattcaataagagagaaaaggggtccagcacttgatttcattgcccaaacgaatcacattcaatcgtttactcattccatgagtccgtcgaaggcaaaccaccagaaccaagaaatgggagggatggggttaaaggatttgaattatttaacctcctagcgagacaagcgtggagaatgctgcaagaacaagaaagtttgagtgcaagggtgcgaaatgtatttccctgatgaagacttcctaagagcagacgtgacttcccgtcgggcgcccgatgggagccgattaaaatcgggcgctgatgtcagcatgacgtcagcgcccgatttacgtgcaaaaactattttaaactgatttttctcttaaactacttatctaaataatgatccgattgcaccattaaattcgtagcaattaaatcttcaaaacaagaccacacatggatatattccgacgaaattttttttagcttattattgaattatttttaaatgttgcacgatgttccactaggtatat

SEQ ID NO: 47189 - DNA, 10892 bp, Oryza sativa
atggcaagtatattgtgtgttcaaattagtgaaatggagaatcacttaacatgaaataatccagagagcgaattagtaataatggagtaaaattgcttattctaatgaagtactaatttcattagaaaacctggaaacctaaatcaattgaggtattctttttcagacagaattaagatataataatatttgtatctcaaccaaatagagaaaatatgatcagaagtatctgctgttatcatactttgaagcgggcatcagatataaattaggaaagggagaatgggcttacgttcagatggtatgatggacccatttagctggcgacttaggcccacagcataatcacacatgtcaatgatttcctacaaaacagaggttacatttatgtcaacataatcatgccttcatggtggagaatcaatagtcgcagttaaatattcgatcatgaaattatctcaataatggccaaattcttaggcaagacattcgattggcagaaagatgattaacagagagaaaaggaaacacaactgcatatcatgttaggggctaagttggtaattctagcaggcaaggtattgatgataatgaagcattcgtgatgagcacaccattaatgttctaaagataaatcactgaatattctgaagaaacacaatatagtggtcatttcctatcctgagtgcaaaaaacaatgaagctctgagtggaagaactggcggcaattatacctacctgaacctctccaatcccttcaggaagaattttccccatctcaagtgacacaagcctgcccaggtgatggagctttgctctcaatgcatcaccaatttgcctaacaatttctcctcgctttggagctggaatctggacatattaatatgtaactgttagtagttttacaataaaataacttaaaaaaagggatctcagctgcgcttcttccacatatttgaatttttgcatcataacagtgctgctagcttctatacatcatagtgtgcttatacatacatgtgtattttaattaaattttgatatcacaatcttataaattaaaacatgtatgaaatatgaaatcgtagtgtgcacattgcacacagtctctactttatcagcattttaacatcggacatactgttactttgccatttcccattttatatcagatttttggtgttcctgaatcatataacgagtccataccaccttctcaaaggaaggagatcctctgatgtagcaccatgctacggcatagggctatagtaccaggaattagcccttgatccttgtcgtttattaacggactaatggtaaaggtgagttgttacatcactttcgctacagtaatgattatcatgtacagtaaattaggtacagtaccgaacactgtttgctgcattagagcgctatagcagactcagattcctgtaaggctgtaaccaaaagctgaaacccccaaaacacccaagttacagggttttgaggcagcatttccaaacaaataatatcgcaacgtttcgaattgcacaattgctggtttccacacagtcagatctctcacgcagcagaaaatagcaaatgacacacaagagcatagtacgagcacttcatcatccgaacgaattgatatcagcactccaacacagcaagtcaagtgaaactcaccgccatccaggtcttggcggcatcgtagcaggcgcgcatgccctcctcgtactcacgcgcggacgcctccacgacctccgcgatgacctaaaccacaaaacacccaaaaaaaaatcccccatcaaaatccaccacaatcacacacaccccaaaaatgccagggcggcccaaaccaaatcgagcgcctagaaccgagcggatcgtgtggggggagacgcgcctggttgttcgtcgggttggtggacgtgacgacggggcccgagccgccccaggcgccgcaggcgaaggacccggggttccgcggcgcgaggccaagctcggcgaggaactggtgctccttcctcgcgaagctccccatggcagaagagagagagagagaggtagccctcctcctccttctagaagacgggttccttctgcgcccgtacggcggggaggggatcggggtggggtgggggaggcggtggctgtggctggccggcggtaaggaagggatacttatacggaggcggtggagtggggactgtgtgtcacgggaaggggaggagaagggagcgtggagtggcgggtggggtcaggagggggtagcagtagcacgggacgagacggcacgaagccgaaagcgtgagctgtttggtgaagtccagaaaggtcaaaggttttattttcccatctttttaaagccttcatcgtagcgctcttgtaaactaaaatttaataaaatctaaatttgataactttttaaagtttcttcatcgcattttattttacatgaatttgcttttgaattattaagcgcacgtatataaaagatttacttatagattagtttttggttgctaataagcaatgcaaataaacataaacgcacattcctttttccctataactacctttcatccaaaaacttttgtcttgaaaaactttcttaaaagggcttgggagtacctatacatctttcgaaagatttttataatcgtatcacacagatttttaatctttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatacactgtaaatttgagtgagaaaatcgagtgagagataagaaaaaatctttcgagtgagatatagcaaaattgaaaggactttacgcaattacgctacaaacacagctacgctaaaaatcacttcctttctttgtttttttcctttgttgtttagattttttttaagtacgtaatactactatacttgttgtgttgtatacatgtctatcatgccataaagttggttttggctatatttgcatttgactttataggtcatgatgactcgaattcgctatccaaataaggtctgccgtgttttggaaaagagacactccagtaagaaaaaaaaggaaatgaaataataaagcactctaaagtctagacataagagaaaaggagagctgggacactccaacatcagctgaaaatgaattttatgctaacaagatcgggtgatgcaataaataaagcatggataagagtcatgaatttgcttttggctagctagtataagctgagataattactcaaacaaaataagttggttttggctagtacatgtgagtatactccaggtagattagacaacaaaataaatgtacaataaccgaagtttcaatacagaagggcgcagattaaggagaaacacaagattgaaaagaaagaaaagaggattcatactagttggaccataaataggctagaatttatcaaaccgttttggatgggcttaccatcaccttatagtttgatgtttatcgtgataacagcacggatatcgtaaggtatattgtggtttcaaaaactgataaggttaccgtacgtcataatcgcgataactgtgtgataaccataagattttgtaaaccctagaatagtccacctgtaatgaacagaggcttcatatatgaatcatatgatggtgatcttaattagctcgcttttatagatttctgaagttgacaggaactcgcttttcattacaagatagagcgccctggtattactactggactcactcatagtgtaagcaacttttcaaaacacaatgtcaccatcatatgattcatataaattgacaaatatattatattaccacatcaatgaggagcaatcctaattgtaaacttccagtcaatccgtgttctctcggaaagtgacgtctcatcccgttccagtattccattccatctcattcctccgaccaaaaaaaatcacccaacataaccatcgaagtacaaacctattcttttattccctgagatttaacagtaacttcagtggagtgctagtaattttaacctcgttttactgacaggagatcgagccgtccaagtgtaactgtgtaagcgagcaccatctctctttctcacaattggccaacaaattaaaggcatttgtccctctgtgccaataatgcttggcatggatagctaaaagtattacagaattgcacacatgacagcgacagagtaggtcactgtgagcacacagctcacaaagccgtgccgtgtgtcgatgcccctctgtagcttgcatttcccggctttccgcgcgccgtcgcccgtcgtcgtcttcggtgcgaggatgcaagatgcgaggcgtgcttcacttggcctccccgtctgcatgtacgtggagagacgttttgggataaggacgatctttatcaggccggagtcgtcgttgcaaagaggcaaacacatcgattcgtttttgtttctcgttggctgaacgtttcaacgtcttggcttgtgaaatggaagcgacctggtttgcatcccaccgcgcaggaatatagggtgtcccatacgacactcactctcaggctcccccctgcaaacagggaaggattttcagatttatcagaaaaggagagccttgaacatggaggaatgtagctcatgtcgacacgtacgtaaagaaagaaaaaatgtagtagcctagtaggtagatggctgttggtgcaatgaatagagagagttggctacggtgaattacctgaaacaatttcctattatgaaatacatgtactccatctgtaaaaaaacaaatttagaactatatgtgacacattctaacactgcggatttggatagaagtatatccagattcatagtactataatgtatcacatccagtactaaattggttttttatgggacggaggtagtatgtttcagccaactagctaggttcactattcagacccctatcgattaacttaaaaaagttaaagccaaaatttaaattttaaaacttaattttgatattgattttaagatactttcaatgtatctttttttagcattggttaaaatcgctaagaatatatatgtaaaagttttatacacaaattaattttattgctatataagctatacatgttacctcttataattagcttttggcaaaccaataagacctcacccttaaaactttgtttggatgggccgcatgccgcgccagcaccatcaattgtcgcctgctcgacttcctcgtcccgctatgctaccagagaggaaggcgggggaggaagctcgacgccgacaccgggaggagagggaggtggcggggaggccagcggccacgccggatgcaagtagtgtcaatgacaacatggtagggggccggagtgcagcggtggggatggtcgtcggcgccgctatatggtccgaccaacgcggaggccgtcgggagggggtcaatgccgggagaactaatgatagatgaaaggagaagaaagaaaaggctgacaattgggtcccacctattgattcaactattggactagtcaacacatcacgttagtgaaaaccactttcaaaatcatcgaaggaatcatttcatacgggttttagtagttgagggttctaacatatatggtattctgatcgggttttagtattggatatatatttgagggagtcgaagtggacttattctattcccgcctggctaactgcatgggcctcattgatccaactccacgctggcccaaaggggacatctcactggagtcccagcccaaaagaaaaggaaaaagtgcaccaagggtccctcaacttgtcatcgagataaaaaaaacatcctccaaccgtaaaaccaaatatgcagggtccctcaactatataaaaccggtcacccgagatccctatgtggttttcaacccggttttgtctgacgtggtggctgagtcagtgtgggacccacatggaccccacatgtcagctagccacatcatcactgtcagggttatggatactacatacctaatagtagttgactaaatctcggcaggacccaccacataccatgtcttatacgggaactgactgcggatatatggagggagttccggataaggaaagacaaccagagttctacatggaaacgacaaggactactcggattgtatccatattggtttctctagttctacttggacaaggggacatctatgggtataaatacaagaccccctaggaggagaggagacacggacaatcaacgggcaacatagacgccacaaagccatgaaccaatacaagccaacatacgccaagacaagacgccagatatcgatttcggagataagcacgactagtcccctacggtatctccggatactgtcaggagagacgaaagcgttatctttgatctcgccgagcacgaactcgaggaggaagactaccctgttgtcgactacgagtcagaccttcagaccgccatatctacaacaattagataggctaccccaaatattgtactggtgtgattatggtgaataagagcaataccggcttcggccaacaagatgtagggttattacctgacaattcaggggcccgaacctgtataaaaatcctcgtctccatctcttttacctcagtctcgcgtataccctagtaccgacgatccccatactatgcaaataccggaatcgcgacatcaaacgtcgacaatcaccctttccctcatctctttttctcctatctctctctctcttctcgtttggtgctcttggcaggccggcgccgccggccgactgatggcgaggagacagactgggcgacgcgggagaggaggtctggcggccggcgacgtggcggcggtggcggcgacggcgacgacgacgacgacgcgggagcaggggagctctcgccgtcgtcaccgagggcccaaccatgatcttgtagcggcgtcggtgcagcaataaaagggaacccaccgaggagtgctagggccatgtcagcgccgacgtgcaattggtctcggtgaagatggggaagccgacgatccatattcagaggaagatatccccttcatcgatgtctcggccggtcacctgcgcctctctaccccgaggccccgagcggccgagttcccatcgtctcatcacctctcttcgtcctcttctccgcccaccccaagccgccacctctccccccatcctcccatctctgcaagctcctccgtctcaccgcctccacatccgcctcctccccaccccgcgccggccgctcccgggaacccacccatgccaggccccggcccagcccccgcccctccccctcctcctcctcctccctctacgcgcgccccagcctcctcgacatggagcgtggccgtgcagcccgccgcgcggacgtcgacgcgctcctccctctctcggcatcgacccgggtgagctcgctggcctcgagctccacgccaccatcgatgtcatgcgcgagcgcgttgagttcctacattccctcaagcgcgtcgagttcctgcactccctcggcctctccgcacgacgtgacgatggaggggatatctacccccgccggccgcacgccgctcctgcccccgtctccgcgcctctcggccttgtcggcagcagtggcgtcgtcctccactgtcgttgccctcctcacgaaggcctcggtggctgacgctgcggctggtgcccgccgccactccgccggccgccgccccttttccacccggccttgcacgcgtgtattgttgtcgggtgcggcgacgtaggtggaggcagaggctgacgttgcggctggtgcccaccgccccttctccgcccagcctcgcgcttgtgtgtcatcgtcgtcgtcgtcgggtgcggcggtggagcttggtagtcgacgcgccccgcctcgccagcacagagaagatagagagaggaggaagagagagaaagggggaaaagagaggtgacgacgtgtcacctgacatgtgggtcccatgcttactcagctgccacctagatcaaaaccggggtcaaaaccactgaagaatctcaggtgaccggttttatatagttaagggaccccacatatctggttttgtggttcgagaacgttttttatcccgatgacaagttgagggaccttcggtgtactttttccaaaagaaaacgagtgcctgcgccgctgcgcggctgctcgcctgctcctgtgctccagcctccaccgactcttcactcactcgtatgaggcgcgtgtgcgtggtcgtcgtcgaggaaacgaccggtaaaacggagcgcgtcgcgtgcgtgggccgtggtgacacccgctgacccgcctgcacgaggcgcacgttgcgggcacgctatgcgcaccgcagccaccgctgctatgcgacgccggcctaggcaaggcgctcgccgcccgcccgcaactgaaaaaatgaaaaaaaagaacgagtcgcgacggcattgcggcctccgccagcccgcgcgcctctcccagcttttttgcccggacgcgggagtacaagtgtagtacaggtcgtgcccctgtactgcctcggctgcccgcctgattgtactgctgctgatgctccatttgatagggcacgctttgcccgctaattacatgtgagccacggcccacagcctcggcgtcgatgccatctattagcactagcactagtattttatagtatccatctggtttggcgtttcttgccacttgcccatgattcccactcctacgtcctcttgccagttgccacagcatgatgaccaatgcagcagcagcactcgaggaaggagagccggacggggcaatgcgccggcgagcggccgaaaaggagggggaaggtaaggtacgtaagcgttggatagtggcggttttgacccagactcgttccaaacatgacgcacgcgagcttgtttgtagggccttaagctaggaggcgaagcatctgtcggacaagtcataaacataaaacgaccactaaacaatcaggtgagtcgatcaccaaccatgattatcagattatctaggataaagtgaagtgagtataacttatcttgttagttttttttttggaactaactcatccgggttaagtcataaacttgacacgagtgctcgtatttattgcttattagtttttagtggtaggcagcgtacccgtcgacagcgagataccagtggttactttgtcaatttcaagatatgtccgtccaatcttttggagatgctcatagagatatggtgtgcgtatgtgtgttcatagagatgaggctcataagggtagcgtgtgtatatgttcgtagagatgaggctcataagggtaggggtgtgcgtgtgtgtttatagagatgagtgtacccgtgtcataaacgcgtgcgtttgtagtatgtttctaaaacaaaattatgggataaaatactatacctacatgttgcttccacctataaacttttcacttattcaaagcatcatgtttcatgccatacggttgcaaattactaaattaggcagcgggaagccacctcttaagctagtcagacgatcacctcaacagagccagctcctctgcttttaggggctgaaggtagaggcgtagggtaaaatgatcctgctactacagtagggacagtaatttgtagttaattactataggtacagtacaaaacacagtaaatacagtgttcccgaatattgtttatgatgtacctagtatactgtagtgatcgatctcattcattcgctgtaaatcggacaactgagaatatcccaaagtaatggcactgtacgtctctctgacttcattatgtgaagtcagtggatcccaatccctgctcaaccgactaccgccgatatttgaaaaaaaatagctagccgataaaaacactattaattgtttggactcaacgatatcgttggcttcattacttgagttatacataactatataggaatcaacatcggatatacagataacttgctttgacatgaattattgacatatgggctactatcaagtagaaacgcatgttagtgatagaaggccccctttaaatcaaagaaaaaattatagaaattctagaggattttatcctatggaaaataattctatagaggtatcctttgaaacggagaattatttttctatcaatttatttgaaatttctatggaatataccttactagagcaattttagagaaaaataagtatgaggtctcacctcatgttttcctcttcatgtgtgctaatcaaacgatagtttaaagactttcctttgtttcgcaatcccacataaattcaataaatatggcattttattcctacgtttttcctatttctctattatcataagtaaacatgaattttgtgtcatgattattcatcttcaagatagtgcttctcaactcagaagcagaggacatgataaaggagaatatttaagttggaagataccggttattactattcagaaacttctaaaataaatcttacaaaaatacctgccgtgctgggaaacccaacctccagtccagtggcgcgaacgtaaatacaaccaaacccagcacccaaaatccaaacctcgcaacgaaggccgctccttcaaaatcccaccggtctctttcgccggaatcctcatccctcctccccttctccgtccaaactacccgcctccgctcccaatccggcgagatcaccaaacccctctcgccgactccgccgccggcggcggagcagcagcagtcactccgccggagcaccatgatgcacatg

SEQ ID NO: 47190 - DNA, 4408 bp, Oryza sativa
agtacctcgaggcgttccggatccgcgtcaagctcctcgcgggcgccaagccggcctccatcccgcccccggcgtcctccgacgccgcgcgggccccgctcctcctcccctcgtccgccgccggacgctggccggcgcggctggcgacggccgggctgttcggggtgaactccggcctgggctacctcctcatgctcgccgtcatgtcgttcaacggcggggtgttcgtcgccgtggtcgtcgggctcgcggcgggctacttggcgttccgcagcagcgacggcgaggacctcgtcgtggtcgacaacccctgcgcctgcgcctagggtttggctttgcggctgcccccaggtgtggctcctctgtttggtttcccgatcttgtatgacaagtagaaataaatctgtgtacaaattcaattgcgtgacagggggattccggtgtttctgtaatttggggggaaattgtagagtacaaaatgagaaagctgctacttttgtgtttccaaccaattgatgcattgatgcctttgtgaatgaggaatggataaagatgacttagatcaaattgaagaataatcaactctagaatggacagagctttctctctctgagctgcaacgaatctaagaagtatcatcagttgaaagatgataagcataggcatatcttttctgaagaactgaaaattgacaatatgaggagcctagattcgatcacggaaagaaaattctcccttttctcgctcttcttgaatgaaatgatgctgtccctgtgactgaatgcagagacagtatgagaatgggtaaactgtagtttggatcatgtaagagcatgatcttgccttgtttatagttttgctcatgattcattggcaatttggccttatgggttccttcttgttcagtgatcgatatgaacttattagtgaaaagttcaaaacactaatgggtactgatcatgtagccatgcactcaatttattcagagcttggagtgaaagttaagatatgtgctttttcatgattcatcacattttggctcgcatggtgatattttagcataatcttaagctgagatgatgaaatgagtaggtcgacgcttgattgatcctaggcagttggcaacctccaatcatgtggacagcgcatgttgctgcagcaagtacttgttcaataggtgtattgtatttcctcatctgtggcatgaagccatgaactatgtacaagtagtggtatcggttgctttcggttgccctcgtgagagatgctcaactttgtgactttgtcttgcaactagaccttttctagttgacggtgatgtgaagtaataatgggcgcctcgccttatccatttcaggggaaaaaactgttgcattgcctagattaagctttcacacacattttaaagtcgcccaaatggtgttgtttgttttgctgcttgaacttgaagctgcaattgatatgtataactttttaggtattgttgttatggatcggactgtgtcaaacacttcgttggcaggaatagtctcatgtgcttcttttttgaaggaaggtctcatgtgcttctgtgcatgtttgtttatctgtgctgtcactgggctctgctctggctcctaaagcaggtttaacgcaagagcaagttctttcttctctgatactactccatcgtaaacttcagtaatagtagcagcactattatcaattggattgacacgccccttgtctgttgctccagtagtgagttataccttttgttcagatctgacttgtgagaaatggtgatcacccttcatatcgtcattgcttcttgtagggttaccgatttgttcacagttaacgcaatctagactgaagtctcgttcgccaaaagatatcgccgttctgaaggcctgaaactcgcatctgtagcttatttttccagagggcgcatgtttggctagtcgctcatgcgcagactcggaactttgccaaaaacttggttgcaaacttgggctgcttggtggatgtcagggaaggcgaaattctgtggctggcctggcctggccttgtactagtctgttcggcacttcagcctgataacgttatgggctttgacagatctggccttgcaaatataagcccgcacaccgggcctggcgtcattgtgtgagctttagtacattcatgcgttgcggtttggttggtcagttttgacctttcttatggtccttaagtcgcaatattaaacattaaaatgattgatagtagtaagtactggactactaatagttgttttttagtgttacttagcaaatggccgattcattgtgtacactgatctaatcgtgttttagtttacctttgtttctgctgaacaaacacaccataattagcaattgtgcaagttggcaacaagccaacaacgagaggttgaacggaagaagcaacacagaataaacgataaaagaaaaaaatgaccaaacatcaaggagactaggggagagggtttcttgacacattatttctgcaaaacatatacagtcacgcattgaatttacaagtttattactagttacacggcgagaaatggaagaaaaaaaatacaatatcacgacagatacgcgcgcaaagctttcattgccatcagagctcgagtagctcagcggatgtagtagtgcgagttgcacctcagcaccatgcgcgccaccgccgcgggcacgacggccgccgacctcgccggcgccgcgccgatagcgccgccccgcgacttcgccggcgcgggctccagcgccgccgcctcggcgacgagccgcctcatcatctcggcgtagtactccctgagccgcgccagagcgcgccgcgacctcagcagcagcagccaaaggaagaacgtcctgcgccgccgtggcgcgccaccgcccgcgcccgcgcccgcgccgagccgcgccaccgccatcttcggccgcccccggcgcgcgcgggcgccgcggccggacactcggaatatcatgccgccgctgatgcgaaagggattatctctccgtgacaggaatgtgtcgaagagaccgacgacgacggtttgatatggtaggcgcgccacgccttaatgcagagatggatcggctaaaacggcgaaacggcttggcaaaataggcaaataccgtgtggttggcaagttcaccaaacagactggtccgtggagttggtagagcgaacagcgtcgagccgaacgctgactgctgcagtttgctgattcaagcggcggcaactagcactaacaaaccttaatttcttttaatacattaatgcttattactatgctcatgacgtccgcacacttaccttttataaagccacacacacatacctaattcctatgagtacttctgaaagatttggtcagtatatttttagatcgacaaagttactacggcaaggatatgagcacttctgaaagactaagccggcatatcttaagattaacaaaactaccataaacgtttcgctactgacgaatatatcacctacactgaaatattcccttcaaatgttgacaaaatactttaatacttgaactcaggtagacaaaatttcaccataactccataagaaatttaaccagttaagttatgctcactttacaacaaaccttaacatatagttcagcagttagaacttgtagttgtgcaaagtttgcagtaaagcatactctcttcgtcctaagaaaaaccaatctagtactaggatgtgacatttctaatacaacgaatttggacatactcttcttttttttattaaacaaaaaagtatgccttgcgtcactttcatgaaaacatgtacaactctgagttctgaaggacattgaggagcttctttaatttgggattttgaagaacgtgaacgtcaaacgtgtagtttaaatcgaggtcattttatttttggttaaggctgacactggctgatatcatgaatatgtcagctgtgagctgacacgaaacacacattaatggaagttagcactttgaaagcgattagggaagaaagcatttgcatggatcctgttctgtgcggtgaccagctcacacccgcaccaatggcaatgcatgatcgatgatcatacagttgaggatccattatggtgtaaaggtgatcagtcactgcataggatcctatctgcgtccacgtttcaataaacactgagctcaatgttttcaggtaacttgttttgattcgactagagtatgtttacttcctgaatgtgtcggcacttggtcgatcgctgagttgaatgttcatgaacgctagtaataaatggctaatagcgtaacaaattatcctctgttcattgtgattaggatcagcagtaatcgttagtatgaacgttcgcacgactacagtgtacgagctacagaaatgtgtttcagtg

SEQ ID NO: 47191 - DNA, 4727 bp, Oryza sativa
tgaaggagggttgggaaacccttctctccgccatgtataacgaagcactcattagcatataattaatcaagtattagctaatttttttttaaaaaatgatcaatatgatttttttaaaaaaacttctgtatataaacttttacaaaaacggcaccgtttagccgtttgaaaaacgtgcgtgtaaaagacaatggataggagttgggaacaaagtgcaaggaaaacagcctcagctcgattcatttgtttacgatgtaggagtagtatggtttcagtctttcagacccaaaagagcagagaatttgcactcgaatacttgcttactccacgtttttagggcctattcaatttgatgtcattttctatcatactatttttttttttggtaaagttgacaaaaaaaatatgtctacgtttagtttgttgccaaatttgatcaatatataagaaattctgccaaaattttagtgccaaaattttggcattgccaaaacttggtaaggtttattttggctacaatctaaacatgcccttagtatgttaatggtgaagagattgacacgtctgaacgtgataaaggagcatgagtctgaccaggtggggtccactgtcatggacccacaagtcaatggcccatgtccctgtttagatttcaatgtttttcttcaaactttcaacttttccgtcacatcgaacttgtctacacacacaaacttctaacttttttatcacatcatttcaatttcttcaaacttctagttactttttcgtaccagccataaccaaggtatgtcggcgacgtgatcaaagtggaacgaacacaacagcacaccaatcaaacgttgtttcactctgattggcccccaacacgccgctgaaccatgtgagcgacaatcagacggccaggcaggcaggcagtaggacgcagttccagttctcgcatgtgcacgcataggcatagctagccccccctgctgctccaacacacacttgagaatcggttgacggcaacgggaggttgcctatgcacacgctactactactccagtacctccacatggcgtcccgtcccgacccgaccccaacgcgacagatgtgcctccagcctccggttgccgcctgcctgcggctgcgccgacgcggacgcgaccggcgccgcgcatgcagcccgatcgcgtgattccgcgtcgtctaccaccgactcggacaaccgctgctggtcgcgggatgcggttggttgcaaaagcagtggctcctgtctctgctgcctccccgcgctgctctctgctctgctcacgggacgcacggccgccgcggctcacgggtggtcgcactgtcctcgccgtcgcctcgtcgctgtctttgatgctgcctcctctcccggcagggcaacagctccggcgcgtgcccgcccccgttgaatctcaaacttttgacaaatggggacatgttttacggtgatcgaaaggcatcagaaatgaaacgcctccaccttacgaaatactgagatgtccctgttttttttatatttttaagccatgttgtcgtaaggaaaagggggacatttcctgtgaaaaccatcaagacataaaagtattgtagattcatgaaaaaaataaagataagttttgtaaattcctgaaaggaaaaaaaaatagagatatgtgtaggtatgaaatatattcttaccagttttctctcaaatgaagttgagtttgaactttaaatttggtatgaaagtatttcatgcctatacctatctccaataattttttcgtgattttatataacttttaaatatggtttttatgagttttcacttattcgatggttgagatataagatatgcaagcaaacaaagaatgcacaatgttgatcgattcaccaacataaaaaaaaaatctatgaatgagtattggccaacagttaggttgagcaaacgagaactaacgtgtgagcacatacctcatagatttgtgtgctgatgaacttgaaataaaatagtatgtgaaacagtcatgtgtgcattgcaaaaagaatatccgaataagcatgtttgcccggtccataaggaaggtttaccggctaaagtttgcatgtttatagaaaaatatgaagaatacatttcagaaaattattccatgcctgattcccatgacatctgtcagggagccagatgatgctcatggctgatgacatgatctgccgaaccaatagctggttcacctatactttcaaaccatgaaatcggtttatagatccatcattgtaccttaactactgatataatggacctatatataccaaaatacaggtgtaacaagcaacagatcaggcagcaactgcagctatttttgctgtcaggagtcagttgctgcagaaactccacatattccatgcatttcaggcttcctatgacgtgttgagggagcaacaaaatcacacttaaaataactcaattcaacataagggtcctaggattagtaatgtgaaatatgatggttattgtttttaacaatctgaagcaacacttctgacagcataaccgtgcaaagattagtaagatgcagctaaattattaatataagcgggagaagaatggtgcaaaaccaaaatactgtcaagcgagaaaccatcacacttttaatgccacatccatacagctcactgcttaacagcattacagcgagtcagcgaccaaacattactcaatagagaaccataacagaaatctgaattacatcatcatgagcaaccaatcattacatcgcaccatagctatgtgaagcatatagttatatcgaagaaatctatgtgaagttttatggtttccttattcctcgacacataaccaatacaaacagccctcaagtaatgagtaggaagaaagaattacatgcaaaattttcttatataaagacttgttagtccacaatttagaaactcttataaattgcttagctcaccccaactgaacagaatctgaattatcaacgcagtatctttttggtatgataatatctaaactactactgaaaagataacatctctcaatgataatcattgaagcattttatcagaaaataaattatgtgcctcattcaatagtagatcaaggagtaggcaatttgccatgcacaaacagaaaactacatgctttacctaatgctgatacgataatgcatataatgcataacataagtgcattgctgttttaaaatgggatgctactgtcctttttttttcatgttagcattagcactagtccaaactaggaagttgccttaaaagagactttggtcgtgtttaattccacgccaaaattggaagtttgactaaaattggaagtttaaaaaaaaagtcggaagtttatgtgtgtagaaaagttttgatgtgatgaaaaagttagaagtttgaagaaaaaattgggaactatacaagcactttaaaagagacctgatgtggtaacctcaaaagtcaaaactgatactttaaggcagaacatggtcttgcataggtaaaacccagtaacacagatttgtttttacatctaatctatgaagtgcaatcttaatatatatctgaacaaccaaaaaggtgacaagacactcagttaagtgtcaaacaaacaccatgatgttacaacttacaactgcgaaacattctgaaagaacagacctatatgaacaatctaatcataaaagatatgatgatagtgtaacaaacgaacaaggttggctataaaaggaagaaccactaaggaatttgacagtttcaataagatcctgatcctgtttcagattacctctagtagaagaaatcatcaccaactatacccttaagtcttgcttttcccgaagcattgtagaatactaggcaaccacactcatcagtcaacaatagagatcttttgagtcttcaagccacctctcatccatgggatcttctcctgttatgtagcgaaggtggacaaccctcaaagaaatttgtgacggacgtctcaaggtcctcaactgagtatttgatgtacaactctgggtgccttccattctctatgtgatgccggaaccgaccaaggaaggatcgatatgctggaagaagtttctctgctattgatatcctaagctcttctctcagctgcgtgtctggcacataccaagcagattgaaccctatgtgcctcctcgaatgcagcattgaaagacttgaaacgctcccggagtgctgatttggatacccctgatgaaaagcccccactgacatgcagaccttcatctctcagacaattcaggatcttcaaccatgctgtccgttgatagcgagtggctgcgagccggaacttacctgtcagctgcttcaaatactcatcaccaataagcccccggagctccggtgaatcctttatcttgtgtgcaatatagtgtacattgttcatgacgaacaaatgagagagtgccgcatccttgtagagtgatgctttgctctcaagattgtgctcaagaaccacaataatccagataagatgagcagcaaggggtaactgactgtcagggtcggcaaggtcaagatcagggaaggatggggcattctcattgccctcaggagcaattcgggagcaagccaatggccgcgacacaatcagctcagacagtgtggttttgtagtcagaaatgaggctactgtaattcatgacatagcgagtgagaggatggatggtaccaccaggca

SEQ ID NO: 47192 - DNA, 3555 bp, Oryza sativa
tccgcgaagggagcgtcgtgggtggcagtggtgatggtagagctggagaggggaaggtcgtggaagatgagaagcagagtcgacgctcgctggcgaagacgccgcggacggcggcgcggcagcacggatccagcggcggatcttggcctcgaggacttcccactcgagccgctgcacgtcgccgatgctgagcttctcaacgccgaggcggcggagcgcggagtcgacggccggcttgcggacggaggcgtacacctggacgcactcgcggccgtagccggcgacggccatgcgggagcgatggcgtggaggtcggagatggcgtccgcggggaggagatcgatttctcggatgctgcgcagcgagcggtagctgctgcggcggccgacggaggacgcacggagtcgtcttcgtccgcagccgccgcttcctcggcgacgtccgcggagttggtccggtcgctgcacatggagagcgaggtgaggtcggcgagcgcctcgatctccaggtcgagggcgcgcgacgacagcacgtggcggaactcgtcctccagccgcgccatcgcgacctggacggcgttggacgccgcccctccgccgccgctagccgacgaggtgcggcgcgggctcccgaccgtggccggggacggcggcgccagccgccgtaggtcatccacagcccggaggaaccgctccgcctccacccggtcaccgccgccatcgaacagcatctgctcgtccccgcccccgcccccgtaggacgccgacgccgtggagtcccacctcatcaccaccctctccgccgcctccagctccgccgccgcagcggtggatccatccatcatgcttcaccccccaactcccaacacacccacgccgcagcacaacacctccacactcccgccggtacggcgcggggaggagagccttaagccggcggcggcggcgaggcgaggaggcgagagggcgctgtgcagtggccgcttcgagcggccgctcgttttatcgaattcgctttttgtctcgggtattttccccttgttgctttgctcctttgggcttcctcgcaccactaattatccaattagtgcgcggattagtagcaaagctgtggaagcggagactttttatcacctcccaacaaaataaaatacactctaaataaaataaataaataaataaattataaatgccgacggcaactgattggtggggcccacatatctgtccccaccggccagtgagtccacgactccacgtcgtctttttcctttcccgaatggatggctgcctcgtgggcccggctagtcagtggcggtaatcctgtaccgacgtgactcgtcacgcctatggtcaattttcgtcattagtatgcatgaacggcggtgtgctactgttttggtgttaatcttttttgagacagtttatgaagcaacattatgcataaattaaagcaggtaagcacggctgacagctcatccagtcggttcttgactggactgcacaacagcagcagagagcacagagaagaggacagcatttccggtatgtctgacagcaaccaactagcaatgcaacctatcggctaatcatcgattaatcatgtacttctatcaggttagacaagaaagagaattacctcctgtgtttttaatagatttcttcattaactttttattacacgtttagttatttatccaattaaaaagtatgtagttataatttattttgttgtgaattagtgtatccctcaaagtattttaagtatattttatatcttatatatttatataggaattttaaataagatgaatagttaaacatgtcgttaactcatctactattaaaaacgatgcgagtaattcatataacagcggatgagagagatcacgatggtcaggctacctgaaaacggtgcatgcgtgtcttcttcggtaagccaagatctttactgcattcttcttcagtcctggaatcatcttttctgaaaatgttttttatcatcttcttctccttttcaatccgttgctgtcttttgtggggttctttcctaggaaaggtgttagttgttcagcctcctttcaagaagctatggaccatactacacgactgcatgatgctggtgatggtgatgatgctacgagagatcttgccttttttgtgctaactgtaacgatttcctttcaggtcagtttcagatataggaagtgataagtacttacgttagaggatttcatcagtggtaaattttgcaggatgtggtaataagcagcgctgaatgagtacagtgagtttttcaggctacaaggcatctctgaattttaacttcaaatggtatcgttcttttcactatcgtagtaataaagtaaagaaaaagaaaagcatgtgagacagtgatgtgaccatggtaaacttcaaacgagttaatttgttcgtcaatgagaataaagtaacctgggttagttgagatcttattacaagattcgaaagcgagttacatgactttctgaatggcaccaaggcaggagaccagttcatttgtttgtcctgtcagtttgtgaagtgtgaacgaatgcaaggacacaacggaataagcaggcacgcaatgtctaatggaccgaattcatttggtagcagaaggatgacactacagttcagcaatcatcctgcaaaagcatagctgtttccgcagacgattcatgcataatgcattcgtgtcccttccctgaacgaccaacagattgagctgtgtgtgtatgacaagcgggccccactcatctgatggctttgtttgtgtgtgtttggtctagtttcagcttcatatatgatggaattattataaactaaatcagaaccaaacgcaaagctcattgtgacttgtgaggtttaatcgaataataatccagattcctctctaaccacaattcttagggataagataaagccaggaaacaggagacatctaggattataaatttacaataagttgaaaccaaaccggcaacttgacagcagtgatgccactggaaaaccggcaaagcatcgattagctttccaagtggtggtggactaccgttctttgcagggaactgaaatacgttagtacgttacgagtaattgtcaacagccacatgcctacgccgctacgcgggattttctaatgttttgttctgcacgatgaacactagtagactagattcgtgtttttttttctcgtttttcttaatctagtactccctctgtactcataaaagaagtcgttttggacaacaacacggtctccaaaacataatttttacttcttatttttataaaaatatttattgaaagtgatatatgtatacttttatgaaaatatttttcaagacaaatctatttatataatttttacattttcaaacttaataacttgagagttatttatgatttatattcctaagatttgatttaaacattgtcctaaacgatttcctttacaagtagggagggaatacttcagcagcaggtaattattggtagtaataatttaccatgcaacatatatgggccgcacgta

SEQ ID NO: 47193 - DNA, 11732 bp, Oryza sativa
cctgcagccctcctctctctcactcttctctgcgggggcggtcgatgggtgcggaggaggccggtggggcgaggcaggagagtgtcgacagccggcgacggcggcacgaaagaaggggatgtggctatttagaggtgaagagggtgtcggtggccggcaacgggtgacccggtggcagcaacaacacgggagaaagagaggcagcggttgtatagactgttggagccgacgagcaccgacgcggcgcgggcccggtatgtggcgagccaatccgccctcacaccggcaccatccgtgcccacattgaaccacccatatgaggcctcctccacctcgcccctgtcgttcacctccagctccgttacatcgagtccgccttcggtgccgcggcacccacctccaagcgaaccaccacggcgcttggccccgcctccgcctttgtgcccaccgccatgctttcccttcactccccccccgggtactcctgccgccgacgccctccccttctcccgcgttgccgccgccacgtcgcctgctaccggacctcctctcccactagcctcctccccacctatcagtcaccctgcccagacaaggagaagagtgagagataggagggaggagaaaagagaggaaaaagagagggtgatgacgtgattaccctaatatgtggggcccacatgggtcgcacgctaactcaactgccacatcggataaaatcagggtcaaaaccgcttaagaacccaaagtgacgcagttttgtaatttgaggaatgacgtatatttggttttacggttgagagatgattttgtaatctgatgataagtcaagggacctcatacgtactttttcccagcagctaatcaccatggcccagcccaaaacttgtctcatctcaccgtagacataagtcacgtaagacaaactgccctgcctgtatattcacatatccaaagcgaaatgacaccgaaacataaactgctcaaatcaccctttttttttcgtaacatctcattcatcatttcgctgtcttttttttttttgcaacatcgcttttagcattttcatctgtagactgcaacgtcccaaactctaatcccgtcaatgggacgtgaatgcctgcaagatcaaaaatcaagactagttaattgattaattaattaactagcaaggtggtccatgcaaattgcgcaactagcattattatattttctctcgtataatagcatatatatatgttttttttctcaatttattattaaaatatattaaaatgacaacataattttaaattttgtactatctttaccaaactaccaatgtgtaataatcatattgtattttatatatgtgatacttattaattaattttaatatcagttttagttatttctaaattatattcctatatggcctgtaaactcgtcttctaatattttttttttattccgaattttcgttatttgtaaattgtatttttatatagactctagcctcttcttttaatattatttatttctaattctgaatttttattatttctaattgtatttctatgtcgactctaaactcatctttcaatattctttatttttttaatttcgaatttcagttacttctaaattgtatttctatacagagtaactcttcttgccatattttttatttcgaattttagttatttgtaaattatatttctatatggactctaaactctaattgtaattttattatttttattccaaattttagttcattctaaattcctatatggactctatgcttttgttctaatattccttatttttaattctttatttgtaaattgtatttttttatatagactctaggctcttcttccaatattatttatttctaattctaaattttcattatttttaattgtatttctatatggactctaaactcatctttcaaattctttattttttaaattttgaatttcagttacttctaaattatattcctatatggagtctatactcttcttgccatattttttattttgaattttagttatttgtaaattgtatttctatatagactctaaactctaattgtaattttattgtttttattccaaattttagttcattctaaattcctatatggaggcttctttttctattactttaataagataatagattataatatgctgcgtgcatgacggggctcatcgtttcctctgtgcagaattagctagggccaaaatttaaatttaaaacttaattttaaagttttttattgaaatttatcttctaatgttggtatttaaattgctataagcacatatgtaaaagttctcataaattattagcattttttactaatgcgccgtaagacgtattattagcatttggctggctgagtagagtacgacgcaccgagaagacgttgcagtggccggggtcggcgaggtgatgcaggaggttatcaatggggccctcgccggtgtagacggcctggaaccagaaccccacgaaggcgagcatggcgagcctcccgttcttgatctccttggtgcgcagcaccatgacgggctccggcgatccccggccccagttgccccagtcgaaccacagcccgccggggtagccgacgtccggcacggggttcctccggttgggcagccgcggctcgacggcgacgcacccggggttgaggtagtccgcccaccgccgcccctccgcccaccccatcagtgccatctgcgacacgaacagcgtccacgggtccgcgaagtagtcgcgcgcgccggcgtcgatccatgagtagtcctccatgaacccccatttctccagcacctccgggaccaggatccccgccaccgccagcatcgcccaccggctgtgcatcagctccgcctgcgcgaaccaccgcagcagctccggatccgaccctgcaggcaaaaacgttcgattgttactgcacaagacacaagtgttgataattttgtggaaagaaattaaatgcacttttggactacttttattgtcgtagtttaactttgaacttcaatctattcattttatactagataactttatgtttgttgcactttgaatcacctcgactatatcttctcaagtcatattcatattatacaccgacaaatatatggcctacttataggtagaggatttcgctaacgtggtaaaaccgacatgtttaagatcgttaatatgctaaataagtggttttgggtagttcaaagtaaaataaacgtaaatttagctagtccaaagtaaaaagattggactagagtgatctaaagtgaaactacgacaacaaaaggtggttaaaagtgcaattcgctcaaacttgtgagaagatgtgcgcataggttggttacctaatccaagaggatcgaaaccgaagtctcccgggaggctgccgtcgagccacggaggaggggagctgccggggaaccagagcggcctgtcgggccccagcggctcgcacaccgcggacacgccgcccttcgtcgcgccggcgcggtggccggccatccttgcaacggcggcgttctgcgacggcagcgtcggcgcgcgcaacgccgcccgcaccctaagctcagaagaacacaagaatgacattttcgcaacacacggaatcgaattgagatgcttcaatggcacaacacaaaaaatgagggaaaatgagggagaaagggaagaagaagacgatgaaatagatgggtgttgctgaattattatgattattattaccttggttggatgctacatgccgcgaatgagccggagggcagagccatggaggagagtgaggagaacagggagagggcgagtgaagctggtgaagtgtgaaggagggaaaagtgcagagcagtttatctgcttggagtttaggatagggagggagagggcgtggcgttcatcgacagggagccaatgaggccttgccaggtgtgaccagcatctatcatacaagttggggtcctgacttttgtgggcatgtaatttggaggcccgtgatacaaatctgtttagagtttggcccgtttaagattacaagaatcttgaaaagctggaaaatccaacttatgactaagatagcccactactagctccaattcatctatagccgatctaatagctaattcatacaatagttgcttattatactattaacatatggtcccacctgtcatacacacattgcatccgtactgcagctggatacagatatgtagcccgctgctcttctctctcatcttttatttcattaaaatatgtttatagctggctaatagtatgctattgcacatgctctaacaattcttaaaatataggtgacaacccggactatttgaggagctcaagattttagaagttatggttgtgaaaagctcccccaagcaaggcctctatatgataatgatggcttccgagtattataggcctataatttagggtcttagtattgagcatatgaaataattgaagcaattttgtagcttcggcaagctaaacttcatgagatgatttaacttcatgagaagtaacgaaaaggaggaacttattgaagtatacaaaacaactttacggatgtgtaaacgaagaactttattgctctcaacagagaaatttgttgctaaaaaggtgtacaattgagctatgggcctgatttagtgtgtacaaatacatgactgaagtggaaacatcagtgtccttttgtgaggcagtatagacaggtggaacatccttaaatacattcctgagactctgagagtgaaagctgtaaaaagctacccaaaaaattctctgtaactgttaactgagcagtgaatactcctacagcaatggtacagtgaaccgaaaaaaagagggtgccgccttgtcaaaaactgtagtcgatatcagagatattctgcagtgctgattgtttaaccagctcacgccgctcgttgtacagatccaggttcttgcacggtacagggaaaacatagccaatgacctgcccctggacgaaggagcactggaaaacgtggttcttcctgtccaccaaaccgactgacatatcatggaaagtaacattcttcacggggatctctgcgctcccctgtatcctgactggtacacgcaccccatgtccatggattgaactgtacgagatgttctctatgatgggaactgccttggggtcgaagccttcgtccgggtgctcattgtagtcggtcttgatcacaatgccaactcggatgtgttctagggttatgttccggtacgtgatgttgcttacataggcccctcttccaggggcagtctttatcctcacacctcgccgtgaatcccagatatggacattctctaccaagacatttgaaacaccgccagacatctcacttcctatagatacaccagcactgtccaataaaatagaaaaaaaaaggtcacacacaatggcacaatcacatggctttagaaaagtctcgactactggcacttaacaaataaattaagcgaacaagctagcctacttaataatgaagagatgtattacaaataatattgatatctgtgatcctagtagataaattaacttgtacggtaaggaaatgcaatcattagaccaaagaaaacatcacaagttcacaaccaatatgctgtgtattagttaacatattcacagaattatctaccggataacttataccaattcatattctgaacatctaaaacttctaatagtgaaccaaaccaaactgagaacataatgaaacatgaggaaatgactcacctgaccatggagcggattgtgacgttgtgaataataatgttagtagatggacgcccataagcaattccatattggtcccaaccactctttatagcaatcccatcatcaccaacagaaatatagcagtttttaatcactacattctcacaagaatctgcatatatagtaaaataattgagaatcttactagtgaagcataaagtttactaaataatacaaatgactccaacatgatgtaggaatacagggttgtctggtacatattgtcatctacatgtacatattgtcattatacagtcataggagattgtaagatataagaaaattgcagctgtggcattgccctgtggttctaaaaaaattataagctaacagaaatgaagaaaagctcagaatcacaaaaaaaatgaaagagataaaattgggaaatgacctggatctatcccatcagtgtttggagctccaacaattggagccaggatggtggtatctgatatagtaacatccttgcagtcatatatatgaagtgtccagaagggagaatcccgtagagtgatgttagaaatggtaatgttacttgaccgcatgagttgcacaagaggaccccttgtgtgattgaggactttcttccgaaatttgctccaccaactttgaccttgcccatttatggttccattttgtcctgtataaggtagggaaaaaggagaaaacctctcagctgatgaaaatacaagccaatttcagcttcaggacaaagagctgctagcaaggataagagtacaaggaacaggctgccaataaataatacacaaaaggaacaaattatatgaccagtgccaacatttagcctactcctaacagaatgatagcttataaataaatgtcagttagcttaattgcaactgtttctgaaaaaataatccaggacctctcttttagtcttatatgctgaaataggacatgtcgacaaccaaatacgattcatattaaaatttagtgactgagaaataactttttcaaccatttgcatgatttcagatatagtggtttcaagatctgatggaacttggctctagaattgctttaacaacaaatacactgcaccaaatattcatacctcctacaatgtagagaaaaatatgctattaaacaagatcgtatctttgtcaagttattctcaatttgccacatgcttgctggtggaaaagatatccagtaccgctatttaaagtttcaagaaattggtgattgtatttactgttatattttagagaacatgtgcaggatgagatcaactgacgagcatgtctccatatgatcaagaaccaagtgattggagttaaactcaaaagtccttgaaaagatagatgacaacataagctccaggctccagcatatgaccacacacttctatcatataatgttttcttttccgaccactatagctgagatttgtcatttttggagactgaattttgtggcttgatcctcacatttgttgcctcgaccctaactgcagcaatgagggtcttaaaggtgatggccatgttgacaagttcaaatgataaagccatacggcttatctttcgaaattccctgttaaagtcaagctacattcttgcaatattacctgagaatcttttacttctctacttagtttgattttataagcacagcattcacgatatcaactgagtattagaatgcattaaaaaaaaccaaaactacaacttaccagttatagtcacatccttgaggtcttgaccatgtataaggctcccatacctaggccccctgtgctctcttccgtacccatatgatggtaacggagacatcaacggccaatatctttcatccttacatataagtaaaagttgactcagttggtaagaaatgcaccaaactgtaaaaagtaacagaaaattttaagtaagaaaaaactagacccgcattgcagcggaaggttgagctaacttcagataaactaaagatcagtatgccttcatttgacagcatacacaggtatatctctcagtgggaaacaaccatttttgactaacatatccattcaagcttcatccaagacataccagataaattacaaaatactgttactccctctgtttaacaatgttagtcaatttaattaggtacaccgttttaaaatgtttgttcactgcagaaaccatgagtaaaaatattgcagctcttccaccatatgcacacctatttagtgttgtaaaaaggggccacgataaacagaaaattaaagtattaagcatttaaacctgaatgtaaatgaaccacgttgcaccacagaaagttaaaagtttgccattgtagtatgatatatgacgctacggtctaattacgtgacacttcgtgaagcgtagccctatgtgcataaacttgttaaaaaaaaccttaaaattcagcaaagagatggggattgcagcttgaaatgcctcacctggaccccgaggatctcagcgccggcggcgaggaatagcgtcatcctactggtgaggttgaacggcgcggtcagccacctcccggcgggcacgacgagcctcccgccgcctctctccgcgatggacgccaccgccgccacgaacgcctcggtgttgagcgtccgcccgtccccgacgcccccgaactccctcagatcgtagaccggcggcgcggccacccactgccccatcccctgggcggacggcgcgcgcttcggcagcagcggcgggcgggtgtagagccgcgcgcggcccaccgaggtgctctgccacaggaacacgagcgcgaacccgaccagccacagcgcgagcagcaccgccctgtacgacggcgagatcgccgccgcgccaccccaccgcctgtggtggtgccgcccgcccaccccgcccgcccgcggcgacgacgcgaccgacgccgaggaagcggcggcgcgcggggaggaggccgcggcgcgcggggaggaggcgacggccaccccggtctcccccatcggatctggcgcgcgggatctacggcgcgcaccggctggtcgtctgggccccgcggcccatggagcagggagacgcgcgctcgcggaggcgatggcgagggcggcggcggcggcggcgctcgtcggaggagcagcacgggtttaaaaggagcgggagacgatgatgcgtggagacggtggagttgggccggaaccaccacgacggcggcggcggtggtggcggcgaaatgaccgaattgccctttgccggccactcgcggcctcgcaccgcagccgttggatcgactccacgagcggcggcggcaggtcaactaacagatgagaagaagagaggagaaaagcggatttgtagcacagactctcatcaatatgtgaaccaagtttaataatgtgctatatatttactttatataaaactattgtattgatagtttattaaagtacggtagatgatatgttaatttttaaaactagcagttggctagattaattaaagagcattgctattgtactatttttttcttagtaattttttacaaacaataatctcgaccgtttaagttaggtaaataaaagttataaaatatctactctagatacactcacggcatgacaccttggtgttaataattaaataataataataagtttgtatgtataacagttttccttaattaaacttgctctttttttaagaaacacagtccataacacgcgcacacttatctttatgaacactatgaaagttagaccgatatatcaatgttaataacaaattaataataaaaagtttatatgtgtaactttttccttaattaatcttgctcttactagcagcgtgaagcgttcagacctccacgcagtgtaaccgactgacagttcagctgaggctgacggccaacctagaaaggtaggtgtgggcccacaaggcagcgggatggaccagcttccacgggcccacctgcgcgaggttggtccaagtccaccgctaggtggaggtgcggtgcgtggtcgattggcacatgcgagtgtgtgacatgacacggatcgaagagattcgtcgtctcgtgctcgtgtatgacacggccacatgatcgtacgagacacggatttcacaaaatagggattaatttggccccccgtgcgtgaccattggctaatggaggaagtaactgtttgatttactttgtcttaagtgttcagttagtccgatggaagagaccaacacagatcggatcaaatagcgatcacaccacggagaatagatacgtctgttttgactccttgtaggagttgttggctggtcagatcgccaccgttggttgcttcatagcatactccactttgaacctttgatccgccggccggaagagcatgctatgagttgggccgagatttaccgtttacgcgagaacttatggattgggctcaaatgtgctgtttcggcccgtcaaatggagtgcagagtagcatgcagcaactgtttcggcctaattgaagtactcggagggagtacttgactgggctcaagcgggcatttgcaaaaaaaaaaaaaaagctaacgggcgaccaatcgcgtgggccctctctcgcgtgactggacacgtgtcgcacacggagggggcggcggacggcgcccacgcgggattttctttttttttctttctcttcctttttttcggttctttctgttttggtttttttcggttttattcggtttctcttctttttgtttggttctctttctgtttggttttttttcgttttttggtttctcttcttttttcggttttctaagatgtacgtatgcaaagtttatattcgtatgtatactaagttttgtattttattttttattcgtgtattttttttctcggtttttaatatgtacatatacaaaatttgtataagcgtatgcaaactttgtatacgcgtatacaaactttgcatacgtgtatataaagtttatatatgtgtatgtacgggatgcaaggtttgtatacgcgtatacaaagtttgtatttgtacctacgtataaaaacctaaaataatacatatatataaattttgtaaatgtgtatatagactttatatacgtgtatacaaaattggtatacgtaggtataaaaaccaaaaaaatacatatatacaaactttatatgtgtgtatacaaaccttgtatacatgtatacaaaattggtatacgtacgtataaaaacctaaaaatacacgtatataaaatttgtatttgtgcgtatataaagtttgcatacataagtattaaaaaccgaaaaagatattgtcgacgttggatgtcgcaattctggtatttgcatagtatggggatcatcggtgctaggatatacgcgagactgaggtaaaagagatggagacatggatttttatacaggttcgggcccctgagttacatcctgttggccgaaaccggtattgctcttattcaccataatcacaccagtacaatatgtgggtagcctttctaactgttgtctacatgtcggtctgaaggtctgactcgtagtcgacaacagggtagtctttctcctcgaatctgtgcccggcgagatcagagatagcgcttttgtatctcttgacggtatccggagacaccgtaggggaatagccatgcctatccctgaagtcgatatccggcggcgtgtcttggcgtatgtaggcttgtatgttgtggcttctagtgggcgtgtgttgattgtcatgggtgtcttccatggtccttcctccctctcctcctagggggtcttgtatttatacctataggtgtctccttgtccaagtagaactagagaaaccaatatggatacaatccgagtagtccttgtcgttttcatgtagaactctgattgtctttctttatccggaactccctagaagccggtttccgtataagatatggggctgcaggaa

SEQ ID NO: 47194 - DNA, 5436 bp, Oryza sativa
ttcctgcagcccttggcggcacggcgcaaagctccgatcgatctgatagattactatagagacaggctaattgagcacgagcagctaatagctggcctaacctgattgattacctgacccgaccaggccggggcctacgcactcacggtcaggtatgaggattgaggaggcgtgaccaacactggcactgtagcgttgtggcgcctcgccacctccacacgcgtgacactgtgacgatggatgtgatgattgagctcgctcttgtgtcctcctgttgcccggtggggcggcgggcgggggtattttttaggttggcatgggtagtaagaaagtgggtgggaatgattggagaaggtgtatgattagttgaaaagataaaataggactgtgtttattagttacttgttaaaaaaattttaacgtatacgaacacacatttgaagtattaaatgtagactaataagaaaacaaattacagtttccgcctgtaaactacgagacgaatctattaagcctaattaatccgttataagaactgtaacaccatattatcaaattatggcgcaattaggctcaaaagatgcgtctcgcaatttacatgcaaactgtgcaattggtttttttcgtccgtatttaatgctccatatatgtgtccaaatcattgatgtgacagaaaagttgaaagtttgaagggaactaaacacagcctaggtgaaggagaatggttgtgattggttgagaggaggagatagatgaaaaaatagctttattttgggacaaggtattgtgtgctagaaatagttacattttgggacggaagaagtaataactactccatccgtcacataaaaaatctactggatgtgacacattatagtactaaaatgtaggattggatgtgacacattatagaactgtaacatcctagtactataatgtgtcacatccaatcttagatttgttttttttggacggagggagtactatggctgatatatggtgtcaggttcacatattagtcgctattatatatttattgtcttctacttaaacatgtgttagatgttaaaggaagatgattagtgttgaaaaagtatatatatgaatctgagaaggcaaaacttattcgtatcacttgctacgaaaccattttcgcttaaaactatagtactccatttaatatcaagtcctcttagaaggggagatctttggcttatatgcggcgcaaaaacgataagcaacaatagagcacgatgcatgactaattaagttatttaattattataaagttttaaaataaatttatttgaaatttaaaacgcttacaaaaggtcttttcacgtaacacaccgttcagtttgggaactcatctctccatcgttcagtttgggaactcatctctccatcctaaaggaacgggctgggtggaacaatcaatatttgatgctaattaaaaaagataatgatttagtttgtatatacttttttttcttgttatttttgccggattggtttgattaaggaattcctttcattaactataccgcactttcgaaatacgattttcttcaaaaagaattggcattaacatcacttatgctgataacccttatcgatctaaacccctactttaacgtatttaatttgtccaaaataaccataatcgtgaggatgtatctagataccgtattagtattaccctgtagatacatttttaggattaaatttttatagaccggatggagtaggcttgatctccttgtgtgcatttgcagggacgaatctaaagtagaagtgtcggtgttaggcgacaccgatgactttctataaaatctatagcaaaactgtttaactatgttataacaccataatctaaataaatttagtatactatgatagcgatagacacgttatgtcacatacgaatcgattttctggatcagtcactgtgcgtttggttggcgtacattgtgttcatgtgggtcgatttattcgtgttttatttaattagcgtcctcataatctcattgtgtcattgagttgcgtgccctatggcaccatgggatgacgcgaaatgaggaagccttggtgcccagtatgtgcttttgtggctcgacgatcgtggcgtgcattctggccaaactagtttgcacggtttcgttcttcactttcaattgtaaactcgctctcttgattgcccatgaaatattttgagttcgtgtgtgttcagggctaaccacttagaccactaattagaatatatttatgccttgtctagtagggttgtttcagctccatttatcttagattccaactaaacggtttaacctctataaaaaaagagcataatggggtttagaccacttcactccatactttgttttcgaagttacgacggccacatcaaacagactcttaatttttttccataataaactattggagtaccagtaattaataagtatccattaacttttcatccaaatctcctccaagaaaaacctgaccttcccaagttcaagccaacaaccctgacagccgcatggacatacctagaggtggtaataaatccaatattttagcctatgaaatatgagggttgaataaaaagagttaaactaagattttttttagagaggggcatttttatcttgcctctatatccaatcggatatatgcatcctcattaagaaacttagcctaacgaacaggtaacttagtcctcaaataacccaatctaaaaggaacttagctttcaaataacccaatctgaaattcgctcctagtgaggttaccgcaaccactaggcttcatgccctttcacaatcattaggtcttgtacgtttaatccctcctataagaaaattgagggagttttagaggggatttatttcatatctattggggtgaaattataccccttcaattttcttcgttctcttaaactgaggattaacgaacaaggcattacggtctagatgggttgtttaacagggttcatggcccctaatccattactgcccctactcccaggcataccgtatacgctcgccgcgccggcacgccattcccttctcgtcaggtcacgcgtccgaaaccgaccacagctggaagccgatccgatcgagattcagcgtgctcgcgatcggctccccatcggcttaaacccaccacaccgaccggccgctcgcggcaaaagaaaaaacgtatcgcgcattcgcacgcaacgtgccatttttgcacacggcccgcggtaataagggaaatgggctgtagtgtactcctccaaccttttcgcgccggctgtggaccacccgcggacgcgatccccgcctcgcgtcgtcgtcgtcctcgccgccgtcgctctcaccaccaccacactatattagcatttgatatttgctcacgtgtttcaggcgtctgcactgctactgctcgtaggtagcctcgcttgccccgcccgtcacgacgagcgaggcggagacaaacgagagggatttttaaagggccccgggtccaacggggaagagagagagagagacaaccagacgggagcttgtcggggaggagagagagagagagtggtggtggtggtggtgagatggccggccgtgcgacggcgacggcgacggcggcggggaaggacaggtccagcttcgccgtcacctgtagcctcctcagccagtttctcaaggagaagaagggcggcggcggcgggctgcaggggctcggcctcggcttgcggccggcgccggcggcgccgcccgccgcgggagctggaggtaataagcgattgtgttcgtcatgcgattaaattagcagcgacttgttttgtttcttaccacgtatggggtgttggtctttgcaggtgctttccggccgccgccgaccaccatgaacttgctgtcggggctcgacgcgccggcggtggaggtggagccaaacacggcggaaacagcggccgacgagctgcctctcatcaaggccccggccgatcagcaaagcgacgaaagtgcaaggtacaaacaatctctagtacactctgcatcctgacatctcacgatctcaaacaaactctctcctgttcattaaaaaagagtagtaaaatgaacataaaacatgttatcctgacttgcaacttgcatccttatacaatgtctagaagaagaagaaaacacacttaattttttggagtagagataatttggttgcaactgtctctttggttctttcttccagtgaggcagctggagagaaggctcaacagctgaccatcttctacggtggaaaagtagtcgtctttgagaacttcccgtccaccaaggtcaaggatctcttacaaatcgtaagcacaggcgatggcgtcgacaagaacaccggcaccgcggcaacgcagagcctgccccgacccgcacacaacagtcttcccggtaataacaactgttcattcttttgcagttttacattttaccatcacagtgctaattaatttccatctactatgcttaaatttatctactacatgtgaaacaatgtaggaatccttaacgaatgactgatttttgatttgttacagatctgccgattgcaaggaggaactcgctccataggtttctcgagaagagaaagggcaggtaggtaactgagtggctttcaacttctatctgaaatacttgcctttcgctgtcaaaaactggctgtcagaccaagtttatggccctaaaattctccatgctcttcaaccactccaggatgaatgcaaatgctccataccaagctaactgcaccgctgcaccgtccaagcaagctaacggtgacaaatcttggcttgggtttggccaagagatgacaataaagcaggagatatgatatgacctcttagcttacagttcactgtcaagtgtcaagtgatctgtggggaagagatgcgtggttggctggttgctagtgctagtgtattcccccgtagcttcaaagcatgaataattactcaatactactacattactactagtaagaacttaatcaatactaggaatcaagctggtggttaattctgcctgaccattggcatcctggaatatatataagcacacacacgggttgtttgttctccacattgtttgctgctggagccgtatgctcactgcagtttatatctgtctagctggttacccacctcagcctcaccatgtttcgggaataaacactgtgtatgtgcaaattcttcatttctcgttcggtttcgccgtataaattacattgttactattttggctccttgttgcttgaggatttatatgtttaatatgggacatatatttgtgtcttatttttttttaatctagagagatatttgtcttttaatttactgggacatctgcccttttatagatgtgttcgaacaatgtaatgcatttggcacatgcatgtttc

SEQ ID NO: 47195 - DNA, 1181 bp, Oryza sativa
acaacatattccgtgtgagtacggcctccgcaattgcatcttcagtcctgcacccaggccatcagggcaccgtgctccttggaaaatcgatcagacgccatttggcgttgccgcttcttccaggaaactgcccatttgtcgtcgactggggtagatgcgggcaaccggagattatggatttttatggtagagagagagagagagagagagagagagatcggtggtccattgcaccaaacgcggttaaatttctcatcccgtattcatcgcccaagggccgtgcgattggtctagtccggagtccggactcctgcctgaccggccatgaatcattgacgactaataacttcgtggccacaagaaacacatgctcactttgatgaaacgcaaattattgggagctcagctactccagtccctgtgtagatttcaacttttttctttaaacctacaacttttcagtcacatcgaactttcctacacatacaaactttcaatttttctgtcacatcgttctaatttcaatcgaacttccaattttgacgtggaactaaacacaccctcatagttctacgctaaaattggaagtttgaagaaatttgaacgatatgacgaaaaagttgaaagtttctatgtgtagaaaagttcgatgttacgtttttgggattcaaacttggcatctaaatatggcctcagtctgtgtagatataacatcttctttaggggctacatgtactgagcagtgagcaagaacctcattgttcatcgttgttatgattatcaattcatcttagagtttgtgtcgattacaatatcgtaggccgcctaagagttgtattagatgttagaaaaaaatgtagtagaacttttaatctacgctatctcttgaatgaaattaaagcaaactaaatgagacacatgatgtatcgcgtgaatgacaatagggtaggtgtagaaatgggtagttgaggtatttactggtcaaaaatcgttaatactatgacatgttgtaattatgttgaatctggttaaagcgtttgtaattagctctagtagatgtcgggtttggctaaatattgttaataaataccgtgtcttgatgtcatcgttaaatatggtttttttatttggttactaaggtatatgtcgatgcgagtttgataactattcatgcaccaccc

SEQ ID NO: 47196 - DNA, 4210 bp, Oryza sativa
atggcgagctcgccctggccgttctcgctactcagtcgcgcgagttaacttttctccgcatgaagtcacacactcatcgtgcaaactcgtgatgacatcactaacacgttatgaatttgctcactcactttacgaactcactgcgagttcgtattcccgctgtgcgacaatggtatatttctgccaattccttctaaaaatatgtatattcctgtaaaatcggtgaaagaaatgtataattttaatttattttccgttatttagttagcctcctaccgtgccatgtcaaccatttaggggcgggagcatgtgaattttgagtctaacagttaacaatccgcattgcaaagaaggtggcaacgcgaggttcaaggtatcggatcaccattgctgtgatctgagaaagtcagaatgtgatcgagccgccgatcgagctgatggtaacgtgaccatcgtccgtatcgcgccgtaggggaaaaaaaaccaccggtcacgtttttcagctacgagttactccatctaggagtacaacaccagtagtagttcagtgcggttggtcgttgccttagatcttatttagataaaaaaattgatcaaaaacgtcacattaaatatttagacacatgcatatcatattaaatgtggggaaaaaaaaccaattgcacagtttgcatgtaaattgtgagacgaatcttttgagcctaattacgtcatgatttgataatgtgatgctacagtaaatatttgctaatgacggattaattatgcttaataaattcgtctcacagtttacagacggaatctgtaatttgttgtgtattaatctacgtttaatacttcaaatgtgtatccgtatactttataaactttacacccacaccttcatgccagtggtgagcagaggcagacagatcatcactgagcacacaaaaaatatctcggtaacacaccgctaacgctgtgtgtgtgacgaatttggctaacttgtcgatcgatttctgtccggccggtgagtacagcgtcgtctcgtggtgcacgttaagccaggttgtcaggatcggggcagtattatttttttaaagtaatatcgtatcgtagaatcgggatactatgagatttctttttttttcaaagtttaattaatatttatattaattatatatagccattatatattaaaaaatatagtaatgatatatatcatgcaaatagagacatttatcaagagaaaccatgttggtttgatatatttaactgatttttatataaatttgagcatgtttatttacattattttcaaaccatgttattttaaataatattttatagtatcgtagggatcgtagaatcgggatatcacctaagatttcgtaggatcgtgtagtaatgaatagtaggatcgagatactatgaaaattaggatattaggtggaatcggtattgtttcggcttgataggatcgtagtatcgttagatagtaggatacgaatcaggatactgactaccatgacgttgaggaagacatgaaccgtacgagcatgaatgctagtagtagtagtagtaataagggggcaaaatggctcacataaagtcgcgggggataaagacagctcgatcgatcggtcgatggtccctaaacaaggaaaatgtgcgcccgcacgctccataagcggacaaaacgcaagttgttgcttccgttcaatgcaaaccgatggttggctggcctggtgaccacgggtatgtttcggagagcttctagcagctgcaggttcatttagaatttttatttgtcaaaagctccttaaacagtttagcttttttcccagattctgagaatatgtaattgtaaaatctgaaaaatgagctagaagccagaagctgggtttccagcttctccagattctcaccagctagcttctcagcagctgcttcacagaattttaaattccctaaacaggcctaaagttggcttcgtcaggtatagtggcatgcatttctcgtgactaatggccgtaccagctgctgcccgctatgctatgctatgctttagtgctaagactattcatggtgtctatacgtacgtctcgtataaccacaagttgccacatcagagatttccctccattccgtatagctctgggcgtgcccttgcgaagaaactcgtcctcccgcaagggcatgcatggatgccccactgtgatgcggtctcctcctctccccttcaacccagcctacctagtaaccaacctctggcgtgaagctttgagcgatgatagcaagaacgagcacgtcaaggagaaagagagacctcctgataatcattatcagctaatgacagccctaaccataccgtttttctccgtttttagattttctttttggatatcctacttaattacacgtgtacgttagctgctgttggctcctcggtccccatcggttggtctaatcttattataacctataacgacttattagtgattaaaaaataatatgtgaatatatatatatatatatatatatatatatatatatatatatatatatatatatatatatatatatattcttagtggttgaaaagccaaagttaaaaaaaaaactatgttgaaaaagaatcaaattcaaattcaaaattaagttttaaaatttaaattttggctttggcttataagccatagggcaaacgatgaggcccctcgtgcggcgtctttcatgggcgatttccggtgcgccaatcttttataccgattgcaaagttctaacactgccaagtgattgggccacgtggcgtcctaggaattaagctctacccctctgagaatctgccacgtgtttccttggctcttctcctgcaccgttcgatcacgtatcatcatcatcatatgttctaaaaccgttcggctgaagtttgattatatgttgctctttggtgcgtcgactggctctggtccgtatccttcactccctctggaacaatctagctggctacgaaatacaaggcacaccgagcgcacgctgtagcttctcggatttgtgacaccgttgcgtacgttgtgtgttactctccggtaaatcgcatgagtaggaggctaggagcgaacataaatacagcatgtaaaaagcggaggaaaatgaaaaaaaaacaagaactaaataaaaaaacactactctttatttttaatagatgacgctattaacttttagatattacgttcaatcatttgttctattgaaaatatataaattatacttaaaaaaatctttaatgataataaatgatgcttgcatagttttcttaacaagacaaatgcgcaaacaccacatttaaaagtcgacaatatcatctattaaaaattgatggagtattttgaattcttggataaatagaatatattgcattataagtcaaaaagacaaatataaaattggcgaaaaggacgtgtcatcattaatatcctatatttttacaagaaacaataaatagaagaataaatgacccatctaaaagatcggatccaactttacattctgaagaaccatattttaaatatttgttgtacattgtttctttcgttctaaaatataaaagtatctagcaaatttaaaaccaatcaaagctggaagacaaaagtctgaaatggcccacattaaacaagcaggaccactcctgattggcataattaccagccgctattgagctaatccatgctgattggtggaaaggctttgcttggttaatcctttcaatatctctttttggattaacagccttatacggttgcacctattaaacttatagaagattttatattttagatgaaaatttaaatgccagaagcccgtttattttgggaccgagatggaggaatatattattagtaaaatgcaaaactgtcagattttgctaaatcactacaacatgggcttaaacaacaaaattaatgacaagcataaattactacttcctccgtcccattataagtgcagccataagtttccgtaccaacgtttaaccgtccgtcttatttaaaaaatttatgaaaaaattttaaaagttaagtcacgcataaagtactattcatatgttatcatttaataacaataaaaatactaatcataaaaatatttcaaataagacggatggacggatggtcaaagttggacactgaaacccacaactgcgtttattgtgggcgctaattatggg

SEQ ID NO: 47197 - DNA, 10136 bp, Oryza sativa
tgcatgcgtgccggtctccactgcggggtggaaccggttttcattaataggcaattttgcaaaaaaaaaacaacacatatttgtatgaaatatctcatacgtccttggaccggttaacacccgttgcgtttcttccggaaaagccctcctatttcacagaaatacaatacgaagaagagaaaattccacttctagggatagcgttgtaaacataaaaaaggaagggactgtttcgaaaaaacaaccacatctaccccaaaccctagcccatgcggccgccactccactcgcgcccgtgctcccccgctgccatccgccctccacccaccgccgccgatgtcgtccgtcctccccccactctccgttgcacatccttgtgtcaccaccgctccacctccatacccccatgctgtcggaaagggtaaagtgtaggggcaaggatggcggcgcacaaatccaccgccccccgtcctcgggagcgacagaggcgcgcggatccggcggcctctgtcttctgaagcaaccaggtacgagtgggaaggaccacggcgtgcggatccagccactctagcgtgctccccatgccacctcagcgccgcccccgccacggtgacagcgccagccactttggcgcttcaaaaaggaccatttctgggataagttttttcagtggtctatttacgaaataagttttttaaaaggaccaaattgtaaaaattccagggtagatgtacaggtagtagtgcttggctccaagcaccaaatcgtgagacgcgcataccaggaggtagaacgcgaccacgagctcaggaatgtaaatcctgcaagggtgaaaaatcagatagacatgtagtttcaggcatgaattttcagtttttcactgctctgctatcagaggataactggtatgatcgtaagtaatgtttttacctctcgacgcagtctgttggcttcaatggttcaagaagagggacttcaagcttgtcctttacatgatcaccaaccttctcagtaaccacccactgattgacattcatggtctcgagcaagcctgttagagctgcacgcattcggtgcatggccatgacattctcaaatagaatctaaaaaggcatcagatggagagacctggtatatattagataaaatctgtaatcttggaaaattgatgggcagattgagagacattctctgcaggaagaattcattcttacccaggatttctgatggcgttcatgatggtaatggcagtgggaatgcagaccatcccccagacaggaatgctgatttcagggaccatgacagacagcggaatcacaacacggtagaacaggaaggtcaggatgggagcgacgaccctccttacgaagaaaaagctgtagagtagatgaagttttttccatacagatacgccctgaatcacatataatcgggtaaagaaacttattgcatgacaatcctgtaacatgttccattctgtcatattgaagaaggctagccttgtttttggcaatttccgttgcatttttctgaagaggttggcagtaccacaagtccatctatgctgccgatgtcggtaggctttgaaggtacttgggagttcactcttaacctgctcaagattcattattaaaacagggtaaaatattcatatatgcttattaaaggatcaacatatacatacccttatatcaccaacatacaggaattgccatcccttgaggcttgcccgtacaggcgtacagccaagtccatgtcttccacagttgtgtgatccttccaacctcctgcttcgttaatagtagctgatacccgccacacagcagcagtacctgtaggcagatcagtgatgttaggaccaggcatgattagttcacgtaagtagttctgatattggatcttaccgttgaagccaaagaatgaatgcatagatgagcctgattcctgctctactttgaaatgatagtccagtgacatcttctgtatccttgtcataaggcaaacatcatagttcactgcaaaattgcccagcaaaggccagggcagaacagcctgtaatcagaatgaacaaagattctcacttaaaataaccaaataacaccacattacccattgaaaacttgaacaaattgcatcagagaattaacagttatatccaaattatgggttttctgggacccgacaaaatttactttttaataacttaaaacggtgcaacattggatgtgcccatttttccgataaacttcctttcattttcatttagtgctataaggctataagctcttcatagttcagtctatttgatgaacatgatctgagagtttagtagacaagcaatacatataacagttgagtgaccaattcaacagaaacataaatcggactatcagaccaacaactgaagcaccgctatttaatttgattaccctcacaaggttggaatgaaacaatgaaaatacttgcttaccaaactcccaacgtgtctgaaccagaccaatcttagggttatgcacaagaaatggtattatttttagaaggaaatcagattcaggttggaaatctgcatcgaaaatggcaacaaaatcgcactgttgggtatagatatgttccatgcccttcttcaaggctcctgctttgtatcccttcctgttatctctgatttcatactttatgttaatttcttttctcgcccaatcaatgcactcaagctccactagatcctgcatttgaccaaaatctaagtaaagaaaccaaaatcatattttaagctctaactctaaatagaaaataatgatggattgtgaaaatatcttctgtgaaacatgaattaactgcatgctctccaggaaactgatgcatcacagtaacacacagccaccaattcacatgtttccagttcatttttcatcactacactatactgtcctatctacagcaatgcatctctatctttaacaatttgttgctgctatcttggcaggaagccgtactgcgagaccggaacttcgaacgccatcatcttctcccctcgagcaaacccgttgcggtcgtaggacgagatctcggtgatgtccagctccttgcacgccctgatgagctcctccccgatcctcccagctgcctcctgtcgcaacaaggccagctcaagatattactattacttacaaatgagcagtgtctgtttaattactaggtgaaattcggggaggaaaaagtggccggcgtaccacggcgccgcagggagggtcaccgcagatggccttctgcagggtgctgccatagaagaggatcttcttgttgtggtcgtcgacgagcatggcatagagctgcctgttggagcagaacacggatagcctcggcttcgtcgccgtgccattgaactgcagcgccggcggcggcaagaaccatgtgagttgtgagcagaagagcgactggtggttaatttgtgatttgtgcagttgagctggggtggatggaattgaaccgtaccttcttctgcagccggcggttcctgaccttggggttctccttcctcgcgccgtgcctcgccgtggcctcgatcctcgggtacgcgcgccggcgagctactccgccgccgcctgcagaatccagcggaaagaaaaggaacacgccaggtgcgaagcgcggcgggaacacgaagccacgcctggagcctggcgagctgggagggcggcagcacgccgggcgcggcgagaatggcagcccggttgccgcgcggagcgatgccatggggagacctggctagctgcttggggtgggcaatctgtcgagcaggtggggcgcggaatcccggggggagctctacagtacccgagattaggatttatgaatgatatttgtcctcatttctggggccccacctgtcacctgaaaggtaatctttatatacgatttcaggggtggaaatgaggcgtttgattgggccacgtggctcactgattatttagggttagttcatctgaaaatcagccacgtgtccctgtgcaatctcagatagtcagatcagtaacttctcaagctggcctgtcttctcctacctgattggtccacatggacttacaaaatgttgacacgtggaacaaagacaagatgcagcctgcagctagcctgctagctacgctctgctttcatggttacaatcctctagatacttccaagctcgtagaagtatagtcaataaattaaattaagaacacctagatcctttggatgatctcaaaaatattaaccctagaataaacattacacagcgaaaaacgatacagcacaaaatttaggaaaaactaggagaaataccataaattggaaaatgaataatgacatgttatagtgaaaaaatagttgtcaaaagaaataataaggccaagactttcttttgagaaaaatcaacaactcaagtctagagtctagatgcttttgagctaagggtacaagcggctacccacaaaaacccacttataggctaaactaacctgcaaactcgcttattttgacctataagtgggttcgcgggtgacccgcttgcaccccaattttgagcgggtctttgaaactggagctcaaaaaataaatagagaaaacaatggaaaattaaaatgtaaaaaaaaacagatctctaaaattgaagctccaaaaaaaaagataacacaaccgaaaatcaaaatatgtaaaaaaaaaaaagggagctaaaaaatagagaaacaaaccaaaatccaaaatgtaaaatttaacagcggagcctcctctactgtgttccttaaaaaaatcacaatgtaaaagaaaaagaaagcacccatggatatcagttgcactgtatagctctgacgatttcagatgctagatgtggtcgattgactatgataataattgaaaatccaacagctcgcaaacaaaattttccaatttatgaaagctacacgtaatttcttactgaacatgcatttttaaataacaagtaggtaacataataaggcatatattactattgtatttccactctcaacctttgataattaaattaattatgtaaagacttgcaaaattaatctgatcatgtcacaggctataaattttgaagcacgccaactggcgtgctgatgatttttctagtacaaggcttaagcaagggaaatcgtaaaatgccccctgagtaaacgccaggtcaggtttattctttccgtatccatcttgtgctctctctcacctcaattaatttcaaacccccgtcaaaaactactcacgtagtacaagtacaactacaagccaacccgcttgcgctttgcccaccatttccacacccgcccaaagctgcgcgccctagcaacgcatggaggggcagtgggggcggtggctcgccgcagcagccgcctcctcctccattatatattagtagtatatatgaatttaatgtgaacataccaaataattaatcaatgaaaaatttaatactaatacgcagcatggtcaaaccggtacacatacataaaaatagtcatttgcatactggtattatcagtgatgtctttgtgaccaaaacttgtgaccttgatgatcaatggggaccaagcagcatgtgacctttattattaatccaaacagatgaattactgatcctcacattatgcaccaacttgtgaccttgatgaatcagcatgtggactagtgcatgcacgtgtgctgcactcttgccgtatgcgtgtaccgatcaatgtatgttgtggacagacttgccgtatgcgtataccatgcatgtacatgccctagcaatactaggaagccatagaaaaaatacaatggaaataaaggatgggatttgtgccttaccacggcgggcactcagacggagccataacccccaaaatccaaaccctagacaatccgatctgcaacaaaaccaaccaaatctaagacaaattgttgccaaattgaagaagagaagggggaaacggatttatctcatacctcgttggccgtcgcagtgccgccgccggtgaatcgacagcgccgccgccgccgcaggagtgaggctgggacgagtgaaaatgagactggagaggggatctgtagttgaggcgctggtcgaggaggagaggatgggcgccagccaaggaagagaggcgccggcgttggaggaagtggcgatggtgaggaagggctggcggtggcggaggaagcgaggcgacggactctgctcgtgcgtcacggaggctgggaatgaagagaaggatttggtttttttttattttttttagaatggtatgtgggaccctgaactgaacctgtgggtcgttgattttagattaaattgcatattgtgccacctttctttaccctcttttcgggagtgagggttgagaaccctcacttttcggcacacaaaacgaagcagcgttttaatacgtgattaattaagttttagatatttttttcaaaaatagattggtatgatttttttaagcaactttcgtatagaaactttttacagaaaacgcaccgtttaacagtttgtaaagcgtgcgcgcagaaaatgaggaggaggagttgggaacttgtactaccgaacggagccttactattgtttcaacttgaactagggtagagtaacctttccactttggaccatctatatttacatgtttcattttgggctcttcaaccttcaactccatcggttttctatccgctctccctgaattgcacgccacactcatcctcaagctctgctgatgccacactatctcaagtcccgctgtttgccatactctacctcgagctggagcttgacctcccaactaggaggtcgatctcctttccaagcgggtggaggtgactccgacggagcttcggcacgaatatagcgctggtgatcacttgtaggcctgcttgtggtgatacttctagccctttgcagtcaagattgagagaagaaatagagacaagagagagggagttagatgtggaagaagaggcccaaaataaaacaaacatgtaaatttaggtggtccaaagtgaaaagattgttctatccctggtccaaattgacacgatggtaaagcaaggtggctcaaagtgcaatttgctcttgattttattagctgagaccacggtgcactgtggggaattgaaatatgtgatgcgtggcttcattcactttttttttgtctatgtagagcacatgtccacatgaaaaaaagtggatgcattgctaatgcacttatgagtgagaggggcataggcaagatggacatttcgcgttccattgccaccttggttggtggtgtggcagccggggccctgaaattgggtgtaaaatggcatattagagctgatttgtggggaccggggggcaaattatctaagttatttagaaagatggcatttaggaatgctacatcgaagtgaatgcaaatagtccaaaatctcggttaagttaggcgattagcatcagacattcagaatttcggactgaaacctttataaaccaaaactgcaaagttcctacattggatttatagttaacaaagtttatagtcaataaaatgtcaaagtgaggagcctagtggtatttgagtttttctattagtgaatacaccacttccattcctttttctttgaagtttttaaatctaatatacaactttgaccattgttatcatattaaaatttagtaataaaattacaatgtcataattaatataaatccaatgacataatcctcatggacaccgccgtagggccaatcgccccacccttgacatcactgaagctcgattcacaccaccgaagtcgatatggtgccgtgggaggggaatgggatgggagggggcaaagggaggtggctccaatagagatagaggggaaaggtgtcgccggtgaagggagaaaacggcgggtctgagaggggaggagaggtgtcgctatcggagaagagaggagagacgatattatcgtggacggagatggagacgcattgcacagtaggggagagagagagagcacgcgatcgatcgatcccgcaccctgtaatcctgtatgcgtgggagggagagaaaaagaaagggaaaaggtaacacgtctccctcaacagtaaaaccgagtggctgagggaagcgattcaatgagagcaagctatggagaggcaacatagacttttttcccaggttaaaaccaaacctgggccgtgagtaatgctacaatcctatacaggcccatatttgaaatcagtaaattcttatattgggccgctaccgacagaagcggtccctaccaagctttcgcgtttcttcccacaaataggcgcgcaccttttcccttttcaaaatttctccccccgaaaatttccatttcgcgctccctcgcctcgttccccttccacttccactcccagatgccggcgaaccccaagctcgcggcgaagccctcgccgtcgccgccgaccgccgccgcagccgcctcccggccgaaagccacagccaaacctcccctcggtgccggataccgcgacaacgacgacgacgacgacgatttccagagccctccccgtgccagcagccgcgccgcccgcgcgttgaagccctccggtaatggcgcggcctcgcgccgccccagcaagaggttgaagccgtcgtcctcgtgttgctccgggaaggagaaccgtccagccgccgccggtagtggcagggctcccgctgggagggccgcctcgaagggcgcgggggttggcgaaaccctaggtgtcgtctcgagggttagcagcggcgttccaggcggggacaaagcgaggggcggaggaatttgcggcctattgaggtgcggatctgatgactttagttcagtttctaatgggaagaaaggattggatagatattggcgtcgcgatggaggtttgcattctcgccccaatccgatggattccacggtttcgatgccggatgccacatgtgatttggaaaatgggggttctcaagtggcgcaaatgctcagctccaatgaccgtatctcagttcagttggaggggaacgctaaggtggagttgggaaagtctgaatctgaccctacgactatgcggaaggaacggaatggctctggggcttgtgaaagtgatcatcctgcaagattgatcgagccgaggcttctgacattggttacaaattgtgattttggaggtgcagactccatggattcaaaagagcttggttcagcgattcatccctctgtttccaaagataggaatgtggagaacgaatctgggggggcatctgtatgtacatttgcacttcataacaggaattgccactcgagttgtgttgaatccgaacttgagatgttgaatgcgaagtatgatttgggtcctcgtgattgcaaggaaagccaagagggtccgggactttgtagcttgatttctgaagagaggacagttgcggcagaaggtgatgcaactttcacattcgaggaaagggggaacacatcaagtggacttgaggcttgtaaggggagtcactgcttggatccagttgaaccaaagcttatggactcatgtgcaacacatgcacttgaaggtgatggttgtgatgattttgagatcggaacacaacttaatgagctcataaacttgtgcatggaggattacacggagggtcctttgagcaacaaggtggcttgccttgaagggaatggaatggattgtgggagttttaattcatcttgtgaagtgcaatgccctttgtgtggatcaaatatttctgacttaagtgaagagctccggctggtgcatactaacagttgccttgatggagataaacctgctaaggtgattcttctatgtatttggaaaattaaaaattgttgtgatctagtgtaatgaccgtgataattattgctgctgaattgttaccttgttagaaagctcaaagacaatcatatggtaaccttaggcacaattttgcttcttgaaatttcccggttggccttcagttattcctctgcatgaggatcatgttagtatgtttattcactgggttctaatcattgttgtgccgatttttgtgtgtccatcattaagttcttatctgggacaatagatgaatacatcttactacataggggctgcagga

SEQ ID NO: 47198 - DNA, 1247 bp, Oryza sativa
aactagccaaaatttattccttgtgctagaggcagctcgcttccatagttgatcgtactgcagaaatttggattgagaattagtgtgcaggaaatgcataactataacataaagaattatctatgcaaagatttcgagcatggtgaacacacactagaattattgccctgaatatcttgcaacagaagctactcttgcagtaattatcttcatggcatggttcacatctcaaggaactagaattcaatgtacataggataagcctttcattgggaacatctatacataagatattgtgatccctatgcttcacagagttttgggacgtcgcaaatacccattgaaaaatatggcagagcaaatcaaatggttttctcagtgctaataatagagtaatatatatgtgtagttctatttgaatttattgcttcatggcattctaagcttctatttgtatgatggtactcccaaggccttttgggtaaaagtgctatcccaggtcagaatgatcacaatggatgacatggaatagcccggtgggcggtggcagagatgatattctgacaacatttctatggcgtaatggtgtctacacaaccgaaatgttacagcatccttatgtagattagttttatgtacatcgtaacatcaatgagagaatagccagaaacttcaaaactcaaaatcacagtgaaaaaagaaggtactgtggtggctggatcccggttatgtaaatattctccgtgcagtttgatacagagttaggtggtgtttgggaaagagggactaaactttagtccctctcacaaaaaaattagaccctgtttagatgggactaaaacttttaagtcactatcacatcgaatgtttgcactaattataaatattaaacgtagactattaataaaacccatccataatcttggactaattcgcgagacgaatctattgagcctaattaatctatgattagcctatgtgatgctacagtaaacattctctaattatagattaattaggcttaaaaattttgtctcgcaaatttgctttcatttatataattaattttgtaagtagtctatatttaatactctaaattagtgtctaaatatagagactaaagttaagtccctggatccaaacaccaccttagtccctaactaaactttagtccctctcacaaaaaaattagtccctaactaaactttagtccctctcacaaaagcaaaagtccctcccatagggac

SEQ ID NO: 47199 - DNA, 24847 bp, Oryza sativa
taaagagttaaacgaagagaaaagagcagatctgcagcacggacttcaagatgtgatgtgtgtatgacagatgagaatagtatattatgcaaatattctataaattgactattacattggttataaatgatttggagttagtagtaggctatattattaaacttgctcatagggccctggactctgctgcttgaacaagcaaagtttacagtaaataatgcagtgggtgcatatgtgaagttctcattttattttatttcttgtttgtgatgttggagtgttatccttttcgtttttagcctctcaccattttccacacagcatataagccaccaacaaattttaaaggtgcatttaggtttttattcatcatagtttttttttaagtatttgtcttctaaatcgttcgtatatataaatgttttatcggtaaattatattcctattgctgctaagcccaaacaagatatcagccctatggcatgagataagacttggaacgaaaaatgagattacatgagaaattaccactgatcaaatctgagaacatgtttggaacagaaaccgctcctacgatcgtcgatcatgtctgtcgggtctggatcctagtagaaaagaagaaaattgaacggagattaattactgtactccacacagagctagtaagcacctttcatctttaatcatggcctctcttttctcctttagagcagatacaatagtaggttataagccagctataaacatattttaaaaagataaagaaagagagagaagagcagcgggctacagatctgtagctagctgcagcacgaactccaagacgtaatgtgtgtataacaggtgggaccaaatattaatagtatagtaagcaactattgtatgaattggctattacattggctataaatgatttggagctaatagtgggctgtactattaaacttgctatatcccttccctttcctcccagtcccagccaggttgcttctgatcagtcaccataccataatagtaggcttaaacacctagcgcatatatatatatgctccactgatccagtacttaaacactaggagcagtagcttaaacacgagggtacactcaggtagtgtctagtattgcaccggtcgccctctcgcgatccgagcggcgaggccacacgccgatgtaaaaccaccccaattctgcacgggaaacgagcacacccgcaccgtgcgccgcgatcgcttggctttcacggtagccgcgcgcgcgcaccaaggggaaggcggaaggcagcagcaaccagcaagtcccacgttttttagccgccgggattagcgcggcggagcgcctagtcggcacgccgctttttctactttaaccggtgaaccccccacgtcccccacctcgcacggtgcgggtcgcaccatcatcacggtcgcacggagccgtcggtggggagaaaccaaccggtcgggccgcgcgcccgtgaaatccccgtttcagtggaccgtgggctagtcaccaacctggcgcaaccgggccgcacgcccgtgaaaccgcgtgggctactcgggcgaaaacctggcccagactggcgctgcgcggccgccgatttcacagcggaatcggctcgttttcgcgaaggaatttttgggccggccttctcgcacctatgtggctgggacaatcgcacaatcaatggaccgctactcgtctgatggaggagtgcacgaacgcgaattatttctgcagtgcagtagattcgtcaaggagagttttttttttaacacatatcagacgcagacgctcgtaacacgtacacactcaaacatcctactcatataagtactttcggaaaactaggtcgacaattttgaggacgaagtcactataggcgtctcgctatcgacaggtacgtctaccctaccattgataaaataattagccgaacatatgtatcaattctagaatttcaatccgggtgaattggttccaccgcaatgaaaaaataattagctgaacatatgtatcaattctagaatttcaatctgggtgaattggttccaccgcaagtaatccaactagtcgagctaagcttaatctgcgtcaaggagagagtttttttttttttgaggtaagtcaaggagagagttgatggagctgccacgagaatacgctcttctgccagatctaacgtaggggggaggttcaccggagcagcggttgcgccatgctctctcgtggacgagggaatcctgcccggccatcacgtatggccggggtacgggccggcagaatctcgccgatgtcaagcgtgtccaaccacaagctcccaagaacgtacagcagcaacgcaacgcaacacagacaggcgtccgtgcctgcaacggatggaatgtgcgttttcttctctgccacacggacaagatattacgctctgcccgtactgtaccaacaacgttgtcaatcttaccgttttattactctttattggagtgtagaaatcaggtgatcaaacagttattcagcaagtgttagagatgatgtgaatttaactagtgaattgaattggatatggcagacaatctggaatcaacagatggcaattgtcatagaagatagttgaaaaaattgaatgcgttctttacagtttcagggcagaagagagtagacacatggaataggcctttgtcccagaacctccttatcatgattcaaattacagatggttcatgtcagaaataatggaggagcattacatgatcatagagcttcattgctaactatatcccatatttatatcattacgtagtaacaccataaaccccaagcttgccaggacctttggaacctgcagattggaatcacactaatcagatcaaaacagagagacatgctagatcaaggataattcacatttgagttgagttgaaaatttggggatcaaagaaaggtatatacctggcatgaacgaactaacatattcacccaactttacatttcaagcacaatatctggaaacaagaaaagttcatattcagtcagttgctccattgacaaaagtggcaaaagaaaaggttcaattcatgataggcaagtatgctacttacactctgaatcagttttgacccattttgcaccatcatcgtctagatcacgcagtgcatcctccaggcactcattgatttctgtctcatctggcttccagtccaaatgcctcttagcaactagcgtggaagaattttgcgggtgtattttcttctgcaatattgccttgagcaactgcaatgaacatcatataagataataagaggacgagaaagtatgtaaaacttatcatgttacataagaaaaaaagaatttcactgtgtaccttctccattcttgattgaggaaatgtgttccttggttctggaactacggaggtaaagccacccttacacatgaataacttgagcaacgaagcgactgatctcggcttgagtgtatttcctttctttcctaacgaattctttgatttacttacaatgatccttttgttgatcaactgtctaatatgcttctcattgtcttccccatcggcacgcttttgtaaacctacttggtcatcatcatgcgagcgttgagcttctgcttgatctttgattgctagtagcgtttcgaattctttccgtatcttgtctacttcttcctctgtaaatttgacggtatcttgcactgactgcacattgtcggatgaattctccacctgagctacctcctcaatctgcttatttccaaatgtcccaatagcaagcaatgattggggccaatcactgaattcatcctttcgacaatctgacacgttagcacctgcgcattagaactcgattaagccgcaagatcagtaaacaaacataaatatatggtcctaagttcatattagcataaattggatgtctagagcatggaccacaaatttttaatccttaaacacccagtgattctcattggcctatcactctttaagtacaatgtctgcccatgcttactccactccctgatgttttcacctgccatttttctgtataccaggaataacttatcacagcagttgttaccacttaaacaatgcattctctgtacaatagtagtctttttatgtaatcttgagagataaataatgtactgtagtccagctggactagtggctcagatctgattccttagtacgatttacgaaaccatccgaggtcaggatattgtctgctcaaatcaaattcttcttggtcacaagtggagggttggggttataaatcaactaaataattgaagccatactgactagttggaaacacttgcttgcagggttgcacttagtcaagactttgacccatactgactagttggaagcagtgctttacagagatattggcgtggcgggcatcaggccatgaaatagtcctttgggggtataacatatgcacaaaaatctctcacttttcgtgctagggaagaggaaaataaaattgaaaactcctactgaacttaaagcgccgtttaaaatgcaggaattttttttccggaagtgcgataattgaactgtttccagtgaaattcctgcgttccaaacaacacccaagtgcatataagaaaattttctcaaaggatcagaaacaacattgtcataatacatcaatgtttgctccatcacattggcgttgtgataggttactcaggaatcaggggatggtaatccagaaaatcgcagagcgaaaagcgttctgttactagcaattaggagaaacctttaaatcgttcactcttgtatatggctaccaagacaacaaagtatatcagcatattcagaaatgaacatggcaaatgatgcctaagcggaaactgctaagaggtaaagacaccataaatggagcagaatgacagcaggaaaagattaaattaggacaaagcaataaagtatcatcgtatccagaaatgaataaggcaaatgatgcctaagcagaaactgctaagaggtaaagacattataactgcagcagaatgacagaaagaaaatatcaaattaggaaacggcttccaaattactgtccgtactctccctctcccctcaaggaacagggaaacatttcataagaacagcatgaagcctggtgaacaacaatcaccttagttctgaaagaatttacaaggaaactgaaagttcaggtacactcacggtaaggcgcagaagaatttgcgggaaaccgatttgcttcttgcttcccactgatcttgttggctacccagctgaaaatctgcagagaaaacccaagcctcatgatgccatcaagaaatggatcaacactaccaacacttcaaatctattaacctctctgaaatgattaatcacaccgatggtttgagcctttaccttcatatcctggcctgaagaatgagagattggggagggagaaagcagctagctgatgaagctaccaagaaatgcaagctcctagcaatggcagagagaggaggaaaggagagatgtaagacttgtagtggctgctattggcgatggaattggtgcagagaagtactactagtagcctactgggtgtgatttgaaggggttcaagttccaaggattggagggttcggtgcagcgtggctggctgtaggatagcttgctatacttcatctggcatgtcacttcctttaccttccttttatagatgactccaaaccgggttaccagctcaacaggtgagccatggaatgataacaggacacagctatatatataaacaatggaatttgcactttcttcggaagagaaaattcggtatttgcaactccagctaccgtacgcccatatgcgccatacggattgtaaatattgaattgatgtttctagatatagatagtgtaaacttgtgatcgacctcacacttttgaggaacccaaaattgtggtagctacacctcaacgggggtgcttctaccctacttaaattgtagagaagtttatggtacttaagaaagtcatgcaggacttgtacgatatttcgagacacctactagagatattaagttttacgataaaaaaccatcatctcgatataccttcttaagaatgataaaactatctgactactctctctgtcccaaaatatagcaatttttgtgtgtccaaattcatagctaaaaattactatattttaggacgaaggtagtatatcgtgagatcgtctagtcaggtgttcaaaaactcaacatgtaagaaaattcccaatccatccctagaagaagctataatttgacggttcagctgcaataagtagggtgactgtagttttaaacagtcatattatgttcgccagatcaaaatcaaaggactcagatttacccaggtattgcagactgtttgaataccgtgcactggttcgcttgcactgcagccagcgagagagtatccaaaaatcaatgcctcaaaggaagaaacccggttgttaatttttttttccagggggagaagaagagttattagctaagataaagtacagcgcggcgagatcgacggcaagttggggcaccaagtgtcacgaccgcgccgcaacggatcccatcgcacttggtcgggcccgacgcgtgtgccagaatcacgtgttaacttccttaaacccggcattagcgcgggtaagtacggggcgcccgccttggttaaccagcacgaggggcgcctgcaccgatgctaatcacgtttctgggggttaactgctgaagtacacccccatctccactagcagctattccgtccattaactacgcaataatggtactagaccgtggatgcacctggaccaacaagctaacatgacatgatagtgctatatatatatatatatataatctgcaaaactaaaattacgttgtggcaatacattgtaacaaaaccaaatttatcagtttagattagaagcgctaacgaaaattctactaattagatatctctagtcaatttctaaacacacattcttatcgctacgtgggtgagtaggggtggttattcagtctgaccgattaattttgtttggtttttcggtcctctcaaaacttcagcctctaaaatcaagatcgaaatttaatataaaaccgtaaaacctaaaatattctatcatttttatagttcggtcttcggtcatggccgagctgaccgatcaatttcgatacatgttttgagagtaaattttgcctgcaattcctcaatcccacaactgtagttgtcgttctcctccttcaggcactctccttcagcggcctggaggcattgtcgccagccacctacaagctagtggagggagcggaggcacaagatgggaggagagtgcgactgtgctgggacttagccagtgactgttggggaagacgagctagggataaagatgaaaataaggtggtgcttgaaactaataaagattaagattaagtaagagcataaaaaaaaagaaagttactaatggttaattaagttttaattattactagttggaaaattgatttagttaatattttagagcaatttctatgtagaaagtttccgtacgaaacgtacctttttagcggtttaaaaagtatgcgaacagaaatcaaaatatatatctatatcttaataaaaaaagcagggtaggtttgcttggtttcgtgctatatttctgctcaatccgtcaacggttaactgaggccttatgaccagaatttcccgtattagatttggttagccaagagcacagaccgaattctttaacgggaatgctacgggacgggatactgtcccccaacgggatgctcctcctccacaacacgattctcacccatgcgacgcggccgaagccctcaacgcgcaccaggcctgctcacccgccgccgcggccgtccctcgccgccatcgtcgtccccccccaccaccgccgcgcccatcccccaccgccgccgtcgccgttccccgccgccgccgcgccgtcccgtgccgtcctcgtctacaggggacggctacagtaggccggccgcgcgcgagtcgggatgctccccaacgggatgcccagctatatctagtaggaatcacctgatacctggtaggtatcatccgatacctcgcaagtatcacgcgatacatggtagaaatcgtctgatacctaacaggcatatcacatgatacctcgcgagtatcacgcgatacgtggtagaaatcgactgatacctgacatgtatcacataatacctcacgagtatcacgcgatacgtggtagaaatcgtctgatacctgacaagtatcacatgatacctcgcgagtatcacgccatacgtggtagaaatcgcatgatacctgataagtatcgcatgatacttgcaagtatcacctgaaacgtgtgtagaatcgtctgatacttgaaaggtatcacacctgatacctactcgggatcatcccattcgaaaacgggattccgttatatactacccccattctttaaacatatcttaggtttggccagtggggcgtatgctccaattttatgatattatatgatcctaccaaaccaaaatgatactgattctatctagtatcctacttttcatagtattttgatctttcttttcacacgatcatacgaaatcttaggtagtataccgattctacgatccccacgattctataaaatactatttataaaaagatggattcaaaataatatgaattaatatggttaagtttacataaaaccaattaaatttatcaaaattaatattatatactttaatttatacaacatattctatattccatataaaagtatatactttctaaattctgatagtttcccgattttatgatactacagataaaaaatgatactaccctcgatacttatcaccttcctcttaggcctagtttagttctcaaaaatttttcccaaaaacattatatcgaatctttggacacatgcatggagcattaaatataaatttaaaaaataattgcatagttaggggggaaatcgcgagacaaatcttttgagtctaattagtccatgattagtcataagtgctacagtaacccgcatttgctaatgacggattaattaggctcaaaaaattcatctcgcggtttccaagcgagttatgaaattagttttttcattcgtgtccgaaaacccctttcgacatccggtcaaacatccgatgtgacacctaaaattttttttttcacgaactacataggcccttagccaagagatcctcaatttgttaggcgcatactccattttgtagtagtacaacatgcgtacagtcggaatgtcgattacgaatctcacagtacgggaagaatatgctccgtcctttgcaactaacctgaagatccttcttcagagagagctttcaacttccaagttccaaagccccctggcataacgcaacacaccaagctactgctgtcactgcttcctctccagatctttcctgcaacctgtacttccagacagcaacgtaacccccctagctgcaaacagcggaccggaccgcgacgacacaccctgctgcttgctatgtgggcatgtggcgcatgaggtcggcatccggcatattatccttgttcgatccccccaccacagtactgtacagtcctactacactcgatcgatcagtccagtctcctccatctatccatccccacatgtacgtcctctcgccatcgccgtctcatgttcatgccatggacaacggcatccgtgcgagcgagatccatgacgagacgagagacagcttgcccagcttgtgctcgcaccgtcgtcaatttgcgcaagtctgccgtgccggcctgcaacgtgtgcttgccctgcaaaccgctagcaaacgactactggaagagtctccttgcctacactagctttgcgtacgtgcagactggataagagatgataatcaactagccctgtcgggagaaagaaggcgtaatcgatgtactgtgatgtggggttcaggcgagaaagcaaccgtaaaactgtgggtgctcacaagatgttttactatacaggtttagaagaaaagagagggctctaaggcaccatgttacatagtatagacgtcggatcacctcgtggcccacggatgacataacaacgcctacttcccatattctgccggtatactctgaagatagccctacacctaatagtgaaatacaggtacacagagaatttggggatcaatatcagcttggatctcccacgagcaaattcaggcatcaaattgaaataaccctgtgacggtccatgagtggtggatggatctagcctctaccccagaggtaccaaagaaaggcttgtgcaactttatcctcctggcataatgggagttttggaaggagcgaaattagggagtgtttagacacaaagaactatcggcaacatacttggttgcaaagatcaaagagaaggcaaagacttggaccatgacagaagcgaaagtactatgtaacatagtgccttagagcgctttcttttcttctaaacctgtataaaactattcatgtacagttttttcctactatattcaattaaattggcatactctaagtgccggtttgttaaaaaaaagatagttaactaattccctgatcgataataatgaatgcacaggtgcccccgcgtcgccctcccccaggcggctcaggaagcgacgcgcccaccgccgccttcctctccccgcctcctccgcctcgccgccgcctgagcaggcgccggcaaagccgcgcggccgcaaggacggcggcggcggggcctcgtctcgcccacgttgcgctcgaaggccgggggagctgtccatggcagcagtggtggtgaccagatccgtgccgtgtccggccagatctggcaggggggtggccggcggcgggggctgacggtggtggtggcggtgctggtggcggttgtggcagcgacgacgctggtggcggatatggcggcgaaggagatggcgacgacggcagcgggccgcggcgcgtgtcgcgacgccggccgggctcgtcaaggacctcgccgccacgacctccggcatgccgccctcgtcgacgctccctccatgacgctgatgacccgcgctgcgcactgcacctccagatccgcgccacccaggccggatctggccggctggcggcggtggcggatggcgacggtggcggctagcgatggtggcgccagtggtggtgatggttggcaggccatcacgaccgaaggggctgacagtgcgtcgttgttggcggcagcatgtggaggcggggaaggagaccgggtgtgggcgtgacgtcgacggcgagaagatctgtggcagtggcctaggctagatcgctaaagggaaaatgtagtcgaccggcgatgatccttcttgtgcggatggttgtgtgggtttggacagggaatcgctggcaaaagcctcactgagccgtttggctggctgacggcggcgacgccctttggcgtcgttcccctccctggaggcgtcgttttagcgtacccctctcctttccttaccattctccgggtgaaaaccttgcttcggcttccgaacgagcggtggcggcgatccacgtcgcgtcctccttgggggcaccgctttggagaaacttattcgtacaaggatgtcgttgattgtctatgcatttgcttcgaatcttttcagccctaggttttgatgagtcctttgctttctagctccaccttttgttttgcagtggacgacctcgctctttgtttgattttgctaggtggagtcggagctgcttcgtcggggtgacgaaactgggcaacgatgacacgttgcgttttctttctaggggttttgttgttggccgtaaatagattgtggcgcttaggcggctttggctgatgttcatcgtgggaagtcgaagctacttgatcatttgcagcatctaggtttagatggtgcatccggtttgaagtaggagctgccgtgtcgcgtggcggcaagctcggcaaagatgacacggttgcaaagtcggaacctcctatgttgttttggtcaaccttggtaacgacatcctacattggactctgtcagtggttttagctgttagtgagttcggtggttggtttttcttttcttgtaacccgtctagggtttttactcctgcttattgaaaatataattggcagctcccctaccggtttagtttaaaaaaaaaagataataatgccagcaggagctagatgatgatcgatacgatacctctcatgggaaaagatcagatcattccacggaccactgtttggccactgtttacaaggccaatcttgtatcatcgattctacctgccgacttcagagatcgacgcagctcagcctcgatcccaatcactgtcaagtcagcgtggcgactgatgaggagcaccactagcactgttccatttgtaagtactctgctagctactagcacaagcaaagcgatgcagggatcagctagggattcgtcagcttggccgtgctgataatataggaaatgcccttggtttacaggtctttcattggacgcaccggcgacggctttccccatgtggtgttcgccggggttagcgattttgatacatatatctggcaggtgaaggtgctgcgccgtcgagatgcgcgcgcggcgacttttcggcgcgtcaaacacgagaagcatatagaaggaatagaatagttacatggagctggtctttagccaaattctcctgaaatgggaaagcctatgggagaagcgcagatgtcaaccatcgacccttgcattatttggaaaattctaagcttagggctaatagcagtaggagagtgtggagtgtggtatggtcgaagcgtacaggccggtacatgggactgatggtcccatggctatggaggtctaggctggctttttctagcaagatatcatattattgtacaagcttcagctctcaaagatgggtggagatttggtggtcctgaaggaatgttcatcgccaagaatgcgtttttagtaggactagtgttcatcttgcctgcagcttttgttggcacactgcctgagttgaaaaaaaaaagaagagcattttgtgtacgaagtacagagcacagtaatttgtaaggttggacttggaggttgcaatggtcatatcttatcctccaaagtgagcggactagacatgttattctgtaattttcatagactgtgcatgattaatgagccaggacatgttttctcaaacttgctgcaattcacagatcatagctaatgcaatgcatcctaatatctctttaattaaccttaatagctattgtttgatcagaaggtcaacagagaccgatccaagtttggattgcattatttggtgtttccagtgcgatatcgtggatgagaaaataattctgaagcaactagtgtgcaagagttaagaactaagaaactgaacttgtagtttcagactacaagcaccttattccagtagccctcaactgggttaagcagacctttatgacagttcactcactatcagcacattagctatggatgttcagatagcatcggcactaaagttttttttaagggatgcacattagctatggatgttcagatagcatcgatactaatgtttttttttaagtgatgcacattaactatggatgttcagatagcttctttctattaaacatgtgtgctaagtttacataatcatgtgcatattgtattactcatgtagctggtgggtgatggcagcaagaacaaataataaatggatagatgataggaaataccaggctgatggtggatctgttcagcaaatcgagtcatgggctgatgggtctcccttatgacacaccttggctgaattttgctacgtcttcatggctctttctccttgaccagctgctgcacatataagcccataaaaaaggctaatgctcaaggatcaagaattcaagatatccaaatatacgttgagaaaaaaaaaaacattgctccacatgattctaccttgttttgttgaatacgtacatctatttctacctatcaaacactggattggacagttcatctggcatcaggaattttgggggcagctaagttcatttccaattgcgattatcagtacattgattctgaagcttctagctgcagacacttatcagcatttacctgaccacattttatcgttatcagctatcacattatatcaagttatacatcctctcatgaatctttatccctgtcatcgtttccgaaactataatactagatatttgagtccattcctattatattcagttcagcgatctagtgctcatgaacaacaaattcatctaaaatattggaaaaacaattgtaccccatccctgattcatctaaagaagtggggaaggagtcacctcagttgagcccgaagacgaagaggaagagaggccgcggcaaccaccgggatcgcgactgcgatgggggcacgttgagggctctaccatctcctccagcaacgtgcgagcctcgcgaagtggctccacgctccctcgcctccggattccggcgccatcgccgatgtggggatctcacatggtgaagaaattctccaagctcgcctctcatggcgcgatgtctgaacaccggatgcggcggacccgctgctcggctatttccgaaggcggccgcggggtgggttgtcagcgagtttgggcgtcatggcagtaagagaaaagaggcgccatcaccgggaaaagatcagagcgccggcggcggcgacgacgaagacgacgggaagggcggtggcggcagaggcggcggaaggatgctggcccaaccaatacgggccgcacgtacaccaccagcccgttacgaggcccaatttccatatgcagcacgttacaccgtaagcccgtttaggcccaactaatatgggccgcacatacaacataatccccatttggcccaaatagtatgggccgcaagtatagtgcaatccgttgcagcccaaccagtacggaaccgtcactttcctacatgagagagtcggagattgtgcggtgcaaatgaaccgtccgatccatcttgtgcggtgcagattgaacaaaggagaggtggcggattactgcgtatacgtattaccgtttgccccctctctggtgcggggtcgatgggtcccacttgtcggcgagatggcaagaacggggcctctctgtctcctgctcgagaatccgcggccgcggctgccgctcgccggagctccgccgacgatccggcggcggcggctcgagtttcgtaggtgcttcaactgttatcgtcctccggatcacagacgttgtttaacatggtaccaagtttgcgaagcagagttccctaaaaaagagtgcgaagtaaatcaatttgcagaggaatcatcagactgggaggaaataattgcgtcgatagcagttcagttctggtttgtttgttggtctgttgcgttcagtgtttcagacagtgtcaattgtcaagaccacatgcctcaaatgtcaggtgctgttgataatcttcagaaccgctctcccctctttcgtaaagcgtaaaaaatagcggcacttggccatgtgttatctgtgattccactaaactgaaagtgaattgtatataatcaacactagttgatgaagtgtttcaactcggcttacttccagtggagcacaggaatggcaccatggttgtttatttagttcatatcactggatatctggatcaccaggcactgttcagtttcagtacttcagttcagatatgcagagttgcagactgaataaatatcgtcttacctagttatttacatcatagatgtttcttttgacatgatcagaaggtgcttccatggacaacacatattctaaatctggagctcacatcgcatgccatgcacagttttcgggaatacgcaaggagcgcatttttttctattaagagaaataaaagttatttacaaggataaaaggaaaacaagtaagggaccaatacaggacgctatggaaaactataggaatatctcgcgctaaatttggctaccacgacctcataaaggccaaacagcggggatcccgtgattagccgactttcaaagcatggcctcctccgccattgctttcaccacttcggtccaagacctttgttgttgattgaagattcggttgttccgtttcttccaaattgtccaagccaccagtatcatgacagtgtcgaagcctcgacgatgccgctccccaatcttcattcggctctcacagagccaattgtggaaggatgactcgttgacaggtaatcagttcagactccttatcgcctgaagcgtccaccaccataattgtctcgattcagggcatgctaccaagatgtgatcaatgctttcctcctgctgatcgcaaagaacacagcgatccgggtgtggcaaccctcgactgcgcagacggtcaacggtccagcatctattcattgtgaccaaccacaagaagaagcggcatcgaggcggagcgagtgacttccaaattggggtggaaaggaaggtgacacgacccaaaaacaaggccttataggcagattttgagctgtattggcccgaactctcccatttccagatgattgaatcaggagtagtaggatcaagatccaccatttggacaagcgaccaaagctttagatattctagaataggttggatcccaagtgctcctcggatgtctttgatccattggcgacctgttagtgcctcagccaccgtccgacgccggcgcacgcatggtggaattttatcatagatgttcggagcaaaggaccgaatgcaaccctcttgcaaccagctatcttcccagaagaggatagtttgtccgtctcttaattgatagacggtagaggctgcaacgaagttcctttccttttgcgaccccggaatggctagcccctgccaaggtttgcttgaggaggtccattgcaaccatgtccacctggaacgaagagctatacccataagctccagattcggtacacccaaaccgccgtagtttttaggggcgcaaactctggaccaagcgaccctgcaacaccctccattagcttgcgcagttactcagttgatgcatgcaaagtgcctctctggctggggcccgggggagtttagagtcaacaaaattatgatgcagctttagcgggcaagcatttctcatcagttcatcaccaaagagatcacagatcggcactcgcctgagctactgtatcactgtgtgctgctgaccattagtcaagtggcggctcagtgcagccaccgaaaggcttcaagattcaagaaaccatcagcccacagaggtaaagggagctcatgctcatggctgttactagtaacttttttttaactcatagaaagaatagacgctgctctgctcagtgctcactcggaacaaaatttccctttgctcgtgatgaagattctgctctgatcatgtagtgccacgaggttatcggatgaacaatcatgtactaggatgtatactctatgtacatcctgttcagagttcagacatggtgagcacgcatttgttttcatgtgcctaatcaaacatgaaaattgggagaaccaaaagatgacttgactgttcaccatttggaactggggttccattacgaaaattatatatatatttaatataatagttagtttggaccatatgtctgaagctgcaaatgtgcaaacccttgaaaggattagcaatttatagaactaactagatttctcagagtatcagaatatttggattaatcgaacaggccctaatggacttgtgcaatttttgtttcttcgtacacatgtaacctgtcatatagttttattttccatcagaagttgatgcccaattaatcacatgacagtgccattttctgaagtctgaactgaagaagaagaagaacagagattcgtatcagccaggccatttatgcgagaaaacaacatcaaaccaccaataattcacgctcgtttgttcgtttgcacctttcggatggcatcggaagccaagaaacaggcccatcaagagatgtccagctcctcgcatttataatctcttggatagaaaccatggaaggtgccccagctgttcagatggcttgtgatccagctgctgttggtgccactttacggtcaaccacgagcagtggtcgagggtgtcgttcagtggcagtctttctccaaaggcaaggtgaatggcactttctgcactgcagaagtgcagattggtggatgcttcggtggtcatggtgcactcaacagggcatgtgaccttagctgcatctttgctgtgaaactgtactaaaagcaagtggtttgttttcttctatcccgggaggcatatacctccttgacacgtctcctttagatccaagaaacatttcttatgagatcctttggaacaaaccccaattctataggaaaattaacatgagctcaaaccttatgtttgtttttttccctttgactagtaacatacctatgcattgcaatgggctaagacaatctagcataaagcagtgagctttttttatccaatcacttttcctctttttttctattcatttagcgtgtagcaaccatttcttttctctaacgatttttttagcgtgcaacaaatgttttccttttttttagcgtgtgctacgtgcgagggggagtggggggggataaagatgattgtacttttatagtagtagagataattctaatgcactctctccatttatttctctaatttctctttttagcacaagcaagttgttcaaaattgttgtatttatttcttgcaaaccatccaaatgaaccaactctaatatttatgtgctttagaatcatataggattctgaaacacatgaacattctattcttgcattgtgtttcagaatcatatgtcagggctcctttcaattggagtattttcgtagtagtttttctaactaggttgtttgggatgttggattgaaagttgctagattcttggattgcatacttatacctcattttaattttcctttgagaagcctaatacatcttggtttctctctctctctctctctctctctaaaatccatccaagttcatgtgttatttttttctgaggtatctaaacaattaatctttcaaattctcgtgttttacaatattcatgcgagatatgctaatatatgacatctcattcattccaaacaagccccataactcgagtccgtgcatctaaaatacatgcctatgtcatgaagatttggtttagtagtgaaacctaaatattgctacaattaataataatcagagaaaaaaaggaaaataagtggtggtctaaaattctccgtacaactgattgaaccacgtggtgttttataatttgtccaccgtcacaaaagttccataaaatagaaatgaaaataataaatagctcacctaatattaagaagctatggtgttgtgtaatacgttactctctttctactctgtataagaagtgaaaaaaaaacaattggtgtagatttaaggtggtttttggcaaggtgaggcatgaaagggggcctgtggatgtgagaattgtcaagtgggtgtgtattatatgaatgtttatataaaaatggtcaattggaaggttttatatgtatgggaggtgcatgcacatatttgggtttgtacaattgtgcacttcaaatgaatttgtagaagatttatagttgcatagcacataggaaaaaagaacacgatcatacccatacttagtcccagtttgattaatctgaatgatgctagattatctgattttatggtaatatttgagggcacaaatgaattaattaactattataatttgaaaaaacgtttttaaaaaacaattacatgaaacctatatatagaaagttttcgtaaaattacaccttttaataacctggatagcatgtctgtgatagttcataatgtaaaaggaaaagaaatgagctttaaaaaggataaaataacttatttacaatgtacaacaaatatctctgtgcttttgagggcacacatttttatgaaatgtacttttttaagtacacacgatttttttccatttcagatatttctttgcagttgcgtattgtctaacacgtactagtatgttaattgactttttgagaagttcttaatagtataacaccactgtcaacttctcgtattcaatacgagcaatgagcaagaaagaaagtacaagtacaccactcatcagcccaacaacaaaaaggaaagacagcaaaatacagtagacaaccacgtaccagctcactatctccatcacaaacgttgaaaacgtatagatacaacctacaagtcgtgaaataaacataacccagctggttagattttctctacaaaaataaatcactcggagttctagataatgatgctcgaactaattgataagtgtaaagatattgtgagcaactacaattaattgcatcatggtaaagaaaaaataactatacaattatacaaccagccaactgtccacctaatgctcagattaacactaatatcatctctactggctgccattagttcattaggtcccccactaatactgaccaccattaaattagagagaaaaagaaattaaaaaaaaagaatactaagaaaaatcaggctatccgaagttcccaacggtcacctcgtcgtcgttgccaaatctgccatgtcgccgccatggatcccctaatcgaggacccccccaacctagcggagacgaagaagaacgagaagggaagcccaccgcgtcgccatcattaactcctcctctcctctcgtctccctcgaaagcaccaccggatccgacgaccccctcctcccctttctcccctcctcacgaaaccgcctcgccttcctcttcttttctttttcgctcgcttcgcatcgctcacatgcccctgcctgccgccgcagacggggcgccatgtcgcgtagcggggtggaggtggtcgtgagcaggggttgctccaggctcgtcctccccgggatgcagccttcctccgcctccgccgcttcctcctcctccttctcgcgcggcggacatggcggcggcggcgaccggaggccgctgcccgatggccccttcgccggattggtcatctgcgtcaccgggctatccaaaggtgcgttgcttttttgcttcttgatttttttttggcccaaaatggtgaaatctctgctgtagtattgatgaggtgcgcttctttttttttgtgtgtgttcttggtggttggggatttgtgttgtgtgcagaggcgaggactcaggtgaaggaggcgactgagaggatgggaggcgagtacagcgggagcctgcatcccaagtgcacccacctagtggttcagatatccttgcaaagatcatggattatggtagcttgttatctcttctcttgggtctcctgctgtttttgtttgtcaaattcaggacggcatatgcttttccttagcgcgcagcacagcttcgccggccgcaagtttgagcacgcggtcaagcatggcgcgaagaatggcctctttgttgtaacacttggttggcttgtggattgcgtgcggaggagcagtaagacgagtgccatcctcttctgtttccagtgaattgtggcggcatcgtgttcatgttacggttgtttctatcgcagtgaggttggatgaatcgttatatagcatcaagaacattggggagaatggaatgccactcggggagttcaaccggcttgtcggcgctcctgttagtgggaattcttgccttccaccgatgatgtttcaggaaaaaacattttcagacacgaccgaaaagcatcggcttcagacatctagaaaagaacatgaccatgatgaatttctctttacaaacgactcgatctacattgaccctgggatatctggtgaaatgaggaagaaggtatgccccgctcttgctgctggattttattatggttggccttccaagtatagctttcggacagcaaaataggacttcaggacatttctcacgatggaacgttgtagcagagcatcatgtggatcaaagttttgctaagcatcgtgttaagagcaatgcaagttagatcgtttgatgcgattgtttccctctgaatttctttagttgacaaggataatttttattttccataccttcccctttgcccatcaatacaacaagacatctcttggtgaactgcatggctacgtttacataaaatgcatcttgtctacaggtatctgatgctgctactagagaaggtgcaaaattgttggaccactggtttattggctgtcatgcgacatatgttgtgtgtgaggacgcttctgtcaagagatatgttggtcattcagacaacattgtaactgtaagcatgttgcctttggttctaaacttctaatgaagtttggcagattttgcttgtattaacattttctgcatttaatttgtcagccactttggatattgaaaaccgcaaaggaaaaaggtttgcagcgtcttgtccatttgtcttcggacctggctaggcaggttgccacgattcttgaaaatgcccagacatttcaagaggtatgacatgctatacatgtaccttaatcaattatcctctcatccagtatacattttgtattcctaaaaaaaattgcctttcaagagatttggaaaatatggattttctcagacctcacaagctcctagaactaggaattctcctgtagatatctttttcttgggtacttccccgctctttttttctctggaaggaaacgaaaagacagtaaatgttacctgacatattacatgagcaatcctctatcttcataaaacgttcctgaaataaagaacagatagagatgggcagctaccctcctgtaatgtatttagtgaagagcagagaagactggtccacgtagatgggaaataatggttctgtcaattttaccgtttcttgaatagtacaactgtacagttcttattatttatgtttagattccttacaactgtacaaatgtcaatttatgtttgtgatatgttcatttttccacatttgactctttaattcattcttggatgattacaaatgtggtattgtgttgaccttgtattgtctactgttttagaatagaaaaattggggatgttccttctgtcaattcaaactccagtggagtaccatcaacccaaggggagatagatgaaattcatcaagagaggcaaaaatttgttgaagtagcaaagaaaaatgtccgagatcgccgtgctcgccgtatgcaggtaagggttgttttacctaccagagcagtttttttttcctcttcatttctagatttgagaacctgcaggttcctagttgcgtttatatttccagcatcactgcaacatttatttttccaaacgaaaaaggttccttggattaatgggacataattccgtaccagcgcatctgccttgtgtttttggacttgtttctgtaatacaatgccatgaaattcatcttggcatgtgtatgaaactatgaaccaggaactagaacacaatcaggacacatttcattatctgtagtcccttattacacaattgtgtacatataatgtataaaaacctagtacttttgtagaattatttggttcttctatattatataaagtttttgataaaatgtctaaattatggttttaagccagtcatgtgaagtaccaatccatccaatcacgcctgtgaaacttatggaatcaatctgttggaccgtatctgagccaactacgtccgcatgcatttatacggagttttcatggtcagacgatgcctttgagcaacaaagcactactttcttcgatgcgaatggggatggcaaggatgatcagtcaagcgatagtttcacccgcccactaagagaaaggtaatcaatgcttgatcttggtcaaattctttttaactgttgttctgatatgcttgtgttgttcctttagtgagaagagtgaagtgatctttaagaaccacttccttaccgtactcttccccattgatcgttttggtgagcttggaccttcctcaaggacattcttcagcaatggtggtttcacacgcatacaagtgcttgatcacatctacaacttctaccaggtacaatcagtatcttgttattaagtttgttgaattgagtgcaatactgcctctttctgacagaactcttgaccaatttttacagtggcttagattttgtgtttagcttgtaagctaacccataattatctttctcgtttgtgaaggaaaatatgtcttccgatgagataaatgtagccctgcaaacggattcacgacatgctgatcgacttcgctcgctgtacgcaagtactgaatcagcagaaagaggttttgtaacattcaaaagaattgattttttgggaagccgaagaagttttgaggggctaaaacgcctcagcagagagaacaatagcaatgtatatgagcttgtgattagggcataaactgcaccatactcggtgttatttagtcaaatttgtttgttgtttacaggttgatagtgatgtactaccatgtatgcacgccgaataaaattgtaggagataatgatatatttatagatcaatgaaaaagatcatgttgggcagttcagccgcaatacccagtgatggacagtagtttagacaaggctgcagatctgttttcgactgttcatcagttcatgaatcattggtgtactaatctgtttgtcttcaaagggaagtggacattggtgtactgatctgttttcagtatg

SEQ ID NO: 47200 - DNA, 1072 bp, Oryza sativa
  unsure (1)..(1072): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatttggaccggacgggggcctgacccacgcagacgtaaacgccaggagggcaacccgccgctggctcgctttatatcccgcgtgagctccacaccgagcgaagcggaggtccggaggaggaagcgcgagagaagctcagctaggcagggcgacgggcagaaacgcgaccacggcaacaaaccccgccgcgcgcgcccaccgtgccggttacatgggagtagaggcgggcggcggctgcggtgggagggcggtagtcaccggattctacgtctggggctgggagttcctcaccgccctcctgctcttctcggccaccacctcctactagctatacacacccatctcaccataacacacatacatagatagatagatagatagatacatacacacaaacataagtagctaggtagagaaagagatcatagcgttaggtgatcgatcgatggctgctgctgaggcggcggcggcggtggggaagcagcagcagaagggcggcgggggaaggggaggaggcggcggtgggccggcgccgttcctgacgaagacgaaccagatggtggaggagagcgcgacggacgaggtgatctcgtggggaaaggaggggcggtcgttcgtggtgtggaagccggtggagttcgcccgcgacctcctcccgctccacttcaagcactgcaacttctcctccttcgtccgccagctcaacacctacgtacgtacacattacacacactcgatctcttgctccatctcgatactcgatctcctaactttgttgatttgatcatcatatcatcatcctgcactgcatgcgtacgtcgaataattcctgtatctgcgttctgtattcaactgcaggacgccttgaacggcgtccttttgggttagatgacgatgtacttgcagggttgacgtttcttgtctgtgggcgagctttcgctgtcgtggccgagctgtgttcattacgtttccat

SEQ ID NO: 47201 - DNA, 44591 bp, Oryza sativa
aattaattagctagtgaataattagttgaatgaaacatctggagctagccaaccaattaagctagctgagctaatttgttaggcaaattaatcttgattcgcttctggactgccggaagaggaagaagaagctagctaggcagactccaatcggtctgtacactgtagtcgacctaaagcgtagaaaaggaggtttcttgtcgtgttacacgatcataaactgaatatctgaactgacctttgaggcaaaaatggacaacagggttagatacgtgtgtcagggagtgtgcgccattcggaagtcaattgatctctccacttcgttttagttttccacgcaaagcatgcttatcggttttaaacgacggattcaacctgccttaagaaagataattgggggcagaaagagacaatagaatgatagaaacgattgaaaagagagatgcacctactgctagctgacgtgttcatcatctttttttttccatttctcccttttgacaaaaacctcacgtctgttgtgtagtcaattcgtcagaagttaattccactttactgatgatcttgcatcagaaaacaagaagatcacatagctataaaccacaactctgaaattataaatagcaggtggaaccacaaatctgaaacggcagaggtcatcttcttccattgaaaaaaaaaaggaaaaaaaaagatgaagtgcgatgaagacaaccatgtacgtaagcaagtgtactccattgctgaatgcttcaaagaggaaactctagcatcatgcatatgcatctgagcatctcgaagatgaccatttccaattactattagctagctcgttgtgaaagggcatatagtctagtggttgcggtgacctaaatagcaccctaaggtattgagttcaaatctctataggagtgaatttcagattgggttatttgagggctagcaccccaaagttctgagttcaaatctcgatagtagcgaatttcagattgggttatttgagggctagcacaccaaggttctgagttcaaatctccatagaagcgaatttcagattagattatttgaggactaggtttctatatttgataggctaagttcctaattaaaaatatatttgataggctaagtttctaattaaaaagaggctgtatatatctggttgaatatagagggctggtaaaaaaatacctcgtctactagaagggtgttcatatctgaactggcaaaaggaaaggacacgtcgcgactagcaaattgcgacgggagcaaagtagcaaacagttccatgaaagcaaagttaattaggtaactgatatatagtagcttgcagatcaggcataattcaggccggccgtcgattgacacgccaagtgtactagtggcgacaaagcatgatttctggtgcatctctatgattatatacgggacaggaatcttggtggaaatttctgggatggattgacttttccgggctcttcgtctatgatcgtctagaaatgttggcacttgttgtaccgtactcaacctgcacatgcaaagcatccagcgcagctaatctttgtttgcctttactcgtgttcgtgcttaatttgtggggtagaaagtttcttcagcgaacatgtcgtgtgtggtttctcctgtgcttgatcacaacatcacaggatcttggacctttggtgcatgaatactgacatgcatgttcatcagtactatagttatagttgtcaaagcgtcacgctaataacaacaagctatttatatcttcaaaagaaaaaaaaaacaagatcagctatctagctcagttctcagtactggttcttcaattgctgcaactggagtagatgagaatactccaaagtgtgaacgtctaatagtattgattagcagcgacgtctgacagagatgtataacaagtatcctgacgtctggtatattgaattcaatggaacagttgagttactctttccgttgtgattgattctgcacatcttgtggtgttgttcgaatttgacttctagtagaaatttgatcttaggatctgtcagtgagacagtgatatatccatcatgttttttttagatgacatccttcttgttttagcacccaacattcatgatatttgcttccctttgatatactgttcttcaagcgttaatccttgaatatactccctccgtttcatattataaatcgtttaacttttttctaatcaaactttattaagtttgacctagtttatagaaaaatttgatagtattatcagcacaaaacaaatatattatcaaaatatattcaagatttaatgagtattaagatggttttttgttccgatcaaacatttaatttagtttagtaagtcagatgcatggaaactacaaatataactaattggaaaaaacaaaaatataaaataagtctaacgcttttggatggagagagtagataatataaatgctgcagaatgactgcagagagtggaagttgtcacctatggcctcgtttagacgggccttaaatctgtccatctacgtatatggccgagtgtttgaactaaactagttgggtggcccgcgcaattgcgcagctagtatccatacaaaattatcttcttttatatatgattttacttaaaatttgttaaataactatctcgttgtcttaggactttaaaagaccgaaccttaaaatctccatgtttctaattttgtagttttaaaaagtcacaccactcactacctcttacctctttgtcaccccctttatttgtttgcttatctactacagcttctatttatcctccttggaactttaaaattgaaccttataaattttagagttaattaaatcgttggttttcattttttaattctcgtcaaatgccgctactctactcctctacggcccgtccaccgcttcctctctttattgttattgagattttaacaatcgaacacaattatcgccagtgttcatttttaactttctaaaagtcccgccaaactgtcagcagcattgccattatactcttgtacggcccgtcctatgcctttccttttaattatcattgagattttaaaaattgaacgtgattatcattgtggtttatttttttactttctagaagtcccgccgatcactctgattgtgcttcttaacgggttgcccgccatctctcctcttaatcgccattggaattttatttggggttttgtttatactttttacgcccattgccttccctcttttttattattgagattttacaaatcaaatatgattttcattggagtttattttttactttctagaagtcccaccaacccccgtgatcatgctattacaatggcctgtccattgtccctcgtcttaattgtcattggattctattttaggttttgtttatagtttttagatgtcccatcaaccactgccaccctactcctttacagtctcgttgcttctccgctctttattttcatttgccatcgttgtgtttttagatggattgtgttttatttccatattttttattcagatattatgttgtttataaattttattcctacttgaacgcctttaattgtttttaaatttttagaatttaatttattttttattccaaaatttaattaaactcgtgctctagatgatctcttctttcagtattgcttattttttattccgaattttagttattttaaattgtatgcccatatgaactcttatttttattttctaactttagaatttagtttggtgatgggttgctctttcaatattcctttttgttaatttcgaatttgagttatttctaaattgtaatcctacttataatatctttttttgtaatttcagaatttattttattttatttttcattccaacatttaattaatcttgtgtgtgttttgaatggcctattctttcaatatcctaacttattattccaaattgataattctaggcttatagagttctgaactgcatgttttcaaagtatggttcatggatggattgttgatttggttaggacatggtatttcttagtactctcagttttttttaactaaccaatatcatataaaaaaatataggagtatttttttataaaaatattgacatatataggctttctagcatttatgattagaaacttgagaggaaagagaacccatctatatatgtgtatttgaaaattagcatgtggtagtcaataaaaacttattgtaattatattagagaataggattactgctaaaagttttagcttttcatttgaatccgatggaggacttgtcctgtcctgtttttcctgtcctgttgctagaccttcatagctatgattccaaaaaaaacgtgtcatgttgttgtgtggctttgctcggttgggagtccgactgcaaacatgactatgagaaggacatgtatactgcgtagtattttttttctttatttatatacctatacaatcaatcttaaccgttataatatagatccactatgagaatatatttttctttttatttcaaattttaattaatctcgtattggatttatagatggactcttattttaattttacttatttttaattccgaatttcaattattcttagattgtacttctatttggactcttcttttctttttcttcgattaacgtggtaatttctaggcctctacggtgaacgtggtgcctctttttcgaactgttttaataatataatagataggtagatagatagattcttggcccacagatatagatgggccggattaaactgttttgcacgtagttgtctatgaacaaagaatatcccaaatctaagcatttatgccaaattttcattgttgattgtacatttgtacttgtgcattcaccgaattaacgatgtgtgataacaaacacgttcttagtgtctttctgccaaaaacatgtccttattgtcttgtgttgattaggacagaaacatgttacgattgcccctcaatacgttcacacgatctgaccggggctaacgagagatggcgactattcatgcagggtttccggaaggtggtgcccgatcggtgggagttcgccaacggcaacttccggcgaggagagcaaggcctcctctccggcatccgccgccgcaaggcgacgacgcctcagtcctccaaatcctgcggcagcggcgtcaacgtcgcgttccctccgccgctgccccctctgcccccggagccgtcggcgaccacgtccagcggcaacgaccgcagctcctcctccgcgtcctcgccgccgcgggcggacatcaccagcgagaacgagcagctcaggaaggacaaccaaacgctgacgatggagctggcgcgggctcggcggcactgcgaggagcttctgggcttcctgtcgcgcttcctcgacgtccggcagctcgatctccggctgctcatgcaggaagacatgcgagcggcggccggcggcgtcggcggcgagcagcgcgtgcaagagcacgcccgggaggagaagtgcgtgaagctgttcggcgtgctcctcgacgacacccatggcgccgccacgaggaagagggcgcggtgcgaggaggcggctgccagcgagcggccgatcaagatgatcaggatcggcgagccgtgggtcagcgttccatcgtcggggccggcgcggtgtggcggcgacaactgaagtccaaacttgtgcatgccacggccatgacctgatcgaccaggcgaacggcaagcagaaggcatgcatggtgaggttggtggcaagaatggtccgatcaaccaagtcattaggtaaaacgagacgaattaagcacgccaaatacgtgcggccctgtgttaatcacgggttgctaccatgctagtagtaaggtaggaacagtacgaggagtcaaggctgaccgaagcgaagcagccggctcttgtgtctggacgttgtttcagttaacactgaaagcttcaccttactatggattatacattttttagataatggaatataatatcccggtctttacttaaaagagctacaaccaattattacatagtagtttttatgaacatagtataaatctaaatgaatagaacacaccgaagagaaaaacaaagaaaccaacataacgtaaggagatcacaattattaaagtctatttgtaaatctccaaccataattggcaaatagttgcataaccgtggtctccaactttcggcatgcaactttcagaaactcttcatcttcatcacacctttgtagttgtgcccaaaaccggagccaatgagttgccctgaaaatgacctgcatataggaaaatgatggtgatttgtcaaaaaccatatcattcctactcagccatattgcccaacaaatggtagaagctccaacaagtatcagtttacccattttcttatcaactcccaaaagccacccattaaaaatatgagatatgctaactggaagattaaaaccaaaagagaactgaactgctctccatagaaacttcgcaaaatggcaatccataaagagatgttgaatagactcattcttcaaacaaaaagaacgtctcaagctgccattccagttacgccttgccaaattatccttagttaacacaacccctttaagcaggtaccacatgaaaattttaattttaagtggcaacttaagcttccaaatacacttgtttatctcgatatagccattattaattaaagctaggtacatagacctcaccgagaacaagccattctgatggaaattccatctaaatctatcagacgaatcattcaactgaatatgtactatagaggcacacaactcatgccaacaaacaagattctgaccaactaaagctttcctgaaagaaacattaagcggaaccgatcccataacagtggcaatagaagatgttttcctccgaacaattgcgtacaaagatggatatttatccttaaaagccaagttaccaatccatctatcttccccaaatctaatttgttccccattattgacaatccaagaacccatatttaagaaagtacttttgacattcataagaccagaccaaaaataggaatcaccttgtttcctgtcaacttgggttatagatttattataaagatattttctcttcaataaatcatgccaaaccccttcctcattaattaacttaaacaaccatttacttaaaatacatttattttgtatctccaaattatgaatcccaagaccccctggtccttgggttgacaaacaacatcccacctagtgagcctgtattttttcttatggtcatccccttgccaaaaaaaccgcgatctataataatcaattttatgaaaaacccctttcggcacctaaaaaaagatatcataaacatggctaaacttaaaagaacagaattaatcaacaccagtctaccaccaacagataaatgcttgcctttccaactactaagctttttctcaattctctcttcaataagtttccaatctttattagaaagcttcctaaaatgcatcggaattccaaggtatttaaaaggaaaggtacctaacttacaaccaaaaatatcaaaatattgttcataacattcctttgcctgaccaaagcaaaataatttactcttgtgaaaatttatttttaggccagataacttttcaaataccgataaaatcagtttcaaattatttgcctgttgcaagtcatgctccaaaaagatgatagtatcatctgcgtattgcaagatagacaaaccatcatcaacaagatgaggaataaccccattcaagagtcccgcctctttagccctcttaatgaatagagtaagcatgacatctactatattaaaaagaataggagataaaggatccccttgcctaagacctttgtaagtttgaaaacaattaccaatttgatcgttaacttttataccaacatgaccaccttgaacaaaagaagctatccattcacaccatctaggagaaaagcctttcattctcaaagtttgttgtacaaaacgccatttaactttatcataagctttctcaaaatcaatcttaaaaattacaccacttttatctttgcgatgtaattcatgtaaagtctcatgtaaaataaccaccccttccataatatttctcccaggaatgaacgctgtttgagtaggactaattaccttttgagcgacatccattattctatttgtagcaactttggtaaaaaaaacttaaagctaacattaagtaggcatataggtatatactgttgaatctttaaagcctcggcacacttaggcaaaagaatgatagtaccaaagttaagcaaatataaaggcaaactcccagaatgaaagtccttaaatagttctaaaaggtcaaatttaatgacattccagaaaacttgtaaaactcagcaggaaatccatctggacccggagctttgttatgttccatttggaaaatagcatccttaacctcattttcagaaaattccttagttaaggcttcattctctaaatatgaaacttgaggaatgtcagcaacataattctcatcaaactgaaggtcagactcatcaggagggccaaaaagacctttataataagtggtaatatgcgactttaaattggcatcaccacttattaaatgatcaccctcctgtagttgataaattctagttttcctatgttttccatttgccactaaatgaaaatactttgtattagagtcaccctccgaaatatccttagtcttagcccgctgataccatttaatttcttcttcccttagaatgacagataacctactcctgaaaaaccatctaatatcaacttcctcttgagaccggagaacagtctctgcctttttatccagcgcctctaacttatctaatatctgctttttctcttttttgtataaaccgctggtatgtttagcccatcccctaagatgttgtcttaggcggtgaattttcgcttgccaacgctccataggagtattgccctcatcaaccccagaccaaacttcttttaccatatcaacaaatccatcacgtaacagccaactaagttcaactatgttgatcgttactaaaagaggaagattttgtatttaggagcaaaggagtatggtctgaaatatctctattgagagcaacaacagaggataaagggtatttttgctcccattccgtcgacactaaaactctatccagtttctcataggttgggtgtgccagattatttgcccaagtaaaattcctaccagtcatttgtatctccctaaggcacaacccatcaataatagcattaaacaagaagggccatctatcatcataattattattatttttttcattaggactacgaataatgttaaaatcaccaccaataagaattggtaaggtctcatgactgcacatgttaactaattctgcaaggaattgttccttaaactcattttgtgcaggtccatacaccaacactaaggcccacttaaaattatcagctttatttcgcaaatgaaacttaatataaatatccccctcatcaatcaaaccaatgtcagaatttaataaattaatacccaatagaagaccaccagatctgcctctaggaggtttacaatgccacaaaaaatctttaccagcacaaagattattaagagcagctatagaaaattctttgttaacagtctcagataaagcaataaaatcaagttgatgttctttggttaaatcagaaacaaacttatgttttttcgggtccttgaacccatcacaattccaaaagattcctttcatttaaaattaatttttttattattcttcttttttttacccttcttaccattagaaatactattagtagaaggtaccatggaatccaaagtggactgaatattatcactactaggacttggggcgcgcgttgcggtgcctcaccgtctgaagaggagtgtgaactttgcataatttgaaccgaacatccagtagcacttaaaagcgaaagagattgtactgataaaatagacgaaaaggtagcctatatggtccacctgattgaattacatattaggaataacaaaaccacactgttctttgatattgctgcaaaatatagtcgcgcaggagcaggagaagcagctagttagataagtagtcattttttctggttcctatcaggatatataaaaggaaccttgttgttatgcaggttgattagattagtggtgcctaccaagctcagtaggcagacgacgtggtggcattgctggcgatccaccctcaagaggtccagtatcagtgtctatctggcgagatacccactggaatgtctttacaattggcaagcgagggttgtttctctcatattgttttagaatctctccatcggtctcactttcactgtcttcatcagtgtagtcaaagtgtttctcaatgtgaattaatatggttgataaatctgcattgtgtttccaagcatactccgatgattgctgatccttctcaactgcctcaatattccaatccattagcttggggataagattgcaatctgttgtccatgcagccaatttgaaaacagaaagatcttctatatggtgctctgcatatagctcctcaaccatacaactgccatcgagtaattctttcatagctgatttgttccatgattctggtggtactccttccaatgcaagtatgactctttgacgcagtgggtttggaacactatgtagattcatcttgaaaggttcaaatgctagccgagttgtttggaatgtgaagcttttctggctaaatgccttttgagatctttcgtactgtttatcagagtccatgaatatgacgatgtacattctatgtctgaatggcagtaacgcaaaatcatcgacttggcagtcacagacgaagcctaccatagctgataccttggttgtgttcggattgccagccccaagcaccttgacaactacagcatcttggtaaatgacatcggcaagcagctgtgaaatctcttcacggcttgagaactttgtcgctaacaacagacgtttagttccataggatgatggctctggctgtgttctgttagggcgtctaccttgctgggcttccattcttttctaaaaaacaaataagatagatggaagtgaatatctacagatttccagatgtaataggtgtgttgtttttttgttctagtaagttcatagttgccctgttcagtaatgtgggatctcgtctatttctatctatgaagagtagcgagacaacagatagaaggaaatcggtgaagaaaatatgccgtggttgttacctggagagggagacgaagaaggctgtagaacttgttcttgctcacaggaagaggaggaggggaatatgagttggggagaaatagaagtaaggcgttgttctccacgacgtctaagccaaagcctgtcttgtctcttcaaaggcagcaggtaaggctatgggttgatgtcagtatatggagtaaaacaacgtgtacgatgtggttccagtatggagtagttaggtgtgtgaattttgttggtctttaattcaatagcatattttggtgatggatagtataaaaccctggactatcgtgtacatacatgctgtgctattgtggttaagcgccggtgttgactaaatacagaagctgctgaagaggtagtagtaacgttcagtttttttttttaggattcgtgacgcctggtaagcaaaacagataacgtatatgcgttctaccttgagggacggtgattaaactggatgtatgaatgcgactgataattcggaggtaaattaatcgccgtgaaataacaaccagtattcaggattatcatagtataactatgataatgcagaatcctagttacatgatcagtgccagttcacattaagtctttttgcaaaagaataagtctagtggaaacggtgtcaaacacaggacaccagtataataataggacagtttgcaaaggcactacagaacggctgattttcttctcctctcactgaagagctgtctggtgtaggcagcaactgtggcatccaaaagtaagcttgtttggtccataacatatcaggcttggttgatggcactgcaacgatgtaaagaggataagcgaagttgcataaaagacatagactgtaaacctatagctcctgatcagtatataacaaaaacatcaaaactcataatacctgccaccagcatcgttgccaggattgtctttgaatagcttcttcgcagcacctgtgccaggagatggcctaggcctttttgtgggtaggttgtaaaaagaacagttagcatttgtgtactgcggaatattaatacttgggaaaaaagcatttacctttttttgtagctcttagaagtgctttgtttagtgctagaagaaggagctttctgtgtgaggctgaggtgatcgacatcctactccatagtaaaaaacctcagtttttagaaattcgaatatgtgtgtttaaaaggaatttatggaaaagcctaacctcatcttctatttcctcttcatcctgaacctctgtagtggtctttgaagcagactctatttccaggtctttgtgttttgatatagcagtggatgggctagctggtccagtctgtgcatcactaagcccaactgatggagttggtgatagagccatggaagctgggagagaagatgcttgagatgcagatggggattgtaacagggcaagggtgtgattgttagcacctccaagaatcctattcatctggaatgcaacagtaccagtagaagcagtgttctcagtgatgctgacattctaggtaaattctttctcaagtaggtcagtgatctcctttggtatgcaaccagtgttacttggattctgctgcaacagtgtctcaactgaacgaccaatgaggcgttgtgccaaacgcccaaagataatgaatgaagaatcagctgtgtcatcgcctgctatcacattgagcttgaatctggaaaatgcattataatggtaattttagtatagctacatgtattcattagcttgaacagtggagtttatgtcaactgacctaggcgaagccaaaacaactggtgggcatgttggatctgcacacctgtatccatttccaaaacgttttgctgttttgttgcatgtgtcacaagcagtgtaccaccaggagctatccacgttaaccttttttatgacgacagtaactaagaactgatgcttctgttcataaaaataggatcctaattagcactgtgtataacataaattgaaatgttagaatgagcatttatagtaccgaggatttaccttgaacttaaaagggtgtaggtctttaatctcaatgaccgtcttctgttctgcattgtttgcagcctgagatggggcgggtagatcagtatattttattggctcatagtttccttggatgctgcatagaacaaaaaagttcatgtctcaattggaaatagaaaagaaagatcagaggatatgatttgctaagacagtatatgtaacaaacctgtttttcaaggcagtcacctatggtttgtcaaggtttatgtaccatttgcaggcagagttacctgacaaagaaacattccctgcatccagagcatatgtaagcaccctagaacattttccaagagccattatagaacacatgtatggtgtttaatggacttactaccaaagcccctcacaagcgtgccaacaaagatcactatctgtggatttttttttgccagcttcaatcacctcatctgcagggaatgttgtggctcgatctccccatagcgcaacatttattgtcacattgctatgcagcagacatagtatcattacataaagagtttatggcatcgtgagcggttgttgggtgatgttagcaaaaaaataaatgtggaaagcatgtatattgaaagggggagtaatatttggtggtagttagttggtgttgctgatacactgttaatagaaatgttagagaactgaagtaaatatctttttgcatattaaaaaacagagaagaagggctaactcggcatcgcgaatgtagatgctcctcttcagactttcaccatccttggtgcgcgtttggataggtgtcactgatgttatctcagtaatgattccaatggcatctattatttaagagatcataataaaacacacattaagaatgcaataaaaagaatggtaatctatgaggatatgactgaatcacagtacctgtgaaagagtccttcctgttcactcgtccccttagctggtcatatggcgttagagagtaaacatagttagggaaattctctggcacatcagtacactcttccagtgtagaccactttgtgagggcaatcgactgcatattgccaactggcctatactggctggtacactgccttacacgatagaacgtgaggtcatacactttgccttcagtgattgcaggggcaaagagctcatccaatggaggcataatctgagctgcaatgctggccccctgtttagaaaatggtactgagtaagaaagcgaaatgtgatgacagattacaaagcaaggattctaaagaactaaccgtgccatcaaccagaaccaggccaagatgatacagaatattttcatcattttggtcgcggaattcccagaaccttgatacacgaagacgaatagttgggttgccaagaccaggctcaagcttactgattagcgtggttaccatctgccaataccgtaagcaattgttagcttgccatacagttatttaggatgttataaaaattggaagcagtgaacagacagacaaaaataaatgcaagaaaaggcagcactacatacacaaaagctgcatagtacagcaaacgggaaaaaggatagtatacaacagcacggcaaaaaatagtgctatagttggtacttaggtgccaaggtcctgcaattagaacagagaacatattagggtttgtcctaatatatctttcggtctgtagtatgatgcacataaagccaaattgtttaataataccatcaatctagctgcatccaacacttcttgataaaccatattcctagtctttgaactacagacctcatcctcatcctctataaggattctaaggcctgctcttgaagttgatctagaagcagcaacatatagttgcccatgtgtggagacaggttttttcaaataaaccccaacacgcgaaagagtttgtccctggcttttgttaattgtcattgcatagcatatacggacaggaaattgtcttctctgaagtgtaaaaggccacttagaactcgtggttgtaagcgcaatccgaggtatgaaagctgtctcaccaatattagatccagttaatatcacacattgtaacaatcgatggccaagagaaacaatcaatagccgtgtgccattgcaaagacccatagattgattcaaatttcgcaacaacataacggtgacaccttttttcaaaataagtttatgtgacgggaaattgttgacattaatagagtttaagaattcagttgggtatagtatatcaaagtcaggcatatggtcacatgatcttgaaattgtatcacaactaagatattcttttggcttagtgggtatcatacgaatgacagaatcatttatttcatcaaccgttcagttgttggggcaaacaatagcacggcatgctagataggaatggtctgtgtacttgttggggaaatctaggaaaacctcatctattattgcctttattttgtcgccggatgtttttattagtaaatcttcaggaatatcgacccatgttgcttcagtttcatcaattttttttgttgcaggtaccttaccatcaccaagacataggatccaattagcaaaagtttcaaggtcttgtcggttctgttcacaaaggtcactttgaaggagtctcatattaatgttcagcttcagaagagtaacatggtgccagagaggcaaatttgttatggacgcatcaactatggaagcacgcgagccttttcttatcactggtagtatttggcgaaaatcacctccaagtacaaccaccttaccaccgaatggtagtctgctgttagaaggtgtgtgctcggaaagcagatcacgcaaacttcgatctaaagcctcaaaacattttctatgagtcattggagcctcgtcccatataataagtgatgtcttttgaatgagctcagcaagcatggtacctcttttaatagtgcaaatactgttctcatcaatgtcaattggtattttaaacctcgaatgagcagtgcgtccccgaggaaggagaagggaagcaacccccgaggaggcaatagcaagaacaatctttttttcagaccttatttttgaaatcaatgcattccacaaaaatgttttccctgtgccaccatgcccatagacaaagaaaaaaccaggttttgagctattcacatgcttcataactgtatcgaaaatagttctctgatcagcgttcaattttggaattattgaattagcttcagtggccagtatggcgctgtcaagagcaagctcttcctcaatcattctattccgtactatgtcatctgagtaaatcgctgggcgcggtaaatcatagtcatctatgttaccgccgctatttgaaaaagtggtttgcatttctttcatcaatagcgacagtagcctatcatgaggaaccaaataagaagggtttgacaaagctgttctaagacgtcgctggatatcattagtgaaatacacccaatatttgtcaaagagggatcgaacgtttccaacagagcaaaacattacaacagtaacaaatagttgtcttagctaggtggatgatgcggatattatggcctcatcaaagagcaaataccactcgttatcactctcgagtaaacctcttaattcacacgcttctctaaatgtcgcataaacaatgccttcgtatgtcctaacatcaacatatgactgagcacctttcacaatcatcaacagcattcgtaaatagtaaagctctccactgattgggctcacatagtacattctacctatcttttcacatggtgttctaggacgccaactacgtgagctggtgtcccatgtccattcctttgggaaatcacagtatgtcagtgttcgtgcgttgctatgttttttattagcttcaaactattccgttaacattgttttttgggccgcagggcttgttaggagtgaattgagttcagcaccctttttgtatcgaacaaagttttgatttggaagatgcacagttagtcgctctactgaaggaactctatagtggatatcgaattcaaaagcacgccaaagagactcgcaggtagatagaaaccgtgcatcaatgtactcctgtatttcatttcgaggtgtgtgattagaattagttgttttgtttaacgtatcatctttggctgcaccattactatcagataattgaccagttggcttattattgacctcaaagtatgctttagatctatcagctccttttgtgacatacttgaaaaggtatttaatcatgttagacttgttgcaccatttgacattaatatgggcttggtattttttaaggagttccatattataaggcacaacccatcgattatcaagtttcactccatttttaagaacatatcgaccattgtttctgcgtttgtagatagtaaaaccaaaatcatccattattgtctcatcctgaaaagacttagggaaatgtttagaacactcccctttcttcatgcacgggcatgatttgttctggttgccacaagggccatggatcataaactcatcgaccaaagcataacccaatggatcagtaaaaacatcaggtatttcagcggatataaagccatcaacaataggagcgctaaattcagtgctgcctgcagcaagccagataaggcaatgtatatgagggagtccacgcttctgaaattctactgtgtagagcactacatggcaagtataaaatgttagaactaactaactgaatgtacaacaaactaaacacaggaagaaagtatcccaccagcaaggactgggccaaatgtttttccttccctaatgtctgagataaactcatttactttcatgttaaaaaccctcacaatcatatcagagcggtcacttggtacttggcctagttcaaacagcaaagcatcgtatatttcttgccactttgaattgcaagtgaaagtcacaaacaaatcaggcactccaaacacacgacatattgccatcgcatcttggtaattttgtaccatgtatcgcctgcctccagtaaaactggtaggcaagacatacttcttccctacagaatcccagtttcaagaccatgatcaatggcatcagatatcgcttggacagactctgagcgaagttcaggctggttgtcagcaatatacttcaaccttgacccttcaacagtcgagtatgagtcaacacatatggaatcactaagacgtccacaacaggtaaagggatttggtttattcaatcgataatggagacggtaacggtagtattcgagcattgtaacatagcgtcgtgaattaccagaaatgctagggaagtcagtgtacttgatacctaaatggaatccggcctccccatatgggaaaagcagcggatactgaagagccatataggatggatgtagagctgagacacgtcgtaacctggcatcagaagattagaccattacatcgtacgtatactcaccgtttgaatagtcacctacaactattcctgcgatctcaccactcgttggaagattgtactgaatttcatcccttgcatcacaccccagcaatctaagggaaattttctcatcaccatggtcttttaaccgatctctagcaaagcgaaatgctttgaccagatcattatggctgtcaagcatagaagtcagctcgataacaatttctgggtctggatcatccacggcattagaatctctctcaaatatattcattctatttgatgtctcattttcagggtcatatatatacaactgagcaaatttaggtgcagcaccatgtcgtggcaagaggctgccaatacggtggtgtacaaccccattgattttaaacacacaaggtgcagacctattatttatcgtcttatcaacattagctcctagcgaagtaaaagcaaacatagagttgtatgatcggatctgccttataaatcgcttcgatcgtgcatcaccatcaaattttaatagtctggctaggaaatcaggtggttttttcagctctggaaggctaatcttaccacttctacaacacaggttgtaaatgatctttcgctgtgacagcacggtcccttttttgaccctctcttggaacgaaaatacagctccacagtatgggcattcatgggatggcccgccatagtaggatcgttcagggtatagcgctgtagaattaaagcataagggaagactggaatatagattaaaggaacgctggctaaaggatgaacaaaaacaaaccttttaaggatgcaatataatccttaggcaaaggtaagatgtcctcaagagtaggttttgggcctatacaacgaatagaaatgaggctataagcagtaggaaacaaattttttctttgtattttttttggatctgaaaataccatcaagaacattcatcagagagtagtctgttcggtgggcagatctcttcatatgtcgtctctccctattgctcgtagcagcacttcgcggtatgtctagtaatgtcctcttccctaagggaaagtagttatactaagaaatgaatcgaaacaatggttcgttcttttctcgaatgaagcaaccaagtcagcttataggctatattagtgatgtacttacttttcacattgcctattgggtttccactgattgtgttgatttcaatgggcagttgcctattggcattagaacgatgggatgtggcttgctgggaaggacctgatggaacgcttccttgcgcgacatctgcatgtatgctacttggtccagtgtgcacagcatctgagctgaggcgcaaaggaacagaacctactgaaccaaataccggagcttgcagaaatcctaaggaagccaatttgctgtcttagttagctgagctaaataataaaaacaacatgtacaaatgtgtggcgcgaataacacaccctggcctaatgaagcatgacgccttaatcgactctcacgcgcccgttggacacacgattttgctttaccagacattgcaaagaaaatggggacacatacagggagccactctgcacagcgcatcacaaaatagaacacaattgaacatgcacagtgagtaacatagataatagcaggttttaaaaaaggcgaaaacagtaagcagctgcaaagatgggaacaaaagctgaacaaaaccaaatcaatagatcaagttggcagtttacatataggaccagaaacagagggcaataattaaagtacgaaaaaacaacgatcaccattaagaatactctttaactaccccgatactacagaggaacaatcctacgacctatgcgcaccgcagaaaaaatggtcctccctaacaaaggtgaaccatagagagttacactgctttagtacattctcacaaggcagatctgtaggaccatagcgcgcctctaacctagcaaggtgtgcagccgctgttatagctacgtcaaccgcagacgcggctatctttctgtatgaaagcaacatgtggaagttataattgtgcacagcgaaaccatacttgacttggagaaacctaacagcctgctgtgcaaccatttcatgggaaacggccgacggctgtactgcagcaacccaaaagaacttgcttactgtaccgcagcctaactgctcgtcaggaagactaagttcaacacctgctaacagcactccgtcaccatctacctcccaaaggtatgacacccaaggtaaacggcaatgggaagcaacagcgttcaacaaagaaacgtaggatacgccaaccgccaccatcccgccgagagcactgcgaatcgtagagacagctttcaaatagggggaaaagagggcttaaaatgttgaggagacaggggctgagggaaggtaagatatatactaagatagcaagaacaggaagatgctataaagtagctacactgtcgcgtggggccaaacacagatatatattctggaaccaacgttcacatgtcctgtacagagcacctcacactcgagaatcctctatgaaaaagggaaaaaaaacaaaggttgacatataaaacattgaccagacagcaacggtcccctcccaaacaaaccaaacgcaataaaggtggcaataaaagcacaaagaacaacacacagcaatctaggcgatataaagagaagaacactaccttggtggtaccggagacccaacaccgaaagaagctacgcatccgtcaagaaccagggaccaagcacgaagagagagagcagcagaccaacgtgcggtggccgttctcctacagaatggaacaaaattagagccggcatgaaacctcaccgatgaacagaagcagccaacggggctgtacctcctccgcaacagccgatccggagctggcgtcaaactctactatccctagatggagatgcccctggatcctgaaagggatttgctggaaagaacacaccgaatatgaggaacaccgccaatcctagaaaaacaatgcaacaccatgctgagcaagggcaatcaccttgccatcgccatcagagcggaaggtcgcaaccagccactgggcagactgaaggaaagggaagaaccgaggagaggggaaaacgggatggaaggtaaaaaggaggacatcacggggaaacttgtgagccgctgtcgatttcctattggccatgcagaacacacatggtaaacccacccaccagccaaaggcacgcaccaactgatatgtgggaccataaaggcgtcgacgcccacgcctgaacagcaacgacccctacgtcaacaaaagggccctcgatcagatccatcagaggagcaagcagcagcatggaccaagcccataggcaacacgtggcaacaagtatgtatgttctctccttccctacccatagaccatagaccaagcccatccaaacaattcaaacaaagcaacaatccctcggttagatcgatcagtgcaccaagcagcaccatgaacctagcccacgcgcaacatacatgtacgttctctgcttctccaaaggcagaccaaggaccaagcccattggaacaaaccaacactgcacgcactacctttttgactttttggacaagagatgacggggcggcataacagccattcttcacacgccgtcgcctctgtctatcggacccaccggtcagctacagcggtaaaaccgcagcacggcacagtaaaaaaaagcccgcttccgtgctctcccgtgccccaccgagacaggctaaacccacgatacaaaaaccgacgacgtggatagtggcgggagcgaacacatcacccctaaagccgcgtaaaacgctctggtgcgagcacattgcccctctctttaactaccctgattcccacttaaatccatcacctcctccataatttcaccacataaatgttgtagtagagtattatcatcgaactgatcgtctagctcaccttcaacaattacatcaggaaacaattacatggtaacttgaaaatttatcgtgaaaaatacaaactggattttcccaattttttttagttaagtgcacccccttccccaaagaaaatcatgacaccttttcttttcacattctctgttccacatgttacatgtcaaatgaaatcagtcggccaggttagtaagggcaagtactataatatctcatatgttgcctctaagaatgccacattggattgggtgatgaggtggaggagagaaatggagagagaagatgaaccacccctaaatcaagaggcaacctccacataaatttcaagaaatgtgtgggagtattagagatattggtatttgtgtgttagaggtaatacattgtatggattgcctcttagttcatgagtgaataaaatagataaatttggaggtggtagtcacatctaccatagcacttgccctaagttctaatcttgagatctgcgtggagattgatgattttagaatttatggacaaattaagtcgcaatcacttgttctcattcaaacatgagttcattcaaaggtatgacgtggtgtattggcgttggtgtggaatgtaacagtcacaaaaagtcagctccatcgtcagcgtagtgttcaaacaggtgttggtggcgttggtctagagtcatgtttggttggctgctaaagtttatgacgtcaaatattagatatgacatactccctccgtttcaaaatgtttgataccgttaactttttagtacgtatatgaccattcgtcttattcaaaaaatttaagtaattatttattatttttatatcatttgattcattgttaaatataatttcatgtacacatatagttttacatatttcataaattttttttgaataagacgaacggtcaaacgtatgctaaaaagtcaacggtgtcaaacattttgaaatggagggagtaatttgttagccaagctctatagttaacgctagatcgctagccacagtttcttactttattactccctttgaattaataatacttgttgttttgaaaaaaaaataaacaactttaaccattgtcttctgtcttctgctagaggtgtgaaagcatagttggttagggtgtggtctcaactctcaacaatcaattgttgccggtttgattcccatggatctttcgctttgtctttcctttttcttccaatatttttattttcgaaacacatccattatctttagcaaatatgataattatatgcaagcggcattccctaaaggcgttttagttctctgacaacattatttccaaaaagtcttgaatactcatactgaaaatcttgcgtccaccagccactgcctgtctgagttggcactctagttggtactaggtgacttaaggcctgttaggcatacctccagctctagctccacctcttctaaagctggagcccaacaaaaaaatttcagctctatctagaatgaaagcgaaattcggtggagcgctctcacaaaatgaacttcagttagatggccagtggtcttcgtgaggggcggcgccatgccctgttagaaacccgtttggcactgtgaccgatcacccacatgcatatctctactaaggtaaaagcacacagtcgttctccttccatctccatctctcacgcatgtacactctacgcgattaaacaccagattctattgctttatccttaatcacctttttagtccatgtttaattatataggcttggtccgttataacgtacgagcatgttattagtatgcaacaaatgcggaagtgctaatgggcgatcgatcgcccggcgacaagggtagcgatcgatcccccttccccctccctccctccacctggtttctttttttggcaccgcattactttcctattttagtaaatttatacacctaaagtttatacaccttaagtttacacatctaaagtttatacacctcaaatttacacatctaaagtttagagactaaaagtttataagtcaaaagtttatatatccgattcaaatttgaatttgaattcaaatattttatatatatatagtatttctataaatctaaagttcataaacctgaagtttatagacccaaagtttataagtcaaaagtttacatacccgattcaaatttgaatttgaattcaaatattttcaatatatagtatttttatgcatctaaagtctatacacctaaagtttatagacccaaagtttataagtcagaagtttacatatccgattcaaatttgaatttgaattatatccgttcaaatttgaatttgaattcaaatattttctatatatagtatttctatacatctaaagtgtttatacacctaaagtttatagacacaaagtttataagtcaaaagtttatatactcgattcaaatttgaatttaaattcaaatttgtatggtgtagtagtaagagaagaaggggaggtaaggtagtaaggggaggggcgggcgatcgaccgcccgttaggagtatcccaacaaatgcaccaacaaagaaaaaaccgtgtccttgccagtcgcatcttacccggcatcagagccttaaaggccagctaattctcaatgggccatgcacccatgccacgcaggcccgtcgatggctatgtgccaagtaggcgaccgcacagggcctctgtttttttggcccccatataaacaatgaaggttcacttccaattgcccagctatagcatgcaacaaccaaatagactaataggcaaatcaatcaataagaccaagccaggatggggcgctgcaagtctgcaaggctctgctattacctaccttttgcatggctgtcgtgcgatcctaattctgtgctgcgccaactgccgggatgtcgtaacgtgatctcaattccacgcgcaacgactaacgaggcggcgacacaacttgatgctttcaacttcgaggctccaagcagcatcgacgatcgcgacgaccttgcagctctgccttcggctgggctcctgggtccagccttcttcctccttgtttgctcgtcgtctcgactcaaccctcgatggttcgactcggactggtaaggttagcctggatgatagatcgtaaatatgtaatatgcatcaaattgtcgtgagttcatgactgtaatctatctatctatctattaagacagctcgaaacgaaggcaccacgttcgtcgtgggggctagaaattcccacattaatcggagaaaaagaaaagaatagtcaaagtaaaaatacaattaaaaatagctaaaattcggaattaaaaatgtgcaatatggaaagaggagtccatataggaacctagtacgtgattaatcaaaattcaaaataaaaataaaataaaatccaaaattagaaaaggaaaggagaatagaaatacaatttaaaaatagctgaaattcggaattaaaaataagaaatattgaaagaagtttccatataagtacccaatacgagattaatcaaaattcaaaataaaaataaaataaaattcaaaattagaaaaggaaataagagtccaagtaggaatacaatttaaaaatagctgaaattcggaattaaaaataaggaatattaaaagaagagtccatataagaacccaatacgagattaagtaaaattcggaataaaaataaataaatctaaaattagaaaaagaaaataaaagaaaagtttaagtaggaatacaatttaaaattagctgaaattcggaattaaaaataagcacactgaaaaaagaatccatataagaacccaatacgagattaattaaaatttagaataaaaaataaaataatatccaaagttagaaaacaataaaagagagttcaagtaggaatacaatttcgaaacaactgaaattgaaaataaaaaataaaaacattaaaataacacaatacggtattaaataattttttaaaaaaattctaaaattagaacaagaaaaataagatttcaattaggaatacaatttataaataacaaaaaattttgataaaaataaatattattaaaataaaagaccatctaaaacacatgacgagatatattaagtaacatgcctataaagagtggtggtggttgatatgacatataaaaattgttaataaaacaccaaatagaatcctaatgacgattaaaaggagagacgtcagggaggccgtgaagcaaacaagtaaggcagttgccgggacttctagaaagtaaaaaaaaaacaatttttagaatcacaatgacaataaagagtaggtggcggacgggctgtagatcagggacatagtgacatcgtttgatggcacttctaaaaattattaaaaataaaactacaagtccaatttttaaaggttcggaacttctgaaaagtaaaaaaaccaatgataatcatgttcgattttaaaatcaaaatgaaataaagaagggaggcagcgggcgagccgtagagaattacaatggcaaagccgctaatggtttggcgggacttctaaaaagtaaaaatgaacttaaacgataattatgttcgatttttaaattctcaatgacaataaagagataagatagtggacgtgttgtagagaagtataatagcaacatttgacgggacatctagaaattataaaaatgaaacccaacatgacaataaactctaaaaactataaaatccaatttttaaaggttccaataagaatgaatagaaatagtggtaaatcgagcaagcaaataaagaaggagatgagacataaggggtagcaactggtgtgacttttaaagcctatataattagaaacacgatgatgataagatttagtctttcaaagtcttaagacaatgagatagctatttaataaatttgaagtaaaatcatacttaaaaaaatatatgattttgtttgggtgctagccgcgtaattgcgcgggccacccagctagtttataattgaaatgatcgattatatcaaattatcgttttgattaaaattactgctcctatttgtttgtgaaacataaaggcatatatttcgaaatatcatacattataacacatattacatatatataattgagtgaaaatatattttatttattttatatatgatttttttaaaaaattatatgatctcaatttgcattttaccctgggcccaaatttaattcctggagacggccctgatgccacgaaaccgatgccctctctaagccaggcacacgtgagcaaacgaagccgcccgtgcatgcgcaacgaaacaacgaaacatcatatcatgccaccaccgtctctacgtgtcggcctccgcgcgcggcgtgcccccacactcggacgtgacgaggcacggttcgcccggcgcccccatgtgcgtgggagagagctagctcagccggccggttatgcacgcggaccaccatggcaccatcgcgcggcgaggagtaaggagacagccagctcgatcgatctccgcgagtacgcctactacgtactactgtactagctagcgtggtactagtagtaggccaacgagcgacgtcgcgtcgtacggggtcgtctgccggtgcgacgacgtgcgcgggacggggacggacgggggaatgtggctgaaagggggaagccgaaccacctcgcgctcgctgcctgccgtgccgggcccgtgcgggcgtccgacgtgtgcggccgatggtatgatacttcgatcggaacaggtagtgcgtacagagccgtacaatctcggtcggtcacgcgctcacgcgtcgtgagctggactccaacggccggcttgtgtggccttgtgccgggcgccaactcactcgacagcagtggcaagcagcgtcgtaataaacgtacgtgtacgtaccgtccgaactggggccgggcctgtggggatcggtgatcttttggttggtggcggatcgcgcgttccgcggggcgcgtggcgcgtgggcgctgatcgatcgagcgcgagccaggctgccaccgtcagcgtcttgggctcgatcgtggcgttggtgggggacgcgacgcgagggagttgggaaccagccaacggacggacgggctcgttcgatccccttcgcctgttaatccgttgcatctcgtgcgctgcgcgtctctgcgccttgcgcgcggtgcgtgcgacggtgcgagctgctttgtctgaccgatcgggaggattatggcaagaactcattgtgtgagcctactatatatgagttcaggccggctctcgcatcagttttttttttaagcccggcctgaaaccggggccaacccgggggtctgcacccaggtgtaccgtgtacggggaaaacgcatatggcaacacgcgttggtgccttggtgtaatgaaagggagccgaaatgcagcagcattaactgctgaagccatttaatttgggtcaatgtcaatgatattacacattatcatttgtttttcctccgagaacccattctcatcatcattaccttcttatgatcaagttaaaaaagaagaaaactccattttttctccccggacttcccttgaggaaatagaagggcaatgaaagaaagaaaaatatctccctagctagcttatctacattaaacgcctaatcaaaccattgctacgccattgtcgtcattatcaccgttctggcaaccatctgtttccacactgacactatcatccctccataatttcgcgagaaggccatgcttgggcacagggaatgggctgtactcaacctcgtcgctggaaccaacaatctcccacctgcaaatcaagaacgcagacgtcaatcagcacaccgttccacaacgaaatttgaggaaccaactcgtctccaatgacatgcatgtgactgctcatatgtggtactaggatgctgagtaggcgctgtgcgatctgagcagtgaatgaccccacaggttggagcatgcgtgtactagcagctgtggtatgtgtatgcggaatctggcagctgggaggaaggggccaatggagtggcagcagccatggcacggtgtggtccacaacgacaaggggagaatatatggcgaatctgtgtggaggggcacgcacctgtagccagtgaccaggtggtggatgaggacgagcatctcgagcttggccagctcgttcccggggcacgcgtgcacgccgttcccaaatggcatgaaggtgttcggcctcggcgacacctgcatagacattgttccacacacaaccagaaaaaaagagaaggttcagaaaaaagaagtttcactcgtggtacttcagttttgaggctctatctatctgcagattggtagcaccactagtatttgctgcggctgctatgcaaagataaattaagtcatttacaaatgttctagataagggtttgactcagcagcaagttgattaatggttggttggatttccatggtatacatctgatccgagtgtgaattctggcctatttgtgggcttgtcgaatggccgaaaaccctgacatattctgacgagaaaaggtacaaattatttctgaaactgaatatacctattcgcacctgacgtattacaactatgtcttattataatttcattccacgaacagtatcacaaagagctgccgttgactagagaagagggaatttaatgctatcgaaaggaacagtgttcagtttgttcagagatgcatgcatcgacatcaaaagcactgcggcgaggatcgatcgatcgatcgaggcccataccttgaatctagaagggtcgaacttctgtggatcctggaagtagtctgggttgtgatggatgttcctgaagagcggcatcaccttccatcccttggggataaggaaccctacacgccaaggaaaaatacacggtcccgtcagcaaaactaaaaaaaaaaaatctacactgtttttttcacacgatgcatggagtaacggacgtggctcccctacggccacgttgtagcgtagggctgcgcacgtgcgtacctttgtactccacgtcagccacggcctccctgaacgtgaacgagatgatgctggccatccttaagctctccaaaatcacctgaaccgaaggatgggagggagatggcaacaaaggaattagcagatggcgccgtcagtaatttaaccgcaaaaatacacgggaatcgaatgaaaactcgggaaatgggtgtatttttcgcgcatacgtaccttgtgggttagggccatgctccgcgtctgcgcccacgtcagcggcagccggccgccgtcgttggcggcgcggatcgccgcctgctccgccctgacggcctcgagcagcttgggatggtcgtggaggtacttgacgatccaggtgagcacgctggccgtcgtgtcctgcgccgcgaacagcacgccgatgatgttgtcggcgacctgctcgtcggtgaggagcgcgccgtcgtcgcccgcccgcgactgcatgaggcagccgaggaggtcgctgccgggctccccccgcgcccgccgctcccgcatgatgtcgctcagcacgccgtgcagccgccgcctcgcctgcagatttagtaagatgcagaaaggaactcgatcggttatcacctactgttgctgcaaacaggacgtacaagaacgacgtgaggaaggcactagaatatgctacagctcgtgccatctagtgcctggcttctgctgcgtacctggatcgccttgtagtacagcgtcccggggaagctgttggggaaggagttgtagcccttctccacgatggcgtagttctgcctcagctccgctttccgccgctcgtccagccgcccgccgaagatggtcacgatgccgacatcgaacgagagctgaaaggaacaaaaaaacaaacacgttacatgcatcctcgtggcgagcagcactgcttttccggcacattcctcttcatgctctggctggcaattcttaccctcttcatggcgtggaaggtgctggagacgttgccgtcccaggaggcgagcgtggagcggacggcggcctcgacgtccggcacgagcgcgcgcagggcgtcggggccgagagggccctggacgagcttgcgaaggcggaggtggtagtcgccctggtggaagaagagcgccgacgggccgatcatccgctccttgctccgcgggtacgtcggcttgaacaggtgcgcctgcgtcaccagcacgaaccgcgccgcctccgggctcgccagcatcacgcacgggcaacccagaatgtgcgtcttgaagatctcgccgtacctgcacgcacacacaagccatacatcagcaataacgccgaaagctacaagcccacaactatggcatgcagtatttgtgttggcagcttggcattatcttgccatccatgtccttcaaaagcatgcgtccatgctttcaggttgcagagattagcagcatgtttgggtttttaattaattggcaactaacctcttctgtttggaggcgaagaagacgttggggtcttgggagtagagctgaagggtctcgccgatgtaaggccaacccatggagcccggcggcagcctgacggctttctcatggccgtagccatggagtttcctcctctgccggctcgtgtagtggacatagcacataaaagcaagagaaatgaagaaggagatgacgatgacgatgacgaaggaggctgccatccaaatgaccctggagaattaaggatcacttggacaccacagctgttttgagagttctgaaccagctgtcttcttcttgctagctagtcgtgtgttattgtctttgcgctatatatgctgttgctaggagagagggagagagctgtgaggagagggagagagggaggagaaaaatcttcgagggatctttcgaatggtggtgggcgtgggaaggccttgcgtggtatttatagaggcagagcgcgagagagaaagtgagaggccagtttggaagctcatatggtgtccgcgagctagggaggggagggagtaaggcctgtttttcccagcttaggattattataatctagattattgagtcagattaccataagctagattgttataatctgtagtagaataaacggttagttgtttctttcctagattattacatcctaaattattgggtttacaagtctaaagagaaagtggtgtggtatgacgggtaattttttacccaataatctggaaaaagctcacctaaatgagcttatcatattataataagccctctttgtttaggcttataagccaacttataagtcgaaaagtctgagcctaaacaagcaagcagcttttccgtttggtttttttgaagccataagccactctaacactattaagccaaaagctaggttggagaagcttttttggcttatgtgagttagatgtatgactcaactactaaacttaggacattaaatccaccggcttataaatcatataagctgacttaaaagtctaggctaataaacctaagcctaaataaagagggcctaagctaggctccagattataataagctacttcaataagttgtttgtttctttcagtttactcctaataatttggattataataatcctaagctgaaagaagcagcgcctaaatgtacatacatcaaggaagtttcaacttatcctgtggatttctaatgatagcatatatatatcgtggtatttatttcttatcaagattttcttaagagggtgaaacgtacatgcagcaagataagttcagtataccactataccctgttgatttgctaccctgtgctgattagtttcaatcgtgtattggccaatctggtcgtaagaatagcattgcattgcatttattatgttcttatcatgtgttttttggggatgaaacgtacatgcagcaagataagttcaacttatccagttttatcgtcgttctgtacatattaaaatgtagtttaatacagtatagtttactcctacttatactttaagtatgtgccacatcatctaaaagtatacatagagataggacatactaggactactagaatacagtggcggagccaggataaaaatatagcggggctaaaccaaaatgaccaacagcaactaagagagatttaggattaggttaggaatttttgggccttcttaacgttttgggccttctaacaacctcaaacaaagtttatattagcccctcatttataaatatatggattagaattttagggggggtattatgagggctctaatggtctattagagggtacgggggtctaaaaacacctccacccccacgctgtctccgcctctgctagaatacaataatacaatagtagttacattcttccattccctcagccatggacgaagctacaagtatccagggatgcctagggaaccgatacataatttttttttagttatagtttacctattttcatcatatatacgtctcctcaattcaaacttagacatccgtatcaagctaaaatcgattcaaagtagagtaaaatatgtgagtggaacccctctattttgttttagctttgtcaccgttttcagtgtacgtaggtaaccaccgtatctaatgctttgtcccataatcacatttatgtagcacatccctacttatataggtccgacacgttacaaataaggctccgttattggtactttgaaaggggagtcttccgtccaccccctcccagtccttcacatcatgcacagtgtgcaaccatcacactcgcaagaaaacaaaccaataatgttcctaacccgttcccaatcacacctcatttccaattacatggtccaaaaaaaattaatctccattgaaagagacaagtatattattatccattgcaacacacagacgtgttactactattaaaacaaataaattggtagtaaagatatgcacacgtgtgtatcccaccaagtaaaatagaattgtccatcgaatgtagataaaaggatgcacacactctttcttatgcataatttgttaactcactacaagaaaacagaatgtccttggcggccatataatttctttagcggtatttacttagcgatcggccgatggaataattaagaccgccaagtacattccgttttcttgtagtgacttgggaataatgtttacaatatacccaagtgtcatgccccgaactagtcccgaccgagactagcccgtgacgctccaatttaacctgttaatcgataccagtcccaggaaacagtgctggtatcacagggagacagaatatcacagcaacagaggtctctttattatagagtaggagtacagtcatgttgagctgcggacagatcccgagctcacaactgcattacaaaaggaaaacggaagccaggacttggaccattcatcacaggcgcgacttgggaactaggccgaaaccctaaaactcatcgtagccggcttgctcctggaagaactcctcatcagcaggatccgcttcatcttcttcagcaactggggggggatatttatatagagcaagggtgagtacgggagtactcagcaagccaggggaaataagtgtttaatgcaggcttcaagggaaggctgttgtttttgcaattggttttatttgaactatttttctaaaacaactaggtgagtgcttctcaaacgacacggatgggacagtgcgtctcgtccggtcggagtatgtgcaatgtatcagtctttgggattgcaacaaggttggcacccggccaacagcttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccgtgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggtttttccaagtcttttgtaaaactccagttttacccaagttgttactcagattttaaatttgaaggcgaccgtcgatactcgcacagagtgcgcgagtatcgaggcgcaactgggtggttacaaggggacatggtatagcaattaacaaaggaaggatcaaatgcgacaaattaggtaggtccgccaatctgccttgcagacgggacaaacagattaagtgtgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactacacgcgaaacgggacaactcaacaaacggcaaaaataaagccctattaacgacctctaagcgtgccataagatagatctcgagatttggggaattttggaagttgaacggagtcaaacggatttacggttgggaagatattgaatttctaagattattgaatttttgatctaaaggaaaaggatttaattaaatcctttttggaaaaaaaaagaaaagaagggagggaggaaatatagacttttctcggacagctagggcgcggcccaagagaaatggagcggtccggccgagctaaatgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggggcatgcgacgcacgcgcgcgggcggggacggaacgcggtgcatgcgcgcggtccgcggtggacgcaggtgcggcgggcccacgcgcagcctcacggctcgcggtggatcgcgcgcacgcggagggaccgaccggggtcggcccgaccaggtctggctgagctggcgccgacgtggcgcctacgtggctgccacgcgggccggcgggaggtagacgacgacccggcctcgaatggacggcgggcggcggcggcaagcggcggagcgaaccacggcgatacgggcaacagcgagcacaccgggcggttgcacgtgacaagggaaggcgagccatcggctcggattcgccggaggttgctcgacggcggcggattgcggcggcggcaaccggcggcgggagaagagggaaacggcgacgaggtcgcgagaggtcgattcccggcggtgagaacatctacgcggcttcgggaactcgacgctagcgtcggattgggaggaactacgccgagcgaggccggcgacgagcgggtgctacggagctcgggcggcgacggcggcgagcacacggcgagcgatggcaacggtcggggcggcgccggctaactacggggagtctactcaagctactaccgaaagctagggggaggagatggagcgaggaggaagaacggagagagactaccgtgtgggacggggcgcagtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgaggcagagcacgggagcggcggcaacggtgaggaggcgaatgggagaggaaaggaaaggagggggaagacgggtttaaatgggcggcaatgtcggtttgagagaggggaaccgacatgggcggtcaagccggcgagctggcgctccggctagcgtccaaagcggcgacaggaggtgacgccggcgagaggggaaaaaggggagaaaaataggaaaaggagggagagaaagggggctcgcccctttgccgattcgggaaaaggaggagggagtggggcaactcggcagagggagaggggctctctgcctccgtcccttggaggctagcgcgcggagtggcgggggccgggcgatgacgacggcgatgacggtgggatggtttggagcggcgcgacgacactagtgacaggcgcggctggcgcggcagagggtgacggcggcggcgaccaggcggtcggccactcggcacgcgcgcgcgggaagcaacgggcggcgcggctgggcagcgggaccgggcgacgcggacggcgcagacgacgcggctcgggcgggaaaccacgcgggcgcgcggggccggctttgcgagcggggagctcgcgcaagagatgggggcgctcggcgcggctctcgcacgcgcgagcagcgaacggggggggggaacgcgccggggtggggagggagcgagagagagagagagagagagagagagagagagagagggggggagacgcccgggagagagggggccggggaagagatgggccgagcggaattcggcccatcgaacctggggaggcaaactagacttttgcggagggattcgatttggaaggaattggattcggagttgaactcgacgatagatcggggattgagatcttgagatggcacggacactagacaacaatcaaagaaacaaatttcgcaattagggtttttcggagataattttcccgctaggcgccacgacggaacgggcgctacaccaagttaacaggtctttattttgcgaatatagaaaagaaaaggataggagaaattgtgttaaagtatctcttagggggaaattgcttaatacttgaagaattgagacgtacagttcgctctccattaatatgtaaaaatttaatgattttcagtgatgtttgacgtaatagtaaggctttgtttaaggaagtttaagattataagaaacatttgatgactatttagtctttgagaatttggaaaaccgaagttccgaaccttttgtttctaattcattttctatattttatagctacatatttatagaatttagatgaaaacctgaattgtttggtactaggagattttagaataaacagcgtgtgtcatatcagagagtggttggtttcactgtcatatatatccgtcgttacatgcactggttgaagctattgtcagcgcgtagaccctatcgttttcacagtggcaaaagtaaaacattcaagaaactacgagcgggttcgtttcaacagttggagagtagaatttggaggccatcctactgcttcgagaaaattataggtttggaacatctgatgtttattgatagttcactactcctaatacacatgttgctctataccagtctactaggagaagacaagcaatgcttttccgatcgtgatacttgcttctcgacatgcctgctttcctgactatgaagatagcaatatctagagttctgttaagaaaaaagatcagtaatatctagagccaatacgtagttacgtactctgctccatatctgatcatggattatgtctcagatctgtatgtttcttcttattattattatcgatgtgttctggtattctccggcatcacaattcagaagctagtctgtactcatttactagtcatctctatagtctgtagaattcgctgttatattccttagcagaattctttgattattaattatctaccaattcgtagttttcttcgcgttgtgaagcatagagaatacagagtaaaacatgttctacacttctacatgatctgtattcctgcatgtttcttcagtataacgtgtctacatgcatcaccacatgataaaaaacgggatcatttatgatcggtttctatctcaaataatttctgaaagaacggcattcattcaggatcgattggaacctcacaatatctacctcacttatttacatcctcattattcaagcttgattcgtctaaataatgttttgcttcacgtgaatgaagctttaattctgaaaagcgaaatatgtggggaagggtgatgagaacaacagagcaaatcggagcatttaatcctccaaatccagccacttccaaattaacctggactgagctgagttctagaccatatatatatcgcgctctcgtcattagtcacgaaactactgttcgtggagtcatcttagaccaactgaacgtttcttgcaaactcgaccaactgaacaagctagtttaatcaagaagcctaccatggaaagagtaaaatatagatagatcaagatcaatctcgggacccaattaagcttggctaatagtgctcccttttctccggaaagctcagtgcacagcacctgcgatttcgacgtgtcatggccgtgagatctgccgtgccggccgcctcacgctgacgacaccagctctagagctcgatgtggctctttcgtgccattacgcaagtactgatcgtccctgtagcgagataattaccatggcgccttgatttgtctccgcttcgtcctgggccagtggttccacggccggtcgctgtcgcgtagatccgctcgccgctcggtcggacagtttgaggttgctctagaaccggccgtgcctgctcgatcgcgagctccgtgcgtcacggtgttaattgcggattgcgcggggcctctgcattggcgggctcccgaccacacgtcgcgggaccgcgcgcgcgcgcgcggtggtgaacgcgaagacgccctggtcgtcatgccatggcactatggcaggcagacgttgcgggtgatcgggcaaccgcgatcgaaccaggtgaggcggcgagcgcgcgtatcacatggacgcgatcgcgaccacacgggaagccgtcgccatcagccgctgcatggagcgcgcgcgcgcagcgttatccccagcgcaacttgcagctagcgtacgtggcggccggggcgagccgggaacaagtggtggccgcgggcgaagcggtgcaccgaccgagccgcgcgggttcgcgtcgtgcgcgtcacgtacgctgcgcgcgacactacgggatggacccacgggagagcggcgccaatatgatgtcggtggctggacagccggatgatgggcatcttccccggccccgtcgccgtccgcgtgtttccctctgagcgccggccgtcgctgtcaaggaggagcagagctaggcgtcgtacaagatggctccgaaatttctcttttcgcgcacgcgggcttgtggctccgcaggtgatgcccgatgcaagttgccaatggcgatcgagcgtgatggggattgatcggtttaggatcaggggctccgcatcaatcatccgcaccgacttttgtgcaagttggtacgatcgaactacttccgcctgtcgtgtttagggagagaaggtccaggtgaaaatagttggaactgtttcgtgcaggtagcctcttgtgcgtgtacgtacttgcttattagcttgccaatcgtatggactacggatcaagttaagttgtgtgacgtacagctcattcaaactttgcccacattttatacacatggatgaaaaattatattcatggtttagttcaactcttcttagaacactttgacctggtcaggcaataagctacggtctgtgttggagacatgtcatgagtgccttcgcccgaacccgccgaaaccattgggaacctgaaaaaacgaccggaagccaagtcgatggaaggcgaagcccatggtgaagcttgaaggcaaggcgcatggtgaagcttggaggcaaagcccgtggcatagcatgaaggcaaagcccacggcgaagcataagggtgaagcctgctggcagagggggatgtagcctcccttggattcggcccaagaaggctgttcatcacctttgtgggccgggccgaggaggctgttagaaggcccacgacttaatagacatcggttacccctgtagttgtcaccatcataagggcatctatctatctatctatctatctatctatctatctatctatctatctatctatctatctatctatctatctatctatctatctattatattattaagatagctcgaaaaggagacaccacgttcgctgtggaggctagaaattcccacattaatcggagaaaaagaaaaaaaaagaaaaggagagtccaagtagaaatacaatctaaaatagctgaaatttggaattaaaaatcagcaatattgaaagaaatttccatataagaacccaatacgagattaatcaaaattcaaaataaaaatgaaataaaatccaaaattagaaaaggaaagaagagtccaagtaggaatacaatttaaaaatagctgaaattcgaaattaaaaataagcaatattgaaagaagtttccatataagagcccaatacgagattaatcaaaattcgaaataaaaataaaaaaaatccaaaattagaaaaggaaatgagagtccaagtaggaatacaatttaaaaataactgaaattcggaattaaaaataagcaatattgaaagaagtttccatataagaagcgccaatacgagattaattaaaatttgaaataaaaataaaataaaatccaaaattagaaaaggaaaagagagtccatataggaatacaatttaaaaatagcctaaattcggaattaaaaataaagaatattaaaagaagagttgaacccaatacgagattaattaaaatttgaaataaaaataaaaataaattcgaaattagcaaaagaaaataaaagaagagttaagtaggaatacaatttaattaaaaataagcaatattgaaagaacaatccatataagaacccaatacgagattaattaaaatttcgaataaaaaataaaataatatccaaaattagaaaaattaaaagagagttcagataggaatacaattttgaaacgactgaaattgaaaataaaaaatacaaatattaaaagaaatacggtattaactaaatttttttaaatagagtaaatttcacaaaactgcagatactataaccaaattattacaaaactacagatttaactcggtgtatcacaaaactacacatttaataccaaatttatcagaaaactacacatttaagatgaagtgtcacaaaactacatatttagtaactaaattatcacaaaactacaggtttagaatcaatttaatcacaaagtattgatgtttatagctccaccataaaaatggtgctagggatttaaactccaaaagttatagttttgtgataagttcaatattaaatatgcatttttatgatacttaatctaaaatctgtagtttttgtgataaatttggtgctaaatatgtagttttgtgatacaactccttaaatctgtagttttgtgataacttggtcaaaatacctatagttttgtgaaattcactcaaaaaataaattctgaaattagaaaaagaaaaataatacttcaattaggaatacaatttataaataactaaaatttgtggtaaaaataaagactattagaagaaaagaccatctaaaacattatgacgagataaattaagtaacaggtctataaaggagtagagtggtggcggttgatatgacatataaaaaatattaataaaacaccaaatagaatcctaacgacgattaaaaggagggacgtcaggcaggccgtgaagcaaacaagtaaggcagttgctgggacttctagaaagtaaaaaaaataaccccattgataatcatattcgatttttaaaatcttaatgacaataaaaaggagaagcagagccgccgacggctgacgggacttctagaaaataaaaaatgaattccaacgatagttatgttagatttttagaatcacaatgacaataaagagtatgcgacggacgggtcgtagaggggtatagtggcatcgtttgatgggacttctaaaaattataaaaaatgaaactgcaagtccaatttttaaaggttcggaacttccaaaaagtaaaaaacccaatgataatcatgttcgatttcaaaatctcaatgacaataaaaaagggaggcagcgggcgagccgtagagaagtataatggcaaagccgctgatggtttagccggacttctagaaagtaaaaatgaacccaaacgataattatgttcgatttttaaaatctaaatgacaataaagagaagaaacagtggacgagccgtagaggagtataatggcaacgtttgacgggacatctagaaattataaaaacgaaacccatcgtgacaataaactctaaaaactataaaatccaatttttaaaggttccaagaagaatgaatagaaatagtggtagatcgagcaagcaaataaaaaaaagatgatgtaaggagtagcaactggtgtgaatttttaaaactatatagttagaaacacgaggatgataaggtttggtcttttaaagtcttaagacaatgagatagctatttaataaattttaagtaaaatcgtacttaaaaaaatatatgattttgtttgggtgctagccgcgcaattgcgcggaccatctagccggttcatgtaaaattccctgcaaacaataaactctagagagtaacatgt

SEQ ID NO: 47202 - DNA, 22568 bp, Oryza sativa
gatcccatagcgcactggtggagataagaatcttctacttttaaagtcacattattttatcactgatatgtaagcttgatgaatcctatacccacatgtaaataggcacgatgattttgataatagatcatcgtaatcctcagtgaagtgtcaatgtgtcattggcatcgtacgatgtgtttgtggtagtattgttggtgcttggctcaattttgcttgagggacttggtagttcactttagtgagttgagagagctgatataagttaaagtccataagttgaacactcataatttcctgagagatgggatgtttgtgaaataagtaaatactagtattgacaagataccatacacatgtttataagcttagtccactagtattgacaagataccatacacatgtttataagcttagtccctgtcacatcagatttttgacactaatttagagtattaacatagactacttacaaaactaattgcataaatgagagctaatctgcgagacaaattttttaagcctaattaatctgtaattagagaatgtttactgtagcatcacataggctaatcgtggattagttaggctcaatagattcatctcatgaattaatccagggttatgaaatgggttttgtctttagtctacgtttaatacttctaatagtgtccaaacatccgatgtgacatgtactaaaattttttagccccatctaaactccccttaggatggtctgtttgattgtccgacctagccaatagtccaggagatttttgttgatcgactgaacttgctaattgaaaaaaaaaaggatcggttaagacatttacaatatcatgtcatggcgaccgacctcgcgtgttcacatcagagccaaagccgccaccttgactgggagagatgtcttgcgggggcacgtgtgctcggtaaaaggcatttgagtctcaatgtaggagatgctctgtagttgtatagccattgcccgagaaaactttctctggacatattcaacctactgtgcattgagaaagggtgtcctcgatggcggttccaacctatgtgacattttctctttatatcacacaataatatttttatagtgtaaatatccttataggcacggacaatcttactcatgatcttgtccaaaaccaaacaagaaaagcttcacatcttctctttttccattaacctttatattccactatgccaagtgagcaagtcatataacatgccctgaagaggaggaatcaaaggtaccagttcaggaactggcataggctcgattcaagcgatgcaccgagcacatccacctcgagtcgtccacaaaatcaatccacaacaatcacagaatcgacatctcatatactcaacatataagatgtggatatcatacagaatcgtcatcgtccaaaaacatccatgaacaaaaccgacaaaaaaaaacatatacaggttaaaaataaaagggtatagaggaggacgcagaaggagagaaggttgacgccgctgcagctcaccatcgccgtctacccgcccgcctaccaccgtcgaggccggatttggctgcccttaagctcgtggcaaatagatccggtagcttccgaactcatggcgtcctactagcccatggagatgtcgaggaggggtgtccggtcaggaattccatgcgacgagtagggtggtggcacccagccgtccaccaacgtcgaggcctggtctaggccgtcgctcgccagctaggaagagagaagaggcgagggctgcactgctcgctggttggggagagagtagacaacaaccgcaggtgataggggagagaggagacagcggcgaggatgctcgatggggaggagaagaaaggagaagagatcgaggacgtggagattgaattaatgaataagatcgaggggtgggaataaaaaccaaaggtgctccatgcggttcgtctctgctcggctcataataagtggtgttgggttatttaaaaaaccagcacatataaccttttataggtaccggtttattataaaatccggtacaaatatttaatgtgccggatttttaaataaattgacaactatgaaatgttataagtgttagattttaattttagacttatgtgagagaggttaggaggatgggaaaatgcatataaccgggtttagagtttttggcatctataaagcctagtcgttccgtattatgttttacagtactgtaagaaagatggttcaagataacctaggatatattacattattaaaacaactttgaaaggaggcaccatgttcgctgtgggggctagaaattcccacattaatcgggaaaaaagaaaaaaaaagaagagtccaagtagaaatacaatttaaaaatagcggaaattcggaatttaaaataagcaatattgaaaagaagtttccatataagaacctgacacgagattaatgaaattcaaaataaaaataaaatacaatccaaaattagaaaaaaaggagagtccaagtagaaatacaatttaaaaattgctgaaatttggaattaaaaataagcgatattgaaagaagtttccattaagaacccaatacgagattaatcaaaattcaaaataaaaataaaataaaatccaaaattacaaaagaaaaggatagtccaagtaggaatacaatttaaaaatagctgaaattcggaattaaaaataaagaatattaaaaaaagagtccatataagaatccaatgcaagattaattaaaactcgaaataaaaataaaaattaaatctgaaattagcaaaaacgaaataaaagaagagttcaggtaggaatacaatttaaaattagctgaaattcggaattaaaaataatcaatattgaagaagaatccatataagaacccaatacgagagtaattaaaattcagaataaaaaaataatatccaaaattataaaaattaaaagagagttcaagtaggaatacaattttgaaacaactaaaatttaaaataaaaaataaaatatattaaaagaacacaatacgatattaattaaattttgaaaaaaaaattctgaaattagaaaaagaaaaataagatttcaattaggaatacaatttataaataattaaaatttttgataaaaataaagactagtgaaagaaaagaccatctaaaacacttgaggagataaattaagtaatatgctgtcacaccccgaagttctttcccaagcctaaattgaatttataattcacctgagaaaataccggtgtaaaagcaagagaaaaccctaataaattaatgcaaataataatcggatttggcatgtggaatttttcttgagttctacatgtcgaaatacactaacaagatttttagtggaattttcaaagctctcgaaataattttaatcaattaaaattgagcacaggcaatatttaaatcctggaaattcctttcttcctttttcttttttctttttccttttcccttagtgggccgccggcccattccccctcatctctccccgcgccttgctgggccggccggaggccacggcctggctcagcctgcgccccttcctctctctcggggtcaccgacaggtggggcccacctgtcgggtcctcccccaacctccagccgctcgccgccgcgcccgcaaccgccgccgcgcccacgtccccgcctcctccgggccacgtcggccacgcccgcgcatgcgccgcgtctcccgcacccacttccccctctctcccgctcgcgcccgcgcccgagatggccgggattcgaatttcgaatcccgcctctctttccacctccacctcccccatgtcggccggcgaatcccgcccctaccggccacgtccgagttccccctcctctatttaagctctgccgccaccccctctctctttttccccatctcgccgaactctcccgagctctccatcgctcccgtgccgtgcacccatccgccgccgccgctcccgctactccggccgccgctaggcgccgctagactcgccgccgcaccgcgccgtcgctgccgttgggttcgtgtgatcgaggtccatcccgtccgcacctcctccatcgaggtccgtcgccggaacccgcatcccctcgcactccagtgagcaccacctacaccgccgccttcggccatggtttccgatcgccgtggtccacccctctccctctaatctctctcttttcctctcttatggcatctcggagctcgtccgtccgtcgccaccgttgtcctcccgtggctcgtcgtcgctgttcgccgtcgtcctcctccgcgccggccactctcggtgaggcatccctcctcctctattcccctccctctccttcctagccgcgccgggtcgagccgccgccccggtcatgcgccgccgcctttgcgccaccgtctcccgccgccggttgccgtcaccggcaacgcgcgcgcgccgccgcccttgccatggccggccggccggctttgtgccgagccgagccgagccaggacgccgccgcaccgtccgatcggccccgggccgatccgggtcgtcgatcccgtggaccacccgcgtggtcccagtccatggtagactgaccacccgtgcgccgctgccatgtggggcccgcttgtcggcgccaccccctctctctctccgggatttatttattgcgcaataaatcaattaaggatttttccgtttatagtaaaaacatagtgaatcttctaaaattcataactaattcatctgtgctccgtttaagcccattcaagtctgagtaaatcaagaaaaatgtgtagaatccattaaaaatggttttgttatctgtttcagtagtcttatagcctgtttgtattgtttgccttgtatgtcgcttagattttggttcttccgacactccggtgtacttcgagatagtcgccgaggttcctccagcagcagagcaaggcaagtcatgcctgtcacttgaacatgttgatcctatattgcaaatgctctattgtttttcttcaaatactgcattgttttataatgttactatgggatgtttacctatcgttacagccatgctatttcgtaccatgttcctttgttagcttgggatataacatgactagagattggacttggaattgcttagccatgcttagttcaactagcacacaatgagggagatcctattaatgtttagactgtaggttctaatggtaatgttggattagtgccaccgttctggtgctgtttaattaaaatatattaaatggtgggctgtgggtgcatggtgttgctagtcgcgcccatggcacttaaggaccggttcgcgggaaaccctagaagaattcctcgtacttaccacaagccagcgtggtcaacggctgggcttgtagtgtagctttcctctagctgacgcatccaggcaagggtgggcgtgatggagcggggcgggccttgcgacggcctctgtcgcttccagattcacctaggcacgagaggggactgcccgtcgaccgctggggacgggggtgaaacctgaggtgtggtgtgcttggttagagggggtcatgcgaagggtcctgtcacggcctctttccggtatgtcgtggtggcatgtcggcgcacggaaacgtgtcgtggggctgtgtcttgtgggtacagttgtacgcctctgatcagagtaaaactattcgaatagccgtgcccgcggttatgggcggtcaaccagattcaccgtgattagtctcaccctagtgtagtctaatgaaattggatagtttaggtggatggttgggcctgttgcaacgtgggatagcgttggacagtggatgattaatattaattaattactacaactgtttacttctttcaacttctgtttataaatgctcgctttatgcaaatgaaccactctagttctcctttgataattctctgcatcatatccctattccggtatgacttgctgagtacagtgggtagtactcagtcttgctctattttccccaaccctagagtacgagtatgtgtcagatggtggtttctctgaggagtaggcttcatccgtgccgtcgaggatgcctgtggagtggtgttcccgctgcagatcgagtcaaggcttagctccagttatcttttgttttccgctgcatttatgtatgactctttatgatgtttgtaagacgtggatctgaatgtcaacattgtcgtttgtgtaccccggctggtcctggacggggattttaatgcacattctgcttgggattccattcgggaatttctgggcgtgacatatgcctataaagtagtaaagtggtggcgattgatacgacttataaaaactgttaataaaacaccatatagaatcctaatgacgattaaaaggagggatgacaggccgcccgtgaagcaaacgggtaaggtgattgccgggacttctagaaagtaaaaaaaataaaccccatcgataatcatattcgatttttaaaatctcaatgacaataaacaggagaagcagcgggcgggtgtataggactatagttgcagagccgccgccggttgacgggacttctagaaaataaaaaatgaattccaacgacagttatgttcgatttttagaatcacaatgacaataaaaagtaggcggcggacaggccgtagaggagcatagtggcatcatttgacggaacttctaaaaattataaaaaataaaacccaacaagacaataaactctaaaactacaaggtccaatttttaaaggttcggaacttctaaaaagtaaaaaaacaatgataatcatattcgattttaaaatcttaatgacaataaagaagagaggcagcgggcaagctgtagagaagtacaatggcaaagccgctgacgatttggtgggacttccagaaagtaaaaatgaacccaatcgataattatgttcaatttttaaaatctcaatgacaatagagaaaagagacagtggacgggccgtagaagtgtataatggcaacatttgacgagacatctggaaattataaaaacgaaacccaacatgacaataaactctaaaaactataagatccaatttttaaaggtcccaagaagaatgaatagaaatagtggtagatcgagcaagcaaataaagaataaagaaggagatgacataagggataacaactggtgtgacttttaaaaacatataattagaaacacagggaggataaggtttggtatttcatcaaagtcttaagacaatgagatagctatttaataatttttaagtaaaatcatactaaaaaatatatgattttgttggggtgctagccgcgtaattgcgcgggccacccagctagttaaacatatatatccatgatgatcgttgctgcggcagtgctaatttagctgtctcttgcaaacgccattcattttttttctgttttgtccatgttgatgcatcttaagcacgatatcaaaagatcgtactagctgcttagttattttggtaggttcattccgattacacgttggacatcaaaaggtagcaccgtcatcatcccatacgtacgcgcaccaggttgtccggttcatgccatttgttcatgtccgttgctaagaatgtgcaatcttcagaaatagcaccaaacgcgctcagtttgaacgcatatcttggtagatatacatgcatacagctagcacacgaatggcctaagttcgtacacgacgcaccgtgccgctcgtgtggagacggcgccgcgaccaaatccccatccacccatcgaatccacgtacgacttccattcgcatcgcccgtcaagaaaggaggatgcgtgtatctcccgcttccacagtgcacacacgaccgaaagccgtgcatatccatctcgatcgatctccctttcaccgcggcgcggccggccggcgcggtagctagccgccgaatcaagaggagcccgttcgtcgcgtccggcgagctaagcacgccatcgcagtgccgccacgtacgcgctcacggagagagaaaaaaaacggctgcaatgccgatggcaacgctgatatttccgctctcgattcggtcaagccaaattgccaaatacagacatggccaacctccccacaactctaaaaacatcaccgtaaaaggaggagcatagacaccggcccgatggataggcctgcccctaagtgacagggaataaactaaaaatccagagacttttcgacagcttcgtgacttgtctgtgtggtctagctgagctgggagatgtgatctggttttgggcctaattaacgacgatatgtgctatggctgcctaggcatatgctacgtcgaccacgtcccagtcggtcggcgctcggtggccggctcccattggcgccctcccgagattgccggagcttgtgccccggccggccgtggatgttaccggccgttcggcgcacgacgcgacgtgtggaactgaatcttgcgtgcctgcgaggacccggctcgcccggccagaccggcggcgagggcgccaccacataggtggtcgctgaatgctggtaagaactaaaagtgatcgagagcgacgtcggtcgcgtgcagaatcacggcgatcagggttcgtcttggcttcgtctacgtacagctgccgtaaatcctagatgcaaggatatcatccgatcgatcaacgaaactgcggccgatcaattgaaagccatgcatacatttaatttcgttgtttgcgtgcataggaacatgcagcgttgtatggatggagtagttgcatggctagctctctctgacatcctacatgattgggcagattcgatcgatcgagatgatctatgtcactgttacacagtgcagtaccaaagatcacgtaaatatcaccgcacgcgatcgatcgatggcgccaaatgaacagttaattaattgcagatgagatgatataatgtggccaccaaaccttggcggatttaatattcatcgtatcacgccgcctggataacgatatcctcattggcatggtctgaaaattctgaatttgacagccaaaatgcatatagccaagaacgcaaaagctgtgaggtatgggggaggagaagaaaagcagtgatggacagcacgtcagataagtagataaccactccgaccgaagaatccaacaaaacaaaaaccgggtcgaatccggaaaaggacactgttctgatcgatcgaatccttgttgccggcggcgttgcgcagcacaggatcaggcgatcagcggcgttttctagaaatccatctgcgtggctacactatacagctcagtttagctattgctccctttctcaccaaagttcaatttcttcttcttttctgtttacggtccacagtgccccagaatttttccacggtccagaaaattgctgcacgtacaggagtagagtagtaggtgagttgttgctctgtcgcgaccacatttccatggcattgctactttgctatagctgcatcgtaagcttgcactagaacattactgccaatctgccatgtgccaagaggccaagacgaataggcactggccggggtggtaggcttccccacgtatagcaaaagccaggccacattgcgggttggaacttgtgctcgttttgatccggacgtggagtcgccatcgcagaggatcccgaggaggatgccgcgaagatccgcgtgcgtctgacacagattgtcccggcctcgccgtggcgccccgtgttcgttcaatcattctgacgctcttggtggccgacgcaccactgcttcaacctgctccgttgctgcaggcagtgccctgtgaaggaggccagaataccggttgctgatgcgtgaaatgatttgcgaggtttttgtgtgtttgcattttgcagggaaaaggattagggcatttggtggtgactggtgtgatccaatgagtacgttggggggaatcagatgacggatcggttgtgtgttcctgcttttgacggccaaagtggttggtatagaaaggacgggggtgatagggaatcagggatccagcacttaccaagtagctagcgatggcatgcagtaagaacatgccatttggttatctacggtcaggagcgaggtatggcttgcgccaccctcgccctacgagtcctccatcactgacatatttggactgaaattaactgagtgaaatgcaattttcattcattgatactgctcgtctaaaccgatatgacgctagataagcaaggataaaacaactaatatgtttagactgtaaggagtgaaaagtaattttcattctttacctctagtctaaactgatatgtgccgtctactcttatgagaaaacgttgaataactaaggaaacttgatatctttttttatgctggacaaacaaagagaggtttggattgaaaggactgaaaatgcttttttttttacctctttacctctagagtaaattgatgtgccctcttcctttctaagaaaatgttgggcaataaagaaaaaaacttgatattattttcttcatgctggacaaccaaggagaaacttggtatcatcctaatgacaaaattggtgtcatgcactctcaagtaattaagaaaaaaaatgagtgtcgaaagccaaacattgcaccatgaagttataaggtcacacaaccctactaggggtggataatgatatcatctagtttggatcgttatctttgcaagatatcttggcttgtttcgttaaccttaacaagctaaatgtctagctcggcttaaatcacaggctgactcattaaactcgttaggctagcttgtttacgagctttatctaatttaataaatccatgccaccctgctagtataggtgtttagcctcggtccagttatgatataagaccattcattcacacattcatattgttttgagcacctgcactattgcatcgaacaaggagtagttgaatcgtcagccctattaagcgcctatcgagcgaatggatatcctctattgtaatgcacatgcagtatatgtcattgacatgtgggcccgaagcatgtgagacccacatgtcagtgacatctactggaggtgcactacagcagatgatttgcgctgctaccgagccgctagtaagttcatctcaattatagtttaaaaaacttaaccagaccgatggttcaatcgtgaaatttaaaccaaaatcagtgcttgccttggtccagttgtgctctactaccgttcatgcattcattgagcgcctatacggctataccattgtgtcgtacctaatacaattgaaccatctgcactatttatcatagtatgagcgtctgtactattggcgttgtacctagagcgattgaaccatttgcactattgaatgggccagtaggaaagcacaacatgcatccaacatatttttaaggctagttgtgtccatgctagaaggttgtaatagttagtgaaccccagtccaaccaattagttcaccgattgaaccactagaacaatgaaccaatatatcgactggatcactcatcagtcggtttaaacttttattttccagaggcaatccggtttgaacttatcctcttcttggttgtgttcttctctcaactttcccaaactactaaatggtgtgttttcaaaaaatttctatataaaagttgtatttaaaaattatattaatcaatttttaaatctttttagtaatacttaaattaattatacgctaattcttagtttgatttttcgtgtcagaggtaaggttgggaactcagccttagccttattctagatgcggattctctttattgaggcggacgggaaaggaagcccactaccgaaacaacgcaacttttgatctgggcctaattccagaacatatctgggcctaactcccgtcagaagcggtgatcaaattaggatctgcggctcattttttagctcaatacaactagcacaatttcccatgagtaacgaattctacagataaggtacatttcatgggcctgcgggcctagctacgtacgtctaagttgcaccctcagggctgtcgagaaatacagtgccacacgtcgagcaataacttaatttgtttttttgtttgttttttttccccggagagcaataactttgtgtaaatccggttatatcgaattcaagtcctcgatcagaaacatgacgccacttatattcggataagagccaacgagtctgttggtaattttttgtgacaagtcgacaagcacgatcgcaacacctaaacgccttgcggtgatatgtagtcgccaaccacctcgatctagccaaagggccaatgaaccggccttgtcccttaaataggggttggtcttgccctctacagacccttctccacgtccaattcaggatagaaaccaaaggagacacgaaacatgtcttcccgagcaaggaaacccgtcactttccaaactttggcaattttccactattttgttcataggtgtcaaatttgggtgtaaacagagtcatcacaaacgggtagacgccagccgtgtagaaacgaaacagctgggtatacgtaacatagagctaattctgagctcgatcgacccatgcatcgccgtttgatctacccgcgtacgattcacggccgttcgattggatgccccacccccatatagccgaccctatcatagtttctgtagccggtcagagcaaggaagcatgcagaagctcgaccatgcatccgcgaactaggacaagcattacgtgtcggctggatctgtacatggatcagatgctattgaatggcaacggtatatatgatgtgcatcacattggaacgaagggagaaacctgcattgtttttttatcaagcacggctgcacatatattgacaacgaaggagtagataaacctgacgacggtcaatggatcggatggacttgcgcagcaggcccaaggccgatataagagacggcttaatttgctttcgttttggatgagaccaagcagtttcatgctggagaagcccagctccaatggggcaatccggaactctttatccagtccgctcttcgtcatctccaacatacgagctaggtacaatgcaaactgcctaatgttctattcattttctgatctgagcgatctatatatatgacaagtctgaaaatccacatacgtacgtacgcgcgcgtggacgatcgatggacttatccacgcaaaaatgagattgaggtttgcaattttgcatgcatgcatgcacgcgtcgttacgtcggtactactactacatattgcccagatctttccaacgtacgtgcggcagccttcgttgactcctattatttgtttcattgtttggtgtacgtgtctgtgttgcaatgcattatatacggatttgcatgcagttgatcgccggcgggcggcggcgagatcaggctgaatggtgaacccaaccgccccaacgacaggccgccaccgtagtatatatgtccgtattgtttgattactccctccatactcaataaagaaagtcatttaggagaacgatacggtctccaaaacataactttacttcttatttctataaaaatatttattaaaaagtgatatatgtatatttttataaaagtatttttcaagacaaatctatacatatactttttatatttttaaactcaataatttgagatttatttatgatttatatttttaaggtttaatttaaatattgttttaaacgattttctttacgagtatggagggagtatacgatacgtaggtgcgggcgaaacattgagggagagggcaagctgtgcctgtgcgtacgtcctcagcatgtaggcagactactgtgtacgtgttctcgttgtccgcgtggctagctagacgtccgccattcaccgcttctcgacctcgatccccacctgcatttactccgaatgattcagggatcggtacacgcagctagctagtctagtacacaagcctggaaagaacacagtagctagctagccgcttgggtaccatggtgtaaatcagaatgaattattagcatataattaattaagtattagtttaaaaaatttaaaaatatatgttaatacgatttttcgaagtagcttttctataaaaactttttgcaaaaaatacaccgtttaatagtttccaaacatgcgtacggaaaacgagcaggtaaagttggaaaagtgtttcaaagaacacacaaacttaaggccttgtttagttcccacacaaagaaatttactgtcacgccatgaactagccccgagcggaactagcccgtgacgctccaaattaacctgttaatcgataccagtcccaggaaacagtgctggtatcacaggaagacagtatatcacagcaacagaggtctctttattatagagtaggagtacagtcatgttgggctgcggacagatcccgagctcacaactacattacaaaagggaaagcggaagccaagacttggaccaaacatcacaggcgcgacttgggaactaggcagaaaccctaaaactcatcgtagccgacttgctcctggaagaactcctcgtcagcgggatccgcttcatcttcttcagcaactgggggggggaattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggataagacagtgcgtctcgtccgatcggagtatgtgcaaggtatcagtcttttgaattgatcaaggttggcatccggccaacagctttcaaacggccacccgggcctggctgatcccatcagccgcagattttccaaacatcgaacccaatccacaacagcaaatttcacaaagcagtagtcaaacaaaactacgctaggaatcacctcacatccgcccatgaccgtgggcacgactgttcgaacagtttaataacctctgcagagggggtacactttacccacacaacattactgacccgaatcacccagcccgtgcagaacggccacgtctggtgacctaaaggttttcatgacaaggcatttcgaaagccgacacagggttgccatatgccgacgagaggggttccagaccaacaacaggttaggtcccagaccatactgtgccaggaagcccgggggttctccccgacaccaccctgttgaatccacatgtctctcggcatcaaggctcccccgcttagcaatttactcagccaggggtgtcccattccatccatgtggtcgcacttgtcttatgttcggatgaaattccaaggaaacggtccttaagtgcaagagcgggaaaccgtacacccggtacgttccccggtccgcgattttagaaattcatttagttcgcgagcaccgacctagatgtcgggttttccaagtcttttgtaaaacccaagttttacccaagatgtttctcagattttaagtttgaaggcgaccgtcgatactcgtgcagagtgcacgattaccgaggcgcaactaggtggttacaagggaacatggtataacaattaacaaaggaataatcagatgcaataagttaggtaggcccaccggtctgccttgcagacggagcaaacagattaagtgcaatcctatcaatgcataatattttgcaagcaatataattaagttcaaatataggctcaatattttcaaaggtggcttgccttgctcgagatcttgagcttgatcctcgaaatcctcgcactgcgagtcttcgggctccgaaactacacgtgaaacgggacaactcaacaaacggcgaaaataaagccctattattgacctctaagtgggccattagatagatctcgagatttgaggaattttggaagttgaatggagtcaaacggtcttacggttgggaagatattgaatttctaagatttttggatttttggtctaaaggaaaagggatttatttaaatcctttttgaaaagaaaagaaaagaaaagaaggagggaggggaattagacttccctcgggaggctatggcgcggcccgagggaaaggggcggctcgggcgagcttaatgggccggccagcccagcaaggcggcccaaggcgcgcgcgggcggggaggagagagagagagagccggtgggccaggtccatcccgcgtggtcccaagtgggacccgcttgtcaacgactcggctcaccgtgagcgaggtgcacgcggggcgtgctagggtttggggaggggggcgtggcgcacgcacgcggctcgcgggggacgcgggtgcggcgggcccacgcgcagcctcgcggctcaccgtggaccacgcacacggggagggcagaggggagcggcggaccggggtcggctcgacccggtcgcggccgaggtggcaccgaaatggcgtgttcgtggcagccacgtgggccggcgagaggaagacgaaggcgccagccgcgaatggacggtgggcggcggcggtttctccgggacgccgtgcgacgacgaggggcgacggggtgtacaccggaatgacaaggggggacgagagggagcgggccaacggcttggattcgtcggaggatgctcaacggcggcgaattgcggtggcggcaaccggcggcgtgaaaagggggaaacggcgacgaggtcacgaggggctgattcccggcggtgagagcatctacacggctacagaaatccatcccttgagccggattaggggggaaacgcaccgagggaggctggcgacgagaggcgcttcagagctcgggcggcgacggtggcgagcacacggcgagcgacggcagcagtcggggcggcgcgagctagctactggggtactacacacactactaactgagtctaatgggaggagatggatcgaggagggagaacgggggaatgcactaccgagacgaggcggggcgctgtgacgagaggccgacggcacgggagtgatctctccggcctcgggccggggaagaggaagaagagggcgcgcccgaagtccccttccgcgtcctcgttcgtgccggctcctctgacacgcgcgacgacaaacggcgacggcgaacagagcacgggaggcggcgacaatggagtggaggcgatgggacaacgagaggagaagagagggagggcgcctgggctttataggatggcaatgtcagtttgggaaccgacctagggcggtcaaaggagagggctagcgctcggcggtcgcggccaaaacgccgacagggagggatgacaccggcaggagagaaaagggaaaaaggaggagagaaagggggcttgcccccttgccactttggggaaaaggaggagggagagagggcgacgcggcagagggaggaggagctctgcctctgtcccttggaggctagcgcgcggagtggcggggtcgggttgatgacgacggcgatgacggccgggcggtgtggagcggagcagcgacacgggcggcaggcgcggcagaggctgacggcggcggcgaccaggcggtcggccaccacggcgtgcgcgcgcgggaagcaacgggcggcgcggctcaggcacgcgtgctggctcgcggggccgagcggctgcgcggtagggcaacggggccgggcggcgcagacggcacaggcgcggcacgggcggcgaccacgcgggcgcgcgcgcgcgaacaacggcgcgcgggggccgatttcgcgggcggggagctcgccagggatggaggcggggagagggagagcgagggggggcgctcggcgcggctctcgcgcacgcgcgggcagagcgagggagagagggagagatggggagggagggagagatgggccgagaggaattcggcccatcgaacccgagggaggcaaaatagacttttgcggagggatttgatttgggaaggatttggattcgggattgatcttgacgatagatcggggattgagatccggaaaggcacggagactgacagcaagcgaagaaacaattttcgcaattagggtttttaggaaatacaatttcccgctaggcgccacgacggaacgggcgctacatttacactatatcacatcgaacatttgaacacctgcatgaagttaaatatagactaaaaatataactaattgcatagattgcgactaatttgcgagacgaatattttaagcccaattgcttcatgatttgacaatgtggtgctacattaacttttgctaatgacggattagttaggattaataaattcgtctcgttgtttactgacggattctgtaattagttttcttattagtacccgaacacaccatgcgacaccctatataacacccgatgtgacacgtcaaaactttacacccctgtatctaaacacccgctaatttagtagccccaacatcttcagcttttctaggttctcgctagctagttactcaccgactatttgttagaatccttccctagctacgatctctgtgtgacacttgcctagcagttgatatatgttttctgggatttgaaaaatgtcaaccgcgcaaaatgtcaagcactgttgaagcaggaatatacatgcctagggggaaaaaggagaaattttagaaaattcatgcaaaagtcccgaagctttttttttctaaaagaatgtataattttgggggaacgaaaattgaaatcttcaaaattttgtgaagcgccaacaatgtggtggttagggtgggacattcggtcagaccaactatccaatctttgttctcaatcttttgagaaatttcggtaatctaaaaagtaaaagatcgaattaactaattcgttatcggtatccaatatgaccgaaatttcaaaagagatccaaaaccgcacaaatccagaaattcacgcaaatccaaaaaaatcacacaaattgccattggagtagatgatccgaggaggtagacagagagtacgtaggctgtcagcgcagcgaccattggcggcggcggcggcggtgcccatgacccaaccctcaccgtgcgccgcttagcattggccagtgtggtggcgtaacatggaggaggagctgtaggcggctcggcacgctggtcatggccatgggcggcgaagtgggagatcgatcatttcaagtaagaatctatagcaaggcaaggatatactcacttgaaatgatatgtgagttaggtttgcatatatacatcctataggatcgaacacaagcaaccaacccaaaaacttttagcggaaataaaagttacccttaaattgatggaaatctcgacgtagttttatcgccgccggtcggaccgctcggacgccgccggttagaccgccggtatgtcgtcggttagaccaccgaacccgataaaacataaatcgaagaactctcaaaatagatgacaactttattgcttctctgtgtttacaaagtgcaacaacagcactccttacaaaaatctcgactaaactcgaaaccctaactaaactatcaactccatgctctgaaaagcgatacagggaagtcacacgctccctctctatttataccaaaaaacctcctacttaaagtaggagtagaactcctagttccaaaacctgcagccacaccggccacagacaagtcggactctcctcgccgtcacagcagcgacacgtcctcctgttctcctgagccgactcggcttgccatagccccgagccaacctatcagatcaacacaaatgcatgcagccacatgcacgtgtacatgcatccacatacacgcatacacgccactgtgtacacatatatgcacaatacagtaacaccgctacagtacctcgagtactgtagcaaccatataatactccacaattttcctccgcgaacaccgacgcttgcacgcacacctcgtgaagcccgctgcgaagatctcttccacacgatgtccatccatcatgtaccatctcatatccaacttcgtcacccggtatccttaaccgtctggaccttaactcctccctgagtctagtcccgatccccaccgttgaccgaagttgaccttcaagaatcctgactttagtcaccttctcacatggtatcccgaccacactagacatctgttcctccctgaacatagtctcggtcctcaccattaaccaaggctgacctcaagtcacctgcacacaatcagacaaaacaaccgtttctgagcacaaatatcacaacctgacccacattagtcacacgcacacacaccaacatccacacatcttttcaaaccaattcatcgaataaatcatttgtaaagccaattgttcatcacaaatattaatcatgacaatgatttcacaattggtatcagagccaggctaggttaacatctctggcccgatggacatgtgtgaaggcctgatgaaccgtgggtgcctgcggggcccgtatacctgatggaccgtgggccggtgggggcccggatacagtgaaagggcggtgaagggctgagggacactaatgtgtgaaggaggagattgttgaatagtcccacattggttgtagaagggcaaatgacctaagatataagtggggagcccctcatctcaatggctagtttctgaggtgggaaaggccctttacgacttctgtataaccgtgaaagaaaatctcaggattttaagaattctgttccgaaattctgagtcgttggtctccatctgtgtttgagtggatatgtgaatgaggtttgcatacatcctgtgttagcttctgtataaccgtgaaagaaaatctcaggattttaagaattatgttccgaaattctgaaccatgcatgctgacaggtttggcatgcccctatggcggcgaaattaagacagtgttgcgcgcccttatccgtttgattcgagccaatccagaaaaccaggagcatcccggccgtctatccccgcactactataaatacttgcccggagacgatttcttctccacgcagcaagagccgatcgatcattgtccaagtctccaagcgatcagctagctgacttgacgacgctgcgagcagcggcagcaagagagcagcagcacaaagggttcccctttcacaagtgtccggccggctgcacgtaggccatggggaagcaaatggccgccctgtgtggctttctcctcgtggcgttgctctggctcacgcccgacgtcgcgcacgcgcagacgcagatcctcttccaggtgctttattcatttcacccataaacgggcaagggggttcacctgtgtaaaattatcgacagcaagtcagaacggctaatataattcacgtacaaccgaatacgtgtctgtaacatttttgtgcagggttttaactgggactcgtggaagaagcagggtggttggtacaacatgctcaaggaccaggtgggcgacatcgccagcgccggcgtcacgcacgtctggctcccacctcccacgcactccgtctcgcctcaaggccagcaagccatgcatctccttcatctcgttacgcttctctttgtagcatgtccgtttctaaatatttgacaccattgactttttagcatatgtttaaccgtttactttatttaaatttttttgtgaaatatgtaacactatatgtatacatataagtatatttaacaataaattaaatgataggaaaagaattaataattatttaaattttttaaataagatgaacggtcgaacatatttaaaaatataacggtatgaaatatttagaaagggagggagtatattacgtgacgtaaagtgtgttacggccagtgtcttactgcaattatcagctgatctagctcatcaggcaattgacatgtatgcatgcatgtgtttaaatcgatttttcccgtgcatgcacgcaggctacatgccgggacggctctacgacctgaacgcgtccaagtacggcaccaaggcggagctcaagtcgctcatcgccgccttccacgccaagggcatcaagtgcgtcgcggacatcgtcgtcaaccaccgctgcgccgacgacaaggacggccgcggcgtctactgcatcttcaagggcggcggcccgcgcggctgcctggactggggcccctccatgatctgctgcgacgacacgcagtactccgacggcacgggccaccgcgacaccggcgccgacttcgccgcggcgcccgatatcgaccacctcaacccgctcgtccagcgggagctctccgactggctcaggtggctcaggagggatgtcggcttcgacggctggcgcctcgacttcgccaagggctactcggcggccgtcgccaggacgtatgtccagaacgccaggccgagcttcgtcgtggcggagatatggaactccctgagctacgacggcgacgggaagccggcggccaaccaggacggccagcggcaggagctcgtgaactgggtgaagcaggttggcggcccggcgacggcgttcgacttcacgaccaagggcatcctgcagtcggcggtgcagggcgagctgtggcggatgcgggacaaggacggcaaggcgccgggcatgataggctggtatcccgagaagg

SEQ ID NO: 47203 - DNA, 37317 bp, Oryza sativa
  unsure (1)..(37317): unsure at all n locations
acaattttgttttgtgttgtttagttctacgaccacgtgttcgactggaacctcaagcaagagatcaacgcgctggcggcgacgaggaagcgcaacgggataaacgccgggagcaagctgcgcgtcctggcggcggagagcgacatgtacgtggcgatggtcgacgagagggtcatcaccaagatcgggccgagaatagacgtgggcaacataatcccgtcggacttccacatcgtggctcatggcaatgactactgcgtctgggagaagagcggccttagagtcccagaaccagaaggtcggcgctagaaacggctcgcaagctagctacacagttcttaataacttggtcgcaaaaaaaaagttcttaataatttgtacgagaaatgttcgtttctgtttgcatatatagcttatgaaatcttaccaatatatactgctctgttttctatagttcatcccggaaatttgaacttgcaagcccaaattttgaatatatcttttgctagaaaactttcttactccaaatttttaacatacaagtaaaaaatacaatagaatattctctatgattacttaaattggaccttattgatggtaagatacttaattagttgcgttcgtttgggcttatcggacgagctacttcatcgttcatcattagcactctttcaaatgttaaatagtatatttttgaaaaaatatacataattatttgaaatatataataaatccatttttaagtttacaatagctaatacttaattaattatatactaatgatatttcttattttacgtacggcttataagctcacttaagacttactccctccgtttcataatgttaagtcattctagcattgctagaatatatatgtctagattcatcaacatctatatgaatgtgggcaatactagaatgacttacattataaaacaaaggaagtagttcaaacgaatccttagtccatgttcttttcagctccttcactaagttatttctatgcattatttgttcctctaaaagtacgatttctcgttaaaaaaatctatctaccgtatatttattaagtttatttaccacaatattcaagttatatctataaccatgcagataatccaatacaataacttttttgaaactaggctatagtgaaggctgcatcactgcatgggctagcttctcataaaaaaggaaaagaaaaaggaagaaggctacatgagcccagtcaagagcaggaactatatggacttatcgtcagggataagggctgcataactaatgggccacggcccttccagaaggaataagttcattttgatttccctaactagtggttgaatttgattcgaattcctaaaccacaataccgaatatcttaacccacaattattaaaaccggtacaatttgattcccttagtggttttggtgggttgtttcgctgatgttgcgctgacgtgacagtgttgacgtggtgttgatatggcgcttatgtggcattagaattaaaaaaatggaatccatttatcattcacataaaaaaatattttggacccactaacataagggcccacatccacatgtcatcctctcacttttccttctttctccctttctctcactggcgtgccacatcaaatttttttagatggcaatgtatttaatgctatggacacctaatttttttttcttattctcattgccatttatctatttcttataatattccttaaaaaaatgtgaaatttgaaacctctaagttgaagcctgcatgaatttatgtagaaattagaacccgtgggttggctcatgaaaagccatatggacggaaatagagagagaaagtgacatggacaaggaagagaaagagtggggaagaaggatgctttgatattagagaatgcttcgatactataggataggtgcactttcgctctataatctagaagccatggtccctctaaatataagttcttcacgtggttggtactgcaaaataggctttggaaaaccgaccaagtacaacggtgaggataacccaaccaaagaatttgcccactatgttgaacttgcaacgagacagctatatacctcatagcacactgccaagtcacaaagagaatctcgggagccatagcaaggtgggcacagatcaacctacaaatggagcaatgaaacaccatagatatggtggaaaacttggtgggcaaccttagcccacactaccggaatattgaagaacacgctccggtcactcattctcctagtcagttgggaaatatggaaaaagaggaatgcttatgcatgtgttccaggcttccaacgcatcacattaacgcctactatcattatagcaaaaataaagtaggaggccagagacatacacccggacctactctcataacattgttatctctctaagtttttttttttgcccccaacagtcctaccaagcaaatcctgctaacacctataggtaaactcatttctcctcctttattaatgaaaagaggccatcctcatgtcctcttattcgaaaaaaaggttgataggtgctataatcacaggaagggtctaaggaggtgaaaatgctaacgggcgatcgaccatgcacgtgcaatccgtgtgatagggtcggtccgtacctttttttttttggctcacatggttttcagcttttcattttctaacaaatctttttatgggcttatgatcatctagttttccctttttaagctggcataggcaacttgttttttaatttgtttgaagtgtatatacaaaatcgtatatgtatacaattctattatatatatatatatatataaagtttatgtgtatataatgtttctatgcataatttttttataggggtagacaaacacactacttcaacttgtttgaaacttgtatatacaaaattttgtatgtttgaacaaagtctttatgtacaaagctttgtttgtcggtggcgtcgggtgtgggttggacttggcaatgctctcgagatccgagtgtgacgaggcggacgagtacattggcgtcggcaccaggatggtggtctccgtcgcagccaacgcgcctcggacaatcgggaatacagacaagcctagactgcttgctgcgcgcgccgacacggacatggaccaccctgacgtggattgcgaaagagaaagaggagatgatgacgtacgtggtcacctgacgtatggggcctacgtgggtcccacgctgagtcaactgccacgtcagacaaaactggagtcaaaaccgccgagggacgtagtttgcattggttttgtaagttgatggatgcattgtatctggctttgcggttgggggacgattttgtaactcgatgacaagttgagggaccttcggtgtactttttcctaatttttttcaatcgggctaacatgttactgggcctaaaaagctgctcgttgggccgttcaaagagaaatatatatgggccgacgctgcttggactcttgtggaaacggaaaaacggatgctaaagagcgcatgtgacatcttatcgtcattttcaagggttaattggatcataccactgctgcaaatgtggactattcacgatatcggccggatgtcactagaattttgagaaattaaatccataccaccccgtcatgttttccatccttcccgtcacactttccgtccttcccgtcgctctttccaggaggctgagggcacggaggctggcgttgtgggcggcagacggcggagccgccgggtcaaggaggcggagcggcggagttgccggcggacggagacgacgggtcgaggaggcggagcggtggagttgccggccggcgtcgtcctccgctcctcgctgccgacccgctcctcacccgctacggcgccgtcgtggtggacgacgcgcacgacgggatggctctcaccggcgtcattctcagttagtcggcccattcatcttgaagaaacagcaaccagtcatatccaatttccatcccagtccgtcgtcccctagctgccggcatgccagccacaagcaaccctcgtcatgctgcatcaaatagcaacctcgtcgtcgatctgcatcatcaagcaacaacagccgtttcggcatctagtggttgacattcacccagcagaagcccggccggatttggcgctggatgcggtgctcgttgaagccgcccgtcacgtacggcgcctcttcccgtccccatcgcatcgctcatcctcaccgtctcctcgtcctcatcgtcaattgcggtaacctcatccaagtcatcgcccgtcgtggcccatcgtctacaagcagcaacaagccagcttcattccggcggtggcggcgggctgaaccacggtggccgtggctttgtgctgctgatgctgcgccgcaagctgctctcaaccacgcgtcccctcccatggaactcgtcgacagactgcaggcacttggccgtgtcctcctcggcagacggcagaccaggcacttggtcgaggtcctcgagtccgcaaaaacgcgcgtgccggtcttgacggcggcgccgcggcggagtgggccggcgcgggacgagttgaggaggccgaagtcgaggccagagaccatcccccgagaggcgctggtcgtcgagttcggcggtgctttcaacggcgaagtagaaagacggcacgtagttaggaaattaacgggggaaggacggaacatgcgacggggtggtatggatccaatttaccaaaattttagtggcacctagccgatatcacgaatagtaatagcgttttattaatttgccacatttgcagtggcatggatgcaattaaccccattttcaatcgcgcgtccctcaagcggtaaaacaggactccgtaggtagtcaaacggcctggaaactaaccagtgcagaatcgcaggataccataacctgaataaatcatacacacaaaccggaaaaaagaataaagaaagaaagaggataaatggtagccaatttgtgttagggcgcagcagccagagccgaaagcttctgaagctgatgcgatcaaacctcaaaagaccatgggcagccagcacggaagttacaaaccgaagccgcgcggcgcgcatacgcatcagaaaggcgcgcaataacggaccacccatacggcggccgcgctctgttcgcggcgtccctgcgcctgcatcgcacgccatccaaggctgcatagcacgacgcatacatatctcacgcgccctttttatctgcttataaatgagatagcccacatagcagcgctgccgtttctcctcttctctcgttgggggcaaccgaacttatccaacaacgatccatccattggccaagtggctgccgtgctgcacctataaattcacatgcaccggcatgccactccacacaactcagctactcgaaagaagcagcaatggcaaagcgcatagcctcaatgagcagcctcctccttatcgccttgctctgtctgagctctcacttggcccaagcccaggtcctcttccaggtaagcatcctgtagtacaatgtcacattacataaaaaaaaatgacttgcgtttgacatgactgttcttggtgtaggggttcaactgggagtcgtggaagaagcagggcgggtggtacaacttcctccatggccacgtcgacgacatcgccgcgaccggtgtcacgcacgtctggctcccaccgccgtcgcactccgtcgccccgcagggatacatgccgggccggctctacgacctggacgcttccaagtacggcacgggggcagagctcaggtcgctgatcgccgccttccacagcaaaggcatcaagtgcgtcgccgacatcgtcatcaaccaccggtgcgcggattacaaggatagccgtggcatctactgcattttcgagggtggcacgccggacagccgcctcgactggggccccgacatgatctgcagcgacgacacgcagtactccaacggccgcggtcaccgcgacaccggcgcagacttcggcgcggcgcccgacatcgaccacctcaacacgcgtgtgcagacagagctgtccgactggctcaattggctcaagtccgacgtcggcttcgacggctggcgcctcgacttcgccaagggatactcggcggccgtcgccaagacgtacgtcgacaacaccgacccgtccttcgtcgtcgccgagatatggagcaacatgcgttacgacggcaacggtgagccgtcgtggaaccaggacggtgaccggcaggagctggtgaactgggcgcaggccgtcggtggccctgcgtcagcgttcgacttcacgaccaagggcgagctgcaggcggcggtgcaaggtgagctgtggcggatgaaggacggcaacggcaaggcgccggggatgattggctggctgccagagaaggccgtcaccttcatcgacaaccatgacactggctccacacagaactcatggccgttcccctccgacaaggtcatgcagggctacgcctacatcctcacacaccctggagtaccctgcattgtgagtcctcagctgcatgaatacgaatgccataaagaaaaatctaattttctcaaccagtttctccgactaaattctgtttattgactatgtgtgcagttctacgaccatgtatttgactggaacctgaagcaggagatcagcacattagctgcagtgagatcaagaaatgagattcatcccgggagcaagctgaaaatccttgctgctgagggagacgtctatgtcgccatgatcgatgataaggtcataacaaagattgggacacggtatgacgtgggcaacttaatcccgtcagacttccatgtcgttgctcacggcaacaattactgcatttgggaaaagagcggtctcagagttcctgcagggcggcaccactattaggcgaagaaaatttttcaggactatttggtgcctggaataagatttgaattatatcctaaataaccagattatgattgtatgagatttcttaatctgagcaaagcgttgagcattgctccgatatttctatgtattctacctgcctggggatatgatatttgtatcctctagaagtaaagatgattttaactcagaagtccattgactttactgctacattttaatcagttgcagcactgtgttgatcaaatgcaaacgttcctgacagcagactcatcactaaactttagggaaattaattaacctgcatactagtccagtgcattgtactccccccgtccaaaaaaaagacaaaccctgagtttccgtgtccaactttgactgtccgtcttatatgaaattttttttataattcgtattttcattgttattagatgataaaacatgataaatattttatacatgacttgttttttttaatttttttcataatttttttaaataagacgaacggttaaacattggacaaaaaacagggtttgtctttttttgacggagagagtataccttacgaagcacctgagcactactactgctgatgctgcttgcattgacctaggaccgacggcctgctgctgtgcgtgcactactacttgcttagctatattgggccacagcccaagccagccagaactctcttttcttctttttttttcccccatttttttcatcagacaattctttttgcgcgttacactaacttaattacctcgttgtgaatttaagaacttttcggacaatgcgcggtaacaatttctaagctttgaaccggtgatacggtagtatcatcagataacctcaatggttcaaaatgctacgacgtgtaaaagtacttaacgagttcttgcatactaatctcgaggccacctagcatttagagatcaagtttgatattgtcactgctatattgaactggaccacccatatataggcgttcgttgtacacgatgtcttgcttcgtgcaatggaacctgatatccggcaggttcttactcactccgtactaaaatataagagatttttaatagataatctttattcagatttatagtactagaaaatgttacattgatctatattttgaggagtatgatagaagaaccataataaccattggttccaccatttattttcaagtgggctagcaaaaataggaatcaataggcgagggcttgaccttgaagttaacagagaaaatattcacgcatgctattgtagcagggacatgcaagattgttagtatctgatattttaggtagtatatttatctaaagtagtaggattatgttatcgggatattatgatattttcttttaaaagtttaatttaatatttatattaattatatagagctgatctagattgataataataaataacataaggatagatttgtcaagaagtacctactaatgctaatagttttatttaacattgatttcgaagatatgaacacaaatgcattcatatagttttgatttttgaattcaaataatgtctagttggaaacagttagtatcttgttcctagagtgattctaatgatactacgctatatatcccgatactagtgtgataccagtcgaaaacgatcctagaatacgtattccgatactgacaaccttggaggcagacaacgcacctcctatccgaccaagacatgacctaagtcattggccgacatgtcccgacttaaagctaatacaagtttcctagtaggtgcccaggattaaaccaagttgcccttgttgggaacatttagagcttgcggtagagtggctagtggtacatgaaagatggagatgaagcttggtgcccacgctaactgaaaggaatattctcttagaatatgctaggagccattccaaccactcttacatcataggaaggtgatctgtgctattatactattagggtttacagtcccacaacggcatcaatctaacttcacatgtacttatcataaattaaagacaccagatactgtagcaatatagattacattttatcgaaaatagtgacaatgagagccatttggagcatatcagattcaccttacaactaggataggtaggaaaaccatctccttgtttatccctattttatttgtgacctcttggatcataacattcaccacgtcgcaccacttgacaatttctatttttcaatccgaacttcattatttttccacgtggatccatgttattatacaaatctaattgatggtttctttcattttaggggctgtttaggttgatgccattttcaaccatactatttttttagcatagttgtcaaaaatatgtctatatttagtttgttgtcaaatctattatataattaaaggaatagaaaaagaagcatccacgttcgctctcatggtctaaaaattctcacattaatcggagaaaaagaaaaggcagagtccatatcgaaatacaatttagaaatagctgaaattcggaattaaaaaataaggaatattagaagaggagactatagtccatatagaaatacaatttagaaatagttgaaattcagaattaaaaaataaggaatattagaagaggagactagagtccatatagaaatacaattagaaaataactgaaattcggaattaaaaataaggaatattagaagaggagaccagagtctatatagaaatacaattagtaaataactgaaattcggaattaaaaataaagaatattagaagtagagtatagagtaaatacaattaggaaataatagaaattcggaattaaaaattaaggaatattagaagtagagtatagagtccatatagaaatacaattaagaaaaaaatagaaattcggaattaaaaaataaggaatattagaagtagggtatagagtccatataggaatttaaaactaactaaaatttggcataaacataataaaattaaaagtatatatagtattaaaggaatagaaaaagtagcctccacgttcgctctcatggcctagaaattctcacattaatcggagaaaaataaaaaacaaagtccatattgcgtaaaatttttgaataagacgaatggtcaaacatgtgagaaaaaatcaacggcgtcatctatttaaaaaacagaggtagtacaatttagaaatagctgaaattcagaattaaaaaataaggaatattagaagaggaaactagagtccatatagaaatacaatttagaaatagctgaaattcggaatcaaaaaataaggaatattagaagaggagactagagtccatatagaaatataattaggaaataactgaaattcggaattaaaaataaggaatattacaagtaaagtatagagttcatatagaaatataattaggaaataatagaaatttagaattaaaataagaaatattagaagtagagtatagagtccatatagaaatacatttaagaaaaaaatagaaattctgaactaaaaaataaggaatattagatgtagaatatataatccatataggaatttaaaactaactaaaatttggaataaacataatacaattaaaagtatatatattattaaaggaatagaaaaaggagcctccacgttcgctctcatggcctagaaattctcacattaatcggagaaaaagaaaaaacagagtccatatagaaatataatttagaaatagctaaaattcggaattaaaaaataagaaataatagaagaggagactagagtccatagagaaatacaattaggaaataactgaaattcagaattaaaaataaggaatattagaagtagagtatagagtctatatagaaatacaattagaaaataatagaaattcgaaattaaaaataaggaatattagaagtagagtatagagtccatatagaaatacaattaggaaataatagaaaatcggaattaaaaaataagaaatattagaagtagagtatagagttcatataggaatttaaaactatctaaaatttgcaataaacataataaaattaaagtagagtttagagtccgtataaaaatacaattagcaaataactaaaattcgaaattaagaaaaacatgggaagaagtgtttaaagtcaatatagaaatacaatttagaagtaactgaaattcgaaattaaaaattaaaaaatattgaaagatgagtttagagttcacatagaaatacaattagaaataataaaaaattcagaaataaaaataaataatattggaagaagagcatagagtctatatagaaatacaatttacagaaaattcagaattaaaaaaaataaatattaaaatacgagtctagagtacatatagtaatatatataattacaaataactaaaatttggtattaaaaataattaataactaacacgtatataaaatataatatgaatattacatattagtagttttgtaaagttattgcaaaatttaaaattatgttgccattttaatatttttgaataatataatgagaaaacatatatgctattatatgagagaaaatataataatgctagccgcgcaatatgcgcggggcaccatgctagttttagtaaatacataagaaatcctgtcaaaattttggcaatattgtcatcttgccatattgccaaaatttaataaggtttattttggctacaatctgaacaagcccttaattttcagtgttagtaattttcattaactaattctagcgaggactcttgttttaatcagaattgccatccttgatttatttacttttttatttaattaacatggaatgtacgagccccatcaactggccaagagctgatttgatgccaaaacatggctcattagcgataaaaaataatttataaatgaaaattttatatatgtgtttttaattagtaacttaaaagctaatgctacaaaagaaatacattaaaaatattctaaaatcaactacagaattatgttttgaatcagattttagcagcggttgattttatataggacaaacaatgaggctctaattccaatcagtaaagctagccgaatggcattcccttgaaaaagaaaacaatgaggctctaattctaggaagtgtccggcaaaagtacgtgtacaacaaggataattaaattcatgatggatggatgaattgtataatgtaatttggataccaaagaagaaaactagcaaacataggaaataaagaaaaaacattaattgcgaaacaaaattcgaattggttttagctagctgcccttaggtggatgtgcgccaacagagacgatcgcatgaaggaaggctgcagcctggaacagcctcgcctcctccagggaacgggaacgggaagaacaaaaggaagctttacctggagcccacaacgctatccaaggctttatctaacttcctattggcctcctttttatcctcttttaaatgagcgcaactcgtcgccgccgtgccgttgcgtttctcgttaggagcaactgaacttatccaacgaattgaacaatcaattcacccggagaggtacgtctgcatgccgggctgcacctataaattcccatgcaccagcattccccatccacacaactcagcttgtatctgagacacgcaatggcaaagcattccaccacaatgagctgcctcctattcttcgtcttgctctgtttgggctctcacttagcccaggctcaggttctctttcaggtgagtctcattgatcatttgatctgctgtacttcccgttagtatgtcacatgacaataggaaatagttcctagctatgaacaaatttgacgtacctgcacgttgacatgatgttggtgcagggattcaactgggagtcatggaagaagcagggtgggtggtacaacttcctccatagccacgtcgacgacatcgccgcgaccggagtcacacacgtctggctcccgccgccgtcgcactccgtcgcgccacagggatacatgccgggacggctctacgacctggacgcgtccaagtacgggacgggggcagagctcaggtcgctgatcgccgccttccacagcaagagcatcaagtgcgtcgccgacatcgtcatcaaccaccggtgcgcggattacaaggatagccgtggcatctactgcatcttcgagggtggcacgccggacagccgcctcgactggggtcccgacatgatctgcagcgacgacacgcagtactccaacggccgcggtcaccgcgatactggcgcagacttcggcgcggcgcccgacatcgaccacctcaacacgcgtgtgcagacagagctctccgactggctcaactggctcaagtccgacgtcggcttcgacggctggcgcctcgacttcgccaagggatactcggcgaccgtcgccaagacgtacgtggacaacaccgacccgtccttcgtcgtcgccgagatatggagcaacatgcgttacgacggcaacggtgagccgtcgtggaaccaggacggtgaccggcaggagttggtgaactgggcgcaggccgtcggtggccctgcatcggcgttcgacttcacgaccaagggcgagctgcaggcagcggtgcaaggtgagctgtggcggatgaaggatggcaacggcaaggcgccggggatgattggctggctgccggagaaggctgtcaccttcatcgacaatcatgacactggctccacacagaactcatggccgttcccctccgacaaggtcatgcagggctacgcctacatcctcacacaccctggagtaccctgcattgtgagtgctcagcttgataatctccatcgctatcagaaatcgatatttgttaaccataatctcgaactaacattccgtctgtctgtacagttctacgaccatgtgtttgactggaacttgaagcaggagatcagcacattggccgcggtgaggtcaagaaatggaattcatcctgggagcaagctgaacatccttgctgctgacggagatgtctacgtcgccatgatcgatgacaaggtgatcacaaagattgggactcggtatgatgtgggcaacttgatcccgtcagacttccatgtcgttgctcacggcaacaattactgcgtctgggaaaagagtggtcttagagttccagcagggcggcgccactaggccaaatatttctttcaggactattttgtgcctgaaataagaagtttaaatgatgtcttaaataacaagaaagtgattgattgattgtatgacagacaaatatttttgtcaggactattttatgcttggaaaagaaatttaaatgatatcctaaatacctggaatatgatagtatgccatttcattcaaacaaattattaaaatttgctctgaccgtctgacgtgtcaagggttcaatgtggagtattattcttgcctcagccctcaggacttttgccccactagctgtgaagtgattttttttttgtttaaattcgcttggtgttagtagtttaccacaacaatctggaaattaccttacctcagcgcagtatgaaaatgtttgtcttctatctatactcttctaaatgaaggcaattgtggtggtggtggtgaaaactcaaaaatattagcagaaaacaacatgttcatcatactgcagatggagcaattgaataatgggtgcgttttctactctaattccatggatcacagtgaaaatagttgggattgactgcacatagcaaaaccgacaaaaatcgcttatcagatcgagagggaaatctgtccaagcgagttgcaaattccttaccgaaccgaaggaagaatcaccgaatcggcccggatggagatctccgctccgcgccgccgccgaaccagtagaggggagaggacggaggagaggagaggacttcgacgcggcgtgcttcggcgccgccggagaagatcgacggtatggcacctagcggcggcggcgccgcggaaaggggattcgtcgccgcggccgaggagagggcaatctggtaattagcgcgagttgacatctccaagagtccagaaacgccgcttcggccttcggataagccacgtcatcaaacaacctgacccggtttgaccttttccggtagactattctacccttggtttgctgccgctgcctctgctggctgctggcgcctccccgctgacctcacgccttaagtcagcatccacacgtcacctcggccccacggcacagcacacactgcccaaatcccctcgacaccacacgttttccacagggctaagcctgaaagaggaaagatcaacgacgacgtggagcatgtcctggcgccgttctgtcgccgtgttactttcgatgttggtctccccctatataagtgcacccgctctcccggcttcagctaacgacctcaagcacactactagctccggctcacttagctccctactgatcactggaacactcatgaccaagaaggtgataccggccatggcggcggcgaggcaggattcttgcaagaccaagcttgatgagcgtgggggtagtcatcaggctccgagctccgcgcggtggatctcgtccgagcaggagcacagcatcatcgtcgcggctctgcggtacgtggtgtccgggtgcaccacgccgccgccggagatcgtcacggtggcgtgcggggaggcgtgtgctctgtgcggcatcgacggctgtctcgggtgcgacttctttggggccgaggcggcggggaacgaggaggcggtaatggcgacggattatgctgctgctgctgctgcggccgcggtggcaggaggatcaggcgggaagagggttaggcggaggaggaagaagaacgtgtaccgcggcgtgcggcatcggccgtgggggaagtgggcagcggagatacgcgacccgcgccgcgcggtgcgcaagtggctcgggacgttcgacaccgccgaggaggccgccagggcgtacgaccgcgccgccctcgagttccgcggcgcgcgcgcgaagctcaacttcccgtgctccgagcctttgcccatgcccagccaaagaaacggcaatggcggcgatgctgtcacggcggcgacgacaacggcagagcagatgactccgactctgtcgccgtgcagcgcggatgccgaggagacgacgacgccggtggattggcagatgggcgcggacgaagccggcagcaaccagctctgggatggcttgcaggacctgatgaagctggatgaagcggacacctggttcccgccattttccggtgcagcgtctagtttttgagctagtgttattagatctcaaccgttggattagattactggaaggccattcatttattcgtttcattgtatagctaattagctatacttcattgtttgtgcagagcacgttttttaggagtaccgtcttatacatatttttttgtacagagtagaaagtaacaagaattttgtatattgatggaatagattatttccaattaatatttgcgcaaaatgtctgcgatgacttgaagctgagttaatttgcaaacgatgcaacggtggaagcagttacacatgcgttccagtgagtctccacgcgagttaataacttaggcgtgtacgtattttgacaagtcgtgactcgggagggtgaatccgcttttcacctgactagtcaacgtcacatcgagaggtggtggaactcagctagttttcgctcgtggaacagcaccgtacgagggaaatcacccgtggcgacggcgatgtggaaaacagcaggcgagcaagcacccagcacactgcacacgggtacacgacggtcaactcgtttccgaggaccaagcgagagcgggagaagagaagcagcttgatagtttacagaagcagcttgattagtttactcgccacggccaagtggcccaactgcctttcccactgtgatcgcaacgtgccaccagccgcccaccacgcagcgtcgcgagccgtctagggatggcaaaccggccgcggtcaccgtcgcggctaagccgtagcgcgcgagacgggtgggtttccgcgacgccgcgcggtggattctggagagaagcgcccgcgatgccgtgatagccacggaggcgcggacggtgaaccgcggctccagctgagtgttttgatgggactcgtttcgtaagccaaaactgggagcggggcgctgctttctcgctcgctgcgcgccgcctggtggcctggggaccaccagccccatccgtatccgtgggcaaaagacgtttttgtctcattgtgtgccctaaaattgatcttttatcacaatccgtctttaggccactggagtttcattcgggctcattcggaatgaagcaaatgtgaaggaaaacaatggaggattgatgatttctttgaattagctaccgtagttgcattcgttttaaaagattggctacccgattgtcacaggaatactattcgctacctatgcacgaagaataagaaattcttatgttattcaatcatgtgtttcacacatacaatcctatcatatttctgtgatttctatttctacatttttttctatcctgcattccaaataagcattaaataaggtgtcatgtcagtgtttctgataatgttgcaacaaattaataaagtgagagatgaaatgggttttaactagacgaaatcttgtctacactgtttttaatatactccagtttgtatcttgcatatactacccatgaaacaacaaacatgaaactatgcattatgtgagctatttcaatcatcaattaaataccttattacttatgtggtatcttggaaacataaaaatgatatctctaattaggaatagccttagatccgatcttatttgcttccattccatcttgattccttaatgaccacccctatatgcccatagtttcatgtcatctagattccctaaggcataggctaggaaaagggatcgaatgcaatgttctttgactcaggaacgtcgtccccatcccagcaacaaggagacattttcatccgtaaaatcttgcaatacgttcatcattcttgttctcttgaccccatctacccgagaactttgtgactatgacgactattaattgaaacaatgatacctccataccaccaaatcaagcaacaaatattgtattagtaatcgctcttgtttgctattgggcatgtgttgtttgtttggtgctatggcttttgtaaacacaaggttaaaattaggccaaacaagtccctgcttttgcggaatagcactactccgcgtcctaattatagttatagtttttatctttggtggacttggtggtctccctgcatatggacgtcgtattgcgttcctaccgttcccccccccccaatctcttctcgtaactttgatctctcttattgatgaactcttgaagggaacggaaatcgaaaatccaagaggtattgtaactttatatgtggctattttctacaacttgttagccaatttctttgctagttgtagtatgtttttacgcctatcatgtatttgatttgcatagaagctgtttatgtctatctgtgtaggtatatcacaaacgaaaactacattttcttcaattaagtggagtcattttttatcttcatgagaagtacaaaagtgaccaaggatcacgtgaaattaattatcttaatatgaataggaagtgcaaggaagattgcgacatggtagaggcctattattcatgtgctaaccttagcatagttgcatgttatatacttttcctgataaaacatatctctcaaccaaataaagattcatggaatgcttttactctattcggtaactatcttcgtctatattacaatgtgttgtgttgttctgtaaagatttctatagatgctttatatttatccatgttattaattattatgtacatgcaaaaactacattgcacaaatttagaccataatcttcatatgttttactagcatgctaatttgtatgactccaatatttagaaaaaaatcatgacctacatttgttttatccatggagatgagaataggttatgtcatacttcgataatttgatcaatatggtgattaaatttcccttcctgctatattgtaagtcatttgaaaagggttaatcaatcttatgtgatatatgtgtgtcacgatttttccttcttactagcatataataaccttttcaggtgccccttactaattctatccatcataatcatttgaataattatttggtattctcctgcatcctaggagatggagggcttgaatattgaagggattccccaagtgcctattgatccaaactctgttgatgtattgtcaagctcaaatattgatccaaactctgttgatatattgtcaagctcaaatattgatccaaactctgttgacatattgtcaagctcaaatattgatccaaactccgttaatgtattgtcaagctcaaatattgatccaaactctgttgacatattgtcaagctcaaatattgatccaaactctattgatgtattgtcaagctcaaatgaatcaaagcctactatttcatttgatttgccatcaagtttctcggttggtcatactagacattcaagtgaagatttaagttcccttacaattaataatttacgcataaatcatagagaggacaattaccaaagccagtttgaagagaagcggatacatagccatggtcacacaagacgttttagtgaagatttaagttctttgaagattaatgatctatgtgcaaataaggaagaggagaattatgacaaccagcttgagaggaaggaaatatatcgccataactcagctggaaacattttcagggctgcagagattgctgaacgcttcattcaaaccattgataagagagtcctggtcgacacagcagcaccaattgaatccgttaaagatgctgttagcaaatttggagggatacttgattggaaagaggtagttttttaatccttctttatccatcttactgtcttgttttgatgaagggaatgcataaattcgattataactattctttcgtagagacggaaacatgtccaagttgagcttgacaagatgcaggaagatgctcctgagtacaagagaagagtggaagtcacagaagttgagaaaagcaaagttcttgaggagctatattgtactagacgaactatagaacgactaaaaatagacctagacaaatcccatactgagacaattcaagcacaacaagacttagagcttgctgagattcggtttgaagagatgcaacaaggcattgcccgcaaagagagatctataacaaaggcaaagattgaggttgccaatgaacgacgtgcaacggccttagaagacttgcagtcagtgaagatggagctagatcaacttcaaaaagaatacacatctctaatttctcaaagggataacactgaaacaaaagcacgtaaggccattgttgcatcacaagaaattgaaaaggttgttcaggatctcaccattaaggttatcacaatgaaagatttgataaccacctcacaagctaaccatgttatagctgaggggaaaaaaataaatgcagctttggcttatcaacaggacatggtgaattggcagaatgagctaaaacagattgatgacgaggttcaaaagctcaatgatgacctatcactcaataaagaccttgagtcaaagctacaaactgcttcaatgtggctgatgaatctaagggacgagtttaaggctcacgtggatggtacattgcctaaagtgccatctgaggctagagaggaagagcggccaatgataattgtttgtgcgaagctagcacgaactaggaaggagcttgaaaatatgaggatagacattgataaggccaaggatgatgtgaagtctttgtggaatgctgctgctacattacaagctaatgtagagatggagaaaacaaacattgcatcattaaggcaaaaagagaatcttgcattgaatctgctttagctcttcaagaagaattgagcaagattgcttttgagctcagcatggtggaagagagaacaaaagcagcaaaaatgcctttagaactacagcaagcaactaaaaagttggaacatgcaaagttgaatgctgtatttgctaggaatgagatggaaaaagctagagaagaggcagatcaagcccaggcagaggtaaatgttgttcaattgagaatagaagcaacattgagggagatacttgcagttaatgcatcaagagaaattgcagtggcatcagcaaatgcactacaagactataaacaggaaatagaactagaaccactagctaatcgaaaaaacaacaatgtcacattgtcacttgaagagtacaatgtattgtgcaagaaagtgcaagatgccgaggactctgctaagaagcaagttattagagctatagagaagatcaagaaagcaaaggatgcagaggtgaggagtttggataggttagatcaactgatcaagcaaattgatgataggagggttgcactgagagaggctcatgagaaagccaatgtagcatgtgatggaaaattagcaatggagaatgaactaagaaaaaggagagcccatcatgagaaacaacgaaatactggtgaggtatctcttcctattgctcaaatctccaatgtaaagaacacatcaacctcttttgacgcagtaggatcatctaactccaatccttataagtatcgaatgttgctacctagagctgacactatagcaactacaatagctgagtcaaggccacggaagtctttcttcccacggtccttagtggcaatgttcatgtttaggagaaagacacatttgaagtgataactcttctccttgctagcttgcctatttatttttgtttgtttttgtacatgtaccttcaaagtgtcgacgtttagggtgggttgtaattacttatcgaaaatatataaaattaagccagaggtatttgttgttcttgtaccactttcaatctattatatactaaaagtttattaaacttcctataaacgctcctaaatcgaccgtgacactctaagaaaatcctaaaaaatctgataaaaacaaaaatatctagccattgatttacacttaaatcggtggaacaattattttaaccattagatttgatactaaaaataaataattcaacaaccggtggacccattatatctattaaaagaataactctgctcccctctttctgtaccgtgattacggcggtgtatggagtacaatgatcttgttcgccatatgaggaccgatcgtgtagctctcgatagagtgttaatttggttgcctgcgattggtttcgatttgtcgtcttgacgattggatgctgatgacgctatgcatcgaaacgctcgagcagcaatcggagaagaattagccgctttgagaagaatggcaaatataatacaagatcaattagcaaaacaataacagataatgctgcctatgcttacggtctatgttgacaatattctaatcagcaacaaaattcacgactgcgcatcatcaacagattaatacactaccacaatcaaggactgcatgattgagagattattactagctcccacctttttatattacaagacgctttgatttattttttgaatggagatagagtagattatcacaccaacaaaattaaggattgtgcatgatccacagattaatacacagataaattaatgttggaatcaaaacaaaaatcttaaaaaggagtcaaacaccacatcacagatttatttaattcactcctctattttctaactaataacaatcttagaaattttgaggaaaaaacatctggccgtagatttatgcctaaatcagtgggtatattattttaaccattagggcaatgtctgacacagctctagattctaaatacaatgtttgaagtttatatgttaaattatagtggtttaaaattttaaatttcatctaaaatagaaacaaaatgaattatccaaatgttatcaatgtaaacacatagatctatggatctatggacctagaaatacaaaactttaataaatcttagatccggagctgtgtcaaaaacaaacaactcaaattggtgatcccattggatctatgtaaagaaaacaaaccgtcttccactctccctccccctccagctgtacatttgtatgtctccctccgcactactcacccctcgtctcctcctcatctcctcccatttaattcacccctcttattttgaactaacgacataataataaagtaatttatagttacatagctaaaatataagttatggctgatttttaatttgtttgaactcttttacaattggatagctaaataactcaacatttaaattacttatagaaaaattcaaataagttggttgaacatagacccctattcttttgcatggtaaccaaacaacattctatttttaatttgtttgtagtattgttttatttataatcatataaataattgaaaatccatattatttcattttattatataaaaattaaaatgtcatttgaacatagcccctatctttgcacgataaccaaataacaataaagcattgaaaataatgatagtaagtattatgacatcttaaattattctacttaataaagaaccattaaatgtcctctagagttcttttaagccttggcgtgtcaatgtttaaaaactagaaaaaatcttcgaaattcaatgaaaaaaaagtaaaatatttgatcattggtttgtgcaggcaatgcgagagattagtaattttacggaccgattgctcagcatgtgtggaaggactttctactccatgtatggatcagtcttgcagttatggccaagtcatgctaaagaccgtataagtcttgcatttacactattttaaaccactaaatctacttttaggaaaacctcaagcagtcgcatgccactttttaaaagttagcaacatcttagaaatcttggaaaaaaaacatccgatcatcatcagtttcaccgaaattgtttagaaaagaacaattttacggttcttgaggaggtaccatgaggtaccactttttctattataaatttggtacctcttggtacctaggtaccatgaggtaccaaattttacactaaatttttgatacctcatggtatctactcaagtaccgtagaattactctttagaaaaactagaaaatcaaaagattttccacggtctttcaataattttatgaaatacaacgtaattatgacaattgaattggcattgcaggctttaaataataaatatataatatacatgtacttaattcatgacaactgcaggctagcttaaaaaatgtaaagtgtttggttatgagtacataatttctagcattaaactataaaatgtatagaaagatattaaaattatggaagcaactataatacatcacataataaaaaaatgatgaagaaatcatactttttcagatgcaaccaataatgcatatgcccgcgtgaatgcgcgggctacctttctagttaatttaattgcattttgccaattctctaacttaaactctgagagtgagagccatgttgtggaacttcttgaggtgttgtgtcatcattaaattgacaaatttccatctttaagtgggcatacgttgtttcacttattgtttgccaaaagacagggctttggtaccttcttgaagacaaccaattgcatggagtggtctagtgctgacaggatgcaaatcatttgaaacattccccatctcaaatcacatgacatctttcaactggaaggccatattacatttgcctccatctaagtcaatacatcttgtaattattctacagttttttcttctttcaactgatcaattgatcattgaagcttgtcttttccacccatctgattaagtacatcaaaattaactagtcatacaattttagaccatcaccgacatcctcgcaatgcctgacatgccttagaacggcaccaaggtccccatccttcttggccctgcagtcatagctcggtggagcatggaagcacggctccatcgacgttgtctggatgcagggcgggttagccgacgctgtccgattcgtgggcgttagcaacagccagggctttaccccggcgaggccatggccgacgtacccaaccgtcgaccgcccgctgaccaccgacacgtcgcagtagctctggaggaacatctccaccagcgccttctggttgggtgcctgcttaccggcgccggccggctgcagcacgctgacaggctcgccggtcaccgtcgcgtgctcgtagtacatcgccttcagcttctcggcgtactccgacggctgcgccgagctgacgagcacggccttcgacgccgtggtggctagcgccgcctcgttagcgctcgacgtcgcgtttgggtcgatctccggcagaatcttctcctgactcgtgcaagcgacgatctgcttgaagtactcctccgacgacaccttgctcccggcgaaggtcgtgatctgaatgccaatattttcttcaaacttggccatgtacgacgtgtggtacctcgtgatgagctcccacaccttgttggaagggtggaacaggtacctcccgatatggtggaacaccgtgtccctcgccgggaacatccaccggagctcgtcctcgaactgcggcaccaggaacagccccggcgtgaagtagagattggagcgcagtatcagccagttcaccttcgccagcacggtctggtcgtcgtcgcagaagaagagctggtccgactgctggtagtcgtgctccagatggacgtacgcgtacgacggcagcgactcggaccgcacgccggcggggtcgtcggtcttgatcttcttagcaccgagcaggttcgcgtagctgtgctcgctgccgcggccgagctgcgtcaggttgtggacgaggaaacccgcggggagctcccacgatgcggccgggaagggctcgcagaagagtccggccatgtcgtcggtgacgtgcaccacgaacacgcggtgggtgaggagcgcgtagaggaaggcggacgccatggagagcatgcggtcgccgaggtggctgccgccgcacggcgtccagacgaggtaggtgcactcgacgaggcccatgctgtaggcggaggtgagctgcatcagggacttcttgtagaagagcgtgccgggcccgcacttgcggtggagcgcctcgtacttgcgcagccgggagacgaggtacggcgacggcgagtgcggcgacggcttgcggtggagcgacgacttgtaccggctcaggcacgcgctctcgccgatgtccggcgagagcagcccgccgaggagcctgtcccggttcgccggggaggattccggcggcgtccctgctggatcctctgcattgaccaagaaaccagtgaactaatcgcgtagtgacgtcacaggaagatcaacgttgagtgctgctgctcaccgtcgtggacggtcaccgtgacgcccatctgcgacacgtcggacaaggtcggccgcgctcgtgacagcgcgaggaagagcgggagagcggcgaagcagaggacgacgagcagcgcgacgggccacacgccgctcgtcttggacggcaaaggcggcggccggcggtgcggccgcgtcggcttactgtccattttaatcaaccctccacttcgtctccgccgtgaaagattttgcagcttcggtgcacgagctgggcagagatcagattgactccaatgcagatgcagccgatctgctactgctggggtttgcacttggcgagttgaccacttgggctctcacctttttgccgctcgaagtaatggccttgcgtaagatgcaaacttccattgttgactcgcctaattgatctcggtccaaagacggtgaataatctaacccaactaagcaacaagaacagcccaggtaagttcacttacggcccataactcaaattcgtttgacttaggtgactcgcttaatggatctcggcccaacgcatttcagcctttctgttcaggactgcatagcctgaaggaaatccaggcccttcatagtaggtacaagtacaactcggcctcttaatttcaggcctaatatcgcaaattcgcaatatttatgttctaccagcaaaaatgtctttgcattctaacaggtaaaaataatttttacgattggcataaaccatgtcaatttaaaccacaaatcgaaacaagacaaacaaaacaatagcaaaacaaaatcagaaatcatatagcatgaaacccgattacgcgcgcttcaaaatatataaactaggattgaatcagatacaagaatctgactaggattatatataagggaggaattttaagatgcacttggttttaactccaaggttttatgttaaatttttaacacatttataatttcttcttgaaaaagagttttgaggaatgtccctctgggcattaaaaaaaaaagggatgtccctccctccaaatcttttttttatatataagggaggaattttcaggcagatcatgtcaaatgcgccgttcagctggggaccgctgattacgacgggatcaggtccggtaccaatcattgccatgttgaacaaaatttccgtgtacagcgtggcagagacacggatcaaactccagctagtttttttttttccccgagagaaaagagagctaagtctgccacgaactgactaatggcagcaaacgttgatccaagcacgtcccacgaccgtgaacatatatatcatatactcctctgtcccataatataagtgattttgagtttttacttataacgtttgaccactcgtcttattcaaaaaattttaaaattattatttattttatttgtgacttattttattatctacagtacttcaagtacaacttttcgttttttatatttagaaaaaaaattgaataagacgaatggtcaaatgttacataaaaaaactcaaaatagggagtgagtatacaccaaccatctagaacaataaaaaaactctgcaaagattcagctagatcagggcatgcaagcaaggcacaaacatccaccacgtccacgcccctacggagagcacgagacgcaacgaatagatcccagcctgactcggtcactcccgtatccaaacgctttccacccaagcagcgcaaaatggcacctcaacctgcattggtactgagtagtaccaccgactaaaagaacgttattataaggcaaaatttgctacagacatccaaaaaaacatgtaattagctggaggacatcgtaaaaacgtgaatttactatagggcatcataaaaaactggtaattgactgctggacactcgcagcattattttattatttttggaggaaaaggagagagagacaatgattaaagacaagtttacccttggctcaaatgactccaatgcagttcccacagagaagtctcctctccctctccttcttcccagacgggccgagtggcggttatgcgagctcacagagacggcatcaaggaaagaagcacggcaggccaggttcctccccgatttttcgatgcgaattgagttgatctgactccgtgcggcatggccattcgcgacatcacccgctgcaggagcgcgccggagaggagggagagcgtgtggagggctgcgatggagttggaagttgcagttggaggtagggcggcgtcggagtggtgatgtgaggcctcgctgatccggcgccggtgcggtgtaccagacgtcggcttgcagctgccgccacgctaggctaacccatgcccgacgcctgtgctactgcgcccggctgtcgtgccgcaccgccccgcgccagtcgcctcccgctcaaaagaaaaaaattcaaagggtagaaccgtatttacacaactgttctctctccttttcctctaaaaaataataaaataatattgtgggtgtccagcagccaattaccagttttttacgatgccctatagcaaattcacgtttttacggtgtcctccaactaattatacgttttttgatgtcctgtagcaaattttgtcttattataaagaggttttttactgtccttgaggttgtgcagtaccaaatcctgactgttgatctggcatcatccaacggtggtacagcacctcctcattgaagcggtaccgtgggtgaaagggtacttctgtactttcgcgtgggcatctctttctttcgcgttcggcttccttccctgtttcacgagagaaaaaaatcgttggggaagagcagcgagagatggcggcaagaggcaggggcagcgagagattgcggcgacggcgagggcctcgatgtgcaacggcagcggcgcggcggcctcgatgcgcctcgatatgcgacggcagcggcatggcggcctcgatgcgcgatggcggcggcagcggcggcctctcttttcctcctttctgctgtgaattttgttgacggcggcggcaacgacggcctgtctcttcctcctttctgctgtgaattttgttgttggatttgctgaaccaaatgtaaatggctaaatggttgattaccagcttactcttgaattgcaagtttcgtattgatgaactaaaataacaaggttcagaaattggatctgctgtaaatagtatcgattcatgagaaagtctcgtgtactttgagttacgcattgtttttttcctcctgaatccttcctctattcatattaaagttacaaactcaaattgggaatctcctcctggtatttctctgttcagattaaagcagcaaactcaaattgggtgcctccgagcaaggcaggctcgatgcacgatggcagcggcacggcggcctcgatgcgcgacggcatcagcaggctcgatgcacgacggcggcaacagcctcgatgcgtgacggcagcgtggcggcctcgatgcgcgacggtggcggcggcgcggcggcctcgatgcacgacggcggcaacaacctcgatgcgagacggcggcgcgatggcctcgatgggcgacggcggcagatggaagagaggagacctcatttttgttagcccgatcatacccctgttaaaccaacggttagattagattggtacctcgtgatacctctttaaggatgggaaaaatgctctattataaaagatgcttgtttcatctcaaatcataggttaatcattgtgtcatgtactgcaagcctccaaatttgcaatgcagctcccttgtcttagaagaggtcatgcatatgtaatctatacatgtgtgccaccaagagctgatgagtagtagaaaattcatagagaaaaataatgaacttctgaagaaactgccacccaaacaaaacaaagcagaagtctcaactctcaagccggcaacgagccaacgaccatctcattgcggttgcaccttcctcctcctccaatgatccccctctccctcctcgccgtcgtcctcgtcttcggcatcgccggcgccgccgatggcctttcaggtgatgaacgcttttgccctcggtgagttcacaacgtgcaatgtgcttgggcagttgatgaacattgtccgcgtttgtacacagggtaccagataagttgcggtgcgacgtcggagaaggtggtcggcgacgtgacatgggttcccgacggccggttcgtcagcgtcggcaacgtctccgacgtgcggtcgccgggggtgctgccggtgctctcctcgctccggtacttccccgacacgtcggcgaggaagtactgctacgtggtgcccgcggagaggaagaggaagtacctcgtccgtacgacgtacttctacggcgggttcgacggcggcagcgcgccgccggtgttcgaccagatcatcgagggcacgcggtggagcgaggtggacacggcgggggactacgccaggggcctcgccacgtactatgaggccgtcgtgctcgccaccgagaaggaggtcagcgtgtgcctcgccaggaacgccgccaccaagtccagccccttcatctccgcgcttgaggtgtcgccattggaggactcggtgtacaactccaccgacttcgagtcctacgctctcagcaccattgcgcgccacagcttcggccacgacggctcagcggccgtcaggtaagaacaatcacgcaccaccgcccatttccttgctacgaattcatggcgtgcttgccgcttgatgctcgtcgaatctgtgattttttttttctagctatccaggcgatcgtttcaaccggttctgggaggcgcacagcgacgggatgccggtggtggagagccaggcgagcgtgtcgcaggcggcgttctggaacaagccaccggaggacgtgttccgccgaggcgtcacgacggccggcggccgcggcgagagcctggagctccagtggccgccggcgccgctccccgccgcgagctactacctggcgctctacttccaggacaaccgcgcgccgggcccgctcagctggagagtgttcgacgtcgccgtcaacggcgagacgttcttcgccggcctgaacgtgtcgacggccgggtcgatgctctacggcgacaagtggccgctctccgggcggacaaagatcacgctgacgcctgcgccaggctcgccggtcgggccggtgatcaacgccgccgagctgatgatggttgtgccactcggagggaggacacatcccagagatggtaacttgacaaaatctcatggatcatgccgaattcgtggtttgctcatcgaaatttattcatgtctcattgtctcgtgttgctgcagtgatcggcatgcaggcgctagccagaggtttcgacaacccaccggctgactgggccggcgatccatgtttgcctcaggggaactcatggactggtgtcacctgcacccaagaaccacttgctcgagtggtttctctgtaagttactgattgccatatgtactatatgcatcaatgcctgcaaaaggggcagtatgttctcttgttgatctctgaaaccgaaatggtggcaatcacacggcaggaatctcacgaattttaaagttgggggatcaatatctgacggcattgccaacctgacagcgatctcaagcatgtaagcctccttaaacaagctaatgccagactcccattctttaattgtcctgctgacagattggaaaaagattgcagtggtaaagtaaatattgattgcctaatttgggtacggtgattgcagttggcttgtgggaaacaatctgaccggaccaattccagatatgagcctcctacatcatttggtttctctgtaagcacagtagctacatactgctcaataattgttttggagaatgcttcagtaaactgaagatcacctggctaaatttcttaactgaaggcatctggagaacaaccgactgacagggcagattcctccatctctagggagcatgccaaggcttcgtgaattgtaagtggcttcaacaagtagtttatactagtcaagtatttgagttcatcgacttgttatgaccgcttgagttttttgcttgacaggtttgtgcagaacaatgcactgcaaggggcgattccgatcagcttcaagaacaaaacgggcttcatgttccagtgagtgatcacgagtgctgtatttaagcttgtgattccttatttttctttagtgactgatgaaatgaaaataatcttgctctgacagatatgcacctgggaataaccttagctaacacaaattcaacgagtataagcttgttcaggttgagatcatccggtgttcatgagatgaagaaaagagacattaaccgttgacgacacgctggaacacattaattaaacaccattttttcccttttattttgtttctttttgccgttcgattctatccgtatttttgttcctcctttcctttctttttggcaaacatgaggtgatcctgaatgtatttaaccctgcaactgtgtggtacctgattcaatttatttgtatgtatatttttaattactactaccttcattgtcaaatagatgccgtcccagtcagacagaaaatttgcatgattaattaacgaagaaatgtcagaattttccatcagaatgatattggtaaattttttcatgaaaatcatttcatataattattcttttaatagcaaaacatgtagttagaaaaaaaagatgaaacatgtgtaacgaaaatgatgtcgatgtctaaacgacaagtactttgaaaatgagagttgtctttctatcctcttctttacacgtcaatgcctgctactgcaccaacaataccagagaggatctgcatttatttacgtgcacaaccaccaacccgataaaattatagaaactaagtaatagaaaaaatttatgctcgaccccatgctccaaacccaatcacatggacccattaaaaagtccacattctattccattttcagtcgcataggtctataaataaaatttaatctctatacactttaatcttcgttgcaatgtatgggtatctctatctggaaaaacagtgagttcgaaaactgaatattttagttcctcactagcctttgtagcaaaaaaatgcattaaattgcggatcctacaaaccggcccagaacagttgggcagcccacgaagtcaccaactgacagcccagcccattaacgcctccaatatcaagatatctcccaatttccttttttttttctttattattatctgtagattccggcacatccttcgtcgcgctcgtcgccacatcgcttgcttccccgtcactcccactatttcccactcgtcgccggcggcgagcgagcgagcgatgatctccgcgtcccggacgcaaaccccgctcccatctccatgactcccgcgaaccccaccccgctcctctcctccccacgccccaacccttccctccccctcccccgccgcgcccggcgcccccacccgccgccggcggccaacaccaccggcgcggcctccacgccggactggttccggcctagggcgccgcccgacgcggacccgtcgacatccggcggccgcgtcgccgcccgggatcccggggtgcgcgtcagggccagggagggcgcggaggaggagaagaaggggaggggaagggggaggaggagatggtgggactggtggtccggggacagggagagctacctcgtcgacgacgtggagccgctgccgctgccgttgaccgttccggacaccgagccgatgtcccgcgaggagctcgaccgccgcctcagctgcgacgtggagatcgaggtgggtgcggttgcggtgggatcctaagagtttttcacttctttggtgattcggagggaaaatttggtgacgatttcggagtatgtgtttgtgtggatttgggtttgaaggattgcaagactgtctcctacgagtggacgggcaagtgccggagttgccaggggacagggctggtgagctatttcaggaagaaggggagggagaccatctgcaaatgcgtgccatgcgctggcattggtgagatcccttgctcgcattcccagtatcgatcgaattgctctcatttgtaggtgatcggaaatagggaatggggatattacatgtatccagatcttcttgctaggaattgctattgtgaactggaaagggtgtaggttgccttcagtttaggggtggcacttggttatcattagatacagtgtagttttgatgagttctttagtttagacagataatttaccattcagccttggtctgcagttaggatgttataaaatgatttgcattagtatgtactgaacatttcatgtcaaacctgtaagtgcagcttttgcccccttttattcaaagaaggctgcaaataccactgatagtactaaatatccagtaaatattgtgcacataacccttggtgctaaaaccttgcacagaaaaggagattttgctcagagatgccatttctctttattgctcttcctattgttgttaagttgagcaattagtctcgattagtcggtgattgtcagcccacacgaccagaagcccacaactcaaacaaatataaagtcgcatgactagctcgacttatcagcgactttcagtgattagttggtgctcagatcgatgtgaaagcatgaacatgatagcactcctgctccacctcatgtagtgcctataataattaatagcctgccatgtaggatcaaacctaatgtggcaagagagttaacgaagtgtgtgagagagaatccatgtcttgcatgagacactacccaaggcaaataaaccaacacatcaagaaacaaacaaaatagcattaggggttgaggtagtgtctgtggcacaaaacgagaggcaaatcaacaaataagagggagagacgatgagagtaatttactatttgcattgatctcacacatagaaactatgcattggacaaatagtattttatagcagtgtccatatggcatgaagtggcatagatgtctagcattaggaatgccttgacagctgaatccaaattaagcatgctaattgcagatgctagcaacaatgatgaaagtttattttaacaatcaaggatagtaaatcaaatatcttgtgtggaatgaactactgataaaattgtatacagtgcctcagttatgtagctcctgaaatgctgcagatgaataatgggataacggaacctagaattcaatgctttagaaatgttcaggaatagctgaaaaagagtgttgtttactgttggaatgttttcctctatgctactgagttcagttacctgagcttttctaagtacattggaactgatctaatatgactaaaattgccatgatatgctaccgaagtcaacagtaaagatatgatactatcatcgaacaaaataatccctgaaaaaatctaataacaagcaacgctagttcttcaatctgacctgatagataatacccctgatagaaattggcatagcatgtgcaggtacgtgtgtgttgggcacttaacgttattcctttgtccaacagatgagaactagatatttagatagttagctgctgccaaaatttccaggacttttgacatggaaaagtaaatagatttagatnnnnnnnnnnnnnnnnnnnnnnnnggatttctgccatagtaaagtaagtagcttgagacaattagatattccaatcgagctcgtgagattaacttttgttgataactgagatctttctaaataccatgctaatttattttgattcctttctactgccttaactcttcattactcctggcaaacttttacctgttgatttgctgttatgacacttggatgggtgttctacttattctgtaggttatgttcggaaaatcacatttcgccaggacattgaaaacatggatgagttagacaatgggaaaccaccatagtttgatggccctgttcgcttggcagctgtcatttattaactgctgctggatagattgtgttcacaacttggacgatttaaccagtgattctttctgttacagtcaggcacggtacatgatgaggtgccatttttaagtgttgtaaaccattatctgctaataattgtactcctttgttcttatcattatagttgataaagaaaaggaaagaaattatttcaagtcagctttggttctgttctacacttctacatctctttctctttccttatcccaagcggctatactagattcttactttgcatgttgtctggcccatcttttgcccttctttctggtttgaggtagcctattctgcaagttctggaggaatcacatattctgaaactttctgcagctgtcaggcatatattctatatatgcaccttagccatgtttaggacaaggaacctatgaacttccatgacgggcaatcaggagctcatttaggcgtatcaatcatccgtagctgcagcaaatcaaatccaaaatgtctcatctgagccttttgaccttcaagtacaatcttgagaagctcaagtccaaggccgcaggccggccaaccggccggctgctgtccggcggggaccggcagttctccgacttgacgaggatctacaagcctgacgacgacgagatgaagaaagtgttcaacaagatcgccggcgagcacgaccggatcaccaggaaggatctgaaggggctcctggagaagttcgggaaagccgacgccgcggccgaggcgaggcggatgatctgcgtcgccgacttcaagaagaacggctacatggacttcgaagagttcatggaggtgcacaagagcggcgtgccgctgggggacatgcgccgggcgttcttcgtgttcgaccaggacggcgacggaaggatcagcgccgaggaggtgatgcaggtgctgcacaa

SEQ ID NO: 47204 - DNA, 865 bp, Oryza sativa
cctgcgccccagaagctgatgtaactccaaaccaaaaggaccaataaccaattactaactaactaactagtatcataatcactaactaattaccaagtaagtaagtagtaattactaacttgccaggtcagcatctttagttcttttcacagcttcagaaaggcacaaacaaaccaaaggcttatatcagccagaagcagcagcagtagccagcagccagcagccacagccagcaaagaaagaagccaagaagcgccaaaggaggaagaagactcctctctcttctcctcccttggctgcaattgcaatactgcaatacagcaaatccatatccagagaagcggttgaattccaggagccgtgtttgcgcagagaacgcatgctgcttctggaatcgtttcctgcctacttttcttctcctcccgtttggctgggcgccgctgctctctccgcctcagctcctcctcctcctcctcgtcgctctcttccctgtcgcggctgttgcgttttgccagttagagcccgactgcgtcggagccgtggcggggattgttgttgccggtgccaaaaatctgatcttggcgaaggttttggggtggaaagattgggttttctttggctgggattttcatggttataggaacctgtggcagacaggatttggagttctgagtttgaagtacttttgatgtgattcttggcgcttcggagatccatttttgtgggtttgttgcgaggctctgaagtttttcgctatcaaaggtgtggaagcaatttatttttccagtacagaaggactgttagtactgtggagatttcgttgggagctcaaatgtttgtctgattagctaaagctccaatcatt

SEQ ID NO: 47205 - DNA, 750 bp, Oryza sativa
atttgcagtttacagtatgataattcagctttgccggaagaaagtatgaactgataatggatatttcactaagcaatgaaattgcatccagcctttccatctggatgcgcacagaaccaagaagaaaagaaaaacgattgattgataaattggtgatgcaataagaaggatgtaccctgcaacaactgggtagacagcgtttctccactcattctgatggtgtgcaggtcagagtgacaaatcccacagtacagcacctttatagcgacgtcgtcatctccagttttcctgaaaaatggcaatatatagaacacaagtcagaaacatatactatttctctactgagccaataaccttttagcagaactgcagtggttattacttcagcattgagagttcagactctcaagtacacaagaagagagagcctaaacaccatgcttcacctcccaagattttaactaagccatgaactggtagaactgaaatttttcttttattttgctttcccttttactttatctgaagtatttcagggaactaattcagtaccatcaaatcaacagccttgaactgctgaagctgaaagaagatgcatgcttacaacactagcaagtgaattggcatacagcaagatcctcaatttaccatcacacagatggctgtaaacttgtgaaaattcacataggctcgacaaaaaaactggtaacaaaaacaagccatgtgcagcaagccgcctactgcttgaaa

SEQ ID NO: 47206 - DNA, 15378 bp, Oryza sativa
  unsure (1)..(15378): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggataagtaacctgaaacatccatacatgaaactgaagtgaacctctagatccccaaggtcatatcttcacttactaatgcttctgtagttgtgctgctactactacaagtttgcagcgtaaaatattccatctcgactttttgttctaccacaagtatgaaattctattgccataagctactaaccaattcttacaactcttccaaaggataacaacacatcgaatgctaaaaactagttcttctgtaacatccaccatggacaaacctgagacaccagccacctgaactggtgagcggcgacaacggcgtgctctttgggcggcttctccttgccaatttcctcatcctccgtgtccacgcacgtggccttcacaacatccttcagcggcggcaccacctccggcatcatccccaccaccatctcccctacatcgccccagccgcccgccgccgccatctcctccaccgcggcggcggcagcgtcagagagcgccacgggaacccagtgcagcgcggggtactccggggaggccgcgcgcgcggcggcgcagaagaggaggaggcccgcggcctccttgctgcgggccccgccgccgccagccggagcctggggatgggacgaggggaggagggaagagaggagggacttggtggaggtggaggagccctccggaggcgcgtagggcgccgcggcgagggagtcccggagcggcgccgcgatgcggaggagggcgtcgcgggggatcgccgcgccggcggcgggaggggccatcggcggcggacgccggactggacagttcgagcaacccacctgcacagtgaaagcccagctaataaatgtttgtgtcgttgtgattgtttcgtgggccggcttgggccagcgttgacgcacaagctggacgaggtcgtctgcggacgcagcgtgtccttgattaggtggggcccacacgtcagtggcccatatttctctgacgtatgtcaaaggagcctcatcctcagtccgcatctgccttatgtttttgctataaatttgttgacaaatttgctcattgactttataggaaaaggtctgtatatactaaattttgtcttagtaagctcttaccatgtgtcacgatgagtatatatagattttctataagtttcatctatttaaatcaaaaggttgagatttataagagttttgcaacgctacagacgcatgacccaatggctcatgtcgtcgaccgtgcatagatggcatatgcatagtagacataggaggcatatgcaaagccgtatatgtcctagtttcttgtttgatggcatgtatggattgaaacaccaccaagtgatgaaaaatagtcttgcatgcatcttttccatgtttcactgcacaatgggcaggagaaaatcccacaaactatattccacatgagccgtgacacgtttttacgataatcacctgtagattataccaaataagttatgatcctaaactatcttacaattagacctatacggccatatctatatgaagagggcaatattatcaaggctagctttgtagtatttagttttaacccctttatatcatatgacgatcaatactttagtacaaccccttaatcccgagatagctagaatagattgatgttgatggcgccactctagttctcgaggaagcccctggtggcagcgctcaaagtctcaaggaaattcccaatggtggcactcacagactcaaggaagcccaccctcaaccgctattaaaagctcgatggcagtggtttggagcttggggcgtcgtgatttcctctccctctcatcttcagtgaggggctctagtgcctgttttcgtagcaaacatgagtttacatcatcaaatgaatcaaaaggatttaaattcttgtaattttacaattgtcacatcaatctttggtgtttatagctgtagctattggatgctatattgttgtcataggggtaggctaaggccctgtttgtttcagcttatgattattataatctagattattaaaccagattactataagttgtattataataaactgacatagaataagctatgagttgtttgtttgtctggattattggaggcatggatcattgggtttgaaaggctaaagtctataatgccctcagctatctgttcggttgatggcataggtgggtaatctttctcaagtatgtaggggtagtgggtttttagccactcaataatctgaaaaaagctcatctagagcagcttattagattataataatctggcttatagattataataatctgctttaataatctacttgtttgtttcagcttactcctaataagctagattataataatcctaagctgaattaaacagggcctaaatctacgaccatgatttttttttcttttgatgcattcattctaaatctaaatgcttatttgtttcaagtggactaacatatcgttagagggatttgtttcaagtgaactaatatattgctagagggaaagggctaaaaggggaggttgtgatgtgaagttatttgttcatagtagtatattaagctacaattttaattatagggacaaactatggtttagaaaagaaagtacaacaattgagattgtctagcaagaatgtcaccaagaagacagtggcaatgtcgaggaggcgagccacgcctatggtgtggagaaggaagacaaaaggttgcataaaggcagggaccggttgcagatttgattattgtttttaagtattctaatgtcgatcctattgtttagaaattaatggtcgaatgtgagtgtacccctcaaaaatggttaaagtctcttttaagaatatagacaagactcaacatcacatgacatccagaaagaagaaaaatattaaaaggatgggatattatttattgacctttgtgatatagggcaaacaaatatttttagataaactacaaatcatatatttagtgttgtggagttatactcttttataaaaaaaaagttttattgatttcaaccgttgtcgaactttttatacgcaactttcattgcatatattttactttttctaaaatataagttccatcaatcgttttagctatcgtcataagtagtagttgttgtacagtacttttgctagaaaacttgttttatttatagctataacctttagagcaatgctacacgtactaaatttttcttactaaacttttactaacaatcatctcaaccgtttgatttaagtagatggaagttacaaaaaatctagatgcactcatagcatgacacatcagtgttagtaagaatttagtaaaaaaaagttagtatgtatagacttttcctaaccttataatgtaccaccaaatgttcttgtgtacaatgacaaatcataacgaaagtctcattaatatataccatttattatgaaaaagttttcatttgtcatcaattctattacctataggaaaggtatgaccatgctgtgttgtacacccagcgaggtaccagcacaaaggaacaggctcaccaccggccacggcggttccggtgggcattctcatctggtgtccgtgggggagagcaaccaacttcgatccgtgctccggaaaccgccgatctccaccgtccacgtaccccggccgaccaaatccaacggcgcggatcgaccgcactggacctcgtccagtgcacggcaaggtcggtttcccgtccactcgttgggttttttcacctcttcctctccagcgacagcagcagcaaacccaagcccgaacccaccacctccgcccatttccgcctcctctcgaaacctcctcctcctcttctcctcttctctcatccaatcgcgagccaccaaaccctaatccccaacacgcacacgcacacgcacacgcgcgcggtcgcgcagcagcgcgccatgggatgagccgcggcggcgcgggagctcggatccggagctagggtttcgggccgcgagtttgcccatggagtgggacagcgagtcggacggcgccggcagcatcggcgccggcgaggaggaggaggaggaggaagaggaggaggagggtggttttgggggaggaggtggtggtgggggcggcggcggagggatgttctcgttcgcgattgaagggatgctgcgcgcttcggggccgtgcgggctcgtcgtcaccgacgcgctcgagcccgactgccccatcatctacgtcaactgcgggttcgaggaggccacgggataccgcgcggaggaggtgctcggcaggaactggttggttcatatcaatctcgcatatgtctcagttattggttcgacttgtttgatttgggcgttcgaattggtggcacttaggatcgaatataatttgcattttatatgatttaatcacgccgtgagcatgatcttttgaattaaatgacaaacggtgcagccctttcgtcatttttagtattcccagcgattacttgtgtccattttgtctataaaaaaaataagaactagtatgttttttttttcactagtatagcttacggatagctgatggcactaatggaccagataaaatagaaattagcacttagcaccatagggtatcatgacctgttgcatcctgatctgggtgaagtttggcttaggatcgattgactttgtagattagacttagtgaactgcatcttgaggcaatactagttttaagaacatgatgcttgatttgtgttgcttggctcagaaattttctttctaatgctaccagtaaatatgacttaattttgttgctagtttcttttatctgactctaggcttgtttaatagcatgctatattttgtgttcaccaacacgctaactgctagacctttgtttcaagaaaagaaataaagaggaaaaaacactaagagcattttaggctgcaaacatgtgcctagttagtgattaggtggtctgaggcagtataaattggctgggtggccctagggaggagggtgcttcttagcacataggtaggctagtcaggcaatttttagaacattgattatgttgttatatccttaaggaagaatagctattgcttgttggtagttggaacttatgctacttataccataaaatgaaaataaattattcaatggaatgatctctatgtaaagaaaatgatggaactgattcagttaacgaagtatctgaaataagacttccctaaaggttgtgaaaagttattttgagattgttagcctgaactgaatgaaaggaggtccataggtctaacacattaacacaaggtagaacaaagaaaagtattaaatggaaatggatattgtggccccaattcctggcttccccttggtcccccatctttgttagcgatcaaaccccaaaaaataggatatccgtggacataggaaatgataaaaccgtgacatgttataatatattgcagcaatgttctttttgcctttttggtcaacaccttggatcttgaagttcatataccagaaacctctaagcttttcccccctgatattacctccaaggagagaggattttttccatgcatatctaaatgctatattaaaaaataagtctactttgatctatggttcttactagaacatgttaatatcaaatttcaactataggtttgattgataagatacataggaaagcaaatcaagtgggtactactttatgtgatggaacaaatataccactgcaacaattgtttgtctaagtttacaaagattgatcatgtaagcgtgtgtagtttttgcatattttgattatctgttgtttttcatcttcactaactttctagtggagtcgaagtgctgtgaagttattttgttattaggcacatggtttgacaacatgcttgtgccaaaaaaaaaatctcccttttttgaagagtattattcagatacctcaccaggattaacttgcttggttcactttacacgtttagggatcaaaatgcaactcccaaggtcaaggagccatgtgatacacccatgcaagtctaggggactactggcctatgatgcacttctattaatcatttatcttatcctacattcgtggtagcagtttagcacttacctctccactattactatcacaattattcaatacaagtatacaacacactggctaaacatttagcatcaagtatcagttgggatgaagtttatggtgtgaagtcaaattcagatgtggttattagccatccaactcatgcacatgttctttcttattaattcagaaacctgcccaagatatttttactctacgccctatgaatatgagtgaaaattttcacattgttcgcatatgaagggtcaaatttttggtggcatcagaaaaaagttttggaaagaacatattctgttgctgaatttttctacatcgttgttcacatcaaaaagatcatgaaaactgagctaacacagcatctagtaccaatgtgcttttgtgagaagggagactgagtggtgcttacaacactttgaatttcctcggagacttgtgctcaaaagtagttggaaatggcactcgccaactgaaagtagcataggatttttgcaagtgtggttcacatttttttcactcatatttcttaaattgttctatgtgttttacttagtacacacttacttgttctttatgtacttttcttgacattcttacacactgatgtttctttcccactttcagccgattcctgcaatgcagaggaccctttgcgcaaaggagacatcccctagttgatgccatggtggtttctgagattcgcaaatgcatagacaatggtaccgaattccgtggtgatttgctaaatttcaggaaagatggctctccattgatgaacaagttacacctgacccctatatatggagatgatgagaccataactcattacatgggcattcagttcttcaccaatgctaatgttgatttgggaccattgcctggctcattgacgaaggaacctgtcagatctacaagatttactccagataactttttccggcccatatccactggaccagggcagagcaacttctgccgggaatattctagcctgttccagttgactgatgaagtactctgccagagtatcctgtcaaggttgtcaccaagagatatagcatctgttagctctgtgtgtaggcggttgtatctcttgacaagaaatgaagatctttggagaatggtttgtcagaatgcatggggcagtgagactactcgagctcttgagactgtccctgcggcaaaaagattaggctggggtcgattggcaagagagctgaccacactggaagctgttgcttggaggaagttgacagttgggggtgccgtggagccatctcgatgtaacttcagtgcctgtgctgtagggaatcgtgttgttctctttggtggggaaggtgttaacatgcaaccaatgaatgacacatttgtgttggatttgaatgctagcaatccagaatggaggcatgtcaatgtaagctcagctcctcctggccgttggggccataccctatcatgcctaaatggatcgctgttagttgtgtttggtggatgtggaagacagggcctgcttaatgacgtgttcacattggatttggatgcaaaacagccgacctggcgcgagattcctggagttgcaccaccagttccacgttcatggcacagctcctgcactttagatgggacgaagttggtggtttctggtggctgtgcagactcaggtgtactactcagtgatacatatcttcttgatgtaacgatggacaaacctgtgtggagggaggtacctgcatcttggacgccaccttcgagattgggccactcaatgtctgtctatggtggcaggaaaattttgatgtttggtggtcttgctaagagtggtccactgcgactccggtcaagtgatgtgttcacaatggacttaagtgaagaggaaccctgctggcggtgcctcaccggtagtggaatgcctggggcaggaaatccagccggagctggtccacctcctcgccttgatcatgttgctgtcagcttacctggggggagagttttgatatttggtggatcagtggcaggtcttcattcagcgtcacagctttatctcttggatccaactgaagaaaagcctacctggaggatactgaatgttcctgggcgacccccacggtttgcctggggccacagcacctgtgttgttggaggaacaaaagcaatagtgcttggaggacaaactggagaagagtggatgttaaccgaaatccatgagctttctttggctagcagcacagtttgaggttcgaagtttattttttatgtttcagcgagcttccttcagaacaatcatgattattcatgtgtggcctgaaacttttcttcactggcaggactggaacactggatgagtatactgaatcttttggcaacgacttgtatttacttggaagaggtggtttgccttgagtagatcaaaacctacatttggggttgcttgctttatgtagtcaaggtgtagtgatatgttctttttcttgttgtttgttttgtcttttaccagaaaatataattcataagctactcttgtgaaatgagtaccaattttatgtattctcagacgcttctgacatgcattatgttagggaaaacagaacaacgttgtatagctgaatcatttgtgatgtactatgcttcttgagcatcttgctgccatctctggcctctgggacacaatttgacgcttatgtgatgtatgcgagaaaaattttgatcgatcctctttattgtaaatcatgtaacatgatgtagctgctttgtcaggtgaactaagctctctatgtttcggcgtgaccatcagacacttccaatgcagctgttgcctgagaactgtgtttaattatcttcgcggtgtcctttgtttttatcctggataatatacttcatgatgatttattgtaacttattgaaagactgcctgtattttccgcatgtgattggttacttggatgtgtacagccatatataatacagtacagcgattggatgaaattgtctagcagaagtatatataaagaatggacactacaaaaaggcactccattatctcgaggactaaacagaatgagttactctgcattttgcattacaatttacaaatgtacatgtacaagaatatttgaaagaccatcacttccacaaactctcgcctacccggcaaagccggtgccataatcaccacaagggatagcggcgaagctcgccagcggcggcggctcctgcctcggggacgccgccggctgaccgatcttcgtctcatcagctgctgctatgccgtcgacggtggcgttgaaccacggaagccgaagcgcctccgccgccgacagccgcgcgtcggggttgcaggtgaggaggccgttcaagacctcgaacccgtcgcgcgacaggcgctcctccgggaacaggtcgcgcagccggtttcagtcccagctccggcaaatcggcaccgcgccgaagagcggcagcgacgggtagctcggccatgtctggcggcacggcgcgccgagcaggcggaagattctcagcagctcgtcggtctcgctgtgcccccggaacagcggcacgccggcgaggagctcgcccatcacgcagccggccgaccaggcgtccacgagctcgccgtagtccggcttcccgaggagcatctccggcgccttgtacccgggcgatccggccttctggtacggcggcttccgcgccgccgtgtccatggccagcccgaggtcgcacagcttcacgacgccgccgtcgccgacgaggatgttcccgggcttgatgtcccggtggacgacgtggcggtcgtggagcctctgcaccccgctcagcagctgccgcatgacgcggcgcacctcctcctccgtgaacggcggcccgccgccgccgccgtggcgctcgcgcaggacgctgctcaggctagggccgacgtgctccatgacgaggccccacatcccggagcgcggctcgagcgcgaggccgtggtagtggacgatggaggggtggtggctgcagcgcgcgaggtagagcgcctcccgcagcagcgcgtcctcgccgacggccttaccacccatgccgcagcggtggcggcggaggaacttgatcgcgacgtccctgcccgtcgcgcggtggcgcgccctgatgacggcgccgaacgcgcccttcctgagccagcacgtgacctcgtaattgtcggtgctctcgatgcagctccgcttgccgccgccgccgccgccggcgtgctcgtcggcgtcggcgatgccactatccgcagcagatcgcttctcgcccatggagaccaagagaagatggtgtcaagcttagccgaggtgagtaaatggaggccaaggctggacgtgggcgagtttaaatagtcacctttcgcgccatgaatccgcgtcgaactcgaactcatgcctccgtttcgcattcggtttctcgaattcgaatccgaatcagcgctcgcctcggctgcgcgccacaaaatacgaatcggactccgtctcgtgtggcgatataaggtggccagcgacgccatgagagcgtgtctccactctcgcattcctcctcctctcaattgatcgcgcgcgcgatcgattcccctcttgtcgagcggcgaccaaaccctagtgcccgatcgccatggcggagcaaggcgttctccggcggtggaagcgcttcttcccggcgttcgcctccatccacgccgccatcgaggccgccgagccgggcatctcccgcagggagttccgcgacgcgacagacaaggtggtggcgatgctctgcaacgcgacggacgacgaggcggtggcggaggagctccgcgtcgtgctcgacgggatgatggtcgaggcgctcctcacgctggagctggttccggcgatgcccaagatgctggcctccaccgacctcgcgcaggacgtcggcgcgctgaggaatcacccgtcggagcgagtccgcagcctcgccatcggcatcgtccgcgggtggagggcctccgtcaaggacgagctcctcaaggccgcagccgccatggagaagctctcccaggcgatggagcccgacgaggccgacgaccatcacgccaagatccttcagccatcgccgcccaagaagacggcaaacacctcacggtcacagccgcctttccccaagaagcagagtgctcgtccggtggtcggcggcagccgtgtcaccacgatggccaagatcgatccgccaccggagaaggcgccggcggcggctgcggctcgaagctcccaccaccgcgagagcgtcgtgccgtgctgtaccgacgagaaggccatgaacgccgcgaagaggaagctccgggaagggtaccaagaagcagaggaggcgaagcggcggcgcacgatccaggtgatccaggcgccggacaggcagcggaagatgcaggcgatcacgcggccgcgaagccgaccgagcttcgtcgccgccgcctccacggcgaagaagagctctggattctcatcgcttcggaggttttagctagggttcttgttctcctccggtgtaacagtgatgtgtccatgatcaactgatcatccccaaagtgtattgcgtcaaaaaaaaaacaaagaaaatccccaaagtgtatgtatgtaattggttatcgagtttatcctgctcgtcctggattactcgcgtgtttaatctatcaaatcaatgatatatttttgtgaaaattgagcaaatttctttatgtgattgtagtatgtgtcaatctgatcgcgatcggcttgaggggcgagagcactgtttctgctcggagtgaagcttcggcttgtttgtcccgaataccaggcttctacatgggcctgaggcttagtagtcgtgggctggaagcccgttataagcatgggccagcgacgcccgtgacaaatgggaatatctgggccggcccatcaagccagctttggtctccgtctcttccgggcccatcacggaagagtcttctcgaaatcgcagccgttcgaccacgatttgacggtcgcgatagatcgccgccgtcgaaacgtagcagcgctagcctttgcgcacaaatgtcgcaacgaaactacgaaagcaacatgtataaaatggaaatgaagccccgacacgattgccatgctcttcaataatacaaagcatcacatcaggatgaaacatgcatcgtacatggcatcgaatcgtgctattattcgcatttagaattgaaaccttgaaggagattggtaggatcaacacgggagattccaagaagattgtaattagctgtcctgctcgtgtcaacacgtcttactgtaagggactcctaaacaaatataaaccacaacacactgcatattatagatcgatcagagattgctggtttggtttgcttttgggtgccttcaacacgcaagtacatcagcaaacgctatcatcacaagcaaagaacaacttttcttcagtaatcagcacagcactctttccagacgcttgcctgatgcgtcgtgagctcaaagctgccagccactgtggctgttcacgggtcaagcagcagaaatcttgtaactgttgtggctaaggccgttttgagcaattgaccagtggcagtggcagtggcagttgcagttttcagttgtacaactgaaaactgtaactgtctactcatcgaaacagaagcaactccaggcaaaccactgggaatgaactcaatcttgttctgggaatgtcctatgaagtctgctacatccaagcagcatttttccagcattttccaaaaacagaagttttcaccaacatcgctatagagatgggtgctggatatatacaaaatgaaactagaatcatgaaacctgttgcgaacgatcaatggagagttctgttgctaatttatatgcacaggaagtttaggctggggggcagggcagcacctagcaacgatagaggtcgaaaagaaatgtaaatgagcagaggtacaatgttctcatgatcgctgcatcacataaagactatgctcctttttaatagctggtcctacaagtacaccatttatcgtccatatcttgtatccctggatccatcaagagaacatcatatatcaactcgtcagaaatgaaacaaggacagcgtcatgctttagagttttaaatttaaagaaaaacatgaactatattatttacatctcatgctgaatttggaaggtagtatcaaattgttttctccacaatgaaatcaaaattttagggtaggtagcctcatgttttcagtattgtactgcacatgcatgtctcaggcactaaaatcctctcctgaaactttactaaccccacctaaacataccaaaagtcttaacacctagcgcataaatatgcaatagatcggttaaaaggagctacctcaaagatgctttcactatgcataatgccatcaagaagaaaacagggaacatgacaaagagtaaaaaatgtaaacggctgtattttctatgcataacatggcagctcaagtaggtactgtaaaagtaagtgcatcaggaacaagaagattccaaaagtgcggtatgtttgtattccatattctctacaacctgaatattttttcattggactagcatgtgttctttgttcttacaaaaatgatagatatagctccaataactaaggaagattaacagtagactgtttctacagacctgtaatggaaactagccattcttccaggtgttgcaatactaggtatggcccctgtgactatgtattcatcatcaatttcatcaaatctgatttctctcaagtcaacagattgtgtgggaacctcgaggttaaagctttcgagatgtgcctgattgctgttcctccttccactgcctcttctttcccttgcccttgctcttcttcgtcttcttgaagatctagagaatcccctgaaaaacataaaagaccaccagtgccttctgacccgcctgaaaacttcatattcttctccagtttcatcatccccatactcaatgacataatctcccagaacaattccattaggaacttgtgcatgaatcgtgctcagcacatcaacaatatcagaagattgctggaagttctcccaatcaacttgcctagcaggatcaatttccgaagggcgtgagtctggatgcttttgttgtgtgtgcttctgaagttcattgaagttgccaacgaatgaacaacaatcctcttcacagcatcttttcttctggttaagatgtagacgagcctcaccgataacaatccatccaatgacatctcctctacacaatgggcagcttgggcggttgttcacattaggagccacaatatggatactatcaagaggagccaccgcaatggttgaaactttcatattggcagggagctcatatgcacctttaaacctctcaagacagtttgagcgggtttgatctgtatcacagacaaatggcctgcaacctttctcataagatgtacatcttagcaggacagcattgtgagggtaatcaagacagattgggcaagtaacatcctctgtccaacttttatcaagctgtatgtcgaaatcaaaagagctgggcctcaccaccttcttcatcatcaggtttcctgaccccatgttagattttctaacaaaactagtagctttaacaagtgctacttttcattaaaacctgcatgacatcaagatgaaaatagattagtttgagactcatcatttctaaacatagtatatttccaatacacaacaaagtttagcatttccatcgatccaacatgagtttaacggtatcacagaatcatgtcaatggatatttggttccaactggttgttttgaactgcacaaactagaatctctcctacatcaacccatatgattgccaaaaggttgaattagtaagccttctcccaacaaattcaactactcagcgttcatatcatcttccctaaatcccccaaaactacaatacccacctggtcaaatccaccaaaaaccagtctcctccaggatgcaacacaagcgaaagc

SEQ ID NO: 47207 - DNA, 2937 bp, Oryza sativa
tatacatgatttattccttattctaaaattgaaataaaaaattaatttgtttattttattattttttatcagaagaagtagactaattttgtattccagtgatcgctcctaaccgttctacgagagataaattaaggttaaattccctagacaaaccgaacttccatgcgccgatcgttaaaatctgtattctaatgatcacttcaaatcatccattgaaagatcaatcaaggccaaattccatggacaaaccgaactcatcttcacatatggtcttctcaaatctcaacgcgaagactattataaagggaaagggactcccatcgttggaaaaaagatgtgaaaaggacgggcatgaatcatgagtgacgcgtggaggacgagagcacggcatatggaggaaactcgtttgcagcttcagcgctgcatacttgtaagttgtaacaatcatctgatgtgaaatgaacaagttgcatttgccgtggaaaattggcttctgctatgcaaaatagagtccatactagtttagatacaagttgtgaaagtcgggcctattgaaattccgatcctacagttaaattttgatatgtagtttgaccattcattttatttttttttaaaaaatacaagtattaactattttttgtaacttatatataaatactttaatcataatctatctatatttacatatttgtattgtttttaaaaacaaatgaccaaacattatgttgaggcctaactctatattaacttgggcacagatggactgggctaggcacgacaaggccatggcattaaatgggccacttttgggctagcccaaatctgaattgcacacggctgtgccggttgcttcaagtttgctgaggagcacctcaacaaagtcaaatatatctccaattttgacgggttgaacttcagttttgtgttctaacatgactaaatatcctggttattgttggaacatgttttggctgtcctattgttctgtcagttttcaattttcaatatgctcttgttgtcattctgaatcccgtaactgctctgactggatggagtagtctctgtttgcttgatcaattttgagcccctgcagaacagcaaagtttcttgcacatgacttttttttgttgcaatgcagcttcaagcttacaaaatgggatatcttatcttctaattgggtcatccacatctcaatttcttagcaactcgattaccaaaaagggtaaaaatatcttcagtacgttgcagcctcgcttggacaatagaagagagtgaaaaatcacagtatagaaacaactcaaacatgtaatagtatatagaaacaagcatgatatgatactcttattccaggagcaacttcaacaacataaagatctgtgtccactttaacagttattacagaacttgacagtaaggttctattattcgattattattgcttctgtgccatgactaacagaagcacagaaagaacacccatggccacaagcacaaaggtgatgctgtaagcctgtactggagctccagggactcttctctcacaaccagagtggaatggcctagtatgggcagttcttgggcagcttgcggatcacattgttcttcattccaatcttggtacgcatgttctccacagtcttgttcattgctcggagagatttcagccttgcagctttctccttcgactgaagagtcaccaaacgcattcccttgtagctgaaaataagagaatcaggacatgagaaataataacaacactgggcttcaagagttctactgatcttatcgatgtagcatagcactgcaaataaccaaatggatgggaataatagaaaagaaagaaagaaaagaagaaaggtttcggacctggaagccagggaaagtggaagaacacgatccgttgcaacaggaatatgtggtttcaggcgatcttcgtaagagaatccccaacaagaacgaagagccctgacataagctgcaagattttgcttagtatcaaaagactcgagatgatgctcagcccaaccgctttccatctcaactaactcattatcctcttcttttatccgcttacaccctgtttggtaaatggcaaatgggttatggaggttggattggtagatggaaatgagtgagtgaacagttaggattaactggaggtgtaaaagaatggatgctaggattgaatcttacaccttggttggtattcccaaaggccaatgttaagccagcactgaaagtcctcatcctctatatcagcaaaactgcaatgacaatatcagaaaccattggccgttagatctacgaagactccacttccactcaccacaaaatgtaaattgtgatctcgaaccttggcctgtagtgcgcttcttcgcccatgagtttcctcatggcctctttggaaaagctggtatctatcattgcagtataaaatcacgcttcacctgtaggtagaacaaccaaaacaacctcattattgaaaaaaaggagttaatttactcaaaaagcaaccccatagatgataaaactcgatccggaaactgatcggaagcaggcccaattcctaaccagctcttctcatatccacatggaaccaggacacccaaatacatccaccagctatggaaaggagatcaggagagcgcctcaaaattactaacacaggagtataactccaaagctaaaaccctgagcttggtaagaactagccagaccgaaacggaggaaacaacccaaaattaaattgatcaaaaactcaatccagaaatcatattctgcgacgacaagaacctaaatcaaaccatgaataacaatctaatctcaaacgggccgccgtcgatcgccaggatcccaggaaaaaagtacttcctccgtttcacaatgtaagtcattctagcattttccacattcatattaatgttaatgaat

SEQ ID NO: 47208 - DNA, 23399 bp, Oryza sativa
cctcatctaacagctaggattaggattgctaaataaccattttacaggctgaaaaaactgcaaatctttctttatctctcctaaagcaggcagggcgaggcctgggggaaatctcatctaagaatcaggattaggattgctaaataaccattgtgcaggatgaaaaactgcaaatctcttttatctctcctaaagcaggcaggcaggcgaggcctgggggaaatctcatctaagaatcaggattaggattgctaaataaccattttacaggctgaaagactgcaaatctctcctgctaagtcataggtgacgtcatgcatgttaatattattacttcagcacgtcataggtgatgtcatatatgttaatattacttcagcattatcttgttggtgtatttactccatatataccacttatgcttccctagtttcttggattattttgtgacataaaaaaaaacgaatgcaaacatgagacgagtatgcatgttcaaaatcacagaaggtgatgtgtttaccgaagtcataactcttataccggatacagtcttgtttccagtaagcatgatactctcatttgaggtgcaaattaaacaatataaagatctattgtttttgcgaatatcacaagctctctgccatggctagcagatgcacaaaaaacagccattgccacaaagatgatgctggagctccaagggctttgatcctgcaacaggtggcatcgactaatatgggcagttcttggggagattgcggatcacgttgctcttcattccaatcttggttcgcatggtctccacacctgtcttgttcattgcgcggagaactttcagccttacaacttgctcctttgactgaactgtcaccagacccatgctcttgtagctgatgaggagaagcagaaatcgtgaataacagcatcaaactaaggagttgctaagattttattgatgtaacatggcagataaccaaatggaggaaaagtggacaataggttcagacctggaagccagagaaagcgcaagagcacgatctgttgcaacagaaggacgtggtttctggcgatagtagcgaataaattcccgagaaccaagagttctgacacgagttcctttctcactcttgttcgttattacaagctcagccccaccacttcccagttcaatgttatccttgtcatctgcagcaaccaactccttaccctccacatcagcataactgcaacgagaatatcagagaccattggccgttagatctacaatgattccatgcattcaaccaaataaagaaattttgatctccagtgctaaccatagtacctacaactagggctctgttcaacatgattatgatacataacggaggaagaactagtatacccactatctatatcatcccttatggaggaagaattttgatctaccacatgatttttcaattaaatctatagtgctaggattgttctattataaaagtctcactaccagtctgagaatataattcagtcatggaacataagggtcaaaactcaacagacaatagcaaaaactattcagtcatcaacagcagatgctcggggtctctattatttgtaaaacatgtcaaacagtagcatggcacacaaaatgttagtgagtaaaccaaggtacccgaaacccacagtgcaattcatttatgtttaactcaacattcaaacataataatgaaaacaagcaatattgaactattgtaagaggaaactcttaatagaaacctgctgctgtaatcatagaaatcttcaaggtcagcatcttcatcatccccaccatctccatatcgtactttgcagtgtccttttgcatccatatgctttctcacagcctctagactttggaaaggctggcatctgtcattgcagtataggcatataaaatcacgcttcacctgcatacgataatcaaagcaaccttatgattaagattatagtacccaagaaaagtaaaagagaagactttacacaaatgaacaatgcctaccttcagaccaacatatataagaagaccatttggatctttcaagtattcgctatcaggtatgaaaaacccatgctttttgtgcatgtggaccatgcaattctcaatggtgtcatgctcaagatcacacatgaagcagaatgtgggatccaactcttcaaactcatctatctcatcatctgatttggaggaatgctcatctacttgcatttccgaagtcgactctaactcacttgggtccacttcaacccactcttcctcctcatcttcatcttcatcctcttctactgcagatggagccctgcgttgaactcgctcaggacgaggcttgactatggtaattccagcaatggatgcattaggctcctgagaagctttcatgagatgtgatcgtgaattaagatgttgggcatgagcttttgagctcctgtactcctttccacaaagagcacaactgtagagcattggagtgctatcagagttgctcccctctgctaaagcagtttgtctagccaaaaacagagcctcagtcactccaggaactccagccacctgacacagaaataaatgtctcggtcttagtctcacagaagttcaattaataattctctagaagcatgttttccaatcataatgctcaagatagacaaatttctagcaagtatgcttctacaacataatgtcacacatcgacttgcatctatgttgctccctaagaatttacccaacaggaagcatgctttgcaaggataatcataatgagtaaaatagtttgtctaaaacaaaagatgtaaatctacatcaactatcccatataggtttttgtaacaacatgcgggatatttctactgggaacacgacaatgcttttttaaagggcatctcatgcatgaacaaattcaccaaaccacagccactcaatgaaatctctgccagcgccaagaggccaacagagatgctcgtgtaagtgtaacacatatagaaagctctcctctcgagttaatcaaagcattagagcctccagttcaaatttcggccaccataattttaccactaatattgccttaatagccataggaaaatattcatcctgaaattctccaaaatccaggactgaccaatttcaggtggaaaaacaaactatttccaaatttccaaacttttaacaggcgacttcaaaacaagagcaaaattccatcactgaagagttcgcatgggcttttcctacactcaaagtttcaaattcggtccatatacgcgcaacacaccaaagtgcctaactaaagaacgaatcatctcctacatgaacggaaaaaaaaaaccctaaaaacaaaacacgctccctaatcgacctaaaaccccgagaggtcgatacagataggaaggcggccaggccaccccacggtggaaggtaaacgatagtaccttgcgcttgaggttgtagcggtgccactcggagcggtagtggaggcgctgctgctcctcgtcatcgaaccccgcgttgcacgcgttgcaggtcaccgtcggcatctctcccttcccccctcttcttccttccccctcgctcttggcctcgattggctttggctttccttgccggaggcggaggcggtgaagctcttcctctcctagtctccttcgggtttgcctctccgcggcggcgcagtgagttgcgggagaaaaatcgaggagtggcggcggcggcggcgggtttgattgggagaagtagaagagaggagaggagaggtcgaggcgaacacgctctgtgctgacgtcggcgcttcggtgaggcctccaccgcctttgggtttaggcccattggtatcagatccaggcctttctaaatgggccctcaatttggactggtaaggttacggcccagtatcctggttaccgaagagaaaagaaaaaaaatctgaaggttctcctccctcccccaaagtgggaaaatgaaatgaaagggaaaaaaaggagtattaaaaaaaactaacgtaagtttttttttgttaaaaaactttcaaatgcaactatagtatagttgaagtgtaattgcattgtaactgtactataactatattgtaaccatgatataacttatataaaacttacattcaactatggtttagttaacttatataaaaaacttatgaaagttttctagcaaatccgaaggaaagagagtactcacgacaacgcagcatctctaaataattacagcacacaaggatagtgactgaataaaaagtgaacatagaaggccaccatatgatgattttctttcttacggatctgtatggctatatgaaacctatgaaattcccttgattcagaaccaaatcacatcgacagtagtggaaaatgagcattgtttctccccaggtggaaaatatttggattttttttaaggaagggcaaaagctttgacacttttgtaaagtttgggaatatttgattatgtgaacccaaaacagagaaaacatgttgctgttctattattgaaaaacaaaggaaaaatgccgctgcgcaatttgcagcctagaacggttaaaaagagaaaagggaaaaagaaggaaagaagagaaagcctcaacgagtataaatcatagaacactgtcactgctactccattgtagtcagttccatctaaagtttggaaataatgaaccagaaataaacaatcaaacaagtgccttaggtgtctgtcagtctgatatgaatctcaagttctctcaatcttaaagcaactttttttttaaaccgtatcttacagcaactagcaggtatagcaacaagctttgcggcccatagctcaacgggcaccgggcagctagcaggtttcaagcaccgaatccaacaattgaagaataattttgaatcgcatggctacaatatgaccaaatattctgttacaaaggcatgaaaggtaaaaatgttgctaagaattcttatatcctaaaaaaacaacatgtgttatagcaacatacatacttacaggcatgcattatactattcttcgtcgtcactgctttgctcaatcctagccttcttcacttgtatttgcatggcagtttctggtcttctcttagcacgatggacccgagaaggtaatcgaatcgttgacaatggcaccatgactggctcagcatcgggtgtccctgtaactcttacaagacagagtcccctgtgatcggcttgtctcaatacaaatgctcgtttccatttctgatcaattttcacttcaataggcacccagggtggcatggcatatgcaccagagaccagcctccttgggccatgacccatttgagcactcggttccctacacacaagttattttgcatcaaatcatttgatacaattacacttacaaaataattgtacaaatctgccatatcatgttcatgcaaatatggtaggaactaccataaacacttattgttatgcgtgatcctacgaggcaatactaacaacggacttatggacatagtgcaagcacaaacatataagaataaaacaaatgcaaacagccaaacattataatctgtaaaagtgcaaaaacttctggaatgaatgaaaaataaaactaatatcagagcttcaggaaagcaatgcaccatggtaggagacaaggagtcacatcccggcaaaaaggagaagtggtaacgatctaactgcaggagtatttgcgacttcaattttttttaacgcaggattgatataataaaagggtaacaattaataactcctataattatcacctataccttgtaataaaggaaactatgcttcgactgttcagaaaatacagcagatggatcttcacgcattgatcacaaggttgtttgaacagttgttaaattaaaaaataaaacggtccatgaggattctttagtatatcgcatgaacttgttccactcatcacttgggagagaacattcagggatgatattcttgtggagaacttttttttaaccaattgtaactatgtaaaaaaaaattcaatcctacattcttatcgcagttttcatcactgaagccaatgctctagaattcggccatagacgcacgcctattaggcgttaggctgcaggcatccactgcgatcaggcattagatggctaacctgccttgggtgcccttgggcaatatgcttgctaattgcttggaattcactagtcgagttggtcctaggtggtagatgccaacactgtagatgtttagtgtctggcgtgttcatgaaccatgattcaaacaatggagcaacatcacttcttatggtgtcactgcacgatttgtcagatagtatctatttccttgcaaacatatctgttaccacatatttctaatattcaacagcagtctaaagcagcccaccggaaccattaaattgccaaaaaaaaagtcaggggcgggaggccaggaagcaccaaaagccatgcacccaagcagttaggagaatatgaggtaaaaaaataaaaatcaccaccacttttgtaggagggaggatttgaacacgggtgggctagcacaccaaccattaactaacaaatccatactgttgcaaatttcagatcgaataactgcagtatcattaggtgcataaatggtaacatgagtagttcaggttgctcatatatataatcattccaggaatggaagagagcatcaataaagctgctcctatggctgctcgcatataagcagcagacatcgtttcattaatcacagtatcacaatcaccttatgcctcaacggcacaacacagaatttccttaatagggaaaaccaaatttcaaatgtgttgtctgactatgcacagacacttgtaatagcttagacctgacactttaaaacacaaggagtagtggagtaccagcattgccaactaggtacaggaggcaattctgtgctcctccttatgttgatttctactgaatcttaaatcagaattggaacatgggcactacctgttttgatacccctacaactctagtcctaggatgaagtatacaagcactccagcacaggcctcgatttagccatgcaatgcgaatcgcaggctcacagcagcaacacaaagcagaactgcagtgacttttgtggcgttccgcacacaacaagactcgtacctagtgagatcctacaggccctcccaaattgactttcaccacaaaccaaatcccagaaccagataagcatctcgagcaaatcggagattcgcaccacggatccatccaattcttttgaactcaaactgcgcaatccccattgaattgagtacaacatactcacgaagtaccatttcacacaaatcgcaattcatggattaattaacaagaggtcctatcatcatattatgagatgggaggaagagagggatgataccgagacccgccggcgaggaccgaaagagcgccgccgccgacgacgaccgcacggagctgcagcggcgaggcggcgagcctcctcttcgcgcgccggataagctctccttgagcgcggcggcggggcgaactcttgtattccttctcgaaagcggctttccctctttccatgctgcgtttccgccttccagttcaggacgcgcccagaagggtgggaattcgaacccgcctctctgacacggaggccccacctgcgggtgacagctgcaattttccccatcccccacgccacgtcatttttctcacgcggctccgatttttttatttttcccgctcaaacaaactccgcctcgtctcgtctcctccgaaaccgccgcgctccgacgccgccggcgaaatggccgcggccgcgtcctacttctccggcacggcgctcatgccatcgcagcgcagcggggcccccgcgccggagtactccgccgccggcaccggcgccgccgccgctccttccccttccaaggttcgtgatcttccgtttcgtcgtaaccctatctccgtctcgttctcccccgaaccctaacgccgtcgaggtttccttgtcagccgcgcgacccccgcttctccggatgcgtccccgccaccgtgctccacatttcccggtccttcgccgccgcgctcgccgcggacggtgggggcgaccccgtcttctccatcgacggcgtcgagaccaccaacgtaggctactcggcacctccacagcttccctcaatttattttccgtggccccgcgtaatctgtttttttttgggtgccgttgatggttttaggttagggttttggggagggtggtgagcgtggtgagcagggatactgacgtgtgcttcactctcgatgacagcaccgggaagatcccactcgttcggtggtgagttgcaattttgtttcccctttcgcattgaatgctgttgcgatgcagtacatgtgacatttttttttctgggattgtaggatcactgatcagtcggatactcgagacacgtcttacattcagtatgtgatgtgtattagtgtataggctctgagatgtgcttattttagtttcagcgattttatattctgttatttatatttcctgtacatatgaagggagggagtgtatgtgaaggttcaagtgaacctcatgggatttcaagctaagaagcagggtcttgctcgatctatcaggtaaggtacttgaattccttttgtattgatgtggtggtactctgttaattcacctagaaagcttctgctcatttgaatgaagtactactatgttttttaaaagttttacctctgaaattcatagttctactggagttacattaattttcaatagcaattatgcacgctctgaagtttgcatacaatgctggcaatctttgttgtgcacttgcacccaaatgtcttggccgtttgctttgtttgaagatcatgggctcacaaagtattattttgtggataatacttgaactctgttcttacagtaagttttcttgaaatatattatatcatttgaatggagtgctaatcttggatgacttgattagatacatggtggatgcaaatttagaagtgttttgaagaaagtatggggatgtttgagataaaggttttattgtatgtgtagcggctatctttcgttttcttttctttttgtatgtttgtgtgtgtgtttgattcttaacactatcctctttcagagtagttttctctgttcatctaagttcaacctgggtatgtcttttggaacttgttgctgattttttttcagatagtaccatcattagctgttctaatttattagatctttgcataaaatgtgctgatttttccttcgttgcacactacctttttcttctatttcttcacctcaggtgttttggaaccttttctttaacttgttcagttggtggacatgttaaatctgttgcactgttattgattgatgtgtattgtatgtacttccttaattgcactcttttttgtcatgtattgcataaccatgttgctatcgtgtatctgtattctatctctgttataccttttctgaagtgtactgttggatgaactactgatcctacgaacaagctggaaactgaattaatcaatccttgcttcgctgacttaattcagtacatttctaatacaagtgaagtaaatggtctgtagaaatactagctcactattgtagtgttagtttatgagtacttgaggaaactatatatatttgctcatttctctgttatttactaagagtacttctattctattaagcttcaaattgtgattcgtgtatttgcaggcctattaacaatttcaacgaagtggtgctacatttcattgagtgtatgcatgtgcatttggaaagtgttcaatcgaaggtacataaagcaagtaattcaatattatggcaattctattactaatttgacaatgctagaagtcattaatgatcgctacctttccattttgaagatgcaaaggcaactccctccttcagtccaaaccaatgaatacactcatgtgccctcatctggtggagtgagggattaccaagttcatttcactcctcaagtaaaccaaggactaccccctgcagttcaaacaaatacatctacttatgtgcctcttttgggtggagttagagatcatcaagctcattttgctcaagtaaaccaagggcagttttctccggcagttcaagcaaacacatctacccatttgcctttttctggtggagttggagaacatcaaattcattttactcctaaagtaaaccaagggcaatttcctccatcagttcaaacaaacacatctgctcatgtgccttattctggtggatttagagaacatcaagttcattttacacctcctgtaaaccaagggcaatttcctccagcagttcaaacaaacctgtataatcatgcggcttcttctggtggagtgagagaacaagttcatcttactcaagcaaaccaagtatgaaattttacatatcgttttgagaattgcttgcttataaaaaatataacatattaatagtatatgatttagttggtatatctgagaactgagatttggttttatttgataatttgtgtcagtattatggaattgagatttttattgccttttccctagcatagtttttagtgccttccgtttaattcaccaacatgcattctttaaggccctctttcttgttacatgttcactcttacctgatcttgttagatcttttatttcccggcccagttttcagcttactcaagcactggtggactacagcatgacccacaaagaatggttttggaagctctgcagcaaccagatatactgtaagtgtattgtcttaggcactgttaaccgatgatagcttattttggatatttggactgactttttatttccacagtgctctcgaacatggagcacacgttgatgaattggttagaagaactggaatgcccaaagcaaacattatgtactctctctctctctctctctctctctcttatgtatatttttttttcttgtgtgttactagtattattattttttaattgcacatgaatgatgataagctcgaccgtttacaatgcaggggggttgtcaagcatctggctgcagcaggcttcgtctattggaccattgatgacaatcatgtcaagtctatgtgtaatggttgatcaatgcaatcatcctcaagactagtatagcagtgtgagattaagtgccctgcggatactaaaacttcgtggcacatgctgtaagtaactcatatagggtgtgactcagtcagtctttcctttcaataatcaagtagatcaagtagggatattatggcccttttgcactcggaaactgtgattgctgaatggatctgtttattactgcatacaaaggtcactggcttcttcaatatacaatttacacttttcatacttaggtttgctaagcttggttgtctgcatatatacttattatatgttatatcactttcttactatgtcaatgattcttttcatgcttatgggattttaattcttattttaaaataatctgctgctttaaccagatatagacttcggtaaattctgattcctcagcacaagtggctacttaggttttgataaaagaaaaaccttttgcctggtggtttgcggttgtccttgcttatcaaatacattgtttatgtcttgtccaattcattgcaccatgagaatggaataagaaacagtaggaatgatagataggggtttgcttatcaatgtcaggtcaactactatttgtttttactgttcattgtgcaatgcattttgtaagttttagttatctttactctttataggttgtcttctcaaaagtatgcttatcttctttgggcattgtataagagctttagtgtacttttctgaggtgcatttcttaattgctatctagtgatcataaaggtacacgtgctatcctaaagtttgtgcaccaaggattcttaatttatccatctaactaacactagtttgctaatacgtgcactagcactggaaccccctacatcttattcttatcctagatcattcggtattacatttattctgaagattacatacaatagctatgataaattgactataaaacgtgtagaaagaagtcaatatcttgtttgagatggttctaaaacacccttggattaggtacactgttcgattctctgtcgtgacctgttttaccacgaatatgcaaaagattggcgctgtgcatcacttcaactttgtatttcgaaaaaccaaaatacaacgttttacatgagaaaccttggcctgaaaaaagcatctaaggctactactctgaaataaagttgcggttctgctgttttgaataatcacgtgtccatttttcccctgtatttcactcacatcggtaaagaaatatctcaaggctgcacataacatgatgcatttctgtcaggtccatttggtcttgttttccctgtaactctttttagttttcttttgaaatgaaagtagtttcttttctgcattcttatcagcagatttcctttagttgtccatgcataaatatgttacgatgctcaacatactgaaaccattatggagatgaaagcaatatggcactagttcttaaatgcacaggaacgtccttaccagcttattttcttctggtggtgcattatgtggtttctgataatatattaagaaagatataaggatgaaggagtagcaaccaactggacatgtttatctggatctttctattgatagacaactctctttaatattctttaatcatgtcacaaacatttatacattcatcttacaccttactggccagcattatcaatgtgtggtccttaccatgtctagatgccttcctacaatccagcatcgtcaaactataccacgggaaaaatgggctgatgcattataaaaagtgtagtcttgcatttatctttgtgagggaattttaccatgatacattaataaataaattaggttaatgagaacttttttccactaagtgctaatcttaataattctagctatatttcagagaaacttatggtattgttgaacatcgcattcttccattcctgtctaacatttgctggtggactgtcagccactgggtcaacagtttttgtcaggcatttagttgctatagctttgcaagtgattacaacttacaagaaagagatggacaaattgctcatttcaatgtattaggtccatgctgaagttaatcttatgatagctgagattcgttttcctactgatcatgcaaatgttgctggtaattacaaagtatttatattgtcgttttcataggattctttttcctgccttgcatttttttttgttgctggaaaatgggaatgtttgccttgtggttttttcagggcatttcatctccaggttgctcactgaaccttctgtttgtcttagtttaggtaagcactgggaactgtcccactctggtttgatcagttgatcttttgagtatctcatatctgctagccacggtaggtttgactgtgctctaattctgaacccctcacttctcatttcttggaaccaagcccttgtttctttctccaacgagtcagatttggtcagaccttgcacgcttggataagcgttagctaagccatgtgtatgtaggtatttggttctaggatacctaaaagtcttgagggccaattattgagagctgatatattacatgcatcaattctttcatgtaccaccggtttctcctttttgctggattcttttcttgggacttctctcacaggtgtagaaaccacctcaatctgtcagagaactatttcagaccaaatcatttggcacaacactgaagcaagcacaaaggtttcaggttttgagtgtaactgttcatagtgtagtaccattagacttaaggaacacgcacaaactttgcccaaaaacaagcacattattagtaaaccatacgcttggaaaccaatgtattgtattcccacctttaagcttttggaccaaaatctctctttctcaaggatgtttttcttgttaagttctaggcacacgcctagacatgctcaacaacttccagagtctagagaagataaaaacacacctgctgcacttcacaagttcacaattcacctcaacaactgccacaaccattaggattcatatctgaaggagcatccagcagcaggcaatttaggtcaggatggggtccaagagtcgtacaaatggatgcagcaccagcacgtaccctggctttaagggggtacagctcaacctgttccaaactgccatgccacggcattgcactggccttgagaaattggcacagcaaaacaaagcctacttggccacgaacccaactgcccgccttataaattagtgccacgctgtgtcgccttcatacacctgtaacccagctgaggttgcaggtagccttgactggtactctttcttcaaagggggggggggggggggggctctatcatcaaggtttaggtcagcctgtggccgacaaaatctcagtttgcttgctactattccgctgccgaattgatacattcatcaacacacttcccccccgtattttatgcgtgaaagtacactatcttttgatgttcatgtcaagatcaattggactggtactctggtattggtactacttgcttttcatagcctgttggatgatgataagatgaaaatcctttctatttacaagtgggcccagtggagagtaactatcaaaaatttcatcttgtaacaacatcacaagcttactcacaatcttagatactattactaactactaattgctcaaagatgatgagcaagaagatggggatgcagtgttgaactcctcttcatcttcgtcatcttcgtcatccaggtcatcgaatctccatagctcctcgtcgtcgtcgtcctccactgcctcgggcatcgtccaccgttcttgccggatctcgacgccttccagcagctccagcacctgctaccacaaccaatttatggcctacattactagtagtgctgttgcaaattacttgtgttgttacacgtaaaccaagcaacatcatcaaaggagtagtttgtgggttactgctacatggagacatgtgcttggggggcaccctgtcatgaatctctgccctaaattatgactgtttacatggaaatgctaaccatgctgatgaaaaaaatatttgcaagtaggtaaagcaatgtagtgttccatcgcagcaatcctacttgagaaatgggcaagcgttcgttgccttctgatcaaggaacagagtgtgaccaatcatgtttgttacctcggtcatggatggcctccacttcgccgacgagcggatgcacagcgacgccacgaacgccagccgccgcgcctcctcgccgtcgtagtcgccgccgatcctcggatccaccagcgactcgatcctcccctcgttcaggaacggcctcgcctgcaagtgcagggtcacaattcagtgacagtttcagaatttttcagtgatcaaacagtagttatactgatcgcgaatgctgaattacccagctgagcaagctcttgtggctgccatccaccggctttctcccggtcatgatctccaggaggaagacgccgaacgcgaacacgtccgtcttctcgtcgacgatgccatgcgtgtagtactccggtgccaaacacctggaagaaaccatgtcatttcagccaaaattcaccgtcaaacccagcaagaattcgactcgaccatgagcacagaaatctttacccgaatgttccttcgatcggggcgatcgcccggtgcgtccactccgacggcagccacttggcgagcccgaaatcggaaatctgtgataatacgatcagttcatgtcaattgaaacagaggaggtgaggaaaaaatggaaatgtggtggatgagatgcgcctttttttttttgaacggaaccagcacaagattgtgcttattcattaaatatagcatgagaaaaatacagctcctaaaaaaatttggattatttctccatttgtgcgtgtcatccttgcgtagtggccatgctaatctttgttgtatcgttccaattttatcggatgtctccgaagagactgacctgaggctggaagtcgtcggtgagaagcacgttggatgccttgatgtccctgtggatgatcctcctctggcaccccttgtgcaggtactccagccccctcgccgtgccgacggcaatggcgcgccgcaccgcccaccccatcgccggcgccttcttctcgtctgcgatgcagcaatcaaatcaaatcaagaaacgtcaaaacgccattaatggcggcgcgttcgtgctgttgctgttaggtgtcgcgttcgtgtcgctggtaccgtggaggttggcggagacggagccgcggccggagaagtggaagacgaggtagaggtcgcggtcgacgcagcagccgaggagggcgcacacgttggggtggcgcgcgtgccccaccgtgccgagctccgccaggaagtcgcgctcccgccgctcgcacgcccacgcgcccatcagccgcttcaccgccacggcccgcccgtcggggagctcgccgcggtacacctccgacgacccgcccttccccaccaggttgccctcgtggaacgcgttcgtggcgcggtggatctcctcgtaggagaagcaccgccacgccggcttccgcggcgactccggcgccgccgcggcggcggcgggcgtgtatctctccttggcggcggcgtcgccattgccgttcttggcgccgcggtggctgatggagaggagcagcttcttgaagctgccgctgctgcgcaggtacagaggcctcatctctcccctcgacgacacaatgccctgcggtgcggtggcgatcgcggcgtcgccggcgagcgaggtgatcagaggaggcgaagcggaggagggagacgagacggcgagctggtggtggtggcggaggaggaggaggagggaggcattgatgggtactaacgccgaggtgctctcgcgagtgccgcgcgagccgtgagcaaatatgaacgcgacgaggcgtttcgcggggatacgcacgcgctggtcacgcgtggacacggtcctccaaggaccgcctctgcataatgctatagcagattagcagagcaaacattctcctgaatttgacactggattttggtaatctgtgtgagatttgagaaattcttgtactgaaatcttgattctgtccgatgcatatgatcaacagttcatatacaacatgtgctcaacagtgttaaggccttcagggtcgttgataataatagcgaagttggtgatccatgaccatgttgcgcaacatgtttataggttgtaccaacacaaataagagcgtcatgaccttcttgaagcatcatcttcaagatcttgtttttccattgtcatgcgcttctctcagtttggttttcatcgttttgtcagttaccgttattgggttgtcgtgagcgacgagtagatattttctctgtgaggataattggagcccactgtatatcttctgttttagcgcttgtgttgggtgaggcgtttatgaccattataggttagcggcgttcgatcacacatagcagtgatcggtatggtgctagtttttttttctctaggaatgtatttggagctgctagcatgtgatggcgttgtgttcgtcataatcttgtatttttcatcgtgatttgctttgttaagaaaaaaaaaacatctggaccactctgctttccctggtctgacggagtgtgcacatacacaggtcacaggtggtgccgtggaacatgtctagatgggagtgtgacgacggggacaggcggcagcgtggaacggcagttgcttataaacaagggaaggaagcgttttcagcagcaggggaagggaacggaagggtgcacctcctctctctcttctgtccgtcttctctgtccttttttgctagtaccggttccactgtgcaaagggaacctgtctcgtgccatctagtactagtgaacaacacaacactcgccacctatgtgcctacgtgcacagtaacaaaaaaacgtaccgacggtgcgtaaaaaaaatgaccaggcatgtgagctagtagaatcagctagtagtaggagtatagtcacagtagtaataagcatcgtcacagatgtcaaacgtgtccttgtaatctcgcccgtgctgacactgtcgcgaagaaagaaaattttgtgctttgtacatgttagatttaattgggtaattaatccatttaaatcaattaaattaaataaattccaatgctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggttagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgaaaaaaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggactattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatccaaaaacctgataggtcattttcggtagttggctttgctgctgcactgaaaccacatgcctttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgttatggagcagttctatgactacaagatggtcgatgaccgttctgtagttgaacaagctcatgagattcagatgctggctaaggaacttgagaacaacaactgtgagttgccggacaagtttgtggcaggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaagcaagggaaaggcaaagggagactgctttgtgtgtggcaagtctgggcattgggccaaggactgtcctaagcgcaaagacaggaagtctgccaacatgatcattagcgagggcggaggaacatcggggtacggtaaaatattacctacagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttaactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgttggtataattcttgagtccagagatgctacattctttgagaatgaatttcctatgaaatatacacctatcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcaccagttgctcgcttgaccacgattcgagtactacttgctctggcagcctctcatggtcttctcgttcatcagatggacgttaagacagctttcctaaacggagagctggaggagtagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactca

SEQ ID NO: 47209 - DNA, 23676 bp, Oryza sativa
  unsure (1)..(23676): unsure at all n locations
cttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacagtacatgactcgtgtcgcttgtcagtgtcctagcttatgctgcgtctcatttcagcatttatgctcttgtcttgggctgtatcagagcctgggccatgagcccacgatgttgagaaggccaaggcccgtttgacgcacactcctcgattggacttgggcatcctaccttttgaatttgggtggatgtgacccctatcatcctaaacaccatcctaatactatgaatctaaaccaatatattatatttatctaaagttctttatattttaggacagtgagtactacgtagtactactaactagtactaaaagcttgttcactttgctaccatttttaacattatcaagttttggcagtgctaaattttagtaaggttacttaaaattttggtaaggttatcaaattttggcaagatttcatatgtggttacttcctccggttccatattaattgacgttttggacaaggttgaggtcaaacttttataactttgaccatcaataactttaaaaatatttagtttaaaggaactagaacaacatatatagatttgtcttttaaagtgctataataaagtaaacatgtatttatttattatatatattataataaaaaaataaggtcaaaatatatcttatagaccgtgtattgttaaaaacgtcaattaaaatgaaaccggaggggtactaaaatttgacaaccaatcgtttttttataactttgctaaaacttaataatgttgaaaatggtagcaaagtaaacaagtcctaataaactgagtcgttttagatctatgcttctcgtagctgctttgcctatccttgcagctgtcaaccgctagccactatctctgctatctttcacattagttgttttacggggtgtttagatccagggtataatattttgacgcgtcacatcgaatattatatatggtattgcatggggtgttttgatactaatgaaaaaactaattacagaatccgtcagtaaaccgcgagacgaatatattaagcctaattaatccgtcattagcaaatgtttaatgtagcatcacattatcaaatcatagagcaattagtcttaaaagatttgtctcgcaaattagtcgcaatctgtacaattagttattttttagcctatatttaatacttcgtataggtgttcaaatgttcgatgtgacagggtgtaaaattttagggtgggatctaaacatgctagtaggctggtaaaattttagcctatatttagtttgtctgttcttttttctccaactgtgatagactggtagttgctttaatttagtttgcctaggttctaaatgacttctccatggtaaagcatgtgaagtctgtatattcaaaagaactaatagtgcttaaaattattactctcctcgttccaaaatataacaatttttaactatcattttagacataaccttatctagattcgtagctgaaagttgttatattttgcgacgaagataataagaaattttttgtcaacgcatgaaaaatgtttgttcactgtgaatatcagatgatcatgctaagcatggcaaccaaagagatgttacctactgttagacattgtcttcgtatctttcttaataaaaaatggtgggacccacctaggagatgggagagagaaggaagaagaggaggggtgagtgacatgcggagcacacgtcggccccaccatttttattaatttgtgtaaaactgacatgtgggtcctatgaggtttattatttttttaaatcgaattgacatgcaagcgctacgtcaattgcacatcaaatgaatatcaagttaaattagctacgtagtcactacgtcagccaaaaccgctgtccaaactgccgagggaccttatctacactggttttgataattgagggacctattatatctggttttttggtggaaggataaaaatcagattcgttcacaagttaaaggatctcatataaacttattccaggtctaaaagagcttgtgaccgatcagccactgcccagtgcccactggaattgcaggagtactaaggcccctgttcttttctccaataaaaactagataaacttttagataaaagtggcattttttcaaacggttaaaaaactttcatataaagttttttaaaaaatataagattaatcaatttttaagtttgtaataattaaaacttaattaatcacatgttattaccacctcgttttacgtgaaacacttaatctttatttttattttcatcttcagaagatttaaacacaatctaaatgagtacattgaatttcttgggcaggaaagtggcaacggctctgcggccactcgccacttcgccagccagtctgccggcgtagcagcatcgccagtcgtcggttctaacgctagcagaatgtttgggccgtaatcggttgcacacgtctcacgaatgggcctagttgtatcatttgggccggtcgacttggcaaacaaccgggctgaatgggcctactctggtgaaacacgatgcgtctaacagcccaaggagaacgaaagccttcagcttcctcctctccccctgactcctggtctgtttctttctcctccccaatccttcgttcccagactcttccctaacaaatcctccatcaaatccccccaaaatccctagcggcctgtttggttggagggagttattaggagggattgggagtttagagggatgaggctattaagagttttgtttggttgggatacatgggaattttggtaggatggggatggggaattgaggaaggaactccctccttttcaatacctgggtagaggcaggtaattgggagggaattactcatttattttttctaagcaaatctcagccatctatttttattaatgacataatctccaactaaactccctatcaatttctatcacctctaccaaacaagatattgggattaaaaatcaaattcccatcttaatctcatcatcaattccctcatgcaaactcccaatccccttctctcgagttaccaaataagccgtagaagttttgtatcaggtgatgaagcaacctgacgctctgccttcctgcagcgaggatccgacagattttcgatggctgatgcggttcgtttctttcttcttagtaagcccgtggttactggttaccatgtgttcatggcttagtttttgcatgattccaatccaggagcattagcttatggtgtgccatggtcgtgcctaggtgccggcagtgaaggcgagcatgctgactgtcactcaaaatgccggtgcagctgtggctagcttcagggaacttgccttgtttcttgttcttgttcatttcgaccgttgtgccaccggaatcaccgaatggtttttgtccttctcaccgtcccattttaccatcttggaatcgttgcatctctcagactctcacagaaaaatggagaagaaatgttggtgctcactcaacatcaacaacttggagacttgtttacattttggaaaatggcatggagtcgctgcgtcctggtacagtatagaggagcccgcttgccagaggaatttggagaagatattttgttcacgcgccggcgaaaggtctatatatatgctgccaaccatgttcttatccttaaccttatgtattatgggaccaaaaaaagctgatatgtgagctctgaagcgaatgttgagcccctcggctgtgaaggtgagatcactaccttgtttttgaagtcctttacttttatactgttgcatatctgtaagattatgtctgtctacttgcgtacaattgttctagttggatgaatcggatccagaattcacttgatagttcattgactaaatttcttgctattacgcatgtaaccagtagagttttacatctaccgttcctatagctatttttcgtggtccttgcagtgatcagctgctagctattttagataatggattagattaaacccggcctctacaagctattatctctgctctcttatatttgtccaactgtggtagacaaagatattggttttagtttctttacgttccaaacgactttgctctttcacactcctggacgtggagaatatatttctaaaattgttaagaaaaaaaattccacgtcataaaaatgttcttccactgtcaatatgaaatgggcatgccaagcatggcatcaaagaaacgtatctactgttgtacattgccttgaatctgttggttacggagtatttttgtagtacccacaagcagggtttgaaattttggtaatttcgtcccccaccggcaagctcacatctcgcccgaaattttcgttttttttcattttttttgtgaatttggtcaaaattttattcaaaatcaatcaaaatttcaaataatttcggcaaaagaattcgaaattttcaaaatttcgcaccccccaacgcaaaaatactaattttgaaattgaaaaccctgcccacaggtacactatggcagaggtgagtatatcgagctttgcaatcaccgttcttgaaaaagctgcgtcttttggcactgactgggctgttagtgagataaagtcagcttggaacgtcaagaaagaactagagaagttggaaacatcactgagatccatatgtgctgttcttagagatgccgaatgcaagcagtctacttcccactcccttcaagagtggttggacaatttgaaggatgcagtctatgacatagacgatgttctggacgatgtttctaccgaagccctagagcaagaagttcggaatagtttcatccatagaacaaggaacatgcttacttatccattcaaattgagtcaaaaaataaaagaagttcgcaaaaaacttgatgagatagcagccaatagagcacagtttggactaactgagcatgtaattgatgtccatacatctgggagcagcaacagggaaacacattctttcataactgaaccagaaattattggaagagatgaagctaaacgtaagattgttgagacgatttgtacagctacagaatcaaatcctttgtctgtgcttcctattgttggtttaggaggcataggaaaaactgcactggcacagctgatttacaacgatgtacaaattaccgagacatttcagaagaagttatgggtatgtgtctctaatgtatttgatcttaagaagatcctggatgacataatgcagtcaggcacaggtaaaagcaacaaacatttaaacctagagatgctacagagtaaggtgcgtgggtttttatgtgaaaagagatatctgctagtattggatgacatgtggaatgacaaagttaatgaatgggacgagctaaaatgcctactatccagtggaggaagtggaagtgtgattatagtcaccacacgcaatatgagtgttgcatcgatagtgaagaccctagaaccatatgatgtggcaaaactaactgatgataagtgcatgcaagtattcatgcattatgcatttagaggtggcgggccacatgaccctaagttattggaaattggaaaatccattgttgagaaatgttgtggtattcccttggcagcaaagacattgggttccctattgtgcactagtcatgatgttggagaatggcggcgcgtcatggaggataaaatttggaatactgaggcaaaagtatatggtctaatccctgcattaaaactgagttatgatgcacttcctccccatctgcgagcatgcttttcttgtttatccattttcccaaaagaccatcagttgttttattctactacagtcatgttatggatggcattggggatgttgaatacaggcaaggaaagcaaacaaatgatatctgctggaagtaagtgctttcatgatctcctaggaagatcgttgttccaagaccaaattattgtttatgatgaaaccattcaaagctgtaaaatgcatgatcttattcatgatctagcacaattcgtttcagaaaatgagcatgctgttatcagttgtgaaaagactgctttctctaaaagggttaagcatctagtgtgagattgcaaggacttctcaggagagcacgaatttcctaagcagttgaaaaaggcatgtaaggtgagaacattttcaagcatatacaattatggtaccgtgagcaaaccttttcttgaggtcctcttctcaacgttcacgcttctgcgtgtattgattttttccgaaactcactttgaagagctgccaagttccatcagaaatttgaagcacctacggtacttagatctacaatggaaccgaaaaatcaaacgcctaccaaattctttatgtaggttggtgaatctgcaaacggttcatcttgctcagtgcgaccaactagagggcctaccaagagacgtgcatcaacttgtcagccttacatatttgagcctcacgtcaaagcagaagtatctactaaaaagtggattttgtggttggcctagcctgacgtttctatatttgcatcactgcgttgagttaacatcactgacagagggattcggcagcctcgctgccctgcgggagctgcgcatcttcaactgtccgaagttggcttctctcccctctgcaatgaagcagctctcctcacttgagaaattggtgcttaataactgcaatgagttggatttgatggaaccaggggaagccttgagcggcctgggcagtcttcgtgcgctcaaccttgtggggcttccgaagctggtgggtttctcagcgagcttccaatctgctgcgtcctctcttcaatatttttgtatcggcgattgccaagggctggagaagctgccagatttcatccaaagtttcacttgtcttaagataattgggattcgtgactgccccgagttgagcaggagatgcacggctgaatccggcgaggattttcatctcatccaccacgttctgcggatttacatcgacaataaaatctgggaaaaggtaagtccgccagctccaaaacgcttattgcgtgttgatctactcaggattttactactgtatgaaagggagttagtttttgtttgtctgcacttttgtgcattgatatgtgattatctcctgaacatgagcttacctctttatccgtctcattttcttgcactagaatcgtacgtgatgcccccctgacgccaggcctgtagagaaccggctggtttcaagactttccgctcaaagaaaattgcattcgaatatttggttggagtggccttccaggctgggcgtccatactctgatactcctcgtgtattgaaggcttgaagcgcatcatgtctgtgtcatttgtgctgcaccctattgtgtacgcatacatgttcgttccatgcatgcatactttgtgtgtaataattgggtacatttgctaattgctacatatttgtgcaactttcatgtgtaacaaacggcacaaacgtactatgtacggatgtttgaactggatactcatgtttgtaactttgtatttctaatatcacatcatttattttgctggtaacaatgtgttttctcctctctgaacgagtgagcttcagaggagttactggtaacaaatgtatactcgtgttttcatgggccaaaagagctggatcgtgtttgacagagctggatgggcctgtttgatgggacggatgcagtcataggcccaaaatgaagatggagagaggaataagtttacttgagatccctcaagttttcgccgaatttgtccctgaaccgaaataggcaggaataactcatctcccaaatcacaataccatgataactttatcactcgacagtacagtggccgatcaactttatcccttggctggtcggttttgtctgatgtgacgagtaagacccacgtaggctcatatgtcatcggccaactcttcttctcctcctctccctctccctctttcctctctcttccccatctctctagggcagtgcgtggcgcctccggaggttttgcgtgttgggtgctgccatgcgcgccgtcggctcgcggacgccgaggacatgtgcgaggactatgtgtccgcgacagcgtcgtcgttcgggaaggcgctcctgtcgtgatctcgtggatgaggcgaagcgagctcaacgctgcctccgtagcccgccacccgctctcgacggttgggagcagcagcaaggcaaccttccatcctcatcccgcttctcctcctcttcctcctcaccgtttcgacacgactagttctctcctgccgccatgcctcgccggctcgtcgccactgagatgctcgacattgtcgcgtctctgtctcgggtgtaggccttagtgtccacggagaccgtgttgctccaccagtccactgtcgtgtccacagaggttgtgagggagcatgaggagggactagctctgtggctccactcccgggccttcttgtcgaggagcaaggatgacaccagagtccagagctacaggtccctcgtgttagtccgcctccgccgtgactcggcatgcaccgtggcgatggtgccggagccggacgggcgaacagggtgaccaggttcaacctgatgccgatgaacgtcatggctttcgaggcattggcgactaggcggtggagatacccgatgacgatagagttgtattgatgttgtacaacaatggttgatgaccctgtctatgattcgtagcaaagcagttggcggtttgatccgattggatttttgatggcagatgccagtttggagtggtcaaattggaccatctactgggcaatatatgttaagtttgatgaccattattgtttagactaggttttggacaacttccactccctcgtttttcacgtgcacactttccaaactactaaaaattttatataggaaagttatttaaaaatatatatattaatctatttaaatttttttagctaatacttaattagtcatgcgctaattcaccactcagttttgcattaagggatgaaggattttcaacctctaccatcgaacgcttgattaaaatagcagcctgtatcgcgggcttgtggcctacaagcccacaaggagatgagctcttcgatcttgtgggctctaacatgtgataattagtcaaaaaaattattgtttttcgtttttcatatcatctaattagtctctactattataaaagttgaagatgtttccctcgaaattttgatacgtcatccgtatttgaattggttttaattttatgtttcggttttaattttaattcgagaaatttaataaaaaatttgtaaggcttgctttttttttctccgtccgaatgtttttcgtcgttgtttttccttcgtggtttttttattttccggttcttgtatggtccggattatttttttgttgccattttcttccgtcgcggttttttttattttccggttttcccgccgctgtttgttgcgttgcgttttttctctcgaaatcagcgaaatcaggcatccatactacgggacctaaattacacggttttatataatttaggggcgaagattttagtattgaagataaaggatatcaaacaaactcgacgtaaagttaagggacagcaagtgaacttattccccatcgatttccacgtgggggtctaacgaaatcacggtccggttcattagcacatcacgaaatctgtgggccattgttgttgtgtagttcggcctaatcagatggagctgacttattagctagcgatggccgggttgctgagctgagtaaaataatcagctttgtgttgaatggcagcgtcacacaccatacatagtggatagctctgatcactctcaggagcacaatctacattacttgcagtattgcatcaccaaggcacgccaatatggacgactcaacaaaacaactcttttgtaccacgatctctatctacagcaggtgtttttccacctcaaatcaaatttctgggtcaacaatgatgcgaactctggtggacaccggagctgaacttgtgatggttatgtctatcgtcttgctcgactggccaatatatgtcgatggcctgtcagtactagcacctccatcagttagctcagttggcttctttggatctgataatagtatgctttgagagttcagaactctagtaacatctgtcattgtgggccgttctgttggatcttcttgagcacaaagaagcgccacctgagtgcatcgcattatcacagggctttcatattcatcacacaatgctgggtctacaagctcatgcaaccttccatctctccacatatgccatgcctgaaatatgttacagttagtcaggtgcccaacacaaatactatttgctagaagaagaccattaaaacaaatactcacgtctcgaatgagattgccaacggtatccccttgtttctccattatgaaattctttcgtccactaatgatttctagaaccacgacgccaaagctaaacacgtctgtcttaagcgaataacggccttccgatgcatactccggagctatgtaaccactggaaatggatagcagaggtaggcatgagaaaactggaacatatatgttgcactgcaccattctttatattttgttcagctcatacctggttcccacgactctccttgtacactcttctgctacatctgaaaccagtgttactgcagatccaaaatcagcaatctttgggttcatgtcatggtctaagaggatattatttggtttcaaatccctatgtacaatcaaacagtgcttgtgcaggtaaagaagcccctcagctagccctttaattatctgaagtcgcttagaccaatttagcaatgcgcccttccttttgtctgtagaatgattgcaaaagaaatgtactttagagaacatagtaattgcttacatactgttctttatcaaatcaacatagttttggaatcagacttttgtgtgtgtgcatgtgtgtgaaaggtgtttcaaatgtgttgttatcagaagcataataactgctttagtatgtgcacatttattaggaattggattaagcccgtctcgcaaaacgtattaaaaagagactgtttaaaacttacggaagataatattgtctaaactgcctttctgcatgaactcatacacaagaatcttttctttttcatgaatgcaccatcccaataacctaattaggttggtatgctgaagccttacaagctgcaattcacttttgaaatcaaatattgctgcatccacaacaaatcttttgatagcaactgtatgtccatcaagtagctggccctgcaatagaattcatgtagcattctattataacaaatcatattttgggtagacaaggagtatctaacattcatcaccttgtaaacagtaccgaatccaccaattccgacatttctgttctctgaaaaaccatctgtagcatccacaagctgaaagaaaccaaacttcctaaatcctggatagttctcttcagtttggatacaaagtctcattattgcctccatgtccattattttctgttcttgcaggtccactgttactggatgagtggtaaatgaccccatgtcaccaacgcaatttggacaaaagttcaataactaaaaatgagaaatgctcgacttctttgtacaataattagtgacttcatgatgtgcaaaagatatattacttatgtgagcaaaagatatattcatggtgtgcgaaagataaaacttgatgagaacaaatgattttcatcatgcactttatctacttcacctagtgtaaaaaatgtagaggttttttactgtccttggggttgtgcagtaccaaatcctaaccgttgatctggcatcatctaacgatcagaaatcgttcatatctcatggtactgcacctccttattaaagcggtatcatgggtggaagggtacttctgtactttcgcgtggggcatctctttctttcgcgtttcgcttccttcacgagagggaaaaatcgtcggggaagagcagcgagagatggcggcgagggcacgggcacattcccggcggcggcctcgatgcgcgacggcagcagcgcggcggccttgatgcgcgatggcagcagctgtgggctcgaggcggcagcggcctcgatgctcggcggcagcggcgagctcgatgcgcggcggcggaggcggcggcaacggcggcctctctcttcctcctttctgctgtgaatattgttgacggccgcggcagcgacggcctctctcttcctcctttttgctgtgaattttgttgttgagtttgctgaaccaaatgtaaatggctaaatggttgattaccagcttactgttgaattgcaagtttcgtattgatgaactaaaaaacaaggttcagaaattggatctgctgtaaataatatcgattcaagtctggtgtactttgagttacgcattgtttttcctcctgattccttcctctattcagattaaagttgcacttatgggacattatttttcctcctcctgtatttctctgttcagattaaatcagcagactcaaattgggtgtctccgagcaaggcagcctcgatgtgcgactgcagtggcgcagcggcctagatgcgcggcggccttgatgcgcggcggcacggcggcctcgatgcgcggcggcacggcagcaggctcaggggctgtttggtttacagggacttattccaagtccctgtcacatcggatgtttggacactaatttagagtattaaacatatactaattacaaaactcattccataatcttggactaattcgcgagacgaatcttttgagtctaattacgccatgattttgacaatgtgatgctacagtaaacttttgataattatggattaattaggctttaaaaaatcgtctcgcggattagctctcatttatgaaattagtttttttattagtctatgtttaatactctaaattagcgtccaaacatccgatgtgacatgagctaaaaagttttaatcccatctaaacaccccctcaatgcgcgacggcctcgatgcaacggtgtctctccattcctcttttttttttgttagcccgatcatacccctactaaatcaacggttagattagattggtacctcgtagtacctcgtacctcatgataactcctaaaggatgggaaagatgctcagaaatatatgatatctttagcatctttacgcttcttctcgctgaaattctgctttttgatagatgaagctaatgttgcacattagctgctattcttgttcaaactgtgcttagtcatttttaactacattgcagtgctatgatgtgatccaaatagccaacacttggccacaagtcatgatgctatgatggatgactaaaattttttcgagggaatgggcaggagctctgccatttcaattatagaaggagaaaaacagaatggtttggttcagcgatggatgactaaaatggagtggggattttctctgttccaacgcattttctaagcatcagcggtacactgttacatttataaaataaagtacactgttactgcgacaaatgcaacaataagattatgttcttgatgatgagaacatttattgcaatgtggttttcaattcataattaacaactgcaggaaactcataaaagtagtcaccttctaatgatttccccctgatttccctaggtttggtggctccttgaacatgtatttcagtgaacgccaatattcttcttggaaacctaagattggtcaaatatactcattatatgctagaatcatgaaaagagggttctcatttcagccctaacaaaatggtagtcataacaactgagttttgaatataaataaatatagaccatatatggggtgtgtttagttcctgaaaaaagttgaaagtttggggaaagttggaagtttggaaaaaaaattgagagtttatgtgtgtaggaaagttttagatgtgatgtgatgtgatgaaaagttggaagtttggggtagttgggggtgaactaaacacggccatggtcaatgattctctggttccagcatgaaaatattcaatatcggcgatagttcgccttcaatgttgacagttttttttccccaaaaaccgtgataaggacatcagctcccggatttgatatggaaagaaacattaagtaatcagttatggggtactgaaacaatatctaaccttgtgtgatgatctgaataacttgggactacactgggcaccccctcggttgcctgctagacaactgcagatatcattcacatgaaattggcttgcacacaaagtggacttttggaactaacagtgcacaagtaaggaaaatcttatgactccagaactaacagttagtacatgtcaagttgtttgactaaaagttgaaatggctatgtaccccaattcaggtacaagtgcacagcagaaacattgacaggaaggatcacttgagcatatcacttcgatcagatgaatcatcataaaaagagatcagcaatttctcctccatctcgatacgccataatcttcagttttaagatgaaccacccaaattatcttattactagaaaaaggatgaaacaagggcttaccgtgacacgacgattattgttgctgctgtcgactagagagatgagagggatgaggcgtatgtacatgtcaatctcgtgctgcgcggcgcggagctcgtcggccatccgagcgccgaggagcaggcggtggaggtagccgcagtcatcctggcacgccctgacgagtgcgtagcaccgccgcagcgcgccttggagccgctcgaggggccgcctggtggcctcccgccgcatcagctcggcgagctctagctcccgcagcaggccgccgacgaggtccacgtgctgccccagccgccggcacgcgtcccggtggcggcgcgccgccagcgccgcctgcaccaccatggagaccagccccagcgcgtccacgccgaccagctgcgccacgctcgacgcctgcccgagcgcgccccacaggccgctcgccatggccgatccccgccgggaaagctgcttcgcccgttgccgccaccgccatggacgggtataggcgtcgcgactcgcgagtgtgaacgtgtcgtggacggcgactttgaccaagcgcgctgctgtaaattgtggtcgttcgtctacatggactcaaaaggcccgtctccgtcgagatggcgtagggggccgaactaaatcacggcccggcccagaaagaccatcgcgaaatttatatgggccttgtctagatcattgtagtgtacagtgtcagggagcattcaggtgtaccgagcacaggtggcaaatcagacgtgatgagatctgcagtgaaaataaatacagagcccagaggttttgcactgcattattactgacatttttttgtactagctttatacaggcgtacagctcgtacctggttcgatcccataactcttcttttgtgctctttttttaacacctaaaagatttcccggcgaaaagaaaaagaaaaaaagagaaacatctgtaagactgaaaccaacgttatagctgatccaaattcgttcatgatctgaaggatgtgattcggtttcaggtcccgatgttgcataaaattttcacaggagaacactatcagatgagtaggagtacatcttcttttcacgtttatgtgtactaacgagtaacgaatgatcttacaaatgcatttcctacttgcagtgggcatgatcacggatgagaggagggatcctagactcctggtccatatggaccacgcacaagaactgagcagagggcagaggccatcacactccgtgctgtttgcattgaatccaattcaattagctcgcgttactcctactcctctgtgcttcgcatgaacacacagctacaacactagtaaagaagaacagtagcaaagtagcaggccagcagcagcggcgtactactcctggtccctgatttcgcgcgttagagaatcctctaacttattttcatctaattttgaaatgtaaatctattgtataaagaatccatatatcaactttagggcactagcaatgcaaccctcaatttgccatgcctaggctgccaaatagactgaggaacctcgaaggacatatgattcacagcacgcgcgggaaggaacgtgaggggcgagagcactcggggaggaacgaggccgaagccactcgttccacaagaccacaagacggctgcaccgcgctctccctaccacacgcgctttcgttgtcgccggaaattggggagccttctttggacacgcgtgcttagttttggtaggcccagttaataacgtgatgtcaaaattccattccgcgccgacgttggatggtgaggtcaaatgccatgccatcacacctaggggcggatagcgagccggctcggctcggctcggtctagctcgttaggataacctaatgagctagaaacctagctcggctcagcttgtttgaaagctcgagctagctcgttaggctcgcgagccaatcaacaagacgaggaccaaggaggagggacctgcgactctacacgtgcgagtgcgacctgcgccttcttgcaggaagtgcggcggcgacagcgttggggaagtgtgatggcggagggccctagcggcttgcggcggcggcggcgcgagcgcctggcgacggcgtcggcgcggtctcgtgcggcggagccagagagagatgcggatgtgcggtctcgagtctctcgacgtctcgtctcgtactctcgtgtggtgcggcactgcggcggatgaggaactgagtgaggagactaggagaggataggattttgcacttttgctgttgtattgggcttgggcctttgctattgtattgggttgagcctttgcgtctgtctgatgaagtactgtctcattaagactcgcgagcggctcgcgagctagctcgagctggctcgttatccctaacgagctaaaatgccagctcagctcgttaggaaaatcaaacgagccgagctgagcctgtcatgagccgagcgagctaacgagccacgagctttctgtccacccctaatcacacaccgcacaatgaaggccgttatgttagagaaaaataaataagaggatctcaatccgactacgcgccattgatggtgcaggagctcgacctggctggctggcactgagccaactggcctagtgacctgggcatggataaggaaggaaaaaaaaacggctcagcttttcatggccggcgaggccaacgggaagacgcaacgaaagcgcgtcgcctctcctcctcccggcgaggaagaaaagctgccgctgctcggcggagatcccgatcctgctaaagccatcgcccaggtggcgtagcaggggcgtcacctacctaggaagtttcatccttcatgtgccacgcaatgacagttttaattcctcatcagatcaagatgattaagtttttcttaattcttttttagctgaaggtgattagtagtagtaagattcaagatggcagcaacggcatgctaggaccatattttagtgctggtcatctgctacaggctggagtaccttaaatccaaaacggatgcaattggtgctgatattttcggaggcagtacagcacagtaccacctaggattagtgtagtactggtactttattttagctgacataggattagtactacccccagtgacatcattaaacgctcataaatcgagcactgtgtgaccaccaaccttgtcatttaagcgcacaccaacataaaccatactcccattctcctactggagtagtaccataataaacataaaacacaacaacccacataagtagagtactaatccaaaatagtactacctccgttcattttaaacgcagtcgtgggttattatgttcagcgttttaacgtccgtcttatttaatttttttatgattaatatttttattgttattgatgataattttaaataaaatactctattcgtctcaaaatataagtaatatctccgtttcaagttataagactttctagcattgcccacattcatatagatgttaatgaatctaggcacacatatatgtctagattcattaacatatacattgtggacaatgctagaaaatcttgtaatatgaaacggaggaagtatttttaaacttcgactaagtcttcgagatggtactattatcaacaatatctataaaaatatgttttaaataaaaagtgttgcatattatgatagttgtttaatgataaatctagtagcatcaatttacatgatttatctttttatttttatgttataatagttaaaatttaaaaatatttgacttgatattattcttaaaatgtttatattttgagacggagaaagtaagacgaacggttaaatattgaaaaaaaaactcacacctgcattttaatctgcacttaaaatggatcggggagtactagcagcaaagccagcaatgcgtttctcctctactgaaactgcaactaactgacacgatgatgatgtaggtgtatctgcctgcccctcgtcgccggcggtccactccacacgacgagtataggagcagctcaccaactccaccaaaatctcgcacgctttcactccctcccctgtggctgttgggcctctgctccctctcccgctgagcagcgggccccacatggcacgcgcgcagcgagcgcacacccaacaagatttgactaattgctcgcccttttttagctagagtggggtggttttgcctttgctgcctcccctcctcgccaatgtcgcgccggaatgattgttgcagcgcagcaacacaggctagcaagcagctctagtcatggcggccatcatcaccaactcctctctactctagtctctggcctctttcctctggatcctggcattttgcattgtcgtttgccgtgttagtttagtgagcagattgtactttgggggtggttaaagaatccgggggtatttgtggtgtggtggatgctgtggtgcgtccgcgcggaggacgcattggccgccgctgcagccgtggccgtggcgtccgacaagatgcgctccgtgaccctgtcagtctcctgctgcttaatttacctgcttctcatggatgtttgctgttggcccgtctcctcaaggtttggttctttcctcgctgtgcgcgcgtgtgtgtgtgtgtgcaggggcggttcgatccagagggtgatgcggaggattggcggcggcggtggtggccggagatcggccgggtcgaggggcgcgccgcagcgggcggaatgcctgggggcggggagcggcgacgcgtcggcgagctgctccggggttggtttttgtctttgatcaaattaaaacccacttctttcttgttgccaagcatttgtgcaatggaagtgcaatttcttggttcctcctgcgaagattgtttgttctgaaaacccgaaaatgtggtgtttttgggtgcatcctgggcactgggcagcttcagacaagctagctgtgttcgcgtgccaaatttgaggggcccagatgagatgaagtgtcactttcccctctctgttcttcgcatttctagtgtaatagatgcagaggttttgactgcttgtttgctgcattctgaactaaatttcttttggatggattctgtcccggcaggtgtcctagactggggattttgtttgtttcctgtttttttggacagtttcaggtgatatgtgaacctgattgctctcttatctttcctctgtaggatgatagtagcaatggcactggcaagagggatggaagcagaagggtaaggatgcggcggtacagatcggagctcgagcaagaagtgagtgcttttcttggtgtaattctgctcgtgtttgagttctgacgacttttgttcctgttgttcaatgaaagttggtactgatggggttagctagtataggctgtggcattatccaatgcttcattgaaaatttattcatagagtggtcctcaaatgaagtctaatatttgctacctaatgtttgctaaaaatttagttactctgacggaactatatttgcatttcaactgagtaaggactaagagctaatattttcagatgttatacatgtttcaggtaaagaaactgcagaggcaactggaagaagagattgacttgcagttggcattaacagatgccatcacaaataatgctacactgatacttgagccctctgcaaagcttccaaacaaggtacggattgcattttagtggatattttgcatgtgtatctaggtagccactctttaatatattttctacttcaatatttcacgtgcaggcacaggagctaataattagcatagcctccttggagaatactgtctcaaaacttgaaaaagacctaaatgacttatgttaccaactgtgtcatttaaggaacaatacgcgacttgcagaaaataattccagatacttagaaactctagctgaagaaaataattccagaggtctactgtctacatcattacagtaccaaccaccgtcaacttgtaaatgtacaggggaggaagtaagtctttattatagaaatggtctcattttatagtgcttcttttggcattcaaataccaaccgttttttttcccttttctgaacttttgaaggacatttcaacactaagagatataaagctcggagaatctgaatcaatgcaagaaaatttattccctgggcttgaggaccaacagaacattcaaaaagagagtgaagggagagagatagtatctcaagatgggcttctcgaagagcatcaagatgttccttcaaatagattgttggaaaaacactggaacgaagaggtttatatttatcagtattaggcaaacatgaatttatgctttatcaaaatattttaagttatcaaaaagtaaattttagcttgtttcttggcagatgcaagagtcctatcctatggaaaatggaggcagagaatatcagataatagatgcgttatcatttgaccaatctcatcagaggaaaagcagcatcaatggtaatgtgtggaatggcaatccaaataagctctctgaagaaatggtgcgctgtatgagagatatcttccttcgtttatctgactcatcatccgagatatcaccaaaagggtcttctgttaattcaatttcatcaacagaacgtctatctggctgtacattgacatctgtatcagattcatccttgatggcatcagtgatgcaaagcccttcagttgattcaaaccatgacagtattgatgaagttagatacttcgatccctacaacgttaatggcaaggaagttcgaagagacattgggaactattgttcagtagctgaggtgtcttggatgtatgttggcaaggaacagcttgcatatgcatctgaagctctaaaaaatttcaggtttccttattaaactctatctgtagctatcaacactaatggatttcatttcatgtctaaataaatagcctagaccaatttacagaagcaaaagtataacaataattaagcatgcgagaaaaatgctacagcggaagattcagttataacaaaaaattcttcagtgtttgtttctaccttgtagtgcaaagtagcactgcttggtattacgtttatgaataaatgatggacattatattatacatgactttgatacgattgctattaattgtttaagttactctcgtctgcaggaatctcgtggagcaactatcaaaggttgaccctacatgtatgacctgtgctgagcggttagcattttggattaacctgtacaatacgttgataatgcatgtaagtatctgttcaaataaaaatgcatgcaagtattatccgctagatttcatggaaatatgatgttataattagttattagcaaaacaatgtgcctttttttttatgaagtgacaattttgaaggcagtgttgtgtagtatatgccaccgtggtattctgttgtaatttcagtttcttagtgtatgctaccgtggtgatttctcattgaaatagcagttcctgttctttgtttgcactgttctttattttgggccatgcagtacacattctcatgtgttgtgcatattctattggagtttaccaggcatatttggcctatggggttccagaaaacgatatcaagctcttctcactaatgcaaaaggtttgtcatctttggctcttatttaaagataccattggctttataatcatggttctttaataagatgttaaccaacttggtattgcaggcctgttacattgttggtgggcagtccttcagcgcagcagaaatagagtttgtgattctgaagatgaagactccagtacaccggccacaacttgtatatgcactctgctcttcattgtcatctcctttcttccttttcggcatgcaagtcgcagtgaagcttattgttttctcgtttttcagtcgttgatgttggcccttcacaagttcagagttaccgaggagcacaagaaatattcgatcgatgatgcagagccccttgtgttgtttggccttagctgtggaatgttctcatcacctgctgtaagtatatttaccttttatcttggtttgtcatctcaacactatttaccttttatcttggtttgtcatctcaacactatttaccttttatcttggtttgtcatctcaacatgtatacacggacggtcttttaaagaagctaaaagtcaccagtatgtttcaggattaccttataatgttttacgccactgaatatattcactcttaagcctgaaacacttctaaatcatcttttatgttccagtatttataacaaaaaaaaactgtcattttcatgcctatcctcatttccaaaatgaaatgtgcgtttgctgtcaaacaggtcaggattttctcagccgggaatgttcggcaggagcttcaggaatcaatgagagactacatccgagcatcggttggtatcaacgacagcgggaagctcatcgtcccaaagctgcttcagagctatgccaagggcaccgtggaggactctctgctcgccgactggatctgccgtcacctcacaccaaaccaggtcgcagctgtccaagacacttcgtcgtcgcggaaacagcggcttcttggtgtgcgcagcttcagcgtcgttccatttgactcaaaattccggtatctgttcttgcctgacaacagtagctcccagcactgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47210 - DNA, 1262 bp, Oryza sativa
ccagctcttccaatccaatctaacctcgggcacacgaaccacatgcatacgagatcaggagatcgccagcccccaccaaaattacacctcatcatcagcacactcccgagactaaacccccgagctccgtaacatccacaccgaacgaacaaactcccccaaaatcaactactcccgctacacccgagaacccaaatcaaaccccacacacaaacacatgaagccatcgatcgccagaatccgagaaaaaaaaaagtcaaaatcgaaccaaaaaaatctggcgagaaggggatgaagacgaggaggaggagggggagaggagacgtaccgcggctgccgctgcggcgagggtaggtggcgcggtggtggtgggagaggagacgagaagagagggaaggagactggaggggaggagggttgaaaagggagtcgagacgcgaggctgcgagggggggaagagaagatgctgccgccgctgctgatgctgttgctgctgcagcctccctatctatctctctctcgcttcatttcggctgtttttgtatataataaaaatatttattatttatttatttgggtcagcatactggtgctttttaaatttgtatttgagcggtttttttggattatcttgtggcgaggagaaaaaacatgcggactgtgcagggtgaatgattaggcaaggtcaaaagtcaaaaccatgtttggatttgtaggagtatgttctactactactatctccgtcccaaaataagcacagtcataagtttccgcgcacaattttagtcgttcgtcttatttttttttataattagcatttttattgctataagatgataaaacataaatagtactttactcgtgacttatgtttttaattttttaaaaaaaaattcaaataagacgaacggttaaagtttgacgcggaaaatcatggttgcacttattttgagacggagagagtaccacgggagtatgaatgcagtacgggttgaaatgttgaataggttgacgggtttgctcgtcacgttttaaccatctttgaaatgaatttgcatgattttctttcaaggtagttcaattcatatgaaaattctctagaattcttaaatcgagataatacagtatgagagtttttttttctacactacatgaaagacacatatgcatacacacctaaaaaaagagcatatagatcaatgaatatgttagctgtgtactcacttaaagaaatgaacaccaacgatagctccgtaatctta

SEQ ID NO: 47211 - DNA, 701 bp, Oryza sativa
atttaattactactaggtacaatataaagtaatcacctagcatactaaactccagtgtaccaataaacaagcagccaaactgcttagctactgaaaaaaataataagtcataacataaacaaaattacaaatattggggcaagtagagtggcataccacttcaccactctctttgttgatcgcgcgccaaacactcccaaatgttccgtcaccaacttccttaataatcttatacctgaagcatgatgcaggaaagaagttagcactcagcaggtacaagctcttgaacatctgagagagcccttacacacacatacacacacacacaacatctgagagagaaggggtgttatttacctctccatttttactagctggagagtaaagctggtcttattctagaagagccctgttgtgaacaagactcatatgtgtattgctgaaatgcctttgaagggtagatcagcaaagccactcaacgcttctggaaaaactctataagcaatacccatactctgacaaaaaaacttgaacaccttcactctgaaagagcaacaaatagatcagaagatttggaagaaataaaaaatacaaataggctgagtaacataataattacatgtaaccgaatcatgaacaatgcatgtcatgtagaaatttcaagcataccggtttgttacgccatcaaacacaaagcctga

SEQ ID NO: 47212 - DNA, 2694 bp, Oryza sativa
acaattttctttggtttgtcaatcagaagttcaggattcaaacatggacagcacaggaatacaagatgtcaggctcatttgctccaagtgactaattcttgtctatctctatgatactcaaacctaattactcctatcaaaatttagctcgcacatgactctgggtttgtgacttgtatttgctgcagtgtcacgaactacagatctattcatcgacagcgacagaaactgtgaagctgcctgtacgacaacatttgctattaagcaaagggttgcccacagtatgtgcatacaatcttcggatactgctaccttgaagattgatcagctgctctagcttcctgtgttacaagtccatcatccccatggttcaactcggcaacatgacccacctgccgtagcttacttggctccgttgtcacacccctagggacttctcttgaccgctggtctgctctcttgcatccccattgacctgctgaggcatagctctgatttggctctttgcccgagctaaaagttgcttccttatatgctttgtgctaacatattcatctctttctactgcccgttgtacggccttcttaagcctggactcaacagtttcccatgacacaagcttctctagaaatgtggagacatagtcagatctccgatcctgcaaagatatagccatgaacaaaataagtaaaacaaaatgttttttttaagtactaaatgtaagcatcacttgtcatctaacctcataatccaggtagtatgcatgctgttgcccaaagtaataggttttgttagtataattgtttattaataaaaatgccaggaaaagaaagagaaacctgattgcaatattcatacctcccaaagatcaattgcaaggagtggctgcaaaaagaaatagcctcatgagatccctgctggatatgcatacggcaaaaaaaaaccagcagacatacagtgccaggcgtatgctttgcatttcaactttagccattgcatacgaatcatgacagaagaatggcatagcaatgtagggtaagtgtttcaagttaatactcacagagtgaccccagacaagaggattgatggcattcggagactttgagatgaccagtctaccataattatcagatgggattgggcttcttgatttcacatgaggcaacttgcttgttttgtctggagagagttacagaaaaaagagttcagttcatcacaccaacatatgcaaattttgaaactggtacgatgaagctaataagtatgtcgctaagcatctgtacatcacttacaacaaagccaaacccatccagaaccaaattgagttgatgcagcatccataaattgtcgaatcatgccatcataggatccaaagtccctgttgataaatttcaaaaggcgttctgggggttttcccccgccaccaggttgcatagatcgccaatagaaatcatggttccatatctaaaagaatgtccagtaattagtcatatggaggacatacagctcagcatacggaatgatacctgtgcagcatggaagaaggggggatggggtgcctccctgccctcattgaaggaggatagcatcatctgccccagcgacatcccctcccactcactgccaccaatcatgccattgagcctctcgacgtgaatgttctgatgaactccccagtgctgttccaccgtctccttgctgatgtatggctctagggcatcctacatttcccatcacacagttgtcactactactctgtgcaaaaccacaaattggtatttgtgtacttactgaaggataaggaagaggctgctgctctatccaggagacagaagcatcttcatcagtgcctgacgactcatcaccatttgcttcagcatcctcatccatttcagcatcggaagcggtttcatcatcgataccatcgttcacaatgtcatcctcggtcaccacattagcctcattggcacactggagtacacgtgagttcgtactctctccctgttgaaataatacatagatatatgcattcttccacatcaaattaatcgtctacagaactggagaggattcttttattctagaaatggtgcataataaatgtatttcacacatccaaccgaaaatgtcatgacaaatcaaatatctacagaaatgaaaatgcattttcttgagtcagtgaatccataaagaagagctactcgcttgataagtctggtgaattaacacgtaacagtgtgacttatccaaaataatacacaggaaacaaagaacggcgagcagcgccaatcagtcagctcgagctaccaactagaaatgctaagctgaggaggaggaggcgacagtttaccctgcaggcgctccctctcagtggggtgacgaggcgtcggaggccatgccgccgggcgtcgccgccgccgccggcgcggaggatgaacggggccgagacggaggtggagctggagcaggagagggggcgggagggggagaagagggcaggcgataggcctcccactcccaccagtgtggcgaacgccatggacgagcagtttgggagaaagcttcgaggagacgataagattggaggaggggataagcggccgcccgagatattaatgggcccaaactaatgtgggctttgggcttctagctggagcttagtgggccgccacattattaccaggggtgcaggaa

SEQ ID NO: 47213 - DNA, 4085 bp, Oryza sativa
aatatttaaaaaatagaccctatcacccaagtgaagggcggcaaggtgatctggccgccctcggggagggctgcagagtctatttctgtaaatattttctctagtataatattactgtaaatattttttaaaaaattaaaaataaaaaaaatctattatcaaccattttgtatttttttgcagaatataaaattcttcggatttgatccagtttgtgattacttgcgatttggcacgtttttagatcgatctgtttcgtcacaagtcgcaacacgaccacgacgactcagtttcaaattcagtggtatagtaaaaagaacagaatttgacagccaaatggcgaatgaaaacacaagcatctactatcatccatatggctggcaggtaaatgagacgtagcgaaatgactgaattcatcttaagacaagtagtatgcacttagtttggttcacttcagacaaaaacccaaacaagctcaaactgaagagtagacagacagcagcaagatcagaatgccagtctcgcatcaggagaagctgataacaataatggtaataaaacttagggcatctattcttaacgttgcaggttgcaatcctttcacttcttctcttccttctcagcctcggccgccctcttctgccgggcaccgatgtggcgctggttcatcctctccacgcgcagcttggcgtaggccttgaatgccttcatgtcatccgtgaccttcacgacctcaaccgagcgcttctcgccacgggtgataggcatgtagtcaccctggacctgggtggctgtggcaagctcctcaggagtcgagtcaccagcctgcgaaaggagttggttaatgtaagggatcttcagaacagtgggtttaagtgtaaggctaaggcgggtaaagttccctcaccttgaccttgcgggcacgtcttgggaagatgacaagcttggccttgtaggtcttcagcctctggacattggcctgcagaccttcaagtgagcggttcttacggcggtgatccactgagatgccaatggttggggcaaacttcttggggatcccagctgcctgtgtgcaataggtttattgagatcagaatcacgatccaaatataacacatggtaaagtttcaacggcattatggcgtcaaagctacaatgttgctattcaaacaagcaatctgatttaccttcagctcttcaagggtgaagccccttccagccctagacttcatgttgtacttaagtgtttggcactgaacaatggggcgaagtggtccagaagtagggcgggggaagatcttcacagctttcttttgcctagctgcaaaagccaacaccaaaagaaaattagatgctgggtaaaaaagaaatagcagcatcttcaaacataaaatttaatgcctcatgcaggactacaaatagcacttgagcattccttttttttttccaatttagacagcaacaatgcataactcacagcatcttgtggctggttttaaataatagaaggagcagaactaaaagaaatacacaaagcatcttttagcttattgtacatgcaaaaccaaatagaatccagaagcatgtaaagtttaagtcgataagtgactggtaccaaagcataaagtagacaatttgtcgcaaacacatgcacaaattgttagatgagggtttatcaagatccagaccactgaattttaatctagtctggctatgcagcaaactaaaattatgatagcaccaataaatcacacaacacattaccagaagaaactataaaattaagaaacagcatagcaatttaacttatatgttaccgcagatggctgctgatcaaatagacataaaagcaaaatatgtacataagtaaacagtgtctaagcagctaccagcaaataaaacactacagagcaagaaatgcgtgatcggcagtcaatatcatacgaacacccagggaagaagcactacgggcatttagaagcacaattgcagttcacgcatatgttacacagcacaatctcacgagcaagtaggaagctaacatgctcattcattcacataatcattagatagatcgcaagagatcaatcactttaccgatgcggcgcctctgcttgcgggcgggctggttgaaccatgtcttgacatagttctcccagtgcttcttgaagtgcccattcgggatgacgttgttgtgcttcaccatggcttaccttacctacaccaaatcaaacaaacacaaaccataagcatcatgcgattccttcctaacagctcttactaacagttgcagcaaaaatccacaccagattactgaaagaaaggctaacaccctgttctagatcccactaaaacgcatgagaatcaaccaaaaattactgctacaaattacaaatcacgagcttcgcttcgcctgctgccataagaacagaacagtgagatctctcgtcctagctccacaacatctcactacatccagaaacaaacaagaaacggagcgcgcgcgcagtacaacgaaccgagatccgaatggacgaaggtctagatcgaactggaagcctcgactgatccagaaatgctgcgcgagaggggaggagatggacgggaaggcaccctaccttgggcggcgaggcggcggcggcggaggcggaggaggatgccgacgcgaggtggcggcgcgctagggttggagaagaggacgcgaggcgaggtggggttttagaagagaagccgaggccgctctagttgggccttctcatgggccagcccatatcgaagcaaaggtatcctctacgtgggccggatataaggcccatcttccgcattccccgcataaaggcgtaatagatagtaatacgcttgtgacagcggaggcgtattagattgtactcgctttctgatctttgaagcgaaatttcgatggaaatggaagcggctctgtgataggccaagacagtaagcgactgcagatattgtatatttgtataagccctgaattctgaagacttttagcaaacccaaattttaaagaatcaagttgatgctgaatattgtttcatcatattttactatccctgtgtgatctttgtttatgttttaagaaaatatatgtttgcgattgtgcaggcaggcacagctcggttcttgcatcgcctgcttggaaaacttcaaacaggaaaatggcaagaacaacatttgaaaaagaaagagagaaaacaatggcgggtcgtcatcggcgatgcgcgtcgtgaagccggcaccagagaatccatccatggtgcaatggacaacagctatagtatgggagccgttttgggcaggatgcaaagctacagcttgctggagcacttactgtaaccgtcttgtgatcgttagctgatgctgatgtgccaactaatcagctatcagggatatataaatgtatctagatggtcaagagagatcttgattgattgatgtcttagtcagaactcagaacctcaatcgccagagtcttgttcttctctagatggaaaaaagagtaggaaagtttaaggtcagcatcagtgtgatcatgtgctgcttagagtcttagagaagaagatgaaaattcagtattttaaattgtggtgcctaatgtgttctcaaaattgtgttgcctagtcagtaaaataattagggattttcagctcggtgatgagttaataagaaaattatatgaaaatatgagaattgtcagtgtcagcagaaatgtccaaaacaaagcttttgccgtcggcatatcttcgattaatcaagacaggagtagttttacctgacaagcagaagaaatggtctggtgagaagtttatgtcaagcttcaagcagggccattccaaaactgcacttttgagccttgcgtgtatgattcaaatatgccaatgaaatgccatgtagatcaatgaattcctgaagtaacatcaaatatgtcatcgatggtgtcacctccttacatcaatgggcttattttatcgctaacacaagcagattggaactttggaagagtttatggaaatgttagatatcttggaacaaattctaagagtttttctgattgcagctgtgaa

SEQ ID NO: 47214 - DNA, 924 bp, Oryza sativa
ctcataagacaaaacaagaattgtggaatctttgcctccacagaagggaagatacctccactctgtttattataagccaactagtataatattcaattagtatcatgtcttgtgtgcttgaactcttctgctagttccatttcttaggttagtgagtgctttaggtggtattctactttatattatcttatttgtttcactatatcttcttgaaatcatatgattgcctcttgtgaccctacttagttaagtactaaagacagtttttaggaactttatagtcaataatctggttaagtattttgtcaggggggctgaaggtgagttgagagggttcatggaaatggagggcaggggtctgtctgagctgttcaggaacacaagtgaagatatgttcctaaaggcgatgatggagaactcgatgggagtggcggcggcggcaccaagcatggagatgatggggttcagaaatctgtcccaaggtttcagagaagacagcgaggagttgttcaatagctggcttatgaatggagaggcaagttttctgaaaatccataagattttgtctcagtacatgaaagttcatgtttcagaaaaaacaaatcccaactcatctgttgttttatgaagtgcacaactttttgtatacatacatatatttagagatagtgcataagcttacatagatatgaacattgatgtactgattactttcatggttaatgttacctgaaattcttgattgcttgtgcacagattccaggatttagtgccatgaataatcgccctcgacaaccatctaggtaagattgtggcatggtgtgccagaactaactattcaatttagtatccataaatatgcagtgatgaataaaattgtatgtaggattggattggttgccttgcatagactagaataactga

SEQ ID NO: 47215 - DNA, 8459 bp, Oryza sativa
cctgcagccatttgattaatagaaaattaatgaacaaaaattgcgtacatattattttgttgataatcaaatattgtctcaccaccacccgagtcagtatagattttgaagacttatgatgtactcatagtccttaagaattcccctatcctccaagatttgaacgtacatcttagaggagttagcagactaataaatagaaacaacgagacaacacaaaatgggtggacaaagtacgtggaagaagaagtttaccgatgaatgaagataacaacgatagtgagggcaacaaagaagccccaaaatggttgccgtcgatgttaatgaggacgtatcgagggtctgcaatggttacgactagcgagtagggaagacgaagcggcggcggaactagctaatgattagggtttggggggaacgaggcaaggggattcaatgggttttatatggtatgacatgttaagagataagatgcatatgtccctcctcggaaccagttcacatacacacacacctcctggtaccagtacacacatagacccttttcattattaatttggtagtaaaccctaggctttgctattccggaaatttctttggtaccagttcacacatagacccttttcattattagtttagtagtataccctaggatttgctattccggaaatttccttggtaccagttcacacatagacctttatcattattagtttggcagtgaaccctaggatttgctattctggaaatttccttggaaccagttcacacatagacccttttcattcgaaatttcgttttatctgtgggtaccggtagggagttcttccgatcgaaattttcaattcattcgaaatttcgttttatccgtgggtaccaatagggagttcttccgataaaaattttcaatatgatttgaatttagaaaaaaaaaatagccgtgtcagagtatagaactcctgtaatggggaagctaagtactccccctttgtgagttcggccgaggtgcaagttttgagatcgagtgtttgatcgcacggtaaagataaacacaagcacatatacaggtttaggccgcggtggactatggatgattggaggaattataaggtgacgtaggaggagaaactcaactccttgcttgctgaattctcggtggcatgaattctacttatatacatgaaggagagtccacaataccgttgcatgcatggagtggagcctactcctctaaacttgatatgcttagtcttgtaggtcttgacactcttcttaaaaccttgaagatgtagatattgtagatctcgataatcttcttgaaaccttgaatatgtagatcttgtaggtctcaaactctcaatactcttcttgaaaccttgaagatgtagatcttgacatctctatactcttcttgaaaccttaagtgcttggtggggctcgcagtgccccaagcccccctacaccttgagctctccagggtaaagggaacccctgctcccacttctccgacaagcagaattcctaaaattttgccaacaccgcccctccccctaggtttatgctttttgaaatagtgaaccctagtacaccttgttaatgcttttttttttgtcacatcaccaacacaattggagatccacctaaagccttgtggtgtgataggagtcaccaaccaccttgaccttgagaatctccttgatatccccaacgagctgctcagcgaccttaaacttgtgctcaaatattcttccattccgctcttttcaaatgagccaacaaaccatcaggaagaaagaatcaaaagcgttcctatagcttggccgaaaaaagcttcgcgcttgctgcgaacactctgctagctgcaaaccgctgtggcccagtgggtcaaaagccgcattaggacaatggtattatttgtcatgcacagcagatcttgcaaataacgtcaggtttagtttagtttcaaggatttctgaaccagcacagttacaacaattggtttctactctgtatccgctaaaaacttatgggcagctgcttccaagcgtaaatgggggaaaaaacttttcgtgtgtcttgcaattcagagattgaatgttcaacatctgaaaatctaagcaaagagtggtcgatttggtcaagttctggtggctacaaaacaaccagatgtgtgtcatcaaacaagaaaggtgcagaagaacatctcaaaatgttaatcatatgttcctaaggacataagaaatctgcttttgataggtgcaacagctttttgttggtccatttggctaaacagaaacggggtaatttttgacaacaagatggtgacttctcctttgcaggttattgctttagtcacccagtggctatgcatctggtctatcctccacaaaccaggtctttaggatactattgtggtggtatcacgtcgtttggatcaagtggcacgggagttttttttaccctggagcatgggtggtgatctagtctacggcttgatagtcactaatttctttgttttgtgttgagggtctagttagatcatgttttgtagctgtgtgcatttcatgcagaggccgggagtgagctcagttagaatgtatcatcttggtgtatttgactgagttttaataaagcttccattatcgaaaaagaagaatatctcgaaattaagatgatcatgcattccacatagaaggcgatggtcgaaaaatcaatggaatagttcagagaaatcaccttttgctcaaccacatatcctgattgcaggtgcattcccttcgtccatgtgagcaattgagcatatatcgacacgacatggccgttttctgtcgaaataatgatctgagagcaatctagtagtgagaaacataaagcacgcaaccgatgaacgcactgatcttcagcaaagtgtatagttgaagagcttttcacaactgattcacaaacatactgaaatcaactcaactggatatattgcagaacagtatatgttgagttgggataatacctcccctcattgaagaagaagaagaaggtgcatttctccagtttgggattccttctacaccttcactcgcgttgcaggttcagctgataaagaacggcggaaggatcccgcgagattcttcgacgaggacccggccacactgccgaggaagaaagatcttgcgccatggctgacgcatccaagaaccagtggtgcctgactgcctggaatggccggtggtcaccatcccatcccataatgcccctgtgctcaacaaacagcgcactcgcggcggagcgcctcggcggctcggcgccctcaggatgccgtagtggacggacggccgcggtggccggcgaggcggcggagctttggctgtggggttgagaagcggcgggtggacaggtgggggccagaggcagggcggttgacctagtgcgagggattcggaaacgaaggtggtacaagcggacggaggtgccccatggcgtccctgaggctgagggtggtggccgtcgccggccaggacgccgtcgccggtgaacgcggaagcccggaatctcggcccggtccaagccaaaaaaatatatgggccgtacgtacgccggagtcacataaatgggccgcacgtaggcggcactagaggtgaaaactgttggaattgttagcatatcttcagaaatgatgctagatcgatcgataattaaccatatttactatttaaattactcagtattgatatttatatgatgaaaaataaattagaaaaaacaaaaattataaataataaaaaacagcacggtcggaaacagtgttaagtcgaacgggaattttcatgaccgttttcaccccgcaccactcttccgtccgcgctgctgtctccatttcccaactccgcgcgctggttgttcacaattgctaactatttatttatgaaagacataccggaaattctcgatagatcgagcgtcatttctgtataagcggtgagacgtcatggtactgtttttcgattccattcatgtataaaatttgaattttctatttatttttaagcatcatatttttatgcacgctaaatattggtaaatgtggttaatttcatatcaaccaagaatctctttttttaaaaaagatgctcaacatgaatcttttttctaccgatctggaccattctgctagccgatgtacaagtaggttgctgatgcgacgacggcatggatgcagcatcacatcacaaagcttgagacgaatcatggtgcaaaatcccactcagcaaattaatggaatagttctcttacattggatgtgaggatcctctcaaattccccacaggcactgatttttctcaattatacttctgaacaagcacaaaaaattggaattgggttgcagctagcgatcatcgattcttgagaaactaatctcaagacgtgaaagaatcaagttgctagaagcggacggaggtgccccacgtctggacgtcgcggagggtggaggccagccagtcgaggccgccgtggaggccgtcgccggtgagcgctgaggctccctgacagtgccacctccggttcttgagctcctcgtacgcccccagccgctggcacacctccgacgagctcatcgcccctttctgcatcatgcatccacatgtcaattgttgtataactaatcgccattggcaaattgttcattgattcgtcaagcttttagcaattaccaggtcctgcttgttggcgaggaggaggatgacgctgttgagcatgagggggtcgcggatgatggcctggaactcctccttggctactcctatcctttccctgtccatcgaatcaaccacgtagatctgcaactccccacacattcagtttcagacattcagatttcagaagcaaagcaatgatcgatcgagagagagattcagaagatgagatttaaccagggcgtcggcgtttctgaagtattgtctccagagaggtcggagcttgtcctggcctcccacgtcccacaccgtgaaggccacgttcttgtactccaccttctccacgttgaaccctgatggaattcgttcatttcacaggatgaaagaatgtatgtctgtcaatgcaggtccaggaatggattatgtcatgcccatttcggcgatgaaataaatgacaatgaacacgatgtatcactaccgattgtgggtatggaggacagaacttcgccaatgtgcagcctgtacagaatcgtcgtcttcccagcagcatccagcccaagcatcagaacctgattaagcatccatcagaagagaaaaaaattctgaacctggttaagcatcagaaaggatgaaaaactgagaatggtgaacgatttcagaatgctgacatgatgttaccttcatctcctttgtgcagaagctgtcgaacagcttcctcagggactgccccatgcctgaatatgatatatgattatgatctatctaccattagttctttcctcttgattaatctctgcttcttcttcttcttcttcttctgattcaggctgccttttattgctttgagaataggaggtagttctcatcgtgcaaatcagcagatgacaccccattactccgattgtttttgcaatgcgcgcgttgccgtttgacttgcacctaccgacgaactgaataataataataatacttgctttgtgttgctgggatgctggtcgatctggagatgatggaaccaccagacagccacaaccgacagtgtttaatctaatttatttattgccggattctacaacattacaacgtaccctgtttcaactagacatagtaaacttttgtttggatctaagcatggtgattgatcatacctcttagtgaaaccttggaataaattacactccatgccggtcgaactattagtatttttaccttcatcctgtacaaaaatgcaatttactcttcgtaatcatctgtttatgaagtataaactacactgtgaataaatgattaacggttaatttaaaattgatatattacataatcaagcaaggtcgttgtagtatagtggtgagtattcccgcctgtcacgcgggtgacccgggttcgatccccggcaacggcgattttactcctttttttaatttgggccatattagattggagcccatatcgatcagcccacgggccgaaccgctatatggcgcccatgttgcccatattagattggggcccatactcctatcggcccacggcccgaagagccttatagcgcccacgacaaagcgttgggtcgtcgcttgctgcttctagacagttctacaacggtcgaggctgctccgtgctctcctccgctctgctttcattctactccccggaaaaatgtcctattcactttggtgcccctgagtccgagatgcttgctgattctccctctttttgtttccacagtttggctttattttgttgcttttgtgttgttatgaaaaggatctactatacttctttttctttccacagtttggctttactttcctgcacattgagtaggattaaaagaagagctagtaatgatgcaatacatgtttatgtacattatcacattgggtttattcaaaagagctaactgctgcagcgctgcagcaatagctatagtggctatattagtcagccagcaatgggctacaaccaacacaaaccatatgcatatgtaaaagtattgtatttaattttattcaaaatgcagcctagcctaaatcgctgccactgaacggttggatgtgcaacacagtctagacaactgctattaagagctaccgaacaatcattaaggccctgttcggctgcacatgcttcaactgtggtacagccaattcgaatagtactatgtgtctgtagctgcagcagcaagggctgcattgtagtgcagccgagcagaacctaagtgattttgtacctatatacttttataacttttgctctatagtttttcatcgagagtataaaaccttaatagtagttccatgtacggtattgaccaagtttaaagatctagtagaagaattcttaatttaaccatactatgaaatgaaaaccaaccactgggtgtacatgttacataattgaagcttcatactacgagattttgtacttctacacctttacggtttaatacgttctatagtttttcgttgaaaaatatttaaactttattagttttgtgtacgtatgacagagttttaagatcttatagaataactcttgttttaaataaaccccaaaccaaacgttgagtgcacatgttacatatatagtcaaaaacaaaaacaataaattgaatacgatttacaagtaaacatagtgtatagaaagttactagctcagctgtgtgttgctgcggctgcaaagcaatgacaactacggtatcaacatgagcaccaccaatgctaggtaatgcagctgttgcgtttgtgtaaaagtagctagcagaacctagccatgtcgtgggagcttttggcaaccgtactgctatagcttctttcaaagtatcaaatttcttgtacggtctaaattatcacctgaactttaataattcatatttttagattttataaaataaactacaagacaaaagataggaaaaacaaactttcgaaattctcatcgtatgcttctcggaatttgagctgctacaaacattccattttttgcctataatcgattatcatttcagacttggaaaggtattataacggcccatcgtctctcctgcttatttaacaaccattatttttaaatcttatatacatatatgtgtttgtgtgttttttagcaactttattaacttttatgtttttttaattcaaatttaaattatggttaacacgctaaaaagaaaatgatgaacttgtattgtgtatcactttatttgtttcaaattatgaggtgtttgttcaaatttatatgggtgtgaataaatctagacgagagataaataaaccaaaatatcttataatttagaacgaaggaagtagttcacaatcaattctcccaataagaaaagaagtcaatactcatgttttgcatgcacgagagactgacaacatgatcacacttagactatgtttaatttctaatataatgcacacttcttaaacggtttaacggtgcatatttttgtaattttttaaatgcaaataaacccttattcagggggtcagacagaaaggtagcaagcgcttttgcaaaaccctggcgtgtatttaagacctcatcccttcccctcccccttcccccaaacccctcctcacccgcagcgccccaacccaaccctccccgaggtcgcagccttatcctctcctctcccctccgcgaggtcaggtgagctcaaaccctatcccctcctcctccacctccgccgctcctccccgccccggggcgctgggttctccctcttccggtggcgacttggtggggtgtggtgtgttgaccccc

SEQ ID NO: 47216 - DNA, 6498 bp, Oryza sativa
tcattggaaacgtgtcaaactgtgggcaatacacgtcactcaccctgcatcgtagtccgtacacgatgtttatgtacatactcccaggtagtcatacgtggtgcttgcaaaatcactgaaaaaaatcgtgactttccaggtggccgtctgaatcaacagatactagttgacgtacggaaaataataaaattgaactggtacggaaacacgtccttgatataccactattatagccccatcatttggcctaaacagccaaataataagccaaaatttaaatttttaacttgattttgaacttgattttgaaatacttataacgtaatttttgttaaaattggcttttaagtcgctacggacaaatctacaaaaattttacttataaattaattttaattttttataagctaaataagccattttggctaaatggacaaccgatggaagctttatattctactagtacaaaattaagggtcactttcgtaggtggtacctttttcatttttgactgggagaaaagaggaacaaataaacaatactatgtgcctttcaaatataaacatttgagggcatgatagttacaaatgaacaaaaacacactaaataatactgctctatataagtatttatgtgatcaaaatttatagtacccatctcataatgtataatgttggttagttcaatgtcaacaagtagtagaggaagtactacacaataagaagttttaattttgagcaacggcgtcatacattaaaatatggaggtaatatattttatgaaaaactttatgtataaatgttggcttaaaatattagatgaatctattttttaagtttataataactaaaacttaattaatgacattatcattttacatgccatctccatcagattccatcgaccattgggaccaaaatattagaacgagtataatattctctctgtcctaaaaaaacttaacctatgatatgtcctctcctaggttaagtttttttggggcgaagggagtattatacttgttataatattttggtctcgatggtcgatggaatctggacaaatagtagttcagattccttatcttaggaggggtcataccccttcccaggttttttttttttgggggggtggggggacggaggagtatttgtcattagattctgtgattgtgataggatgatggcaagaagggggtggcaccatgcagcagcattccctagtcggtcggtccttctgccgcaccgaccattcgaccccccgtcgccactacaaatccaccacgctcccctcccgcgtgtcaccacgccattacttacttgatccttcttccccttcatcacagtctagtacttcttgcacctgcatcatctgcattggcagcagtaaactaagggtgcgttcgttctgagagattgggtgagaaatggatatcgtttttcacgctgcttcctaaactattaaacggtgtattttttataaaaatcttctatagaaaagttactttaaaaaatcatattaatttatttttaaagtttaaaatagttaatacttaattaatcatacgctaatgactcatcttattttacgtatcttcctaatcttttctatctccttctcctcgaacacaaccttggtagtaactagtactgatctgaggataagctccagccattctgaaactctctgctctgtctgtccgtgcatcttcttcctgcagctgacgacaccattgcaagctcggtaggagtagcagtagctctgttgttcggttgttctgctcaatggccgctcgagcactgtctgctgctgccgccgccgccggtcgccggatggccggacagactggcttccctcttcttgcctcctgcaggtaactggctataactgaaagaatgggagctctgtttcatgtatttctcctgttttttttttttttttgcttcttcattggattgtttctgctatggtttatcagtgtccagtacgtcagtttagtgtaggccgtgaatcgtgatgagctgatggcgacgccagtatcttgccttcgatcttctctttgtactatttttttttcctctttggtttgcaaccctcaatcgatgataaacatgccacctttttatgtggaactctgaatgaacgttcatttgggctgatgaactctgataaactctgatggagaaagaaatgagccaagcaagttcaagttcctttggagatgtttctctcttctgtttttttactgttcattttccagacagatcctgatccttctagctgttatttagttactgctccatctctaaatcatttgggctgtgtttatggtttagctgttgattgagctgtcatgttctttttagatggattgagagtgttgttgtcttgtagagtagatgccatattttgagagaaaaagaatgttcattttctgatgaaagtctgtgtgagcaggagaggagatcaagctcatcagaattactcgattagcgcacaggcccagccggaggaggagcagaaggccatccacgacggcggcggcgccgccggagcgcaggtggaggcggcgctgaaccgcaagaacgtggaggtgcacccggaggaggagacggtggaggacgcgtgggtgcccgaccacgagaccggcgtctttgtccccgccgacgaggccgccgtctccggcaccgaaaaccacgaccactgcggagcggcggcggcggcggccggcggctcgccgtcggtgcttgaccaggcggtgttcgtccgcgaggaggacatggaggacgtcgagaggccggccgtcgacatggccgctgccaatcacaagcccaaatgagcatcaactcagcagtagcagcaataaccaataaagccaaataatgccttctgaaatctcatgtacaactagtactagaaaatttccagtgaaaatcttgcgtcgttggttgtatgaatcttgttatctacagtgatcaatcggataatctgttctttgatgaatcttgttgtggttttatcggatggaatttgctgggattgctttgaattcgtgcacgacgccgtcgatctcgatgaggctgcagccggggaccttgtcgatctcgttcctcctcatctgccccctcaccttcaccgcctcaccgtgccggccattcgacgcgtacgtgttcgacatgagcacgtagtcgccggcgtccgcgtcggccacgcgccgtcgcatcacccgctcggcgcgctcgacgtcgccgtgcgcgcggcatgcggcgagcagcgagctccagatgagcgcgtcggagtgtactggcattgccgcgatgagctcctctgccttgtctagtctcccggcgcggccgagcatgtcgacgacgcagccgtagtgctcgatgcgaggttccggcatggcgttgagttgctggagcccctcctcgacaagtccggcgtgacagcacgccgtgaggacgccgaggagggtcacctcgttcggcgtcacgccggctcgttgcatgccggcgaatagagacagggcgtcctcgccgcggccgtgcattgcgagccccaggatcatggatgtgtaggtgtacacgtctcgccgcgccatgccgtcgaacacctccgtggcctggtcgaccgcgccgcacttggcgtacatgtcaagcagcgcgttgccgacgacgccgtcggcgctgtgccccatcctccccatgtatgcgtgcaaccacctgccggtgtccagcgcgccgagctgcgcgcacgcgccgagggcggcgacgaacgtcgcgtcgtccgggcgcaccgccgcggcctgcatctcctggaacagcgcgagcgcctcctcgagctcaccggcgcgcgcgaacgcggacatcatcgtgttccaggagacgacgttcttcttcacgggcatcctcctgaaccaccggtgcgccgccgccgcgtcgccgcacttggcgtacatgtcaaccagcgcgttccacgcgacgacatccatagcaaccttcctctccgcgacgcgccggtgcgcctcccgacccagcgcgaggtccccgatctgcgcgcacgccgagaacgccgcggcggcggcgacggcgtcgatggccacgcagcggtcatccgccatggcgaagaacagcaccacggcctcgtccaagaacccgtgcctcgcgtggccggtcaccatggccgtgcaagagacgacgtcccggccggcggggaacccgtcgacgagcgcccgcgcggaggcgagctcgccgcgagcgaggtagagctcgacgagcccgtcacggacggcgcggcggcggtcgaggccgagcttggccgcgtgggcgtgcacggccggcgcggcctcgccgtgctccgcggccaaggccttgatgagagcccggaggcctcgggcgtcgtgaggggcgccggaatccacggagacggtgccgttcttgtagccgccatgggagcgatgaggcggtggcctcctcggcttgctgctgctcgccggaggaagctgctgctgcggcggcgacggcggcggtaatggataaggcgccatggccggtgcccggtgatgaggtgagaatgagtttgggtgggtcaaaaagtcaaaacataagtactgacaggtggggacggatacaggttgggacttatgtgccgcataagaaactaaggcccataaaccaaccggcccaatacatatgggcctcacgtgagaagaaatccatgagctacgagccgactaacatgggtcggactcaggacttcatcaagattcagatgaacaacatcgcgtttgatttcatcttgattttcagataaacagcgtcatgctgaatttttaccttcatcatccatctgatcctggaaagcctcagggccatcgaaatcatcttcatgtatccaggaatacaaaagcatgtgcctctggacatgcatattttcagcaagctggaagagctgaaagcctgaaaatgctttttccctttggaagaaccaagctgtaaatgcatcgatcacatccaaaaaaacatcgttgcacacatctcatgcataataaacatgttggaaggaaaatcaaattgaacgcacaagtaatactgcatttaacacggaacaggatgcaataccatttttccccttcacaacaaggtaaatattatttcttgtagagagataaaacaaggttcagacattcagagtaacaggcacaacagtttgcctccagaaaactaacccaaataacaaaacaaccattactattatttctaacagacgataattaaaacgaacatggcagttcaccaaaaacataaacatcctgcaagccatcccttgcagcctgttcagaattcagatgccatcatagatatagtagcttgagttgcaaaagcccttctgctctgcagcacttgaggagagaatttcagcagaagataaacccaaacaaagcttccttgtagcagctaatgatcgcaagagagtagcatcctgggcttcacccagttgggcagcaaccctctgcgattgccttgatttggcgccaaggatgacacacagtatgaatcatagccgatccctccccatctctgtgggttcttgcaagacaatggtggccgtggcctgaaagcctccctcttctcatcgaagaagaaggcccattccttcaactcttcctcttccatcttcacccacattgcaggctgggatgacaggtcaaggcagaaggcctcgccgatggaggcggcgagcaggatgagcatgtcatcacacaccaccagcgatggctcgcagaggtcaggctccgacatctcgacgctccagacaacttgtacttcttccaggctgagctggggttccagcttgacggtgtaaagctgctgatactcgagggcatagagctggcctttgaagggcacaaactgctcaagagctttagaattgggcgggcaactgcactgcgaccaatggtcgcttccaactcgccatgcgaacagggagtgcttggcctcgacaaggaaatgcgagttgtgataatcaaggggagctgtgagggcacaagagttgacaaaagtaaagaatgggcagggtggaggtgaaacactagtgccggtgaacacgtcgacgatggcgaaggttgtgtccttcagcgagggggcattgccagagaagatggcatggccataagaacagcattcataatccatccccgccagaaaatctggcggagtcacgcggtgtatgcagatggttggcttggctggatcaaagagctcccatactactggatcatcgccagaggaagcgcagctgcggatggcaagaggacggaagagggtggtgcgtaaggtagattttgcagacctgaaggcagcatgccaattggggcaggtggcaatgaaggcagcaaggtcactgggtgaactcaacagagcaaggacacactgcagtaggtcatctgggaggtctgcccatccttggagcactggcatggagggctgcaggaat

SEQ ID NO: 47217 - DNA, 708 bp, Oryza sativa
tcctgcaccccgcttgaaaagtaaataatgaaagcaaaaggaggaaaaaccagtaaactatgaaagcaaagaaagaaattgtctcattgcatgaacagtgaacaataaaagtagagaaagaaaccgtttgattgcacgactggtaacggtttcttctctcttttgtttccagggtagtaactgtttcaaggcagggattttacatcatttcagcaaaacaagttcagattccggaagaaatgttccgacattatctgttctaagatctacacaacagaaacaaagaaaaaaaaatgttcagtcacctgcaagtgcatttctttaccaagttatcgttggaagaggggttacccttgctagtctggttacgacggttactatgcaaaaccgaaaaaaaaaatcagacaaatttcatcctaagtttaaatttttatttaattttttagtaacttattaaataaacctggtatttttcattaccacgccatggcaaacaagtaaccacccatatcttaaacccaagtcacaagcgctgcccactgacacctcggccccacaggtagataataatattattagtcaacgaggctgtcctgtgtagcaggagcaataggtgccagtgggcagcgcttgtgtctagggtataagatttgggtggttacttgtttgccatggcgtggttatgaaatataccaggtatatttaata

SEQ ID NO: 47218 - DNA, 2958 bp, Oryza sativa
  unsure (1)..(2958): unsure at all n locations
ccacacataactaaccgctgacatgtggggcccacacagccggccgagacataaacgacccactgacatgtgggccccacggagccgtcccgtccccgcactttcccctacacacaccagatcccctcttctaatcccaacctccaaaactcataaaactactctaaaccctactccactcccgctccgctgtcactgacaaccatggcccaccacgtcgctcccctcctcctcctcctcacgctcgccgccgtcgccgccgccgcgtcggaggaggcggcggcggcggatacggaggcggctgcggccgtggaggccggcctgctggtgcggcgcgaggcgcagctcgcgcggctcgaggagctcaccgagtcgctcgccaagtccgtccaggcgctggagtccgcgctcgccagatccgtggagcccgatccgccgccgccggcagccgccgcggcggcgcccggcgaccggagggcgccgcagggggtggccgtgacgaagcggaggccctactggtccgagcggttccacttcgccgcggccgcgcggctcggggacggggcctacgccgccgcggcgaccgcgctgccctacgaggacgcggatgggctcaccaagtacttcgccgtcggcgactcccgcggccgcgtcttcgtgttctccgccgccggggacgcgctgctcgagctggagcccggggtgtccggcgagccgccggtcaccgccctgctcgcgtacctnnnnnnnnnnnnnnnnnnnnnnntcctcttcgccggccacgccgacggctccatcgccgcccaccgcctcatcgagtcgtccccgcacggcgatgactggctcaccctcgccgccgcgtcgtcccgcctcctcgtccgcggcctcgacgccgcccccgtgctccacctcgaggcccaccacgccggccgcgcgcgctacgtgctgtcctgcgactccggcggccgcatccgcgtcttcaccgagaacggcacgctctacggcaccgccatcgcctcgtcgacgcctctcgcctttgtgaagcagcgactcctcttcctcaccgaggccggcgccgcgtcgctcgacctccgatcaatgtctgtccgcgagacaccatgcgagggcctcgctgaagctctcaatggctccctcccaaaggcctactccttcgatccttccgagcgcttcaaggcctatggtttcactgatgccggcgatctcgtgcacgtcctgctgctcggtgacattgccagcctgaaatgcagggtccgggcaatcaagaaggctgagatcgacaaccccgtggcgatacagacgatcaaaggctacctcttggtagccagccaagataagatccttgtgtacaacacatcaactcagtactatgggagggttggggctccccgcctgctattcgccacatcaatcaaggatatcaagtctgtgtttgcgggttctggtggcgtgatgcctgcttcaccagctgggaagccgcttgttgccgcggacagggagaagctcgtgatcttgggactcggagatggttacattgctatatacaggtccaacttcccggtgtacaaaccggagagcaatgctgtggtgtggagtggtccagcgctgctcttcctcctgttcttgattggcatttggcaagtctatgtaaagaagaaggattcgttgggctggactccggaggagacatttaacacctcagtcacagctcctacagggagcattttgaatcattcgaccagtgaccgtgccttcgctgatagctcaacaagaactggtgagcgaggctatgttgatggcacaacaagagccagtgatagaagctatgtggatgccaccacaagagcgacagaccgagcctatgctgaggctaccaggggtgtggacctacggggtggggcgttgagaggtgctccaagaaggtatgtgtcccctactagatatacaggggccgcaggaattccatatcgacctgtttcaacagagcctgtgcttcgaaccacaccggagctgaagtatcgaggcccaggtatggagccccctggttttcccaagaaaagagacacattgttctcaagcaaccagacagtagtagatgatcatgttgattgactgtttaattagcggtgtagacaacacgctaaattttgaaggggttttgaaaatcctgcaccaatgtgggcagcgatccacatgtgtgttgttgtaagatgtaactcaaaaatgttgtatttgcatgagtacattacagccattgatatgatgctgcagatggtgaaataactttgaaatttatgggttacattatagctatgaaagaagggattgttgagctgttttcgtatgacttccatcttcaacgatgtaggaaaattggacaagtttacaataatttttaacaatgataggctggtaggatgtactatggaattgctttaattatacagtggcgtgttgagcatcagaaaaattcagcaagttgcatttgcaataattttagccatagacactacaatatcagtgagatctttttttttttcagaattcactaaagttattaatgacacagtttgcaaactttaaagctcaacacatcacgtgtaacattttaacttgattttctatcactatctgatctctctattacctttttgcttccaagataaggaggatctgctgactgccattgcagatattttttagtggttgcaactgctacatcatcttaagttggtgacaatgacatggggcttagaatggtagcctgtgttgtctaatttttgtgttcttttagcatgacaagtgattccttcaatctgattcccatctatagatgataaccaatttagttatctgggagatatcataccagaatttattctgacagttttacatgaattagaatttaatctgacagacatgaactctgctcggtctgca

SEQ ID NO: 47219 - DNA, 1802 bp, Oryza sativa
gaaggccaacagcggtggaggttttgcagcatcccttctttcaggttatttttctggttattactttccatagtacatgatgaacttatttatgagtttgcggtagttgtatatttgttattttgaaatatcataattgtttttttttacagccatgcttctacatccccccttcacttcgattcagatcaacaaacggatatgcagcaacaccaccatcaggtttgtcattatcctggcgatgtagaaactcatttttttcattattagaacattgttattgaagcaatttgaataattgatctacagttggggctaaaggagctgtggatcagaagaatgctaggagatattccgtggggcccttatctaatgggagaccagccgttaattactcatacttgagcgctaacaccccggcaagagcaggtatacccatttaagatggtttgtcatgctcatttcataggggaggatttgtggctgttgcacttggaattataacaaactataattacctccttgtagctggtgtgcaaaggaagctggagttggatcaccaggtgaatatgaattcttgtcaggctccagagggtaaccataaactgacaaaggcagaggcaatgaatcagccttggtccagaccaccaccagcagcagcagcagtaaggagcaatggtgagtgttgttttaaacaaactatgggggtgtttagatctatgggtgtaaaattttggtgtgtcacatcaagtattatatagggtgtcgcatggggtgttcgggcactaataaaaaaactaattagtccgtcattagcagatgtttactgtagcactacattgtcaaatcatggagcaattacgctcaaaagattcgtctcgcaaattagtcgcaatctgtgtaattagttattttttagcctatatttaatacttcatgcaggtgttcaaacgttcgatgtgacatggtgtaaaatttttgtgggggaactaaacagggcctatagttgaaatgatttttgtctctttatttttgttgatatcatgcatgcatctatttaacttcacttctcgcatcccttatgtaggaaattacttcactaaagaccagggccctcgtgcgcctgacattgcggagaagctgtctcagctgacagtgggctccaacagggtgccaagcttggcttcggacaagtttgtggatatgaaggcaagaacccatgggaataccatgaagcggcctttgcctcctgtgggaaccaggacatggcacgccccggccgaccccttccggcgcccatacgagatgccaggcgacagggctttccttcccaggaagctcgttagctgaagactacgatgaaacggaagctgccgccacactcctctttgctaccctttcaccaatcctcctactatcctgaaaaataagaagccaacagagccgatctccctcgaagagtttttagtgctgtttcctagtagtgtcgtattggttgtgaatctcataccccaataaaaatggagatgtgccagcctgctggtactcctatcttgccttgcattggcatccatccatgacagcacctcgaggatgcagctgatcctcgggggcatgcaagcatggccgggcgcgtctgcatggaaaccttgtgtttcgagtcggaactgtgtgttatttgctccctagtgacgtgacgcttgttgagtcgtttctgctctgcgttggctggcccctgcctgtgacatcgcagctactacagtactactactactatgtcaaatattggtataagactatta

SEQ ID NO: 47220 - DNA, 4903 bp, Oryza sativa
tgcctgccaaaggagatggagacggagacctcacgttcatcaggttcaggccgtgctccctcctgccaaaggctcagctatctttttcttttttttctctctcgttttcccttaccttcttgtatccttttggcatttgcatttgcattgcagttgccgcatcatccctcccagatatcggctcaaaaggctgcagttaacatctgagcggcattctccttttggagttcacgtgcacatatctttctttcatcgtcttcttttcaaagcaaaaggaataacgaataccacaacgtcacgcctggttttgattctacaaacttgaattattaagaaaaatggaaccttcttttcttcttttttcccaccaaaagcaaaatacatagcacaagagctttaaggaggacgttggcacatgccagattatcggctttggtttccgcaattcggaacaagtagatagatacatgatacatcatagatcatctactacaaacattacagacagccagtaacttccagcagccggcaggtcgtgggttgcaggtacaaaacatcgtggaatcttaaaacatgatgatggataagagttttctgtctcttctactagaaaaaaaaagtagggttctcttaactagttcatagcacgatacaattgaacaaagaaccaggggaggcgcaatcactgatccaactcactagcagcggtaaaatgcggggtagaggtccaccccgctgccacaagcagcaaagttctcaatcacctgcatcatcaaagaaaatggaatgaattgtgtgagagaaatgttggtgaagggatgctcaaggtagacgcggaccgataggggacccacatctgggcatcgggatggagatcgagagctgggttgtcgagaaggaggtctggttggacctctcctcatccatctccgaccacgagtctcgcctcccaggccactcatcgaagaaaggcctcagcggctggttctcgtgcttcacatttcctagcatcccccccgctccaccaccaaaagagcggcgctcctgctcttgggacagcgaggcgatggtgacctggccaagttcctgtgaaggttcaaggtgggagtaggagtaggcacctggtaggaggccagagtcccttggctttgacatcgggtatgggggtacactggaaggcagtgaatgccatgagctatctgttggagaatcaatggtgaagcccctggtgtttcctgatgctcctgagaagaagctcagttcacccacatcagctttagctccaagagagtacctgcatagccattgatacatgaaaattaggaccagacaccagactcagacacagtacatgtagatttgcgcagcatcaaatggaatataatgggatgattacaggttcacagtagctaagggatttctacaactcaaggggaggacataaaagcagctgcataggaaaaatgctaccaaaacgataataagacaacctactatagttaaaaaaggaaaaagaacgaaaaatagtcgaaggagcaaaataagctttgtcagtcatctagcaagatgcaaatgcaaaatgacacgaaactagaacatatgccatgcatgcagcacaagcataaggatggtgtcgaaggtacaatatttttattttgtgattgctagcagaggaggaaatactaaactaaggtatggcacacaaaaaagatgacacaagcaaaattttccagcataaaaaagacggtaccaagattttagagggcatggaccaaaaacaccccagaacatgacaactgttaacactatttctcaaaacataatcaggagttagggcaataaaggtcaaaatcagctagggcttaggtgatctggaaaagcgtacaatattactgcaaaaagcaacagtataatagggctaaaggcacaagcaacagacatatgcttatgacattgtgcccacagaggtttgtagcatcaaggatggatggaatgcaatacacagatttaactaacataatccaggtacaaaatttttagttggggttatggtcacatgtaaattggcagtatcactcatctgactaactcattgaataagctctgatcgacaaattcttaggcagcctcacacacttataattactggaatgagggtaggttcactacttgagcaataagcatcaacaacattagagctcaaatactattttgagtgtctcaacccttttaagaaagctaccagatcagctctattccagcataatatgcaatcaatctaggcaagcttaattcaaataagcattcaacacagagtcaatgagattagaggggatacttgctgccgtacgatggtgcgtcgacatggaactgcgacgagccagcaccaccaagggacagaccgtgggttttagcacccacagtgagtgacgggagaggcgcatcggtgtcgtgagtcgcggtcgtgacattggacagctggggctgcgactggggcgcaggggcagcggtcttggattccacaggctttcttgaacggttgcggccacggtgcatgtggcgctcgcagtacttggagtcggggtgcgcctccttggagcaccgccacttcttgccgtcggtgcggcggcaacgccacggctcagggtcaagcttcttgccatagtaggcataatagctcactgcagtgacatgagcacaggcacattgaatccatatcagcattcatcattgttcatattaaaactagatcaaaatgcaccacttcaacatttcatcaacccaatgcaaagttggtaatggtaataactactatatgcttaatttgcttaggatataagagtgagcaaagaatcaatcgaacagcttaaacggacatactataagcaaagatccgtgtacgttcatctatcaataaatcgtgagagcaatagcaaatcaatcccaatgagcagggcagcaaagagatcctgtcctgaaagaagaaacaaaaaaaaaagaaaaagtcccaagaaagcacacgcgcacacatatataaatttttctcagatttgaatacccaagcatgaagcaaacaagagatggccatttgtggaaaaaagatggagagagagcttacgagaggggtggtggtggtggtggtagaagggcgcggcggcggggttggcgaaggagtaggtggcggcggcggaggagtgggggcggattgggaggaggagatcgcccgggacggggacaccggcgacgaggtacttgtaaatgagcgcctgctgctccagctccgcccactgcgccgccgtgaagaccgccgccccgcgctgcggctggtaccctcctatccccggcgccgccgccgagggcgacgagctcagcatcggtcgaaccaggcaggcaagcgagcaggcaagcaggaagaagaagggaggtcgccggcggcgaggtcgggagggggagggggagggggaggggaggaggaggtcacgtgggggttggagggttcttggtggcggccattaatggaggagggggaggagtcggtgggaaagctgctgctgctgctgctgctgcagcgtgtgagtgtgagagggagaggagagggggatctgcttctttcttcctcctagagtatctatacctatttaggtcttgtttagctttctaaatttttaattagatattataattttaattattttttaaacgggtagttacataatcctagaaaatactccatccctcttataatataacgtcttataatataagagattttaacgggatatgacacattctagtactacaaatctggacaggctcgtagtcctaggatatgtcaaatcccaccaaaatcccttatattatgggacagagggagtaaactactaaaatagaagctagaagttactcactccgttacaaaataatttaatttaggatgtccataatcgttggacacatctaggttatgttattttaggacagagtagaaattgatatgaccaattctttttattattataagttgtgtcttaccatctttggccttgtttagatctcctggtaaaatttttcaccctgtcacattgaatgtttagacacatgtatggagtattaaatataaacgaaaaaataactaattacacagattgcgtgtaaattgcgagatgaatcttttaagcctaattgctctatgatttgacaatgtggtgctacagtaaacatttgctaatgacggattaactaggcttaataaatccgtctcgcaatttgcaggcagattctgtaatttgttttgttattagtctacgtttaatacttcaaatatgtgtccgtgtatcggatgtgacacgcaaaaactttacaccccttatctaaacacagtcttaatctcttcaagcaaaacctacatctatatggatgttaagttaggccctgtgtagatgggactaaaacttttaagtccctatcacatcggatgtttgaaaattaattataaatattaaacgtagactattaataaaacccatccataatcttggactaatttgcgaaacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacaggaactaaagttaagtccctggatctaaacaccaccttagtattaacttggttctaacaagaaattattattattccatcagtcctataaaaaacatagtgcggcatcagtactacgaatctatacagctcgaaacgtgatacatcctaatactatgaatttagatatctctggtcca

SEQ ID NO: 47221 - DNA, 2781 bp, Oryza sativa
ttcctgcagcccctattgtttttttaaaagattttctaccaagtactattattcagttgaaaaaattgaacacaagacaacaaacctgatctaagccacttgctttgtttcacattataagacgttttttgggttttaaacagattctgcatgaatccatgtatgtgtttcatatatgtgtccaaattcatatggatgctagtgaatctagacgagggatggagagaccaaaacgttttataatgtgaaatggagggaatatggttttaagtctgcacacactctgtttattgtttctggctgccctttacagttgcaaaaagctgttgtcaaatgagtagcaatccggtttcagttacaaaagaatttatcgggttcatctctacaaccactggtttagcaaataattcatctgcaaaacggtttagttatctgactgttaaccccaactgtgatgcttacttgaggacaccacatgtagtgagttaagctaaaaggctaaaacaagagaagctcacacaatccaaccccctagtaagaagcaaatgcaatatgcatgtcaaaccaacccacgttaacaaatcttaatcttttctgaatatgggatccacctcagaacacttagaatcacattttgtattttgaacatcagagaagccgggccatgtgagcagcatttcagtttatctttcagcaatgaattaaaagaaaaaacgagatttggagggagagacgtctctccaaacatttttttaaaaaagaaattgttagcatgttggggattgaacacggctgtcagcagtgaattgtggagcctcaggtacactctttcactcaaaattcaacaatgcggaaccacctatttccttttccctctaggttgttcgcttacaagttcgtggtcagggctccagaatcgtcaagctaggatagattctaccgcatggtgcaaacaaaagatttggccgaagagaatgccccaaagttttgtcactttctgaatcgcttgaacaaaacgagcgctagtacagcacagaccacgaacataagaacgaatcgggacagatttgtacaaccagtggctgtatcatcgcgctctccttgaccagttcatctaaattgcgtgggaaagggggcaaaaaaagatgaactttttagggatcgacacactcactccccaagaaacagacaaactgcgaactgctacaacttcacgggcaaaagagcaattgaagacagtaagatttcaaagaagtagggaaggtaataagggacgatcattacctatggatggatggatggattggatccggtttcttgcttggtgctgctgtctcagctccaacaagttcttggtgttcttggctccttcctatccttttgcttgctttctgcctgtctggttggagtgttgtgggtcacaggaagagagagagagggttccagaatgcagcagagaggtaggggaacgatgagctgtctcggtcccagcaccctactacaccaacatactcctacgtggagcaacatggctgaacctgcactactactgttaacagtgttattactgtgctacaagagcattttagaaattattatgaccaaaatttgaaagaccgagtgaatctttatcgaaatgttaaatactaagcatttttaagtattcaaattttatacccaaaataaacattcctatgagaccgattctcatacatggaaatcaagcgttttcagccaatgggctgctgaggaggagaatccacgtaatcaaaattcaaaatttaactaataaaataactttaaaaaagaataaaaattaattttaagtacttgcaaaacataaaatgctccggaggaacggacgggatattcatgaccgtagtaaaaatttctctgtttatttcttggtctaccacggtataaacagaagagtatagaaaaaaaaatccggcccagtaggatggcccaaagagtacgcttacctgggccgggcctcctagcaccgcgtctgacagttgggcccacacaaaaccggatttcgctgacaagttaagggacctcaagtgaacttattccgattaattaagcgacggcttcctcctcaactagagacgcccacagcagcagcagcacgccgcgcgcgatggccgccggagcgccgccgctcgccggcgtcggagaccggggctcgtcctcctcctcctcgcacccgcctccgcctccccctcccaagatccttctcgccaagcccccgcttccgcccccctcgtcctccggcgccgacgacgacggcggcggcggaggaggcgcgggccgctcgcggcaggccacgcagcctggctcgctcagcctcgtctccgacgcgtgggaggtccacaccgacaagatcctcccggtgcgtgcgtcctcaagtggctttgctacgaggatatgcttcttgtttctttcatttccttttgctgttcagggtttacttactggttcgatgcaagcattgtgataaaattgtgtgagatcctataactagattcagttgacaatttttttttttgtgtctggttaatgcaataatccattgttcaatgcagttgttagttgtaggctcgtagctcttatacagtttagttcatggtttcctaggttctcttgagatgcattctaatactatccctgatgataaagcttaaatcttgcagtaatatgatatatgccaatgcgacctttgtctagcacgtcaaaagttacagtttgtgcatgaaactggatttgggctgcaggaat

SEQ ID NO: 47222 - DNA, 1460 bp, Oryza sativa
ttcagcattcagtcttccaatagtttcagttcaattcattgttgttactttcatgtgtcaaacaaaacatgcgcttgtcagaattattttgtagatgcactctgctgttgataatatgcactctattaagtccttaagcttctgtttttcttccatacatcaattttcccctaacctcttttgtgtcttttggcttgctgaaaaagcgtagtgaagagttgtaatttggctagcaatttgttccatgtggacacctagatcaaaccgaagctcatttagttgagtattgcctgtaggaatgcttcctccttttgctacacaaactgaggaaatcaaagcaatggctaagcactgtactgctggcattgatatcaggatctctaatgaacgggttatacttctagacactcaggtgataagagttatttaactcagtttctgctatgcaatgttccaaatgccagagctgttaaacatattgctggtaacgttctaaaaaacaatcaccttttgtcttgcagccagtattcagtccctccgtactaattgatatgatgaagccagatggttcatccgcaattcctatcctcagtggtgatccattatcagcagacctggctcatgagttaatgggaatccaggtaaatgctatacttcaattctcgcactgggttgtacccactgctaactgagcttgacagtaccgaatagttgatcagtgttttatgttgttctgcaaggaattgctgtagcttggtgttttcttggcatctgtttgcaatattttgttggttgtatcggaggggattaatgacctgtccatgtgggacctcattcttacggtaagttgtctgtctatatttgtttatgcctttgtttttatcatccataccacttgatcacattttcttacagtgaatagttaagaacacatttatatcctccagcgtattagagagctcagacctgaaactccgtattagtatattgtacttatgaaaatttgtggttatgctgtgttgatgaatttagtttctgccaatggcagaaagttgaaagggtgatttaatacaatttttgcaggttgatttactgaagcacaacatacctgatccatcattattgacctcctcaactacccaagacaaggaaaacaaaaatgataaccaatcaggcattgaagattacatagctgatctctgttttgtgcatgctaggtgaacactgctcagtttcatgcttgtttgcattttcttatgttatcatatgctcatttcttttttgatgaacaaagagatccttttgttgtttccggtattttggcagtgaagttagttgttgtgatatgaacacaacacttttgcacttaattctacaatccaatcttttataccaattaatttgataatcttagaatggtgtggttttctaactgaacagattgcgggaacaagactttt

SEQ ID NO: 47223 - DNA, 705 bp, Oryza sativa
tagttgcatctgaatcactgttttgtgttttgactaaaaaggattatcgatctgcttaagttttgccacaaatttagtgcttgatgagtgtaaactcatctatccttgtaatctgcttgtcaatttggggtgtttaatattacaatttccagaggaattattcacctattacagtactaagtggtggttgtcatttgaaattgtagtaacatatggtattcttatgtttctccccgatggggactttgcttagcagctgttctactttttttttaaatcatgacctttcaagttccaaaggcaatgcttttggacttgtttcgtaatacagacaccaaagatcacattttatcctcgagttatcgtatctaacaattcagtttcatctttcagggcgcccaggtattttcaacctgaaagacagatacaaatgggatgcttggaaggccgttgaaggtatatgccgatctctttaagtcctcaaaaacatatatcagctaaactatataactttgtcatatctgcaaactcccatcaatgcttacaaatccaaatcatggtgaattcagggaaatccaaggaggaagctatggccgattacatcaccaaggtgaagcagctgctggaggaggcttctgcatccacttcttaggctattatgaacaacaccatcaatagtgctgcatatatgtaccaataaacata

SEQ ID NO: 47224 - DNA, 1153 bp, Oryza sativa
gcataggccggtctatttgagtgcgtcgtgtttcaaaaaactctattcttctaatatattgacgtgcaatccttttacgcgttcgaaaaaaaaactatacttcagtagtacatagtagatgtgtttgagtagagacaagagaagggcagtggaggttcattgcatcatcctgattattccagcaaaagaggagatggatggatagagagaaacaccatcatcttttgccatcctcatcctctccctgactcttttcttttctcaagatgccatgaatctgcaggagaggaggtgcactccactccagtatggcaggcacgccatggtcgacggctgcagtatacagtatatgcttgtggaatccttgttggcttaaacaagcacaaaagggacagacaaacttcgtagaattgtaggaatttgaaggcaaattgttcggttcattcaacagctaggaaaaattcccacaattccgaagcgtagccttaaaacgataagttaaattcagagaagacagacagacttaattatactcatgaacaaagtatggattgagtaagaaattctctcataaggattggcaaatatataattgaggaaggttatagaagaaattgaccagttggaaggggaatgtctttcgataggaggaaggcgtgtgtcaattaattcggtgttgagttgtctaaccatgtttaaagtatcctcaagaagctaaattactataggtctaaattttttttggcaaagtgatggacataaaaaaaatatagaatagggaatttagatatgcaaaataaatatttgttgagtaaatagttgtatagtaagcagctgccgcggcaacaggttgtctgacaatgtaaagcatgtcctaccggattttacgagttttgaactatttcctatagaattcatgttttcttaaaagcagaccagttattagtgcaatcaaccggatagtttcaatgttcgctgttcatacaacgcagcacttattttttttgttttgttttatttatcgtttataactgttgttctctatccaacagttcactttctttgcttttattgtctactgcttgatttaattgttggtactgttttgccttcacagtttccattgtctactgttgttactgtttgtcttctt

SEQ ID NO: 47225 - DNA, 1564 bp, Oryza sativa
agaggatgagatgcaccatgctcgaagaaatgtgctacagctgcactgtaatcaatagtcgactctaatgtgcaatagcatgggaccaggcaagacggctgctgaatgaggtgtgatcttcaggtgcagttgacaaaagagataacgaggaagtctccgtaaagagaaaacctccagccaagaacttcctcgagcagcgaaatgtgcaatacagaggaacttgtggtgtagagggtgtactccatatccttaatgagaatgctagagccctggcagtgcacggtgttggaacctgcaaaggcatgcaaaatgaatataaataagcagcaaagcaatggttgaaaacatgtgtcagtgaagtaacagggaaaaacatagtcaaagtgagaagagggcatttatcgattcatgctaccaaggagcaccaaagcacccatgaaattagacgtcacatgcatgtgccaattcatgttacctacaagcatcaaagcacagagcacccgagatgcactaatttactttcgtcccagaaacactatgagatttgagtctatggatgcatgtgccgtgaaacaacgttaccaaaattaacataggacctcaacagtgataaattgatactacaccatatctattgattgcaacgaattgattgaattctcgcttcctgcacaattaagacagtgatcttgctacagcatacatattactggtaccaacatgatgccaagtgatgagactagacatgaaaaaagtattgagaactagagtaagtttataatcagttgccagtaaattaaacatcagacgcataacatgtgcaacctagcataaatcggcatgatggatgctcaggaactgcgattcatgaatagacgtgaggaatatccgtgactgatgaaccctagctcacacacatcggaaccaacaactcctccaccaaatcccgtagaaatcatgatgcgccaatcccccaaatcaaccctgctaaactccctcgaaattcgaaccaaaacaattcatccacccccaacaaacccccgcaccgatccgaaattccgaatcaatcacccgatccccacccccacccccacctcccccggcgcccgcagcaaccaccgcgcgatccccaaatcaaactcatcagacaccccaaccatggcacagccaagccacgcgtcgattcgattcgattcaccaccaccaaatcagcccaaaattgaatcggaaagtgggacgacgagcgagcgagcgagcgagacagacctgggtgcctctcggcataaccgtgcgccaccgccgccgccgagggatccaggggacgccgccgccgccgcctccagcgctgaagaggggggagggggagggggggaagggtggggatcggatggcttcgtctcgtctcctctcgcgtcggggatttttttttcttcctctcgccttcctgtcctctcctctcatttatcgctcagccgtccaatgtggcggggcctttttgcgatacggtccctgtactactcggttatacctagtccaaccttgccgcgttttctttgttctttac

SEQ ID NO: 47226 - DNA, 11911 bp, Oryza sativa
ctattagctataaaacttgaattgattaacataatttttatagcaacttttctatataattttttaaaacatgccgtgtagcaatttaaaaagcatgcatacaacgaataatggagcagtaaatgagaaccatgagtagtagtaggtctgagcagacccttagtaaggtggtgtttggatccagggacttaactttagtccctatatttagacattaatttagagtattaaatatagactacttacaaaactaattatataaatgaaagctaattcgcaagacaaattttttaagcctaattaatccataattagagaatgtttactgtagcatcacataggttaatcatggattaattaggctcaatagatttgtttcgcaaattagtccaagattatgaatgggttttattaatagtctacgtttaatatttataattagtgtccaaacatccgatgtgatagggacttaaaagttttagtcccatctaaatagggtcttactttctttgtgtgcgaccattttttttatgtttcttatcacacgacatatatgcatatatacaattaactagcacatactcctctttttagtttatttttctaaatcatttattctcaatatctatgattctattgatcacatgaatttatatttattagagtgatccaaatgagaatatgataacaattattttgaggagacgacaataattttcttagtatttacggtagtagagatttgtttctattttttttaagaacggaaggagtattatattaggttaaagagttcgagcaaacatgtcgaaagatcgggctacatgttatagccggattatcttgttatcttagtcggaaagtcaaaagcaagatacgtgagatttgagaaccgtcatttgaccatgtcttttaagaaaaactcatggtagttatcatgttacactgtggatcctaaattgcctatccccacacttgaattaatatatttttctctttctcttaacagcattgagcttgaataaatttccacttttactatacatgaagcaattttgtccctgacctgaaaaaaatataactttaaataaacaatttagatgtggtaatgatctactccttggtaaattaataacgggcaaggtcagtgtgcatgaccaaatatttggtctgattaggtgtccttccagagtggcagaattcgttcggtccactactggtccatgtccctcttgtccaagacacctaattaaactaattaacaaatgctattaatcgtgattagtacactgcatgggcatcagagaaagcaatgggtaccgacttgcgtacctaaaatgcctaatccgtatcgctgtaaacacaatgtattattggtgccacggtgattagtagtaggagagatttttgcttgaagcaaaaaaaaatcgcacatggtacgtgtggtcgtgggtgcattgcgaatacattaattgattggttcatgatttctgtctatctcaatccgattgttcgtgcttatatcgatttagagcaaggctaataatatagccgatatgttagctataaggttttttttttgtcttctctcagcctacttacaattaatatagttagctctttacaattaatataggacccacttgtctctctcacatggtttattggttcttatatccaggccgcctctaagtttacagcccgcttctcctctccctcctctcttctctcctctacctcggcatttagccgacttataacctattattatattttcttataggtgaatatcacccacgatttaggacttgatcggttgtgctagctgctgtagctgcaacaagcaagccattcacaactgccgcaaagctctttggtttggattattggggctggtgcagcagcgcgccagcccgcactttcgatcaggaccttaattacagtggtctcgttctcttggacgatgttaactctaaaaataattatcacaatgttgtctctttcgtgcgaatagtgttatcttaagattatgttattcctcctctttcccaactcacattcatttttttcgcatgcacgtttttcaaactattaataaaagtttttttatagaaaagtttactgaaaaaaatcatattaatccattgtattaaagtttatttcagttaatacttaattagttatgagctattacatggtttgttttgcgtgctgaagagaagaggttcccgaatacagcctaagggccaagagattaaaattttgagaagcagctggttagtagctggcttctgagagtctgaaaatgctgggtttttcggtttatgatttctaaatcattttctagattctacgactacatattattagaactatttagagaagcttataattctgacagaagctacagccaaacatgtcctatgtagtggtcgattcaacttttcatgacttatccactgataattttgtttttcctttctgctagcatccatttgtgtgtgcttatcggtataggcggtaccgtccatgactaattaaagtggtttcgacctcttggatgatccggagactaaagataattagcacaaggttgcctcttttgattgcaaataatgttattttaagtggtggtctccctatttcgatctaaatagcagccacaataattgctactacatccgtaacgttttatattataagactttctattattacccatatacatatatctggatacatatatgcctagatttattaacatatatataaatatggataatgttagaaagtcttataatataaaacggaggaagtagttgattaagtattaatgcaacgtgatgggggtcgtcattacatttgcagacaagtagacaacaataatggcgatgcaggtttggattatccgtgtatttaggtgccatgcttagcttaatactactccactttacagtcatagccacgtcagcgtgatatgcttctcattttctaagtaaattatagtgtgatttaagttacaccaaaccatagtaattcgagaacttctacggtatactacagttttaaggctttgttaactacggtatactacagttttaaggctttgttaactaatcactgtagcacggttaagagcaagtttaatagtatagccagctactggctctaaattatctgtagttaatttaatagtcaattcatacaatagttacctacaaacatataccgcataattaatctctggtcccacctatcatacacatatgtatattggagtccgtgctgcagctggctataaatctgtaacccgctactcttatctctcctcttttatctctttaaaatatgtttataactggcttataatttgctattatatctgctctaaatgacatagacggtgcattaaatgaacttataatttcgatacataagtttagaattgatatgtgaccatgatatgtatcaatatacgtaacacattgcgaagtgagtgtaactcgagaagggaggtcggactcccccatgactactgccctctgccacctccatccatcgatcctgagttcctgacaagcaggcgtagcaaccacccttctcggcccctcttccctgcatttgctgacgttgttcttgtttgcactctcaaggtgagcctcgtatttccccttatctcctccactgtcacagattccggataggctcgtgtttcttgattcgatggcggatggatttggttggtggattgtgtaggtaggggaggatatttctcggttttgccatgccgtacaacagcaagatgggagcgaggaaggacagcgaggcatgagggtcgttgtcgggttaatggtgtcgtcgcaacgagagaggcggggctcgtcgtactccaatgggagcggctcggatgacggcgacggtgggggtgactccgacaccacgtcgaccctctcgaggaagaggccgtcatcggtggtgcaggtgccactcaagaagcagcactagccagaagaggggcgcggcgaccgcagcggtggtggtgggtggcaggagggcggcgacgacaatgatcccttattaattgttgtcgtccgtgggcccatcacgttggctattggctactccggcctcttcacatcgcccgcagtgcgccaccttgaagatgggaagagataggaagagaggtgtcgatggcgctcttcagtgccgtgctggtgccggtcgcgttgcgacgttgatgcgtgtggcgtggatgtactgctcgctagcctcttcgccgagctagcctcttcgcctccttcctctccatgcacgctcggccagcttcgactcgccgatggagatatgagagaggtagagaggggcgaggtggacgaagtgggactcactgatgtgtgggtcccacagttttttttatctttttgtttgacggacatatgtgcccgtatttttttttagtttcaattttgctctttttttatcaagctgtcacgtaagcgtcacgacattaccacgtgagatgaaaacttagtcaaggagccatgaaggcaccacgcgagttaaaaacggggacaatactaccgataaacctcgtttacactggttttataagttggggggctgtatcagatatttcggttcaaaggatgaaaatgggatttggtgtcaagttaagggacctcaaatgaactttatcgatgccaaggccggcccatctagttattacccaggaagacctccggcccacgcagcccgtcgcgtggcggtaggtggggagggggcaggtgggtcccgcagtgcccccggcgtcgcggggtcgtcgtgtcgcgtgccggctgcgctcccctccactcctcctcccctccccaccccacggtgccgtgccctccacacgatcccccccccctccactctctctctctctctctcgcccgagtctcctcctcccgcacggaagcagtagtcccgcaggcggagctctctctctctctccggcaaatcggcgaggtgagctctctcttctcccatcgctgaatgaatccgcgcctaaggctctagggtttcgtttgcttcgactatcatccaccctgctcggatcgccgccggttttgctcttttggttaggggtgtgtgggtgcagcgagtctaggcggatctggcggcgatcggtgtgtacgggatctcagcctcctcgttggggcggatggtcgccgggccgccgcggcggcggttgacccgaatttcgtgtcgaattttgcgtgttagtgattgatctcggtctgcttcccctcccaattacttggaggttcttcagagttggggttgctggtcttcagaattgggtggggcatgagacaattcgcatggcatacacctctttcgatttgtgttgtgcgtctgtgttagttgcgccatcaacgaccgggaaggctttggtgaaatgccgcgccccactttgtgggggaatgagagatgattgcggtattgacgcgtgcagactgatcttagtgctttgttgtcgttgaggttcacgaaacatgagcgaagaggtgaggtgaagaataaccgagacgtttatggtccttatcatataatcttgtctaactagtggtaactaccatgatgccatggaccaataacagctactagaactcataagactacgtatccatccacaataggaatatacgcgtgaccaactcttagttagcacacttttttcctaaatgcacacatcatgtttcagtcctttatggtaacatcttgaccttcactgagccatttctctgaccaagtggcaaccttgagtccttgaccatacaagaagtcgagtgtctcttggtgcgccgttggccaccaacatagatagacaatgccattcatgtagcaggggcaaggaaactcttgtaagaatctgatatcatttggttaatgaaatgggagaggagctcctctctttctcaaaaaaaaaaaaaaagtagcaggggcaatggcagcatctccattttttttcccaggatgtactcatctagcttgactttgtaagtggttttattccttatgatgtctaatagggttatgcactgtttctccgcccttttagaaaatctagtttgctaaaaggtatgaatgctgtttttagtagaacaaaaatgattgatctagcatggcactgagtaagtgtgttatgttatatttctcactttgtaaagcaaacactcctgaaagtactatactctattgcccttgtaattcatttagggtaatgtagaatcacagaaccagctaaattaatgtcctccatgtctcccccattagtaaaggtacaatgcgttgcttcaacttaccaggcttctcttttgctctcacatgcgcatgcatgctgtttgtttgagggtgatgtgagtatgcttaattatcatgacggtattatttatttcctcatgctcaagtgtgttgcttccacgatcctcatttctgcttttttaaactacatttactaccataagattatttatgttcatttggcatggtttctccaggatggaaatgttctttggcagttttcttaatgaatcagcatcacaagagtacttctctggtcgtccaaatgtcgagagatgcccattcctgagaaacatcaatggagctacaacattttcattttcttctgctttgccagtagctgtaagatcttctttacatgacctctggtgatggcattatcaatatcaaaagtgcatttgatccttaatctgtgctattgtgcaggcccgaggagccaagggtccaatttttgaggacggaccaggctttgattcagcatttaaacttttccatggacgggatggaatagttccgctttcaggaaagtcatatgtacctgatgagaacaacagcgagagcgttgatgccaagcctgaacctgctctgccgtttaacccattggctgctagagctgccacaataagtctatctgcatttgggccattcggctttaacttctttaatggcaagggcaaaaggcagaacaagaagctcaacaatctaaatcagtcaaacaagaagcccagcaatccgaatcagaattccatgaaagtttgtcctcattccttccttttattttctttcttttcgcatatggatatggtgctatgtttgtgaagtcctatctagtttctcgctatcatgtcctaatagcaatgcaaactttaatgtttctcgctatcaagtccgaatagcaatgcaaactttaatgttttgtctattattccaagtaagaatgttccgtctaacagttttaccattttattataaagaactgatccagattttgttcagttgaagttaagtgatcgtgattttggttcacaagtaggcattttggcatttccctgggtgtttggctatatgttatttctcatgtatgatgtatccaagtgcacagtgttcttgattggacagcagtagttgcatagctaggattttcatctatccaatcagtttttctcatgttctgttttgaaccattttcagcagaaaggaggtaattcatcatcgcacgaggcaatgagcaacgaatggctggaaaatgggcagtgcccacttgcccggtcttaccgagcaatgagtggcattctgccccttgttgccaaggctttacaaccaccagccggtgtgaagctgaagtgcccacctgctgtggtcgctgtgcgtgcagcccttgcacggactgaacttgtgaagtctctccgtccccagcctctgcctgcaaagatggtagccattgcgttgctcggaatggcagcaaacatccctcttggggtgtggcgtgagcacaccaagaaattctcccctcagtggtttgcagctgtccatgccgctgttccattcattggaatgctgaggaaatctgtcaacatgcccaagactgccatggcattcaccatagcagcctccattgttggtcagacaatcgggtcgagggcggagcgcattcgtctgaaggcactggctgcaaagagcgacgctgattccaccaccgtggctgacatgtatccaaacaagactggaaattgcagtgacaccgagggcaaggcatgggatccgctcgcgatgaagatgatggcgggacgggcttctggtggtgctgctgctccaacaccaagcatgtgtttctgattgctcactgattggaaaatttgtatctaccagtatccctggagagtggagagttgatattgagtctattttatcttgtgatgtaattgcctttgcttgtccctcagaagtattcgtttgtttgtggggtgagacaagtggaataagagtgctactatatacacgatcattctgttgttaagtttgccagttctgcagttcatgtatctgtaatttgatgatgctggatttctactatttatcaatcgtcattatactgtgtgtaacctgttggatgaacgcttgttagctgttctggtgagtgacatgtagccctctttgaatctttttattgagaggataatcactgtatctacttgattgtacaaataaattaaatattttaagaaataaactcaacaaatatcttaaaacaaatggtttaagtaatgcagtaaaagtcctttttaaggaaacatattttttaattgtagagcaaataatttgataaataaactaaaattttaataatctaagagtaataaataagctgaaatttcaataatccgataaatacgctggaaaaacatggcttggacattggctgggtcctaccggcagtgagagagagcagcctgccaagtggggcccagatgtaagagaggtgtgaaagcgagattaaccgggaggaacagcgggctcccgccatttccattcgcgcgtagcgacgcctttcccgcgcagaagaattcccttttcccgcgagaatcctttttaccgccatttttcttggcgccaagcccggctttcccgcggcgcgctcttctccttcctataaactcccccatttcctctctcttctccatcccaattcccatctgctcctccaactccaatccaatcgagaggtcgatctctgaatctgatctgatcaccatggtggtggcactgggtcccggccggttctacggcagcagcctcccacggccgcgcttcttctccggcggcgaccgcgtcgagccgccggtggccgtcaccgacccgctcatggcgtgggcgcacgaggcgcactggtccatgggcggcctcagctccaagcgcctccgcctgcagggccgcatcgagggctccatcgacaagctccgccgccgcgcccgccgcgacgccaggaaggcggccaaggcccgcgccgccggcatcaagccccgctcgctcgccgccctcggctccgacgacgacgactcctcctccgacgaggaagaggaggtcgaggcccagaagcagcagatcgtcgacgagccgtcggagtcggaggaggagcaggaggaggagaacgaggaagaggaagaggaggaagccctcgccaccctcgccgccgcggccaagaggaagcgggcgaggaagctcagcgacgagttcgaccgcgtcgcgaccatgcaggagggggaggccaagaagcagaagcccgcagcaacctctacaccggcgaggacttcaccgaggaggaaggccgccgaggtggctctcaccccggcgccggcgagggcgtcaccgagggggaaggctgctgccgagggggctactgctgcaccggcgagggcgtcgccgaggaggaaggccgcggcaaggaggacatcgccgaggatgaagcactgagagaggtggcctgcttaatgtgaaatcctagttcttgctctgttacattggtcgctctagagaatcgagatgtgattgatggatatgtaatgtgttatgtgtgtgtgctaagtatttagtgatgaaaccattgaaatgtgatgctaatctctgaattagtcatgaattcctgaatcaacacatttccagatctgaattctgaacatcttgcatttcttgtttatgagtgatgacatttttttttgacttgctcttatcagccatcaattgttttgcatgatgaagagaaaacgcgattgtcgtttcaatcaaatgatatcttatgatctgtgtccgtgatagaaaatgtcactgattcgtctgtttcttaattaatcctgaaatgacatgctccccgatctgatttctgaacattttgatgctactccccatctctctagatggaagtagaatgcaattctcaatcctttgcttgctggtagtggtatgtgtttgtgttaagataagaacaggaaaagaatggtacatttaggccagcactgtaattctgcagtccttttggtttgtgtgtttataactttgtatctagtattctttgttctacagtaggggtactaatacagggagatggcctattatgtgttggtatcagagacgattcgttctatctcttctagtagtcgctctttttcttccaccagatcctcattttgcttctgaagctcttctatctgcttggtctgttctgaatctttcctgcaaacacataggatgatttagtagtggcaatagttggatcatgcttatgcgactagcgtgctgagaagcatgagatgtctgtgaagcaatgcgcgtaccggttcatgaaggagaggttaagcttcagtgaccggacctctttctctagagtttcgcagcgcttaagcacaacctgtatgtcagatggtattactggtgttgagcttctttcctttgcttctgccatcctaatcaataaaaacataatccaatgtcactcattgttcaagaaatggcattgtcgattacgaagaaagtgttattgtaggtccaaatgccttgagtcttcagatgtataatagttgtatgtgtaacataccaaactaccctacaaactataagaaccacattgtgcatacatacttgcgtgagcgctcaaccctgcgtttctttgtaggatctcctttatctgcaaaagccaaatatgtagggctttcaggtattaaaaacatgaaaaaaaaggcgctatgtgagatggactacatgatcctttaaacttgtttcatgtttcaccagtgtataagcttttgtctcttcagtaattctttgcagtagtcatcctatactgaacttttaagtttttaaaagtagagttccttgttgggtttacctgcttgttcagatgaaatggatcccattcgagttaggctccctttctgcaaatgagtgaaatgaaccgtataacatctgccatgagaaggaaaataagtgatcagaaatatcagttagaacatacctttctgtcatccttcaaattttcttttagtattctctctctgaaatctgtacaccatgaacaaatacacacaatgttataactagagtagagttcaaacaatttataacagcaatagtgtgctcattgaagattttatatggcctcgggtttaaatttatccttaaggttctattttttttcttaaatgtatacctttgccttttgatctacagtcagctgtcccattgccatttgcagcatttgttctagtactctcacaaacagtcattgcttgcccaatgggaggcaggtcatcacaaacttcaaatccagctgaaggtgctgggatagcagtagatgatccactctgcgaaggctctcgagatgctgtaccaagccaaacctggtttgcaggagcaacaaagttcccactgccttgttctgttggcctctcgactttcggaagcatcaccgagtcttgaatttgggaagttgtcaccagagggaatatatctgttcctccaagaatgttctgtcgaaactgttgactgtcataaaaaccaaaagatatgcctgatg

SEQ ID NO: 47227 - DNA, 14615 bp, Oryza sativa
gcaggacagcaaaaggccttgcattcctttgttcactgaagtactgtttagcaaaagaccagcgctgtcagcagccggatcaacatctgtcacaaccggaatatgacaaccctagagtttcagaagttgaaagcgggtggagcattcaactctttttaggtaggtaggttcagactttcagtagcaaatcgtttcgtaggcgagcaggatcagctgcctgggccttgcatcctggaagtaacttcatgcttctaattgtagagcaatgctcctgtcgttatgctaaaacaagttcagattcgttttggttaacattaacttccacttcctcccttgtagtgggtattattccgttctatttcagtgggcagtaattcattgctaggcccttgcattatcaaacaagatttcaccaaaaaaatgtagacctgatatatcatcgaaaataaaccggatagcagcagaactgaaactctgggatgacaacataatttgagcacaaatgacccactatcattgcctctaaaatgcagaaaccggaggcagtgaaacagcacaaatttgaacttgagcaacaacttactgaaacaaaaagatatgaatataggaaaacaatgtaattctttactgcccagtggaaatttttcaccgaggaacagaattcatcaaatgtgagtataatgtaagctccaatgtttgctcacaggtgaagtgaaaaatgcaaaacgtatcctgactgttgcatcttattacaatctcaaggcctagaaaacaaacttcatattcatggtaaaatcacgacactgaaccagtttctctcgtctaagtggacttaacgatgaagttttggcggctgatggggttcatgatgactggtggtccagcggtgcgaggccaggcctggaacttggtgtcagtggcttgccaccactccttgtcagagacagtctttggaatggaacctgcgtccaatgaatgaagcagattaaggtccaatcttccgggaggttaagcacatgcctgtaagactaaactcacctccaaatgccttcttgtcagaaacaaatgtgtcacacaggtaagcaatggcgaaggatccaaccaaggacccagcaatgtatccggccgtcatttttgctgcacaatcatgaaatggcatacagattatcaagtctgatagaaaatgaatgttacagattattcatatgaagagaagcatgagtgaacatcacagtctagaaaaacaagtcccctgctaactgtagttgttctcaaactataaataagcagctttcttgttcattggtataaacacaacagacagacaaaaggaaataagctccagcgtacatatagtcaagcgcaattgtgtagaaatgcagatagtcaaatatgattccaagatatacaacttaatctccagctagtttaacaagttagattagtgcaagatcaaatggcggtcctcttgaaacaagtgatatgataaataatactggacttattgtggaagagtaaatgtgcagtacgactcaaaccacagcctacatataccttaacagaatcagttatagataatagagtagacacatcatttattctactgataatactccactatctcacagccaaaatgcaggagcaaactagacccaagggggcttattgctaactgtcgaagttgtcaaaactataaatcagctgctttcttgttctttggtacgatggaataagttccagtcttccagcacatacatagtcatccacagttagaaaatataactatcacgcctcaagcgcaaatgtgtagaactgtagataaggaatatgcgattccaaaatatacaactgaatctccagctagttcaacagattagattcgtgcagatcaaacagttgtcctcaaacaagcaatatgtgattcactggacttattgtggtagaataaatgtaattaaaaccacaaccatcatatatactttaataaaaatcagctgaagatatagacaccttgtttatttattctcctgacaaatgccctactctctcacagtctcacatagcaacatctagacccaaggggattattggttgaagcaacgggttaaaatgaaagggttggcttgggtgggagtggatggttcatccaatcgaaaccagtggtagtatcgatggggccattcttcaactataatggggtcaaagtatatgttcacaacagcaattttctattcgtaatgtgtattaatagtgggattagcaaaaagtcatttgcctccgcccctgctccaattaatcatagtattaggttaaaaggatcacagagtagactccgcgatcgatcgatcgatcatccctgaggaatcggtagcttgtaatcgatcaaacacgaccacttcaaatctcgacgattcatgcacaaattcatcagagaagatgaaactgggacccccaaaacgcaggcgagctcgctgcgcaaacacggcaggacccacgaacgaacgagttaggaagcccagcttatacgtagagaagtccgacggagaggcgcagcaccatggaggagatgaacggagagagcagatccgcgagagatctgggagccctaggtctaggggggcgggggtcggcgagcacgtaccttggttcggatcggattccgccgccgccgccgccggagagagaagagaagagaggagaggagacgcgttcctggaaaggaggagacggtggcttcttggcttctctctcgtgcgggttaatgatcgattcctatatgggcctcgtgggctttttttgaaggcccatagcatgtttatgcaaaatggcccctggattaaaaaaattgcaaatatccaaaaggaggaaggggcagaagtcagaactcacaagcaaaattctgtgtataataaacctgcagctagctgcagactgttgattaattgaaccaaactgaacatatatatatgttcacagcaaattaagcagaatgatatatatatatataatatgagatgataaataatacggtgacactgccaatgttgcaagatcgatcgatcgatattacgtacattacatatggctggcacataaaacaaacttgctatacattcgatcagcgtaggactgaaacggcaacatcaacgaactacgtaccgatccatcgatcgatcaacattgcatagtactctctcgtccgtttctaaatatttgacgcctttgatttttttaaatatgtttaactgatcgtcttatttaaaaaaattaaataattattaattattttttatacatttgatttattgttaaatataattttatgtatatatatattattttataaaagtttttaaataagacaaacggttaaatatgtttaaaaaaatcgaacgcgtcgaatatttagaaccagaggaactataaattattcatggtgcagtgcatgtagatgtagctaacctatatatatattccctccgttccaaaatatttgacgccgttgactttttttaaacatatttgaccattcgtcttattaaaaaaaattaagtaattattaatttttttctattatttgatttattgttaaatatactttaatgtatacatatagttttacatatttcacaaatttttttaaataagacgaacggtcaaacatgtttaaaatggttaacggcgttaaatatttaggggatgagggagtatatagctagcctattctagatgatactgattaataagcgcgacaaagccggcgaggtagaagacgatgagcggtatgtcgagaacgacgtagtgggcgaccagcatgtgcttgtagccggacgcggcgcagaccccgccggcggcggcgaccacgacggggaccagctcggagaggacggcggcggtgtacgcgccggcgaagtgcgccaccagggcaaagaaccccgacaggaaccgcgccccgttcgcagccgcccgcgccgccgtcgccgccaccgcctgcgccgtcgccgacagcagcaccagcgccgccccggcgcgcatgaacgtggcgccgccgctgccgccgccgtaggcggcgcagggcccctgcgacgacgacgcgtcggcggtggtgatggcgaggacgaagagggcgaacgccaccgccgcccagcccatcaccgcgtgcgcccacgccatgccgctcaccgacatcgtcatcctcaacactagcgaagctgggcagctagctagctagtgagtatatagtggttagtgaagtggagatcgcgatgcagcatgcatgagaacaaattaagtgcaagggctacatatatagtgcaaagggctaaagcacaagtcaattcacttgttggtggcataggaaatatgatgtgaacgaaacattacaggggcgtagctagctaggtggcacctatttaattatagtatatgttctagttaatataataaaaattgtatagtggaccacctatttaattgacatattacatacaaatggaccacctttactcaaaattatagctacaccactaaaacagattctagctacaccactaaaatataagggtattccaaaatcaagaaaagaccatgtcgcaacttctcaccaaaatacatgacaaaatcaagctatgaagcagtggggggcaaaaaaaaaaaaacattgccaaaatacatgacaaaatcaagctatagagcatgtgtggggcaaaaaacattgcgagaatatccgcttagattttaatttagtgtgtgtttctttttatgttttcttcctgtttcttttattttcctctctctttcacgtcccttgatagtatttagtcccttggtaatattgtaaatactttctattctcttaatataacttcagtttagcgtggctacgatttcaaaaaaacatatatataatgctgaggtgagcttgcattggcatgcatgctcgatgatcagaaagatgagatatggatcagcagcaactaataacttaccacagctgatcataatctctgcaaagttaattaaacacatgatcgatcgattcatcggtcttcgagattggtatagtaggaaagattacttgatgaggctggccggctggcttttgagatgagcagagctagcacacatgtgaagtcgatcgtacttttttccccatttgcattgcattgcctgctacgaatcctaatcccgtttctcttaattacgtacgcgtccaatctctcttattaatttggctctgctcgatcgatctgctcttcgtcttttgcttaatttgttaatttgctcttgaggccatcgcacacatcatgagtgactacttgcttctatctttgtatacatctttcttctttgtctatctaggaggagtaggatttcctcatcacctcccacaccattaattgattgccaagaacgtatggctactttcttcgccggtaagcttaatgtccttgtcataatcatgcatatttcggcttgtttgcacctaatttcctcttctccattgattactactcttacttaggcctcgtttagttcgcgaaaattttttttgagtgtcacatcggatgtttgatcggatatcggaagaggttttctgacacgaatgaaaaaactaatttcaaaattcacctggaaaccgtgagacgaatcttttgagtctaattaatccgccattagcacatgtgggttaccgtagtactttatggctaattatggactaattaggctcaaaagattcgtctcgcgatttcccctctaactgtgcaattaatttttatttttatctatatttaatgctccattcatatgtccaaagattcgacgtgacgtttttttaaaaaaaattgagtaactaaaccggacctttttttttagataatggaaatgtgttacatctccggcctctgcccgtaggcacacagccaaaaaattcagacgtgaacagaaaagttaaaaaagacaagatgggacaaacccccaacttctgccgatgatatgatctactaaaataatattttttttcaaaatcacgtagattctatcacaaaattctgtaggtactacgccatccaaaatggaataaaagttccttggctactaattccaagcgtgtagcaccattgcgcatagtatcctgttgttcctgtgaaatcatcatacaccaagagtggagccaattggaacacatgaagataacctgcatgatgttagatatttttttatggttaaaaactatatcattacggcaacgccaaattgaccaacataaagcactagctccaaacaaaccggaccttaattagtctatttccatcgtcacaatatatgcatgtacaggatatatcatgtactccctccatctaaaaaaaagttaaccaaagaggggtcatacctcctctaggttgcctttttctgggacggaaggagcatgtaacttgggctccatgtgattcaattcctcgggcttggttcttgtttgatttcgatcgattaattaatttagtttcttggttattgcctctgctctgctccgttgcaacacagcttgtggtgttactacagtacattctgatagctccatccatcgacttgaaatttccagaggaaactcgcttgctaggtatcaccaacaagcacaacgatgtgattggatcctatacagataaataatttagagtaaatcacgtggccaatatctagatttgttcgtgtgtgtcatttagatcctgaactcttaaaatttatttttagttttttaaacttattaaagtgtgtcattctggtttcaaataggcacaactcctccaagatcaattggcgtggcatgtcacacggatattttagtcgtaaaatttatttttccttctcctttcttttcctcttcttttcttttttgccatacttacatgaaggaataagaaaagagagaggagatgaaaaagaaaaataaaaagagtcaatatttacgtggcatgccacataagtgtcacgtagaatcttagaaggatcatggcaacctcggaccggaatgacacattttatcatgttcgtagatctgaaaatgtattttaagagttcggaaatcgaaataatatatacggatgagtttacgaaccaacgaaccaaacactttgcgcaataatttaagaaaaaccatttagattttaccaatggagtggttacatgcatggctgatgggaaagaagggagcaacagatgaacagtacgtagaagttgggagtgtaccgggcaggacgtccaatctttttatttcaactacccacacaagatggtgcggaatttcatattgatataacagaaaaaaaaatcacaacactacaatcctataactaggaagaagaagaaaaaaagatcaccccaccacaagctagaggctccaacacataccttgagaagcactagcaccgaattggctgccgatgtgcgcgactgatcgccgctacccctacacggggaaaccaatttttcggttcaaaacattttcaatatctggtaaacattttaatgtactcgtcactgtaaaaaaacacttagaatttaggcttatttagattatctcaattacatatgattattgtagaaaaaaacacaatgaacgttattacttattggaaccaagatcatgcgaatgggcactggaaaatgaaacatatataaaaccttgtggtcgttgtctgatggagtatttttcttgtacttttttgaggaagccgatgcttcaacaacgctgagcccaagaaagtgtaaagtgtagaacaaatgtatggactgcatttcggaattcaccagtagaatcaagaatggattaattttgcaggatgatattgaccgcaatcaatctcaggagcattttctggcctaaataaaccatatcaagttcgttccatatttggagctagtgtttataattagctagcatatcattatggtttcttgatcagaactccacttagagcaacttcaacagactctttatttagctctccaaggtaaaatttagttaacacagagaaaaaacgagctccaatagcctctctatccggatggcttccggatggccaaattgctcctccggctagctaaatgtagccaacctcctccactggctaaaggtgggtcccaccaccactcccatccccatccaacatctctccctgccggcgacgaactgagggcatatgccggccatgagcgccccccgccaatgtcgtcgtctaggccaccgtccgccgtggcagtcgtcgtcgtcgccgtcgcgcctcacgcacgagccgtcgcagccatcgccgctgctgcgcagggagccaccgccgcctccgcctcgcgcgctggagccgtcgccactgccgctggatcgatgggtcgatgctgccacgcgggagaaaagaaatgggaagagaaagagaaagagaaagaggaggaagaggaagggaatggagatgggaggatgacatgtgggtttctttgtgattttggagatgtaaatagagagactgttggagcatacatctagtttgactacccaaatcagttggagagttggctaaatagatatttgaagagtctaatttaaagatgctgttggagatgctcttaattcagaaggaaaaaacaggtgaactaccagaaaagctttgccagcaaagtcatgacgtatacaactataagccatcttcagcgtactctaacagaactccatttatgccaattgaagaaatcgttgcaagttaaccgcagtttgagctaactattatgttataatcttttgagttgcggttgataagctgtggaaaataaacgaagcaaccaaaagtaatataacagataaatagcaattgaaaatttatatccatgttattagtgattgaaaagctagtcgatcgctagaaaataaactgacaaaaaaaactcaacataaaataaagttttaaaatctaaaatttggtcgcgattgatcagctaacgagagcagaagatggaaaatttgttgtccgaagaaaaaagaacaaacacagacggaaattaggcctgtttagatcccacccaaaaactttaaaccttgtcacattaaatatagagtatcaaatatagacaaaataaactaattacatagattacgtgtaaattgtgagatgaattttttaaacctaattagtccataatttgacaatgttgtgctacagtaaacatttgctaaagtttggggtgtaaagttttggcgtgtcacatcgagtatgccagcacatatttgaagtattaaacgtagactaataacaaaacaaattatagattccacctctaaactgtgagacgaatttattaagtctaattaattcgtcattagcaaatatttacaatagtaccgcattccgcgataacaacgcgaaaccgagcggtctggcggaatgaaacagcggtctcgctcaagcaatagcaatactagtgtcatgccgatttaattagcaattaattatcttgattagtgattaattaattcctaatccagatacttaatcactaattattattatttaattgttaattaagtaattaattactaatcaaacggagcccattggacagtgtcgttgattgcttgggcgaggtcgctcttccatccattatgcgagactgcgtggtctcgcgctttcaccgcactcgataccgctcgcgatgtcattttcgcgtaacggttttgcgagaccgacaatatgttttttgcaaaaaattttacgtctcgaatattcccgagaaaaaattgaatgaaatgtatattttcaaatttaattatgctttggtatgtcgaggacgacgtagtgagcgatcgacgagcatggacgcggcgaagacgaccccgccggcggccggcggcgaccacggcggggaccagctcggagaggccggcgacggtgtacactccggcgcagtgcgccaccgccgacagcaccagcagcgccgccgaggcgcgcatgtacgtcaggagcattttctagcgcctaactgtcactgcacattgaagaaaaaaatggcatgaaaaagtttgttcgatacttggaactagtgttaattacagtaccattttaatatggctcgtagataattcagaacgaaaaagtaggtaatttaattatcagtaaagctttgccagcagagtcaccaagtatacaactttctttcagccatcttcagtgtgtactttctcacaagactccgctttataccagttgaagaaatcgttgaaagataacggcagcttgagctgacgattctattctaatcgtttgatctatggcctatggctgaaaagccgtagaaaattaaagaaaaaacatccaaaaataaatatacaagtaaaaatttcatatgttattagcaatcgaaaagtaaatactagtagaaaataaactcggaaggaaaacaaacccctcaaagtcaacataaaatcaagtttgaaataatttcaaattttggtcgtggctgataagaccaacgagcaaaacgacgaaaaaaattgttatctggaacgaaaaaaaaaacacggtagagattaatactgtactaaattttcaacggttgggtcaccttcaattaccaaccgaagcaagcaactggtaaagcaaatcaaagcaaaagatgctagtagtagatacccaccaacgaaagaagccgacgctcctccctccttcctacaccgcgtccaccgcacaccgcccgagggcccaacacccggtccacggtggaccgcgtccacagatcgatccctcgcctcgagcaagcaaaaaaaaaatccgtactactctacgtggcgtggcagtcgtcctcctccctcccacgtgagcctcaccgacaggtgggcccggggagaccgtggtccccacctgcagtggcgcgcgtggtcccatctcccaaagcgagatgagtttgctgctgcagaataaaaggcacccagaaaaaaataaaaaggcagaaaaattcggcggaattcgctgttggagtgagtattcatcgaggcaaagctcgaatttttggtactatccgattggtggcgaagcagcggcggagcgagagaaaatcgctgtaggaatcgggggagaaggaggagtagatagagggaggtggattgagctgtgggaggttaggttggtgattggtagaggaggaggaggaggagatggagaggaaggtggtggtggtgtgcgcggtggtcggcttcctcggcgtcctctcggcggcgctcggcttcgcggcggagggcacacgcgtcaaggtgcgcagctacgtctctcgccgccgccgccgaggttcccggcggcggtttcttgaactgccttgttactactactactttctggatgaactcgctcgcgttacttttatagatctcggtgtgtctgctaagttgagcttttgtttggatctcgctgtttcccatcggggatttctgacctggtgggagtagatgcgtgtagcttatccgtggttgttcgctaggaaaatgcgctgtggcagaagtgaatctttgagcctttttatgcttttggttgattttcgctagagctagtgctgcgatcatgttaggtgtagagtggatgtttagttcaatctgattcgactagtgcgtgtaaaattatatggttgaatcagaatctgtccaagttatttccttttctggcaatgttcatcttgtttgtcaggatatagcactattagtctactatatatggtgaagctttacttattagaaatctttaaactcgttattctactgttcttttactcttgacaatgcggctagaacagcttaatcattgtgaaactcattacaaaccctagtgcctgtaagcacattgcagatattttcctctttgaggcttgaggatagactaattttgcactgaaatgcatgtaaaatcatgccgcgatgtaggaatataaggtggtacatgtttatagctttacataatgcaaatgcaaacctcaaaagtgtcaaggatcttatgctacgcagaaagttcttctgactgcaagtgaaactttactatagaataacttaaaaaacaaacagactggacatattaactgtggggctgtttggcagcgcttgctgcagctgcgctgcacggacggttagaagaaatatgagttcggttcctttagtagctggctgtggtgcagccgcagccagggcttctgaacaggccctgtagtattaactgtttcactatgtatgatcttagattttacatatagattcttgcaataacagtcataccatcgctaaagcaatatataattatcatgtcccttactctttttagagtgctagattgtaataattggctgtagctcttctgagcaaaggccgggatgttctattccattatctaaaaaaaataattatcatgtcccagttataatgcacattgcttaactcatgcaggtttcagatgtgcaaacttcttctccaggtcaatgcatatacccaagaagcccagccttagccctagggttaatatctgcggttgctcttatggtcgcccagtctattataaatacagtggctggttgcatctgttgtaagaggcatccagttccctcagacactaactggagcgtagctctgatctcattcatcgtgtcttggtaaaactctacccttgatgtttattgtgttattttacctttttcctctatcttgacgggtttcaacttatcttaccgatctaagagaattctgaatattattatgttatgttgaacctaacttagccttgacagtttgttaaacagtttttatggaaacaagggatcttggttgccaaatgcgttggagttcttgactctgtcattttggcactacaaaggttccttgcagttgatgccttatttcagtagtctttattaaaacatgtgtgtttttctgtgagatagcgtactagcattaggctgctgtttgttttattctttgcaaggaattcatatgagtggttcacatgatggttaaatagaataacttttgcatagatttcaagtgcaattagtaatgtgaagtgcaattctacttttttcttggaacatctttggggggttagctgtgctttattctaaggtagggttcagatcagaatgttgtggcttattttgcggaagtcctgattcctgaatgctatattttagcaaaatactctgctatttgttatttgccataacgtcgtcctggatattgttacattctgcagggccactttcataatcgcgttccttctcctactgaccggagctgcacttaacgatcaacggggtgaggagaacatgtactttggcagcttctgctacgttgtcaagccaggggtcttttctggaggggcagtgctctcacttgccagcgtggcactggcaatagtttactacgttgccctatcatcggcgaaaagtccaccaaattggggtccccagcagaaccaaggcatcgccatgggccaacctgtgatccctccacagagcagcgaaccggtgtttgtccacgaggacacctacaatcggcagcaattcccataaatcatgatctgtgcaagctgtttcgagggccattctgatacattatgtttggtttgtataggcctccaggttagaacagtagcagtaacaattgttgttaggtagagtcatgttttttgctttcttcttccccctctttcttgagcgctactgtcgcacgttctgcttcatcacagcggatattcgattttacatgaaccgggcaatgttgaagaaagcttgagtttcttgctatttgcaaattctgaaggttttacatgataattggatcatggatgtggaattacaatctgtcttacacctgtgggaacttgatgagcagtcattcagcacacagtggatgctagctgctccctgaaccgagcaatggtgtcgtggacgatggcgttggggcgcaccgtggcatcgaccacggtgatcccctccgcctcatcgatctgcagcaggtcgagctggctctggagcaagctcgccggcatgaagtgctccccttccattgatctcctcctgatcctgtcagcaatcacctctgctgatgcctccaggcacacaaacttcaccctgcagctggagtagctccctgaacctgacctgaagctgcagtctccttccctgaggatctccctgtacttctgctgcaatgccgagcagctgacggcgacgtcctcgccatgatccagccgctccctgacagcgtcgcggagggcctccagccacgggatgcggtcgccgtcggtgagagggatgcccttgctcatcttggctgttgtcagggacagggaagagcagagaagttcagaaacgaaaaagggaaatgtaggttggttggttgtgagatgatgaattcttcagagaagtatattgatcttgatcatgccagacctttgtttgcctgagaatggtagtcgtctgcttcgatgaagctgcagcctaaggtttcagcaagcagtgctgctactgtcctgcgaattcacaatgaaatgctaaattcataagaaaatgtgataaattttgctgaggacgggctgcaggaa

SEQ ID NO: 47228 - DNA, 1920 bp, Oryza sativa
ataaattttgctgaggacaaaaaaaaaagaagtaaattcaagatttaaagctgaacagtactattacaaaatctgaatgtaggtttgaaagtcacatcctaaaaccaactcttcagcaaatgcagaggttttctccgaggaaaagacacagcaacatccatttgacatcacaatgttgaattgttgacaaaatgcatatcagtgtactgataatgtctctttctgcttgcttctacttaatgtgcctaaaattgaccaacttgaccataatattaagcatgaactgagctgaggacttgaggttggtctaaaacaacacaatcagtttgaatacttgacagggtaatcagaaagaaagaagtaataatcttacgatttaccgcagccactgactcccatgatcacgattgccaaacctgcaaccccagatgttgaacaaagatgaattagcagacacccaagctctgctgattacgattagtacttgtaatgataatcccattccaagcaattccttgaattaagctttaacacttcaaaaagaaaacatcaattcagaaatcaacacagcacctattctgtcagaccaaaatcacaggtatggtcgcaatacatgtttgggatccatcacttcagttcgcaagaacaagaacatggtgaacatgcacatgaataacaggaaatctgaaccaattcggtgcagcgaaattgcgagaagaaactaaacagatcaaaagagttaaaaacgaaacaagcacgcactgatcctggtcactgacctggtcggtgcgtgagatcggaggcagccatagatgagcttggtggttcgtctcgatctgttcctacgacaaggagtacgacaagagcgtactaaacctgcgaataaacgaggaagaagacgacagcggcggcggcaacaactctacttggcttgattgctcttcctttattttatatctcgagattgaagaacaaaatctatcattttttgggagaaatttatttagtctagtctagaaattttgacttgcatgaacactgcaatttggcatttttgacgtagtgagtactatggccatcctcataaaaataaggagaatttttcacgaatccaaacatagaaagacaagattgttttaggattggacggcgaagaaagagacttgaagcgaattgtcgtctgatgactaaaactaacaaagatgagacgtagacgaaagcgtcttcagttcaaagcaagaccacctgacgtttcaactttcagttcaccgtcactttagactgggacctggtgtttccaaagactcttttacagttcattcatgtccatgctgtcgcattgttgttgctgctgactcagagcttatcacacatccttatccaagaggaacatttgtagtatcaacagaaatcatctttcaaaggatattgttgttatacaggatcctcccaagaaaatgacaactttctatagagaaaaacaagttaggacgagagttggtgatgatggaaataccaacttctctcaagtcttggttgattggattcaagttgatgctttcatgttcctctagctcagcaaagaccttggtggtttctactgaacttgtttctggtctctgaatctttcagcattgcttctggtttctgaagcaaggaagaaaaaagctgttgctaccggtgagaacaaagatgttaagatgaactcaaaagatgggggcaaaaacagaatccgagatatacataatcacatacagtaccaaattcatctgatctagtaatgtagtcacgtaagaacatgcaaacagctaggtaactatggctactttctgaaaaaccctgaatcctgaagtgttttgcaatattctaagatgacaggagatttcttcaccatgtcccagatcttcgctgagctcctca

SEQ ID NO: 47229 - DNA, 709 bp, Oryza sativa
catgcgatattctgtttggcagttggaatgctagtgttttcatgtatgctagtgatggccagccatttgaagctgacgtaactgttagggtggttgaatggcaaacatttaaatttgaaggtgtagtttcaagtgctagaatgtattggttggccattcatgatattcgagaaggaatcctggcagcagagatgctttagttggtctctttttcgttcagttttagctatctcatacatatgcaggttatcaactcactgtaatataccctgaagtccagttgttaattaatcttctaccttgacactgtaagagatgtagtcaatgataatatgtggtaatatgcagagagagcacaaaactatgtttagcttggaaaatacatttgcacagaatgcacaacaattttaagctcttagctttggttggcaatacatgaactttcatgtgggacctccacctcagcttccattttctgaatagaagcttaagcatgcttatgattgttgctccatgttaatgttgtcattgctgaacaggaaatcatggcttcaacattcggtgccacttctacggttggcctcatggctgcgccaaccggaattgtatcagacaagaagccatcttctctatcttcggtgtcatctgtttctgttgccagccgaccacgcaatgcacgccttcagaggaagtgcaacttcagggtaaa

SEQ ID NO: 47230 - DNA, 2961 bp, Oryza sativa
caaaaacagcactattacgctagcaatcgaacagacttgcacaaacaatttcaaagtttgttttgcagtcacctaagaccgaataattcaatgcaacactctatcctgttttgatagcacaaaaactaaatgacatgaaagttgcttccaggaaaaaaacaacaacattaaggaatatgaattataccaatgaatctacaagctaaaaatttgcacacatacctccaaacaacggtccacaagctgccgacttcttgggtagtcaccatttctgtagtgtccaaccgccagcagatatagcttctccctagtctgcagtgggctgttggattgacctaatgatgctgtgaaaacaaaacgaaattgatcaaaacagattaggctgcaaaaattatgtttagattatcgaaaacaaaacaagatatgagaccttcaagcatgcctattccacgatttacatcctcctggttcttggaatgcacgagggcccaagacagcctcataatgctatcactcttctgctcttcatttgcagcctcagctacctccctttcacagccctaataaagcatacaaccatagaaactctgagcgcgaacgtgtaagcctaaacattatttggaatgtatctagtaacaaacagggtaatgatttttttgtaaagtgagactgatatgtgcattttcttagccaatagttgcagtgatgattgaatcagagatagttccagtgttactcttcagattgtgaaccgctaaaaaggaatcaaaatcacacagctcaataaagagaagccgccttgactcatccgcgttgcaacaaacaatcacgcgagctaatcacgggcagccgacggcagcaccaccatgatggaacaaacaagccactgtaaatgggggcaggctgccatgccgcctaaactaagcatgaaaaccactccacactcgaccattcgctccccagtacaaccctccaatcctcggagttgctaatcctcaagcaccgcgcgggatctcccgctagaactaaaacctccccccattgaataaattaaattagaaattagagtactagaaaaaagctccccacagcaggggattcgaataggagcggagagaatggattctcacggcgatgatgtcgcgggtgcaccaggggatggtgtcgccgccggagaagaagctccccaccgactcgacgagcttcccgatcttggcctccatcggggagggggggtgggcaggggatcgggccgatctggaggaggagggagaggagagcaagcacggcggcggtggcggagggcgaggcgacggggccagcagcggcggatgcgaatccggtgggtgggaatggatttgggtgcaagtcttgagtcgcgtcgcgtgggttttgtattgtttgttcgattcgctgctgctgcttcttcttcttcggcgctaagaaagaaggggaggagaacttccggcgacttctgagttctgacttctcgccgtcgcacgtgggtcccgcgtttaagccactgtttaattcaacatagtcatattataatctgaattattagaactaagttgaaacaaatagatagtttattatgatggattattacaatctataagctatattactataatctggtaatccattaccactataaaggtgttttttaaatattatgggtgtagctatatttatagcgccatatttttcatcaaaaaatagtcggcatgtatttacattgtaagtccttaaattacatatgtaattttagtgtatttacaatgtaagtctcaaaattacatatgtaagtactaaaattacatatgtaaattcgaaaattacataccaattacatatgtaagtgtgtgtaaatgaggtgtaactactgtgtaagtggctgaaaaaaaatcgactgtaacatatggcgccatatttctagcaactccgaatattattgggtggctaacatttagtaacaaacaactaataattcagagtaacaaagaactatcagcttattttatatcagtttattataatataacttatagtagcctggcacagtaatcttaagttgaaacaaacatggtctaagttgattttaatttttcttaggaaaataagtgtactttactttttagcattagcttttaagatttatgtaggaattttataggattcaaatcctctcaagaattttaatttttcgtacgcggccatatgattcaaatgattgtagttttctaaatcctatgaaattcctatagaataacttagggcttattcggttcattagatttccaaattaaaagaataaaaaagtagggctgattcggtttgtaggattttcaaaacgtaggaatagtatagtaatgcatgtgcaaacctaaggattgaaaaacataggaaattttcctatggttgtgtagcaaacaatccaaaggattgaaaacattgggttggagtggattgttttttttcctttgttttcccttaaaaaagtagagggataggaatttttcatttggtgcattcctttgaaacgaatgacagtatagtacccattccaaaggacgaataagccctaaaaagattgggatgtcacatgcacttcatttcttagggatttttcgaagatgtctcacttcatgctaagaatcctatggaataaacttgcaagagcacaatccttaggaatttggtagtccattcctatgaaacgaatgatgcatataggaaaaaaaatcctaaggttttaattcctacaataatcctatgaaattcctctaaactgaatgagccctcattgaaggtagattttgaagaaaacttagcaagagcttcaacatcttggaaaatttcctctgattctatctctcctattcgattcctatatttttcctgcggtccaatcaaacggcaattcttatgctttttctatgttttgcattcctctatttt

SEQ ID NO: 47231 - DNA, 2811 bp, Oryza sativa
acgagtgaattttgaactaaagtcaaaaactgccgcgcgtaacggacctagaaatttccttcggggatttctctcagttccttggaattcgcaccgtcgggggtgcgcctatttaaagggattttaagtgcgcattttgaagtccgcccactccgtcaagcacacaccgcccgttagcactcctcgccttctccgccgtcataaagaaccctagcttcgtcagctttaggtccatctccggcgatcttgcagctgcgatggatctcggcaagtcgacttccactagcgcgaccctaaagaagctccaggaggatggcgcccttcctggccgtggaaacgcggagagggaagcaggaggtactgatcctcagcccatcttaggttgcatggttgcgatcgaagattatgttgtctgcgggtttctccctccaccctccgaattccttctgctggtcttgaatttctatgggctttctcttctgcacttgaaccccaattccatcgctgcacttgaaccccaattccatcgctttccttagcgtccttgtgcatctttgcgaggcctacattggggtagagccctttcttgatctgttccgcttttattacgagttgcgctggatggaatccaatagggtgtccggttccgttgggttccgacttcgtgacgggatgaagtcgcgctatgtccccttccagtgcccctcttctcgcagtaaatggcggaacaggtggttttaccttgaaatcaaggactcaaatccggtcctcgttgttcccgaggaacaactggacaagattccagtctggaccgccaagccccccttggccccctctctccaatcgtttatcgacatcatcgataatctccgagaacggggtttatcgggatatgaagtcgttgcagacttcgtcggtaggtgaatccagccgctccaggctcgggcccacccggcctataactattccgggccagatgacgcgacccgggtttctcctcggggtatctttctcgcattcacttcgatatgcttgtactcgcgatcccctctgacctatcaaaaactaatttcttcttgacaggtctgagcagcgaaatcgtggagcggcgtgttggtcaggtgatgatcagcggcccgaccacggcgagcgacatccccgtgcccctttgtgaaaagggagcggcggagcgtgacgaagcaatcaatgtgagttcattcgataagcgtccgccttcttttgctcaaaatcagcttatgacatgatttagcgtaagcccttcctttgactgatgtcgtcggtccgctcgcggatcatcaggtggcggcatctctgaaagagaaggtcgtcaaggaggcgtctgacgctgccactactagtggtggcaaagctccgactaaggcgaggaaattctcgtctgtgctcggacaccgccgcaaggcggagactccctcggtaattttcaccttatcatccatttatgtagcgaggaagatttgttctcaccctatgtcggttgtcttgtaggcttccgacacatctcctccgcctgcgcgacgtcagcgcattgtgacgatcggcgagaagtaagtgaagaaacttttagattctcgtgtcttctgctcgagtggagttttgattcatggcgatttatagggaggcgcgggcgaaagcagctcgggccaaggccgggggaacatccagtgcatcccctgccacggcatcaacagatgtcgttcccgtggtcgggagtcgggaggtgacgccgagcggccccgtcagcgaccctgctggaggtcgtggtctgccagagaccgtcctctcctgggaggagctccaagccaagatgaggcgccttctcgaagccggtgctcgcggcatcggccgcgagatctcagaggcgagggcggagacggcagcggcaaacgcgtgtgctgagcggttggtgcgggaactggctgaggcccgcgaggacctcacgaagatgagggagctggtggccgggaacgagcgtcaacgcaaagggctcgaggtctgcatgtcggaacttggagacaatctctccgagatccgtggttcgctgcgggtcacctacaccggcctccaccagctcgccagggagtgcggcgtcgagtccacgatcccggtgaaccccgatgagttctcgttgacttcttctcttgcggagctggcgacggcgataggggaaatcccctccaagcatacggccaggatcgcggaggagacgtccaacggtatcttcaccggggcgtgtcacgtccttgcgtgtgtaaggttgtcgcgccctgaacttgatctgcgtgagatcttggatcagggggcggcaagcgacacgcgtagagaggtgatggaagaagtcagtgacctgggggagtctgtcctccctctttttgaagaataggacttcttgtatttttgtcatttgtaaatcttgaactctggttgccttcgtgcatgtgattaccatccttgttcaatgttgatctcggaagtttttcttgtcgattgtagagatgctgatgacgaggatgtccagcagcgcgggcagcccgagtcactgggcagcccgagtcactggcgataattccggtactcgagtttgaaccacacatcccacatgacgtcgaggaccaaactcttgatgtgaaggtcgacatggcgacaaccacctcaagtgagtagcctttttaactccgtgttgggttagtggtttccagcttgtcttagtggtcgttatgtttagcaggtctcgaggatgcccttgcaacccaagatcatcgcatctagtat

SEQ ID NO: 47232 - DNA, 1276 bp, Oryza sativa
gtagtactcgtggcctgttacagatgtcttaggaaaaagtgtaatgtagtgggagatttatgtaaaaaaacagtaagaattattatgtgaataaagaaatctatctttaacaaatgttttcttactctggatgttgtgtgtgtaagagtgtgttctcagttaacgactttagttagccgtttgagtcgtacactctccctagcccccagccttgtcgtaggagggatttcctcgggtgacaaggctcctggacccttggcccgtcttggttgaataagctctgatcctagcccccagccgtgaagttggaaagcttggtttccgattacacggcttggttaatacgcacggcgagaactcttacacgaccagatcttacatggtctttcgtctctaaaggatctgacaaggccttatcggctctgggcgtccctagccgaagatcccttaggttcctcggaggccttgtcgagacggcgtaaagggacataaggacaggtttcaacgctaggcgtcgtcagagtaaggggtcattgggtgaaaacactttggtcgtgatatgagacctaggaataggctttattgatactgtaagggtgcttacaggtatagcggtattgactcatacatagaatttacgtagttggtcaatgttccacgaatttgctagttcgcgaacgtcgccgtcagcgattttgaatgcgcctggccgcaagacttgtgtgatcgtgtagggtccttcccattttagtgagagtttgtttcgccccgcttgggtttgaactcgtctaaggacgtagtcgccgatcgaaagtatgcgtgctcggatgcgcttctcatgataacggcggagggcctgttgatagctagctgctcggatggcaactcgctcacgatgctcctcgagaaggtttagatcgatctctcgctgattctcctggttctcgtcggaatgcttctgtactcgtgtgctttgatgccgtaactcgtcggggagcatggcttcagaattgtacacgaggaagaagggtgtttccttattggatgttgtcggtgtagtgcgcacggcccatagtactgatgggagttcttcaacccattttttgtcgtgtgacatgagtctgtcgtagacgtgggtttttatcccttgtagtactatgtcgttcgccctttcgacttgtccattgctttgagggtgagagaccgaggcgaaacatatttggactcccaagccgatgcagtaatcctggaaatcggcgctgatgaattgacagcc

SEQ ID NO: 47233 - DNA, 1058 bp, Oryza sativa
tagctcgactacccatttagcgatgcggccgacaacttctttgtttctcacaacttcgccaagtgggaaggaggagacaactgtgactctgtgggcttgaaagtagtggcgtagcttccttgatgtcatgatgactgcgtagagcagtttttgaatctgtggatatcttgtctttgcgtcatggagagcttcgctgaagtaataaactagtcgctgtactttctctctctcgacgacaatgacggtgctaacggaatatggcgtggcggcaatataaaggaataattcttcattaggttggggagcaacgaatacaggggggtttgataggtagcgcttgagtgcaataaatgcctcttcggcttcctgtgtccatacaaatttgtcttgtttcttcaacaaggcgaagaaaggcctgtccttgttctcccatcctagcgacgaatctgcttaatgctgccatgcatccggttagcttctgcacctccttgagtcttgtgggcttggcatcgggtcgcaccattagtttgtgctcaatcacctccctggggacccccggcatgtcggacggctgccaagcgaacacgtcggcattatcgcggaggaaggtgatgagcgcgagttcctatttctcatctagtgtagccccgattttgacagtcttgtcgaggttagcactagagagtggaacgatcttgatggcgccatctggcttcggcgtcttgtttagcttgctcactttcttgggtggctcaaacgtggtgggtggggtgggcgtttgctcgaccatgtcgaggctccgcttgtcgcactgcaccgccagctttgcgttcccctgaatagtgattgttcccttcggtcctggcatcttgagcacttgatatgcgtagtgtgatgcggccattaacttcgcaagtgcagttctcccgatgatggcgttataagctgtatcgaattcagtgacatcgaaggtgatatgctctgttcggaagttgttggcttggccgaaggtcacgggcaatgtgatcttgcccaaaggtctggatgatgattgggga

SEQ ID NO: 47234 - DNA, 2061 bp, Oryza sativa
atgaagaggacacggatgatgacgatgacgatgggtcggttggctccggcgtacgattacgaggatgacgacctggatcccgggaatcttgtcgttgtctctcgctgttatctcggcgccgatctccttcgtcgtcgtcgttgcggcgatggccatgaccagtattgtctggcccccgccgttcgcgatcgttgcattctcggtcctcgttttggcggtctcctcgatcatggtgccgtgaagaaacatgacgccgagagcgatttgcgtcgtcccgtgtgcgccgtgcttctcggcgaccgttaatttgatctcgaagatcgccagtgccacgaggtggaggggtagcctgtcgaggcgattccctccgctccggatcttcaccattggggttgccgattggtggctgatcttggtgtgctgcggtagcgacctcttcgaacgcattgctgaggttggtcaccgactcccgtaattgttctgtccaacgctcgaggtcgtcattcagaacgggatcgtaaggagtttccctcagtatagcttgaatagccctgatgtgctaggctggagtagtcgattgattcgccgcttctgcgttggcttgcgctgacgtgccaacgtcatcgataactagtacctcccgcggcgcacttgttgtcgatgacccgtagtcttcgaggagatgtaagaccgatggttcgtgaggatcgagatcgattaccccaacgaatcgatctgaggctggagtcgctccctgttccttgccgttatccctggcggggacgtatgacttaggagacggggctttcatggcgccgaggagaactttacagctcgagagatcgtgattctttgtcttgtggataggacaatagacatcccgagttggagaaatacgttgaattccacgttctttgcaggcgcgaatttcagcacggacgttgatgaatacccagcaatcttgaagggtatgtttcttggttttgtggataggacaccaagacctgatagcttcagaagtcatctttgtcggcccgtgatttacgtcggagggacaagacttggccgcatcagaatccttcccaagtttggatgtagtcggtaatccgttctccgtttcaacgggtggatttttcgacatggagccgtcttggtttgtagccactgcgttctagttttcagtcattggaggaccggttgagatcggcatcgtggtgtaaaccgggaagacgatttcgcccacttgagtccataccagcatcgttgaagtcgagagtgcttggctggagctggtgttgacgttgttgtcgacgaagcttgatggcatagtagtagaaccttgagtaccaagtgcccctacctggcgcgccactgtcgacgggtgatacccgtagaccggatatagagggtattggggtacgctggtacaaggatctacgtagtacgacatcgagcaatcaaaagacaagaattatactggttcaggccccttgacaggtaatagccctaatccagttgatatggtattatacggtggaaaacacagcttacaaaggaaaagatggaacttgtcatatccggcgaggttgtaatcgagttgattcgactagctctcgacgacttggctcttcgcaggctccggcttcgtaggctatgtgggttgtattggctctgagattcgatcccttatgccctccccgaggggtcccttttataccataggtctgatgctctccgagtaggactcgaacacaccagacctagcacgacacgtaggtaacccagttcttgtccgagaaggactcttcccatttgttgatttcgtgaaaagtttccttagattatgaaggaaatgtccgcgtacgcgtgggtatgccatgtcgatacataacgtatatcgaagggtagagggtatgccagacccgtaaccctgacagtagcccctgacttctactcaaaatgaactcgtgcgaccatttgcgacttcgggtgtcgagaacgttatcattccaggtgcgaggaccacggagatgacttgtagtcaagcatgccgtttgaagc

SEQ ID NO: 47235 - DNA, 1038 bp, Oryza sativa
ccttagattatgaaggaaatgttcgcgtacgcgtgggtatgccatgtcgatacgtaacgtatatcgaagggtagagagtttgccagacccataaccctgacttttatattataagtcgttttgattttttttctattcaaaaatttttacattttacttaatatatataaaaaatagcaacatctataataccaaattagtttaattaaatataacattaaatatattttcatatttattttgtgttttaaaaacctaggtcaaacttaaaaagtttcactagaaaaaaaaattcaaacgatttatataatacgaaaccgagaaaaattcaaacgacttatataatacgaaaccgggagaatatattattcaaagctaccggaaaattgaaaggacaaaaaaaaataacgtcaaaccaaaaccaaaaatagccccaaaatcttccacgcctgggcagaaacaggcgaaaaaacttctgacgcggcgggtcagaagtccagaaaccagcagtccacagcaccaccgcagcagcagcacgtactcctacaacaaagtactagcagtggtgcgtcgtacctccacgcgtcgctctctatcccccactcccgccgagattcccctcgccggccgcctcactctctcttctctcactgccacgtgggccccaccccatccgcaccaccgctcgcggcgcatccacccgcaaatcggcggcggcgacgaaggcgagcgactgactccagtagtaataaaggcgaacggctacagcgcccatccagctccctcccactgcacggcgcgcggcagggagccgcacgcgtaaacaaaccaaccataccagcccaactgatttttctgtaaaaaaaaaaggggagaggagaaaaaaaaaagggaaagcgaaaaaaagcgaggtcccccttcccctctcctcccccgtctcgtctcgtctcgtctcccacctcgcaccattcctctctctctctctctctctcccctcgccctcgagccctcgatctccacatctctctcgcgcgcgct

SEQ ID NO: 47236 - DNA, 2757 bp, Oryza sativa
gggggggcggcgatgtcggacgcgtcgtcggatctcggcggcgcgcggcccggggccgtggagcgcgacatcgagcaggtgagccgcttcccgatcctccgcttagctcggcttgggaatgccgaggaaatcccggctgtcggtgtgttcctcgtctcggggccgcgcgtggcggggaaggcgtctctggatggtagatgcatttgctttgcgtttgtgcgttttcgtgcggctgctgaattctgctaccgcagcagtagctctgcgtgtcccccgcggagaaaccaaaattttggggagtctggagcctcggctttgctgctgcctgcaagtagggttctgtggtggaagccgatttaattactgttatttggcctcttgggttggataattccagagacattgatttggctacagtgattgtgtttgctaactttttttttggggaaggccaatcgaattgggctgtttgctggttgttactactttgctctcgtgcaggttgtatgattgagttgggagtggtatgctataacggtttcccaaccttcttttgctgttggttaatgctgcgtgcggtaattgattgagttgagctatactgctatattagttatgtcctattgctttgaggggaagtgccagtgtgttaattggatcaatacacgtcttctctgcagtaatttctgacagatactttctccttgaatgaacttgtaaaattctttgcccatttttttgagtttccattttgttctctctgtgctcacatggcacaatgaataattttaatgaagttctgagttatggtttacctcaaagagaatagcctatatgtgctacccttctaggagaatcccttatttcgaaagatgataattgtttcagagattattgatgagacctttgcatttgctgtaacatgtagcatttcatctcttgtgcattagggagtttgctttagtaattcacttctccatgtaatagctggaacgctattttcatcatctccagtattaaccgattagtttatagtgctatacataatataatgttcatttccagctctgaagtagtttcaaattgtctgaaagaacatgtcgatggccaattagaatgcatgtgattgttccattgtatttaatgcctctcctttgtggcatctaaaatcagagttatttcttgacctagttttattattttactaggatagtagtgtgatactaactactgatgctcgatacaacattccactgtttctcaggccatcactgctctcaagaaaggagcatacttgctgaagtacgggcgcagagggaagccaaaattttgcccatttaggctttccaatgtgagttttgtttgcattttctctcactgagttgtaaagccctctttgtttacccttcagatttatggacattcatggtgtttttgttcattcaggatgaatctatattgatatggttttccgggaaagaggaaaaacagctgaggttgagtcatgtgtccagaataattcctggacaacgaacggtgagttaccatttctggaaaacttcaaatttcaggaatatagatttctctaagtctaattggccattgtgatcaaatctcatatcatatctggtaaaacaacagtgtatttcttttgcttgtttgttttggcgttaactccttatgaatacatctgtgggtgtctcttcagcttttaccctaacataattctccctccttaagaggagtttcgttgcattcttactgacaactgacaagaacttttacagttcaaatttctgatatctactactgatacaacttatgccattaggagatagctgtaatcattagtcttgcccccataacaacaaattacataccacttcaaactgatgcaacttctgatggttcatttatgattctcttttgccactgcctccagaaaaggagctacatatggcagttacaaattgatctgtcccatcatgttgtttttttttttttacattcgctttctgatggaaaacgattcacaagggagtattcaactatatttaaggtctgtaactctcccctaacaatgtctgtttctcttttgccaatgcaggcaatttttcagaggtatccacgaccagaaaaggaatgccagtcattttctctcatatctcatgatagatcattggacattgtaagttatatactgttcattttatatgtgctgtttatcttcttggttcgatttccatttttgatgcacactaaacccctttcctcggtagcaaattgattttgtttggtgatgtggttttatcatgatatcagatatgcaaggataaagatgaagccgaagtgtggtttgctgggctaaaaaccctcataacacgtagtcatcaaaggaaatggagaacagaatcgagaagtgatatgctttcctctggtacaactagtcccagaacttacacaagacgaagctccccattgagttctcctttcagcagcaatgacagtgtccacaaggtatttcccactacccacccagctcatcccactatgccactatattgtgtgttcgtcacctatacagaactacccaatctcttcctgttttgtatgttccatcttttttcttttccattttttggttttggcctgctgctttaagatctgaacaacatggcaaaagtcttatgtcgtacctaggctgttctctttgttctgtatggtctgtacaatctcattacatagatatttatcgct

SEQ ID NO: 47237 - DNA, 1367 bp, Oryza sativa
ttgtggtcactgtatgacggtggcgctgactacctctgggcatgtatatacaatgggaagtcctgtctatggccagcttggaaatccacaagcagatggcatgcttcctgtgcgtgttgaagggaagctacataaaaactttgtggaggagatctcatgtggtgcttatcatgtcgctgtcttgacttcaaggactgaggtgtacacatggggtaaaggtgcgaatggtcggttaggacatggagatacggacgataggagttctcctactttggttgaagctctgaaagataagcaagtcagaactgttgtttgcgggattaacttcactgcagcaatatgcattcacaagtgggtttctggagttgatcagtccatgtgttctgggtgtcggttgccatttaatctaaggagaaaacgtcataattgctacaattgtgcacttgtattttgtcatgcctgcagcagtaagaaatctctgaaagcttcattagcaccaaacccaaacaagccttatcgcgtatgtgatagctgctacagcaagctgaataagggtcctgagacagatagatattcttcagcaaagcggggatctgttatacaggggttcaatgattctgttgacgaggagttggagacaaaatcaaatgcccagttgtcgagattgtcatcattggaatccttcaagcacatggatagcagaacttcgaagaaaaacaagaagtttgagttcaatagcagtcgtgtttcccctattccaaatggcagttctcattggagtgggctcaacatctcaaaatcctttggttcatcaaagaaatttttttcagcatcagttcctggatctagaattgtttcaagggcaacatcacctgtttcaagaagagcaagccctcctcgatccacaactccaacacctactttgggtggtctaacctctcctagagtggtggatggtgtgaagccaaatgatagcataagccaagaggttctaagtttgaggtctcaggtacatatcttactatattctttatccagttacctttctaatttgtattctccttcagtaaattgtaggcatgtaacttaattgaatattgagcatcatttgttaatctttggacacctgaatggaaatcaaaatatcttgtgcgaacatggcaaatttgctggtttttgtatgcagtcctgtttttcttctgattttattaatcttattaccttgtgagttgtgactattcatggacgcgaaccatctatctttttgggacccactagttgtttttcacctacttaatattttgactgccttattcaagcattggaaagatagatcattaaactccccatttgtttaaggtgagatc

SEQ ID NO: 47238 - DNA, 6854 bp, Oryza sativa
atggaccaacttcagttagaaataagttgagtcaccctgaaattcccaagaatggaacaaggctacccgattcagattctaagcatgaatctgaatgggtagagcaagatgaaccaggggtgtatatcactcttactgccctacctggagggactcgagatctcaagagggtccggttcaggtacacaccaaccacacagaggcaaaatatatagtcattagtcagcaaaaatcttgtctatcaatcttgaacatagtacattattcgtttggcgagtagtctatgagactagatctaacaagcaatgacagcaattgagtgattgacacttttgggcattccatttatttggcttactatatagtataatcaacttattttttgctggtcctatatagatatttggggttttaagtgtttactctttttttatggagagaacaacatgaagtgggcagtagcctctagttgagaggatcttgatacacaaaaccactattaacttactctatatatgtgcagatcaagaatgcaatgaatattacaataatttgataataactattgacaacagacctgtctaaatagaaccttcaacttgcaaaaccagatcatgtgaccgcctcaaatcaatcctgtcctgtttgagttgatgtagcaccctgtccacgacacagagccatccaactcgatttgacttgatttagcatctagcattgagtagatataggtaacagcattcagtgaggtttaggtaaataaaatgccttgcctgatttttctgccctccttggcattattgtgttctcccacttccacaagccatgtcatggatgcagtagagacctcgtcccatctgctccttgatgatagtccaggatgtagagttgtggggacgattttgggggtgaagatgttggaatgggatgctagtgggtgccttgcagggatgtgagaagggcacaccagcatttcagatccttcgggggcaagtaggtgattgttggagatggtggaggagattgttggtggtgatggtgcaggaatttgagattatgcccaccatttctggagacaggtaaaaggtaggctggagtggctgtccagatcatgctgggcttgggtatgtaagcgagagagttggaaaaggagaggacacatgggctcactgaggtatacttaaaattggtgccacaccaagtgataaccaggttggatattcctgggggtcaaaaatgttctggctatatgagttgaagatttctactttagactgttatggagctgtgttcgacttttcacactcactaattctgttatggcgcatactcactaattctatgttctgaatgcagccggaagcgtttcagcgagacacaagcagaacaatggtggcaagagaatcgggcacgggtatacgagcagtataatgttcgagtagtcgacaaatcggttggcagtattgataatgatgtacatcattgacataagaaatttgacttggtcagtcactacaaagctctcaaagctctcaccgttgagcatgggtgctgacgcggctatgatattttggttaggcccagaagaggaggggcctgctgtttgaaaaatgtgggcttgcattctttttacacgattctttcctcttccatttcccttgtgtggaatgtagagtgttcaagcagaagttatgtaaatggttagtggcagctggctaatctgtcctgtaaatgcataagcaagtgcatcaattttagactatgatcttcctgattttcctttaattggcaaatataggtgcaaaatctaagtgatgatgatgaagaatatttggtgctaattgtagattgagatgcaaagtagctttgaaagatttaagctttgttctggctgacttgagtgcctgttttggcgaaaatttcatgccaattactctgctcccccagattgaacgtcatttgtcgaacttacatggtctggatgaggtatgttttctccgtttatgcaaaattctgtactaatcattattaccccgggattcttaatagtgcgtattttatttagcaaaagttttcagatcacgctttgaacatttatctcgtaaactatacaaccaatatttttgagtacattaaaatatgaatatattagtgtaaattttatatattaattgtaacttatactagttcaaagttgaaaaaggtgaattcaagatacacctaatgaaaatgtataggggaagttatccttctgaggctaaattgcatgaatggtaaacaaacttacatagtaggtgcaaataggcacaataacttgtaacttactttttttttttgctggaatgattgaaggaggtcatccaatgtaattaagatagggagaaaatgttacgagaaaagttttacatcaacagatagctgtcgaggaaggatgtgcaccagagcacacgcctcgaaccatgtgccaactgcccaaacacacgctatagagagggaagccgagtaccgaaccggccgtcatcaggccaacaacaccaccacggagcgaagactctaaaaaacgacaccctcatgagggtcgccacgccaaatgacgccgtcgtcatccatccaaagactgaacaaggttttcacccagagctccttgctaagggaggaggggtacctcaacagtaccctcaggagagttatcatgctcaaaatagtagtcactgttggcccaaagaaaccttgggctaagatttcgctcggaacccctacaaccctaccgtcgtggtccgtcgcccaatccgaaaccaccatccaaacatcggtggcacatggcctccaacacacccgaccgacgcccctccgccagccggcttccagtcctgccaacgacaagactgccacaacaccagtcaccttggccagcgcgctgacccaggccgctttcaccacgctgcctgccggcttccccgttgaatccgacctatgggagcccgcacaaggaacaacattgcctcggcaatctgagttttccttgttgaccgaccaccgcctccagcctgccaagaagctctccacaaagaaggggaggagttccctagcagggttagcctggccaaccacaaggaagacgacctgccaccactccctagcgcgctgacccaggccgcctctgccacgctgctcgccggcctccacgttgaatccgatctatgggaccggatcgggaacctagccttggcaacctgagtcttccctgtaggccggccatcgcctccatcgtgcctaaaagctccccacaaagaaggggaggagcttcccaaacacagtggtagcctggccaaccacaaggaagacgaccccgtcgccaagctcaccggcggcctcgctgatgcctccgcaccgctgccacctcgaagctcaccaacagccacccgggccacccagcatcaccggtcgggccaccgctgctctggctttcgcgccaccagcccgagcagtgccggcctccgcgccacccgccgcgcctccaccacgccagccgctcctgcgtcggcctctacaccgccggccgcgcctccacaccacactagcagctgtcaccgccgcccacggcgccctattgcgccggccgccggatctggtggctccgctcgaggccgttgcggccgaagccgcccactccacgccgacgcaacctcagccccgccgccggtcggccgcttcgtccagccccgccgccaatgccaccacctacacgcagtcgtcgtcgccaatctccacgcagccgtcgccgaccctgctctccgccgcccagagcaacagatccgagcatggggagactagatccgtgcatgccagcgccggatttggacaccgccggtggcttttccacagtgagcgtcggcgccttgccctgagctccgtctcgccggcgccctgaccaccttgacgtgagcgagagagagaaagccctgtaaattacttatttcgaaaacaacttgtttattatgtgcaaactaggctaaatagtccaatcaaaatgatgtgccctgtaaattactcatttcgaaccaacttgtttattatgtgcaaacttggctaaatggtccatacaatcaaatgatatgacgttgacatggatgccatggaaagccagtatagtttggccacaattttcttcatttttcaaaacagaaaaaccatttggcattgagagctaactcgatgctgaactcatcatcattatcaggacttaaatgttatgtaggttacatggtagatattttagcataaatattttttttaccacaaataagaccaagaaactactgagatcacaccatgagaaccaaattacatttttttaaagagaaaaacctaaacttaagagtgatggaacatcgaattctcaatatataaatcacaacaccaatataattcgtggcatgaagcaatcactaaattagagtctacgagctttagaggtctcaaactcaagccattcgactggcagcaagatttaccacgataaacgtagcactgcagtactgctccaatcattttgatgctgattcgtacgagcaagcacacagtagatgtatacactcatatatacacgactagctaggtgaaactcccacgtggccatgtgttgctacgggcactttaggtaacaatcaggatgaaatgttttttttatagaaactagcatggtgggcccgcgcagattgcgtgtctacatcattatctttttttcctcacatactaaaatatatattttcacattttattattaaaatatattaaaagtgacaataaattttgtactaacttgaccaaactgatcaatattcatattgtagtgtatatatatgtgatagttatttaataatttttaaatttttaaatttcgttatttctaaattgtattcttatatgtactctagacttcttttttcagtattctttatttttgtcgagctaactagttgggtggcccgcgcaattgcacggctagcacctaaacaaaatcatatatttttttaagtatggttttacttaaaatttattaaatagctatctcaatgtcttaaaactttgaaagaacaaaacttatcatccccgtgtttctaattatataattttttaaaagtcgcaccagttgctaccccttgtgtcatctctttcattatttgcttgctcgatctaccactatttctatttattctccttgtaacctttaaaaattggaccttatagtttttagagtttattgtcacgttgggtttcgtttttataatttctaggcgtcccgtcaaacgttgccattatactcctctatggcccgtccactgtctcttctctttattgtcattgagattttaaaaatcgaacataattatcgtttggattcatttttactttttagaagtcccgccaaaccgtcagcggttttgccattgtacttctctatggctcgcccgctgtctcccttctttattgtcattgagattttaaaatcgaacatgattatcattgttttatttttactttttagaagttccgaacctttaaaaattggaccttctagtttttagagtttattatctcgtcaaatgatgccactatgctcctctacggctcgtccgccgcctactctttattgtcattgtgattctaaaaatcaaacataactatcgttggaattatttttttattttctaaaagtctcgtcaaccgtcggcggctctgcaactacactcctatacaccacgcccactgcttctcctttttattgttattgagattttaaaaatcgaatatgattatcaatgggatttatttttttttgctcatttgcttcatggcctgcctgccgtccctcttttaatcgtcattacgattctattatgtgttttattaacagtttttatatgtcgtatcaactatcatcgggcatgttacttaatttatctcgtcatgtgttttagatggtcttttctttcaatatttttttatcacaaattttagctatttataaattgtattcctaattgaaatcttatttttctttttctaatttcagaatttagttttttttaaaaaaaattaattcatatcttattgtgttctttaaatatttttattttttattttcaatttcagttgtttcaaaactgtattcctacttgaactctcttttagtttttctaattttggacattattttattttttattctgagttttaattaatctcgtattgggttcttatatggattattctttcaatattgcttatttttaattccgaatttcagctaattttaaattgtatttctagttgaactcttatttcagttgtttcaaaattttatttctacttgaactctcttttatttttttctaattttggatattattttatttttattctgaattttaattaatctcatattgggttgttatatggattcttctttcaatattgcttatttttaattccgaattttagctaattttaaattgtattcctagttgaacttttttttttgctaattttggattttatttttatttttattcccaattttaattaatctcgtattgggttcttatatagacccttcttttagtattccttatttttaattcccaattttagctattttaaaattgtattcctacttggactatccttttcttttctaattttggattttattttatttttattttgaattttgattcatctcctattgggttcttatatggaaacttctttcaatattgcttatttttaattcccaatttcagctatttttagattgtatttctattaggactctgcctttccttttctcc

SEQ ID NO: 47239 - DNA, 8350 bp, Oryza sativa
  unsure (1)..(8350): unsure at all n locations
attcctgcagccctatttaattttttatttccaattatagttaatctactattgggttcttatatggactcttattttaatattgcttatatttaattccgagttttagttaattttaaattatattcctacttgaactcttcttttcttttcttttttctaatttcgattttttttgtttttttatttcgaattttaattaatctcgtattggattcttatatggactcttctttcaatattttttatttttaattccgaatttctgctatttttaaattgtaatcctacttggactcttttttttgggtaatttcagattttattttatttttattccgaattttgattaatctcgtattgggttcctatatggactcttctttcaatatttcttatttttaattccgagtttcagctatttttagattatatttctacttagactcttttttttgctaatttcggattttattttatttttattccgaattttgattaatctcgtattgcgttcctatatgatctcttctttcaatattgcttacttttaattcggaatttcagctattcttatattgtatttctacttagactcttctttttttttctccaattaatgaggggaatttttagcccccacagcgaacgtaaaaatcaaatatgattatcgctgggttttttttttttactttctagaagtcctgctaaacgccttgaccgattgcttcacgacttgcccgtttgtaattctttttagtcgtcattaggattctattttgtgttttattaatagtttttagatgtctttattaatagtttttagatgtcccatcaaccaccaccaatatactcctttataggcatgttacttaattaatctcgtcatgtgtttcagatggtcttttttttagtaatcattattttttatctttgacaaaatatctggtgttggatgaccttgggaggttgacggtgataggatatgcaaaataacatctctatacacatgggtttatcttggaggggggggggggggggagggggatatcaaaccatggtcatattaatgtagcgtggaagcctataagatatatatgctggtgctaagtcactcgatatggattagacgtaaatgaaaccctagtttgtattaatagtatatatgaacattttttgtaagttgttacaactatttgcacctatcatatataacatatatgcaatttactctacctttgaccttgatattttgcactgaatttaacagagttgcgtgatgtcaaattgttcactaatttacgcgcatccaacataataaaaaacaaaaaataataataataaacgaattaactgcccaccagatgtttttgaacacatcacgagatagtcacccttccaaaatacacacggcagcagacgaacaagaccccaacaacacgccacgaaacgcaagcaatagatttgtccgatggttaggtccaaccgccgcgacacacacaacgttcagttaggttccagtagctcacaggtcgcaacgcccctcacccaaacaacgattttgcccttactcttagcttaactcttacacccaatactgatgactagctacttgctccaatcttattagcagctaatggttttttctccggcccccaatttcatcatcaccaattcaccaagtaattaatcttcacactaaaccgagtcttctttttctctctctctctctcacaatctcagtagtaagagccagcctctgttctagaaaccgtgcgtgcatcacagacaaagctgtgcatggtgtgtcgtgacgagcatgcgtgagtgcgttacacgctcaagaaaagtgtgttagcttagcttagctagccaaccatgcatatattcgtcacgttcgtttcgagttgatcgatcttgtgtttaattccaagctcctcttgagcggccgtaattcttgatcgtcgttcccatttgctatagctagctagccatggaggacctgtcgctgtcgtcggagctcgacccggcgctcctctcgacgtcgacgtcgtcgtcgtcgccgccggactccgcctcgccgtccttctccttctaccacccttcgcctcccaactacaccctcgccgtgtccaacctctcatgccgggaccctcgccgcggctccggcggcgccgggttgctctcgtggttgttgggttctttctcgaccagctcgccgccggccaccggcggcgcgggcctcctgaacaacgtgtcgttcacggcctccagctcgcagatcctggccgtcgtcggccccagcggcgccggcaagtcgacgctgctccgcatcctctccggccgcggcaccggcggcgagatcgccgccaggccgcacgcggtggtgtccgtcaacgggcgcgcggtgacctcccgcgcgcggctccgccggatgtgcgggttcgtgacgcaggacgacaacctcctcccgctgctcaccgtgcgggagacgatcctgttcgcggcgcggttcaggctccggtccgccgtgacggcgcgggagcgcggcgagcgggtggaggcgctgatgcaggagctgcgtctgtcggaggtggcggacagctacgtcggcgggtgcggcggcgccggcggcgcgccgcgcggggtgtccggcggcgagcggaagcgggtgtccatcgcggtggacatcgtgcacgacccgccggtgctgctgctcgacgagccgacgtccgggctggacagccggtccgccatggacgtgctgtcgctgctccgcgacgtggcgcgcgcgcggcggcaggtggtggtgctcagcatccaccagcccagctaccgcatgctcgcctacatctcctcgatgctgctcctctcccgcggcgccgtcgcgcacttcggcacgctcaagtcgctggagcactccctgtcccgcctcggccacgagatccccatgcagctcaacccgctcgagctcgccatggaggtcaccgagcagctcgaggccgaccacgccaggttcggcgccgcgctcgccaccaccatccatcaacaccaacacaacaaggtcatcgacgacgaggacgaaagcagcggcgctggcgagcacgagcacgagcacggctactactgcagccgcgcggtggaggtgggggcgctggcggtgcgctgctggcgcacgatgcaccgcaccaaggagctcttcgcggcgcgcgcggcgcangcggtgatcgccgggctggggctcggcagcgtctacttccgcatccgcccggacccggagggcgtcgcgctccgcctgggcctcttcgccttcagcctcagcttcctcctctcctccaccgtggaggccctcccgatcctcctccacgagcggcgcgtcctgatgcgcgaggcgtcccgccgcgcctaccgcctctcctcctacgtggtggccaacgccctcgtcttcgcgccgtgcctcctcgccgtgtccctcctcttctcggcgcccgtctacttcctcgcggggctccgcgccacgacccaggccttcgcctgcttcgcgctcgccgtgtggctcatcgtgctcatggcgagctccctggtgctcttcctcagcgccgtctcccccgacttcgtgctggggaactcgctgatctgcatgtcgctgggcgtgttcttcctcttctccggctacttcatcccgagggagagcatcccgaggtactgggcgttcatgtactacgtgtccatgtacaggtacccgctggacctgctgctgatcaacgagtacggcggcagcagcagcggcaggtgcgtggcgtgggcgggaggcgtgtgcttgaggaaggggggtgatgtgctgagggggagagggatcgacgaggggatgaggtgggtcaatgtcggggtcatgctagggttcttcgtcttgtacagggtcatgtgctgggctgtgctggtcaggagggcagccaagaccacgctgtgatttttcacataagtgtgtgttgtaagtagtactcgtatatgggaaatgggacgtgactacgcgtcggacgtccgatccactagagagctgagatatactgttcctagcagtcttgtttgttgaaatccaaagatgtgtagctcccctattttctgttcacgtgtccttaacatttttaaaaaaggcaaaatttgctataggacatttaaaatttgtggcttttactatgagacacctaaagaacatatatcttctcataaacactgcaaaaatatggtggttaacggctggaaacccgtttcattattttattatttccggtgaaaacagatcaagaaacttcaatgaaagacaagtttgcccttgcagccgccgtgggtggaggtggaacggcagtggccatgtggatgacggttgctgtggggggaagtcggagatggcacggtggtgcgagaggcactggagctcggcgtgtcggtcggcggccatgcgcatgacaagctcgaggtgcgcttagtggcagcggatctagaggcgggcgtggtcagggggcaggtcatcattgtggtcgaggtcccgtgcggccatgtggacctagtcgtgcaagatctaggcgtggtcgttgggccagcagcgggcaacgtagcagacgatagaggcagagatggggtcgaggagcccttgcggctggatccatcccagtcctagtcgctgtcgctttggcggcgggctaggcggggtcgtcgggccaacagagtggcagccgcgggaggtcgcccattgccggccgaggagatgaggcacgggctcaggttcatggttggatccatcccagtcctagtcgctgtcgctttggcggtgggctgggcaaggacgatgacgacggcaacgatgggattgggttggaagaatttgataaaagaagagccaatgccctccgatgacgacaagaaggaggattgtgatcaatggagttcctcagcttgccactcactagaagggtggattgtgaatttgtgatgtatggatagtgccagattcttacttttgttgttgtttctctctctgttttcaccagatataataaaataatgcggcgggtgtccaacaactaattactatatttttatagtatccacgagaagatacacgttttttgagtgtctcacagcaaagatcacaaactttgagtgttatgtagcaaattttgccttacagaaatgaggtgaagatcaaagaattggtcgcttaaattgtttgataataaaagtgtgaaacacatatattgtactattccatctattatacattactataagatacctttgaaagaaggcaccataatcattgtgaagtctagaaattcacacattaataaaaaaagaagaaaaaaacttaaccattagatcatagtggactcatattataatggtatagaaaaaagaaggcaccatgacatggttgttttcagagagacggtgaacaatgctgaccatttccctcacccaccaccatgtaagtgtagtttaaggatctatcatgcataacatttaggcttagcattctaaattactcgatatgactttacttattttgtaggtaactattatctggtggattctggttaccctctacgtgaaggctatatgtccccatatcgcaagacaagatatcatttgaagcagcttgataccaaaggtcctgaaaatttgcacgagatttttaactaccagcattcttgtctacggaatgtagttgaacgctcatttggggttctgaaagagtaagtggtggattctgaagggcatactgttttatcgtatggagaagcaatcaaagattatcgtagcatgcttcgtgttgcacaattttgcaatggacaacaaagaacctgacatggatgtgcacaatgtgtttggtgagaacaagtacctttgcaggtcaggtcaacaaattggctctgcccacgattggttagcggcgacagccaagctggactatatggtttggcatgaattggtaagtgttttgttaaatggtagagcgttgttccggtccatcagctcgtacctcacggtacttgtacctcgcggtacagaaatgcatctaaccgttcgctatcaaggggcacgatggggaaaacggcggaagcgcagcccgcaacgcgcctcaggcattaggagccgctgcccacacgtcgtcacgtcgacatgcagcgccgcaagctcatctcgtagaagccggcgtcgaagccggcgaccgctccaattcattgacgcgcggtgacgcaagggaggaggaggaggccccgactccgattcactgacacgcggcgacgaatcatcccgtcgaggacgtcgtcaccgtcatccgcgccgacgaggcgcaccactgcgacctcgacgtcttcattttttcaagttgatgtacatgaccatccatgacgagctgtctatgttgaccacgataacattcacaggtggtcgtggtgcgaggcagcgatgtggttgtagagtggtcgtggtgcctgttccgacaactccacgaccacctcgctgcctcggccacctcgacgtcatggccggcaatgctcctaatgccaccgccgccgcatagcttggtgtctgatctctccacgaccacctcgtgtctcaccccgctgctcgcaatggctatgcctagaccagacctcgcagagtcgtgggccacacatgccgcatgctgccgtggaccccgcagcccgtgccgtcgacgctgggattggatctcgccgcacgtcgccgtcaaacgctggccctgcaacgcaccgcgctgctcgccgccgccgtcgaagccggggccgaacaacgcaggccgcatgccaccccgaacccttgaaccccgcagctcgccgccgccaccatcaacaccggccctgaacctcgtcgtccgctaatgccgccgtcaacaatggcctcaccgcccaccccagagcccttacatgcgaaaagtctatactacccttccacctctcttcaaaagacggtaccaccatatgggctaaaatggtaccgcatggtatcgagaaatctcaatcgtttgatttgtcccaattgatggctaggatttagtaccgcctcccttggctggatgggagtaaatctcatgcagaggaggcaccttcgggttagtggatcgggaggaggaagagcttcagccctcatgcctcagcgcaaatagatgtatgatgcgaagtttcttatttgcccttccacaacgcggacccaggggaggtaccgccaaacgggattacggtaccttgcggtaccaacgtttatcagccgtcggatcatgctcaatggacaaataggatttggtacctcctcctgttggactgtaaaattcctcttaatgagttggtatgtaacatcagctgcatggtgggaagtagtagaatgtaacaatataaattattttgatcttctcgttccaattgaatatactgaagctatgtttgtgtttgattgattttgcagtgcacaatatcgttcgtgatgtaggagtcagcagttattgttctgtgatagccctagttaatttgaaagtcttgttctgtagtgtagtatacacactccactaacagggttaaaattttcaccaaatttgtgttacagggcatattagtgctccagtgaatccatggttcctcacaattggaaggttgttatgcctacttacgttttggtgtcagctgattggttcgcttggcccattgtaatcacttggtttattaaggctgacatattatggattaggtgaccgtatggttccgtgactgaaagatggttatgaatgtgaaattttgctatgcttgtgacttgcaaaatatggctaatctttgtgttgcctgcatactaatggaaaatggttccattaggttttggccctactattatgttttatgtgtgctactgctgcagcagattgcagggatctggtgtgctacatgcaaaaatagatggtgattactatcaggtacgtactacttacaaaatttaggtgtaaaagtagcacatttgctgtgaaaattacttatggctctcaataagaggggtttgctagagtaaatccatctaagctttgttgaactttcaattttaagatgcctgtatccgagcgctaattgcttttagtttctttctgtgctgctctaactatgaaggaccaagctaagttcactgtacaatggcatattaagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgc

SEQ ID NO: 47240 - DNA, 705 bp, Oryza sativa
tgtaggccatacggtacgactgatacctgaatctctcgtgtgatttaccatcatcaccatttggattttctgaaaccactcacctgagaagttttagggttattaaagaagtttccacgcgttcagtacttgttctttctttcgagaatgctccagtagaactgatactaagtcaaggtgattgactatgcatatgactgtaagttggagcaccctttgcacagacaatttcgcttgcagatcacatctaaactagttgtagtatttttcctttaaataagagttacaggcacctgctaatttttgtacagctgtttacaaattacaaatgcaaacacaacagctatgacgcccatggaaataatagccctggttgttgaggagttgggggttcaaaacctattcacttcaaaaacacccaccgcttttcaatgtgtagttcaaaggaaatactcaacattaacagatttactcagtgaaatggatggtgaacagaagggatatggcagaactcaaaatcttgatctcaggcactgaacatctatacgaagaaatcttcgccttcataaacacagcgaagattctgtggctttgccgacgaggagaagaaagattgatctagggagcagactgcccatggacgaactgactgatcgtgatgccttgccagcccaccccccggggttatggtatcatgttggtttc

SEQ ID NO: 47241 - DNA, 2038 bp, Oryza sativa
gggcaatcgaaactgcactgttatagaatcaatagttttcccaggatcatttttaatccccaccatcacattgacacggcaattccccgaatctgatgttaactgaggtttcacataaattggtgtggtcttcaatttcttaactctggtcattcatgattaaataatgagtaaaaataaaacagacaagccaaacatagccaacagagagagaaacagaaggaaaaataagagagcaaatatttatgcacctgtaactcatgagctcgaactgcccgtcagggggaacaaacgaaaggatctgattggactcccaaggtctgaatcggacacaagggtgaaacctcacatcgttgataattgtaggattagagaatgacaaggtcagttctggtacacctggaaggctagaatttacttgaattttaccatatgcttcacatttcactagagctccttctctgtaaataaaatttactgggatgtcagacatcaaaaacattctttcactatggtgcatgtcctaaggtaacaagatcagatggtgtcatgtgcgcacatgacagatggttggatctctccagaaacgagctacattgtgtttattcacagacatggtttcgttgggatccttactgctatgacaattaatgggcatgaactagatcacagtagtgaaaagtttgaatatgctatatagatttcagtaatagcttcctgcagatattaatagatgaaaaaactgttcaggcatgaatctagggtctaaaactcaaatttacagatttagtgaaatatatttggaatatcgaaaaggccaaggtgaaagtacctgtttacacatgcatctagttcttcaactatgttaacatagacttcattacttgcatccttgacaacagttgttctccatggtacaaaagaagcagctgcatctggaagtttgttaccaagattagaactcttaccagtcacaacattcaacattttgctgacaatatttggtggggcaatcatctctttcaagatgtttggctcagtagtgagtggaaaaccgttgtccatcatctcatctaaaatctgcactcatacaagtattatattttagagaatacacaaacatgaatattataaaatttgcctatcatggtcttcacaagcaactaaatatgctgatatttagactgcagcatgcagtctagatcgatgtttcacatatcaatagaatgaaaacaacaaagtgtcttgatcaatccacgtacattacagtagaaattattgctaacaagtatagataagtacttgtaaagttcgtcgcactggcagttgaagtatcaattagataagttgtaatacagagcaagtatttctttttatctgtgttgcaaacaataatatcattgttatggaacaagtgggatggcatagtagctgaataatatattttgtctaaccttaatttgatatgtaaatttactataacaattatacttttttatttacatagcaacataaaaaaaacacagcgcagcacaaacaccacaaactgagactaagaatgatatcctagttttgaacttgtaccatggtacacaactgtgtccaaaatctgtatatagagagatttaaaacctgtctgacatagtttgacaagaaatcttccagcaataaagtaaagtggcactgtaatatcatccaaatatttgcactagttttcaaatttcagaagactagaacaaggtgaaaataatataataggcaaccagctgcaaagttattatgtgatgtcacatagaagagcatatgaaaatagacctgatacacaagtacgaagttgtctttgattatgtcttcatttaaatctccaagatagtcagttaggacatcagcaacccgtgagagaaactggaagtcgcaaatcatattcacagaaccataaaaaagagcaaaagtcaaaacctgtagtcagccatggttcttggcatttcatcataaattactttagcaaattactgcaatgtgcatgggctgcaggaat

SEQ ID NO: 47242 - DNA, 7164 bp, Oryza sativa
  unsure (1)..(7164): unsure at all n locations
gcataaaatttttgaataagacgaatggtcaaacatgagagaaaaagtcancggcgtcatctattaaaaacagagggagtatgtaattacactgtaacttgcatgtaactacagtgtaacttatatgtaagtttcacgtagttttgaatcgttagatctattacaagatttatttcggtgaggaagaaaaaaaatcatagcacacacctatgtgaaagaatttgttcccacgacctccattttaccaaaataacatgttatggagagattttttaaagttacgtacaagttacattatagttacagtgtaattacatgcaagttacagtgtaattatactagattgtactgtaattacatctgtcaaatttttgtgggaaaatttgtcgacaaatatatagcaaaattgtaccgtaattagatggcgacgttttttttttaaatttttcttaatttataattttatttattaagatatttaaaaaatattttttcaaagttttacaaatcttacccctaatatcctctaaaagggtgttttttaaaaacgcttttccaaaggactttttttttgacatggcacatgtgcgttttctaacatccacatcaagatcagctagccattttgcagtcaaccctttgccatattcccaaagggctaaaggagaccgcttgcaaaacaactggggttggccatttgttgcctttcaaacctagttttctaataagtaggtcccttatcgtcctcctatagggctgactgtaaggtggccacttgcaaaatgtgcttttccaaaggacattttttttgacatggcacatgtgcgttttctaacatccacataaaggccagctagccattttgcaatcagccccttgctgcattcccaaagggctaaaggggaccgcttgcaaaacaactggggctgaccatttgtcgtccttcaaaactagttttctaataggcagccccttatcatcctcttagagggctggttgtaagggagccacttgcaaaatgtcgtaggtcgctatttttacaggcagcctccttctcgccctcttagagggctgcaaaggggttcatgtgtaaaatattcacgcggccgttacaacacaccaatgggcatgtgtcatgtcataaaaaataaagctctcccagagagcgttaaaagtgtagatttgtaaaactttgaaaccaaaaaatattttttaaatattttattacataaattaaaaaaaatggtttttcttaagaaaccacaacacgcatacatttacccctataaacgcacacgagcatactctaccttttgagcagctccaaaagactgcgacaacatattttaatattaaagaagtcactgtggagcgcctcactattgatcgatacgtctgattctatcataagaaatctaactagtcgatgctcacttttcgtcgttagacagtatggttaaacaatagtagtcctcaactaagaaacatcttactactaacttgtagggctcaaggcatccatcactagataattagcattaccagctatcttagcaaatatattttactccctccgtctcaaaatataaacaattttaccatagtgtcaagtcaaacattttaaactttgattattaatagcaaaaaaataaaaaaaaatcaatcatgtaacattgatgttactagatttattgctctttttattcaaaacatcttatttttatagatattattggtcaaagtagcatctcgaaaactgcgtcgagataaaaaaatacttatattttgggacggggggagtagtactcttaggcgtctaacaattaatgttaagattgtaccaaataatatatgatctaggattgagtaactttggtctacggtcttgaaaaaaaaacttaactttgatttacttaggttatagcttgtttgtgctagaagttggtcaacaaaatttgtgtttggtatagttggtacagaagacctaatgagggagtagtttaacctcgtcagttgtatgtgcatctgctaatctgctatggtatatgccaaagctcttggctaattaaatataaggccattgaattaattttgagacttcagttgtagaatccacacaagtacatatattttctttccttgaaagaagaaataagatcgatattctaggtttataccgtgctggtattatgtcgataggtgccgccatttaaccatcaaacacaattcacaatatttgcgctggctgatatcatttgataaaggcatttcatgcatgatacgtcctgtttatgtgatggggaaaaaaatcgagacagctttccgcatcgtcctcgcatttagcctttaatactagtggtcatatttccagacaatgacatatagcgaatagtaccaattttatgtttacgcccgatttcgatcgtgactatgtggtgctgcttctttgctgatctggcgcttgcaccatccatttcagcaacatgagctacagcttgtgatggaaagacctttccatgccttccctttctatctagctaagctacgctatcagattaaatcagactgatccaaagatgtattttgttggagccatactcggacgacaattttgatttaccacacgtataataatacaaagcgtgactgatagtcatgattttttcatgagcaatatgtggtgttcttctgctgatgtggcgcttgcaccccccatcaaaaagtctcaacagcatgagcttctcgtggcgacaagagacctctttggctatttccatcgcaaggtgatccaaaagcaaactttggaagaactaataagaagtgaacttgacaacctgtagtaggaaagatatggtcaaaaatcctgacaacgagaaagagagtgaggggccgatttgtcaggaaaatgataaaatgagcagccggaccggatggtctgcaatcgccttcaggagaaaaagcaatcggttgttgcactcttcattccaatccttcgtggtagattggtggtactagctagtagaggacaagcacaaggccaccacatttcacctctaccaaagtcacctgccacactttgtggtgcccctctctttcaagtgttgtactacacctgccaactttctcggcacacggacgaaacatacgcagatacactcactactctttactatcccaaaaaaatatgttaatctttatacagccagcgtgacatggtttatgtttaaatttatatataaaagttggtttatttcaaaattggttgggtttttttgaatagtagcagtccttgattccaagctctgacctgtgagcccctctaatgacaggcatcagtggctcagtgcatcacaattggactagagctttaaacacagaagagtggaaaaatgatgtgtacttcttctattccaatataaaccaattaaaataggatgaaacattacctataacaaatttagataagtgcccataaaaattcatcggactaatatcgtttcattctatactaaatttattttgggataagtattgcctgtgacacttgttatcatagataatcaatgcagagtcatcagtgctgcagcctgcagcacactaacctctgacatggaacacagtaacgcacaaatggctacagaacaaaaccaagaaaatccatgccgatccattgatttcattccacttcatgaccacgcctgccatcacagtagtacacatacaaccagtgacagagaaagtacaggaagaatcaggggaaaggaatcaagaaacgcaatcagacacctcatcacagctccgaatggaataaaacaaaagaaaaatcctcttcttctttttctgtaaaactgtgtacagaaatgtgtgtggtgatgatgatgggtaattggatggaatgggatcaatggcacctaattggagcggtcgccgggctcggggaaggcggcggcggcgtgccggttgcagttgtcggagaagaagtcgttgttctcgaggagggtggggaggcccgggtcctccttgccgtgggcgctggggtttccctccagcgggcacttttcgtcggggcacacgcaggcaccacgccgccgcgggagccctcgcggcggcgcccgggttgtcctcgccgccacagtcatcgcccggtctctccctcgggctcctcctcccgctcctgcccccgatcccctcaaccaccgcgccgttgccccagcaggccaccgccgcgggcagcctctcccggatcgccctcgcgaccgccttcctccgcctcccctgtttccttccgccgccgccgcccccttgctcctcctcctccaccctcctgccggatgaagacgacccggccgagccggaggtggacgggtaggaggacgacgcggccgagccggaggtgggcggctgcctccgccggcgaagcgcccctcttccttcccctcccgctcccgctccctcaccatccaatcccccattggttctcttctcccctcccgcatacatgcaaccgccacgggaatcccccgctcccgcacggcagcggcggcggccaccgccgacgcggaggcggttggtgaatcgccgatcggtttccgatcagcgacgacgtggtggcgtggggggattgaaggggagaggcgaggggagcgatgcgatgcggctaatccgaaaaattctaattcgattccaaattgcgaattggagtggtattattgggggggcaccagctcgaatacgttgtcgccttgggccttcctccctctccctctcgctttcgttacaagtggaagcctcgtttaatttacagcgacagagagagaaactgcctcgtcaaaaataaatgagtatgaaatataagtacaactttatcactttgtcatgcactaatggagggaatttgtatacgtaaaaaggggtagatttgattgattgcttaatgttgagtgatgatctagagtttacgcaatagtgtcgccatcggtggttccgtgacacgttcttagatttgatcgaagtaaacctgtaaccagcgtagttcacagctgtgaacattttgtcattgtacttgtagtactatatgacaatttcagactagcggatggtcaatattatttatctcatgatgttgatacggctataaagtaccacctctttcatctacaaataagtaatttagaacatcattaaagataatttattttctgtagaaaatgttgcatactataaataacaagaggtgtgacttttttttttttgaactttcctttgtttctctctgggcattatcaaaggaggactcctgttctctttactgtattttttttattcttataggatttgataagtatactattttaatttctatatttttttctattagtttttcctatcgcaattgaagtaagatactagtactccctccgtttcagatcaaagtcagactgctttaaatttaactaagtttttagaaaaaaaatagtaatatttttgacccaatataaatttattagaaaaatatatttaattattaatttaatacaactaatttggtaatgcaaatattactatatttgtctttaaatctattatatactaaaagtccattatacttcccataaacgctcccaaactgcaaagtggcaccctataaacactcccaaatcgccaatctatctatctatctatctatctatctattatatactaaaagtccattaaacttcctataaacgctcccaaaccgccaagtggcaccctctaaacactctcaaatcgccaagtggcaccataataataagaaaaatctgaccatctatttttacttatattagtgcacccattattttttggatggttggatttacttagatctattttataaagaaaaaagaacatccggaaccatcatatacggaaccaacgtacgtaatgtcgaacgtacgtgcgtatgtactgtacgtacttccctcttgtctttccatattttcattcatgtgttattttctatttaatgagaaaataaaaaaaatacttttacaggtaaaaaaacacaaatagaccaactactaggtttagaagctctccctatttctaaatcgctacgtgtactattaaattagagaaagtattagaaaatcttaaataatacaaagcaacgtaccatcgatttctacttaaactgatgtatttaagttgttagattttttaataaaaaaatcccaaacctctctccctccctccccaccccttgcagtgttaaaatccattaaacattttgtaaacatctctaagctactatgtcacatacttaaattaaataaaatcttacaaatttcaaaaaaagacaattatataataaaagttcattaaacatcttacaaatacttctaattcgccaagtggtaccttacaaatgctcctaggtcatcaagtgcactctaatccaaccatcgatttttatttaaatcggtgatctattatttttatattagaaggttagattttttttttaaaaaagcacacattccgaacctcccgtcacgtacgtaccaacgagctatgttcatgagaaatcataatcaaaattatttttacattaaaaaaatcacaaagagacctccacctattaggtctagcaactcttactctgtgactctaaatattctacaaatacctctaaactactacgtggtgctattaaattaaataaaatgctagaaaatcttaaaaaagaacaaaacatttggctatcgatttgttagttttttaataaaaaaaaccaaacctctctccctccctccccacccctgtgtggtgttaaaatccattaaacattttataaacacctctaagctactatatcacatacttaaattaaagaaaatcttagaaatttttaaaaaaagacaattatatataaaatttcattaaatatcttacaaatacttttaattcgccaagtggtacattacaaacgctcctaggtcgccaagtggcactctaatccaaccattgatttttatttaaatcagtgatctattatttttatactagaaggttagatttttttttaaaaaagcacacattccgaacctcccatcacatacataccaacaagctatgttcttgagaaattataatcaaaattatttttacattaaaaaatca

SEQ ID NO: 47243 - DNA, 3070 bp, Oryza sativa
atatgatctatgaagtcactaatcatagcaggtattcatgtagcaatatagacaatagggtgaaaatgaaggtgtggttggttgaacatcatattgataagcatgtgggttgtacctaaggattttaaccgtggaacaaccttgcagtggctttagcaataaatcaagtcagttccatttaggaattaatgaccatgtcctttatttatttatttttattaaacttgctacagtacattgtaaagtcttgacgtagaacaatctaaaacatgtatttgttataagacaatacactttagtgatgattcgctaaatacattatgaccattacttcaaaatttcaggagagaaaatttagaacgtatacctttaccccatactaggttatgttttcttatattttcgtcccaaattgcaaagatcaaatcatttcaaggatgattaatagaatgaaactatccaaaagaaaaaaaataaaaatgggcataaaataaattgaaaattgaaaaaatattgctggattttaaatcaatacttgattgaaaaattcaaacattttacaaggatggttagaatgaaaaaatatatctataattttaaaatacaatcaaacaaaaaaaataatattattgaatttgttttgaggttgtaagatatccttttggcgagttaaaataccctaaattttatcataggaaccacctccattgtttcgacacaatagtttctcatcaattaaaaaccacatgatctcaagtaattttattttagaatttatatgttgcacgggtaattataaaaatataacaagctttcaaatcacacaaaataagtttaattttagtttagaacataatatatgatattttaataaaaagccacccgcatataaatattcataataaaatttcactcacattatacgagaaggtgcacgcgcatgtgcgcgggctaactttctagtttaattaaacttgaaacaatttaactttgacatattataacctgaaacggagggagtagtatataaaaaagaagtatcaccgttttttttcttagggtattagctgtagttgggatccacacccaacgttctgtaatcggattattctactcccgtaattgggccagctcagtcctaacatgaaatggacggtgagagcaaatttaagtagcttaataaggtgtaacagcacacccttataaaaacataatgattccaaacgtaagaatgcatagtaggaagcagttctctctgtaaagcgcaggtgtgtcgacgtttgatgtcgcggttctggtatttgcatggtatggggatcgtcggtgctagggtatacgcgagactaaggtaaaagagatgaagacatggatttttatacaggttcgggcccctgaattgtcaggtaataaccctacatcctgttggccaaagccggtattgctcttattcatgatattcacaccagtacaatatttggggtagcctatctaactgttgtcgacatggcggtctgacgatctgactcgtagtcgacaacagggtagccttcctccttgaatccgtgcccggcgagatcagagatagcgctttcatatctcctaacagtatccggagacaccgtaggggactagccgtgcttatctctgaagtcgatatccggcggcgtgtcttggcgtatgtaggcttctatgttgattgtgttgggtgttgatcctctgtgtatgttgattctcccgttgggcgctgatcccgttgggtgttgattgtcccccctcctcctatggggcttgtatttatacccatagttgtctccttgtccaagtagaactagggaaaccaatatggatacaatccgagtagtccttgtcattttcatgtagaactctggttgtctttccttatccggaactcccttgaggtcagtttccgtataagacatggtatgtggtggatcctgtcaagatttagtcaactactattaggtatgtggtatccataaccctgacaaggtggtagttggatgtccatcgagggacaaaaaaatccacggtcaaatttattatttttgtttcgaattgtataagtcgaattttaacttatatgtgtgtgaaaagatacatcatatattgatctatcttgataaatttttaaaatttttaataactttttgaacgtcatgcacaaaacgaggggatgtcgagggaaaaaatccatttccaaggttatatatacactctgaggagatattgccaaatcgatcggtaaaactttggtcgctggctcgctgcctgccagagaattccttgtagacttgccagccgtcatggactcatggtcctctgatcgatcatctcgtttgtcgatcgcctccttgccgtttttctcgtcgcttatcccttcttttccagcgcgccctctctgtctgcagttagcttcgacttcgaactagtggtacatgtacctggccccttagggcttagggtgaaattgatagtacgtttgaaactgtacgaggtgcaccaggagcgtgaaagttgtgttggactgtagggtggtgcatgcaccaggtggcaaagagtaatgacatggattctcaatgtctacatgaaggtaaaccacataaatactttaaatttaaatggtgtttgattacaacacgagaaaaaagtatgaaaacatgagctaccatcttttggttattttctctgaaattgccataggattgttcaccataagaatttcaaaggaaatgataggattcaattaatcctttatttcaaataatttcatagaaaatttttctatatattaattataaccttctaaatttctatgtcaatcctccaattaaaaggggcctcattttggaggataagaacataaggcttgttttctttttttctaaaattttgacaactttaatagtatcgatgccgctacgtttagatataccttttgggttgactttaaaaagagttgagtgtccggggacatgctaagagcatctctaacagcctcttcaaattggactctccaaacacccatatggccaactcgggctgcaggaat

SEQ ID NO: 47244 - DNA, 2815 bp, Oryza sativa
tgttataatatgacagactagtgaattgaatgtacagaccagtgttttgtatatgagcatcttctctcttaccgactccgatcagtcagtttgtagagtcatacactctccctagcccccagccttgtcgtcggagaatcgttctcggatgacaaggctcttggacctttgacctgcctcggttgaacaagcactgatcctagcccccaaccatgaagttggaaaactcaatttccgattacacggcttggttaatacgcacggcgagaactcttacacgaccagatcttacatggtctttcgtctctgaaggatccgacaaggccttatcggctctgggcgtccccagccgaagttccctcaggttcctcggaggccttgtcaagacggcgtaaagggacagtacgataggtttcaatgctaggtgtcttttgtggtaagggatctctgggtaaaacacttggcgatcttgtgcacctaatatcaactttgttgaagcagggtaatgggagaatcgctacacccctggtcgaggaccgggtagtagccgtaacccgaccacttgaagtggaaatagtgggagaaacgctacatcgctggtcgaggaccaggcagtagtcgtaactcgaccacttgaagtggaaatagtgggagaaacgctacatcgttggtcgaggaccaggcagtagtcgtagctcgaccacttaaagtggaagtagtgggagaaacactatatcgttggtcgaggaccaggcagtagtcgtagctcgaccacttaaagtggaagtagtgggagaaacgctacatcgctggtcgaggaccaggcagtaatcgtaactcgaccacttaaagtgaggcgagagagatcactacgttttactggttcgagaaccaggagtaggagtctcttaatcacctataggggcgctaaagttggtttattacatgtgcatatcatgtggccagcatgactcacacacccaacttatagcatatccggatgtccgttcgcaatcatgtcgggtgatcaagccgacgacgttcgcgaggaattatccgttaacatccttttctcgagtagtccagcgatggccggcgctatgagataggtcgtcggtcttctttgataggttgggcgcgacgactctgcatttgtcgagatcgttctcgataatgcggtgtactcgaccacgacctactcgagtgctcaattgttcctgaaaaatattttctagaaggcaagatatatagcagataatgtcgagtatgtactcaaaaaaaactgcatggatcttctagtattatcaggatataacgagcagatgtaaatatcaggcattatgtaaaccgtaaacaagcatgatttatacggaagaaaacagagcgagcccccagcgttagatcgtagtcgatttaacatcggggacactcgcgctacagatattattgtataaagaacatgctctgggtaaacataataaatcatggatctgataatgatgtatgatatgaataggtacgataaattgcatatgaaatattgcgtacctttgtagatacatgccggatgtatctacgaaattagtagatcaatttgaaaaaccaatctaccaattaccttattgcgtactcgttggacatcatatgatctgacatcttttggtacgccgcgtatcttgaggcttggatgatctcgatagaccaagttgtcgatgacgatgatggttctgatctggttaggttggatctccccacagccgaagtcgccgagtagcttgttgtcggagagtccatctcttaaacccatctcgtcgaaatcctgaagcaccaaaatccccctacctggcgcgccactgtcgacgtttgatgtcgcagttctggtatttgcatggtatggggatcgtcggtgctagggtatacgcgagactgaggtaaaagagatggagacagggatttttatacaggttcgggcccctgaattgtcaggtaataaccctacatcctgttggccgaagccggtattgctcttattcatgataatcacaccagtacaatatttggggtagcctatctaactgttgtcgacatggcggtctgacgatttgactcgtagtcgacaacagggtagccttcctccttgaatccgtgtccggcgagatcagagatagcgctttcatctctcctaacagtatccggagacaccgtaggggactagccgtgcttatctctgaagtcgatatccggcggcatgtcttggcgtatgtaggcttctatgttgattgtgttgggtgttgatcctctgtgtatgttgattctcccgttgggcgctgatcccgttgggtgttgattgtcccccctctcctcctaggggggtttgtatttatacccatagttgtctccttgagtagtccttgtcgtttccatgtagaactctggttgtctttccttatccggaactccctcgaggtcagtttccgtataagacatggtatgtggtggatcctgccgagatttagtcaactactattaggtatgtggtatccataaccctgacagtagcccctgacttcgatgcaaatgaacgagttcatattctcaaccgcagactttggaggaactgttatcgagctcacgtgaccgttctcggtgagtttagagataacgttagacttcctttatcagcctcgtgcgggcaccgaatgagtttgcctaagtcaatctctgatgtcgaccgagaaagtacagagcgtaccactaagtctcccgctttgctgtaatcaaaaatttggattgaagtcaaaaaattttatctcgg

SEQ ID NO: 47245 - DNA, 2646 bp, Oryza sativa
atggtcactctaacaaagcgcctcatcggatggccaatgctttggctgatcagccaaagctgcctccaattcggctaaacttcaatgcatattggttagcttattttgcttaaatggcttatcagcgaaagcatttggccaatgttcgctaattaatactgcgtcttccaaattgtaaccttcccatggcatataagctactaatacgttttttcctaaagcaagttccccaccaaccgtagcagccctctgatgaggcccagactctctattaatcctcttcaaaataacaatggacccacatatctctttccttttttcccccaaaacatccttcctatcgtcgaacaccacgcatcgcaccaccaacgacgacgatagaggggcggcgccggtggaggggcagcgcgaaggggcggcacggaggggcagcaccgacggaggggcgatgttagcgggagcggcgcgagcagcggggggatagaggcagcgccggcagaagcggtgcaaggatgtaggcggcgccggcgggaggatggcgcgcgcgccaatctggagacgccaccactggttcgctgtccctcccctccctccttttcctcttcttcagcacggccatcgcggtggacatctcgcaggcggcggcggcctcggggtgcctgctgctacgccgcccggcagcgccagggctcgtcaacattgccgtggcaagggaggaggaggagcggaaaggcgccgtgcccgtcgtgctcggcggagatcgtcctcgtccacggcatctctgcttcgggagaggggcaaaaggtgtggggcctaccattggagaggccattttggatggccaaagttggccagcaggagggggagtttagccagccggatggcttggccatctagttggcaagtttgttagagtgtgtttttcgttcaaaattgctaaattttaacttggagagagagatagagatgcggttggagatgctaggtcatactcttcagcctaattgcctcccaaacaaccagggcaggctatgctagcagccaccctacggcccccgcttataggcctcgatgtgatcgcacaacctatgagattggcccaatccgaaatacacaccgtaatgcaaatgaataagtcgacttatactccctcaaatatagttttaatctgattcgtatggatccctcaaccataatattaaatatcttgaccatctaactattaaaaataatgcaatttgactcccttaacagtttcaagagcgttttttactgacttagcttgttgactagtctaagtggttgagtcaattttatgcgggacccacatgttagtctccgttcctcttcctcctctctttttctatctgcggtggcaacatggagaggccgatgggaggaaggatgaatagggaattggtaccatatcttcggaaacgatgctcgatcgatcggtaattgatcatatttatcatttaaattaatcagtgtcgacattactactatgtagaaagaaattaaaaaataaaatttatgtataacaaaaaacggctttgctaaaattatgtcgacatatttctgggctaaatacagtcagtttgtcgatctgccatctaatcttctcactattcgtgcaagtacatctgataagctaatcgaacaacttgctcctaagttggcgactcctttttgctttgcatgacacgtgttggtcatcaacgaatgtaattactctatttacacagtaattacacatgtgtaatttagggacttacacatataattttagtatttacattgtaaatattctaaaattacatatgtaatttagatacttacatatgtaatttcgagacttacatcgtaaatatactaaaattacatatgtaatttaggaaattacaatgtaaatacatactgactattttttggtgaaaaatatggcgccataaatatagctactccaaaaaaaaataatggtcggaaacggtaccccttatacgaaaacgatgctcgctcgatttgaaatttccgtgacccattttcactcctaccggtgagctcttggatgaccaccacactccctccaccaacgagtcgataacgagttcgctgttaccaccgccctacaagagcatgatttttcctgtctcgttgccgccaccaccggcatgctcatcgtgcgtccccgagtcccaccgcctgcgccaactcgatgtcctccgcggcggcggcgtcgttgcacccgtcatcatcgtcatgcccggcgactcggccagacacgaggggcgccagtgcgccgcccgtcgcagccatagaattcgaagaagcagtctgaaaaccggcgtggagagatcattagttcagcatcgtggaatgctagaattcagttttgcagtgcagtaagaatgcaaatgtgctagtactactagagttttccacagggagggaggcattactgtgcaagcatatatatatatatatatatatatatatatatatatatatatgtatgtatgtatatatatatgtatgtgtgctcccacatccacaaacaaaaagttcaggattcagatccaatagcactagcaaatcctagtgacgaacgattcgtgctgcggtttggggggggggggggggaggggg

SEQ ID NO: 47246 - DNA, 15016 bp, Oryza sativa
ccaccacctattcacgggcccgacccccttggagggagcgccacgtggatactagggacaatctcttccctctaagcttggtatcactgggcccatatcaccaacataatcataaaaaaaaattcaaataagatggacaataaaaattggatacggaaactcatggctgcacttattttggaacggagggagtacaatactacaatagcatgaggacttgtcgagcaggccatggtggtcttagagcaagtttaatagtatagccaactatcaactccaaatcatctatagtcaatctaatagccaattcatatgatagttaactacaaatatatactacatcattaataattagtcccacctgtcatatacacacattgtcttggagtctgtattgcagctggctacaaatctgtagcccgcttctcttctctctcctctcttatctcctccacgtgtgcttatagctgacttatagtctactattgtacctgcttttagaggatggccctagcaggtggggacatcgagatggatagtttcctcgctgtcgtcatcgaggttccgcatatgcgcttcgtcgtcatcggcaggaagtgagctgcccaagccatcactcaccactcctcttcatcgcaggctgccccttgtcatcgctcaacccgtgcgcctccgcctcgtcgtcgttcaacttggggttgttgccagggttttgaaatttcggttcgaaattttcgaaatttcagtaatttcgccccccaccggtatgctcaaatatcgcccgaaatttttgggttttttttgcaattttttgtgaatttgtcaaattttattcaaattcattcaaattttcaactaatttcggccagaaatttctgaaatttcggtcaccgccagcataaagtccaatttcaaaattaaaaaccctggttgttgcggagacagccttcgtcgctaaggaagatgcaagggataaaagtaggggtgggcgttcggtctacccgaaaatttcggtctcggtcttcggtttttcagtcaattcggtttttaaaaagtcaggaccgaatttcatcccaaaaaaatcaagaccggtctcagttttttcggtctcggtctcggtcagatcgaatttagaggagccgagccggagggcggagacgacgctggcgatgtcgaggcggagggcggaggtggcggcgcggtgtgatggatccggcggccggcggcctgcgcgaccggcgaggcggcatggaggcggagggcggagacgacaccggcgatgtggaggcggagggtggaggtggcggtgcagcccgatggatctggcagccggcggcccacgcgaccggcgaggcggcgtggaggcagagggcggaggtggcggcgcggcgcggcgcgatagatctagcggccggcggcccgcgcgaccggcaaggcagcgtgaaggcggacacggcgccggcgatgtggagggcggagggcggaggtggtggcgcggcgtgatgaatccggtggcccgccgcgaccggcgaggcggcgtggaggcggagggcggagacggcgccgacgatgtggaggcggcggcgtggcgcggcgcgatggaggcggcaacggcagcgcggcacgatggaggcagaggaggcgtgctcacgcgggatggaagggagggcggtgcgatagggatggggatggaagggagggcgacgcgatggctggatggatagggatgcagcctgcgggttgtctctagggtttagtggtgtattgggcctattgggcctcctggacctattgggccacaattcggttttctcggttaattcggttaactgagcccaagaaccgaattacctgaacaaatttcggtctttgacatgctgagaccgaattactacccgaatttctcggtctcggtcttttcggtttcggtctcggtcttttcggttcggttcttcggttcggtcttattttgcccacccctagataaaagagagggagagaaggggacgctgacatgtaaaccccatctgctgagtgagctgatagaactaggtcaataagctacgttattactccgattcaaataaagtactacttcctccgtcccagaatatagcaacctaagatcgaatgggacgtatccccctatctagattcgtagtactaggatatgtccaatccggtcctaggttgctatattctgggacggagggagtagcctactaggcataccatgataactgaacaacaccctcaaaccgattttacataatatcataataaaccacgtttgttgagaagaaatggaattgaactactataatgcatcctaacagcaaggaaaaaaattaaaggtaattaaaagcataataatagtagtagtagttgtttcaggagaccacgttcaggcgttcagcaccacaaggcaccacacgaaacatgccatcgtcaccaccgcgaccgcgaccccccgtggctttggctgcgcggtagccgatgacgtcggattggacggcagatcggatgactgggacggcggcggatcggacgtctggaacccgagcctcgacttgtggaggtcgtagatcatgtacgtgcccgtctggatcatgctgccgatgagcgacaacccatcgctgtcgtccggcgacggcggtatcgtcaggcactccagcccggtatcctcgtcctggtagaggtagttccactgctgcagcttcatcaccgcgtttcccccgaagacgaacgctatgtcggggatcttcgccctgtccatgtgctggcttctgtagcacaggtcaagcccaagcgcggagccatcctccgtgttgttggaacccagcgcgctcaccagctccttcttcaggaggccgtaggcgttcttctcgaggtaagtcactggcacggaggtgctcaggaccgcctccagggatccccccgccgagccgccgccgccgcccccgagctgcaggtccttgccgccaacgcgtatgccggtgagctcgacgaagtacaggtcgaggttcgcgctacggactgcgccggtggtgaagaacggcgtgtagcggggacgactgccgccgctgttccctggcacggtgatgccgtcgtcgtcgccgaagacgatgaagtcgtctgctgcgttgttgtccgtggtgttcacctcgggtgcgaagtagtaggagaaccgcccgaggttgagctgcgagacgagggagagattccccttgttgaggccgagcacgccggacgcgccgaagtccccctccgttgaggagctgcacccgaaggtgacgacgccctttacggcggtgtcttcgctgtcgtcgccgaacgtgaagttttggacggcgaggttgccggtcgtctcccttccgtcgtcacccccgtacccgtacgtgtaggtgtactcgcacagatcgcccgtcgtgttgcaggtcggcttgatgatacgctggcaggtatcactctcgcatttgtacagctcctcgggccgcgcgtcgtagaccgtcacgccgggcatgttgttgttcgtgccgcaggaggagttgccggtggcgcagcacggcacccacacgaactcactggtgacgtcgagcgcgccggagaagtcctgctgcgagccgacggcgaaggcgacgctgtaggtcacggcggtggtggccggggcgtggcgggcacgcctcggcgtcggcgggctcggggcattgctgctgccgtgatctgcgccgtcgcgccctggctgctgctggggctgccggtggggaggaggccgaccacgtctttcgcgtggttcttgaagaagtcccgcaacgcttttcctgtctttgggcttaccaagaaccgtgggatctttccggcggaggccattcccggcatgacgacgaggacgaggaaggcgatggcgacggcgggggctcggccggccattgaaggcaacccgatcgacctcttgtggcaaatcgaagagagagctacaatgttctctgatagattacttatggtaaacaagagtaattattctgtgtggaatgtgcgtgattacaacactggacgtactgctatttatagcctttaaatggatcggagctggctggcaaatttgatcgaccgagtcaaaacattacttggagttggttcatatatactaaaacaatcacattttccactcgttttcaagtccaatgcacactctcccgtgctttctctactctctctttcacataacacttcccctaaaatttctgtgtttcaaaagacatcacttctattgttagggagcgttggttctggtgagttagggtgagaaaacacatcgtagtccgtgcgcacgcttcccaaactactaaacggtgcgtttttgaaatttactttaaaaaatcatattaatctatttttgaaatttaaaatagtttatgctcaattaatcatgcgctaatgactcatctcattttgtgtatcttcccaatcttctcaatctcctatccctcaaactcacccttactctgcttgaaattttgtagcattgtatagcatatgactaagcctgctaatggactggattggaatgggttaaatggattggttttgtatttgggtttgctttggttggattgaaatgggcacacgctataaatgggttggatcgatttggatccaccggaaaagaggattggggcggtttggtgatggttatgattttttgagtataatgtggattcagtccatggattgaacccatggattgtgaatggtttccactaagaaggctagatcaggtctcagtcgtggacaacacactccagcggtcgatgagacgatgcatgttccctggtcgattaacaagctgcatcacggccgcctcctcctccgctcgcgctggctccggcaccgattccgctgccggcggcctcttcacatccgcggaggacggcaacggcgacaccacggctttgactgaacaaccgcgtccacctgcctctctacctccttctgcctcgccgcctccgccggaaagggaggcggcggcggcgatggcagcggcttctgcctcgccgccctgggcgccgtcgccggcgagggggaggacgaaggcggccgttgcccctgcagcagctgctgctgttgtagcagcagcatctgctggcggcggacgtgagatgggctgtagagccggtcgctcaacatgtagcctccacgggacgacgacgacgacgccaaggtggcgccagacgggtggaccatggcggcggcgccagaacaagctgcatcgcggccaccgcgtgctcggcttgacagacggcgaggtcgacacaaacatgtcgtcgacgctatgaacgccggcttgctgctgccgttcaggctgtgcgtgacgaaatgcatgttctggttgatggtgaatcaaatgggtttgtggtcgggggtggattctaaatggtctgaaatggtttgacagggtggactgaatccataggaagggaatgggttagtgcggtgtggactgaggtgagaaatggattggattggtttggattctgaaaggagatttgcgggttgggttggtttgaactatttgagctaactgctgtggtgtggattgggaatggggcgggtcttaggccattagcaggcttacatatgacaatcaactcctacgtttcttctatttctctatgtttttaaaatcctgcattccaaggatatctttctcatcctattcctattgcatagcatgtggagttttgtttgttatttttattacaatctgtacaagttaaattttaacctgcatgtttatagagtgatatattatatattgatctatctttttaattttttttcataactatatagataacatacaacaaataggtggacgtccacccgagtgatcaaaacggtttccccatagcatgggagatggattctaatcactcgggttaacgtccacccgtttattgtatgtcaactatatggttataaaaaaattaaaaaaattaataagatagatcaatatataatacatcactccgcaaacatacatgacaatcttttctattacaacacttatgttacctgtttgtcgtcttaggctctttgtagcttgctgtcgggaaaaagaaagatgaacatgtagaccgtgaagcttcagttatgattgttttttttttccattacacaaagaaggcacatacatgcatctcctaaaactgtaaccctatactaactaaaaacccgtcatcgtcagactatatgcctaaactaaacgtgttgaacattatgcatttaactcttttctaattaattggcacgtacgcagttatactacgcaacactaccaaactacttttggttgttaacaacacgaaatctataaataaattttactactatatacatatagatatgggttttgcttatcaacggaaagaaatgtttccttatctatatagtacattaatttactcagtatacacacacacacaaagatttacttatgaccaatatttcttagtaataaaatgtactaagaatagcgcattggtcatataaaatattccctccatcctaaaatatttgacaccgatgactttttaaaaaatattttaccgttcgtcttatttaaaaaatttaagtaattattaattctttttttatcatttgatttatcgttaaatatacttttatgtatacatatagttttatacatttcacaaaagtttttgaataagacgaatggttaaacatcttttaaaaagttaacggcgtcaaacgtttagggaagtagggagtaattagaatgggtgatgcttcgaacccagatcgtttagcccaccgctaccttgtgaagctagtcgtaagatccctgagcgtttctatcagcacagcacattgaccatatagcttaatttggtctacgttaatagggaagacttaagtcgttgaccacacagcttcgggcaaggtgcatggtaaaatatggtatcatgacaactctcctcgatctgttgtctaaaataacagtgaagattcctaccagatggagttctcttttcgctcgatcgatacatattgatctcgagttgcttctgacttccagtgatccagattagttggctcacagaaggacgaccgggtccagtaaattttctgatgcccatcaagggcgatgaactactaaactgtgtggtcaacgacttaagtcttccctacttaatactccctccgtttcaaaatatttgacaccgttgattttttagtacgtgtttgaccattcatcttattaaaaattttaagaacttatttattcttttcatatcatttgattcattgttaaatatattttcatgtacacatatagttttacatatttcataatttttttaataagacgaacagtcaaacatttgctaaaaagtcaacggtgtcaaacattttgaaacggagggagtactaaactgtgtgcccatcactcttcgaccggctccagtaaatcccaagacgaacacttgcaattagaagagtgatgaagtagagaggggatacttgatcaagtagctacagctagtcagctagtggtaagtaaggcactaaggctgaaacattcaaatcaaaggaaatgcttaatttatatgaaacttgtctttctcgtttaacctcagatcaactcagtagaagatagtatattgttctcggtaagtcggcaattgcaagtgttcgtcttgggattgtatctttcgtttatgcatgcataaaagaagaagagcattggttaattaggttcatgcatcgtgtctgaaaactaattggtgaggatgcacgcgttcaaaagatgatcaaattgttctcggcaacataaactgtaattcgattgctcgctgaccatgtcgatcgtagctttgacaatccaagttaatagctagggaagaattaattaacggatttgctgaaaaagtgtcgccacattacgtggctgagtacagtcggattttaacggctgggatgcgctgcgctggacatcgtgtgcacgatgcacatccgttcctccacctgtttatccctttgcattttttttattttatttgttgatccggaattgctatgggtttgtagtagtcaactttcttgttgtaattatatatttatacaaatttacatactagttacaccccacttacacattacttacatatgtaattaatatgtaattttaggatttacatatatgtcgactggggatacccgtagaccggatatagagggtattggggtacactggtacgaggatctacgtaatatgacatcaagcaaatagaaaacatgaattatactggttcaggccccttggtaggtaatagccctaatctagttgatatgggattatatgatggaaatcagagattataaagggaacagtggaactcgatgataccgacgagaccgtagtcgagtcgactagatcacccggcgacttggctcctgtaggctccggcttcgtaggctatggtggttgtctcggatgtgagattcgatgccttaggtcctcccggggggggtcccttttataccgcaggtcaggtggtttccaagtaggactcggagacatcggaccctacatgatacagttacgacccagtcctatccgggtaggaatcttttcatctatggactccgtgatgaatttccttagcgcatacaaagaacgtccgtatacgcgcagatataccacaccgatgtatagcatatatccaagggtagagggtataccttatccgtaaccctgacagtagcccccgacttctacttaaatgaactcatgtaaccgatcgcgacttctgatgttgggtttgttgtcgttctcgtctagtcgatctcggcgtaaggaccgtagagacaaagagtaatcgacaacgctatgaaaagttcaacggtcgtgagtgaatttaaattgaagtccaaaaactgccgcgcgtaacggacccagaaattttcggcgggcatctctcctctttccttggaaatcgcaccgccggtagtgcgcctttaaaagagttttggggatccattttgaagtccgcctgttgcgaaagaacttttcagtctctaagcgctcctcatcttctccgctcccgcaaaaccctagcttgttcatctccgtccctcctccgacgatctccgacggcaatggatctcgacaaatccacttccaccggcgcgtcgctgaagaagttacaggaggacggcgctctccccggttgcggggccatggagagagaaccaggaggtactgaccctgagccagtcctgggccgcatggttgcagttgaggactacattctctgtggttttcttcctcctccttccgaatttctgcttttggtcttgaatttctacggtctttctttgctccatttgaaccccaattccatcgccttccttagtatcttttcgcatctttgtgaggcctatattggagtagagccatttctcgacctctttcgtttctactacgagttgcgttggatgaaatccaacagggtatctggatgcgttggtttccgactttgggatggcctgaagtcgcgctacatccccttctagtgcccctcttctcgtagtaaatggcgggcgaggtggttctatcttcagatagaaaattcggatccagtcttcgttgtccctgaggagcaaccagacaagatttcttcttgcaccgccaaacccgccttaaccccttcccttcagtccttcatcgatatcatcgatgacctccgagtacaaggattgtcggggtatgaagtcgctgccgacttcattcgtaggcagatccagctgttctaggcttgagcccacccaccctttcactattctgggccggaggacgtgacccaggtttctcctcagggtatttttcttgtattttggactccattccttaagtgtgtattcctcctgacttatcatttctggttttcgatctacaattgaacagcgaaaccgtggagcaccgtgtcggtcaagtgatgatcagcggtcctacaacggcgagcaacgtccccgtccctctttgcgagaaggagccagctgaacgcgaagccgcgatcaatgtgagtgtactcgacggccctgttgtctttttcctccgggatcgcattgtgactttatgtagtgcaggctctccctcttactgatatcatcggaccgctcgtggaccaccaggcggcggcttcgctgaaggtggacgtcgccaaggaggcgtccgatgttgctgccgctgctgccacgatgagtggcggcaatgttccgaaaagggggaggaagttctcctccgtgctcggaaatcgtcggaagacgcccaccccatcggtaagctctcccgacccttcatcactgaagatcttgacctcacatcatgctcgtttttactctaggcctccgacgcgtctcccccgcctccgcgccggcataggcttgtaacgcttagcgagaagtaagaggatgaatttgaggttttgttaattcgtcgaactcttgtagcctgtcttgagagcaatctttcacagggtggcgcgggcgaaggcagcgcaagacgggtctggagggaactccagtgtgtctcctgctgcggcctcgacagatgtcgtggtcgtgcctcggagccgtgaggcaacgcccagcggccctgccggcggtcttgtgcctgcttgaggccctcccgctgacgtcctcacttgggaggagctccaaatcgagataaggcgcatcctccaagccagcgctcgcggcataggccgcgagattgcggaggcgagggcggcagcggcggcgtcagcgaacgaacgcgtcgacaagctagcgcgttacctggcggaggttcgcgaggacctccagaagatgagggagctggtggccggcaacgagcggcaacagcaggggctcgagcaccgcatgtcggagctcgagaacaacctgtcagagttccgtggcttgctgcggcttacctacactggcctgcaccagttcgccggggagtgtggtgtcacgaccacgatcccggcgaatcccgatgagttctcgctgacgacttcgattacagaactgcgacggcaatggaggcgatcccctccaagcatgcggcaaggatcagagaggatatgtccaacgggatctacatcggggcgtgccacgtcctcgcgtgcgtaaggttggcgcaccctgaactcgacctccaggggatcctggatcagggggcggctaacgacgcgcgtaagggtgtgatggaagaagtcggtgatttgggggagtctgttctccccctttttgaagagtaggacttcagtttccctgtactccttaatcagttatgcttcgtaaaacttttgttggctccaactgcctttgtgtgtgcagtcatcaccttagttttctttagcattttgatcctgagtactttgttgttgtttgtagagatatcgatgtcgaggatgtccagcagtgcgggcagcctgagttgccagtgatcgttccggcacttgccttcgagtcgtatgtgttgcaggacgacgtagatcagaacttgtccgtggaaacgggtgtggcgacgacttccttaggttggtttttttttgttttcatcttctttgctctttcagctggattgacttgatttgctgcgttctcgagagaggagggcagcttgacttagtcgcttccatactgagcagacttcgagagtgtgcttgccgaccgagatcatcgcatccaatactagaggacgaagtttgaggtggcagaacttgagaggactatgttggaagtgaaaaaggaccaggccgtggaagcactccgaggtcgtgaggtgtggttcaactcgtacctcaggagttgttgcacagccatggccggagtctgccgggaactccaagtatctcgcggggatcccgaggagtcggtggccgggtatatctcgtggctgaatggggcctgtgcccaacttgaaggcatcggcaagcgtatcgacgaggccttgaagcaggagtgccgtcgatcgagccgatatgccggagggcacgtgttggcctgtatacgagataatcgtccgcagctgcacctcgagttcctccacgaagggtttgcacgttctcgttggactcccgcagagatagaccacctggcgaagtcaatggcaccgcttgcggagaaaatctttcagtcgatggattggcgttggacttgctggtagtttctgtatcctgtgacaaacatctcagggtagattgtaatatattttcaatttttgcgagctgtaaaaaatacttgtgaaatagaaaagagatctatctaactgagctttcttactctgtatgcggtgtgtgcgagtgtcttctcacttagcgacttcgatcagtcacttgagtcatacactctccctaacccccagccttgtcatcggagaattcttctcggaagataaggctcttggacctttgacctgccttggttgaacaaacactaatcctagcccctagccgtgaggttggaaaatccaatttccgattacacggcttggttaatacgcacgacgagaactcttacacgaccagatcttacatggtctttcgtctctacaggatccgacaaggccttatcggctctgggtgtccccagccgaagttcccttaggttcctcggaggccttgtcaagacggcgtaaaggacatgaggataggtttcaacgctaggtgtcatcggggtaatggatcatcgggaaggaacactttagttgtaatcttttcctgaaagaagactttattgaagaggtaatatgtcttacaagtatggatgctattgatttatacataaaatttacgtggttgatcaatgttccaagaatttgccaactcgcgaccatcgccgtctgaaatcttgaatgcgcctggtcgcaggacttgcgtgatcgtgtacggtccttcccatttgggtgagagcttgttttgcgctgcttggctttgaacccgtcggaggacgtagttgccgatcgaaagcgtgcgtgctcggatgcgcttctcatggtatcggcgaagggcctgttggtagctagctgctctgacggcaactcgttctcgatgttcttcgagaaggttcacatcgtcgtttctcggcttttgcatcgtcctcgggtagctcgtcgctacttatgaatttaattagtgggatccgccagtcatctgaggtctcgatgtcagcaacgacgcattctgcctctgtagcccccgagcagatgtcgggtgtgactgtgctattttcgtcatttgtttctttcaccgatggttttgtcaggacgtccaggaaggtgccgggttcgagtggctcctgtgtagatgcacgccgtgccagatcgtctggttcgatgttgtccttgcggtatacgtgtcggacctcgattccatcaaatcttttttccagcttcctgacttccgcgaggtacttggataactctgggctagagcacttgtagtctttgtgcacctggtttgcgactagttcggaatcccctttcacgattaattgcttgactccaagtgcggttgcagctcttatcccagcgagtagtccttcatactccgctgtgttattggttgctctgaagttgaggtgaattgcatgcttgaactgctctcccgaaggtgatgtcaagatgaaccctgcccctgctccttggctgttgagtgcgccgtcgaacgccattatccatgtttcattgtcggtttgactgtctaacctattttcaggcatagtccaattggctacgcagtcggcgagaacctgggacttgatggctgttcgtggcacaaagtagacatcaaactggcttagctcgactacccatttcgcaatgcggccgacaacgtctttgtttctcacgacttcaccaagagggaaggaggagacaactgtgaccccatgggcttggaagtagtggcgtagctttcttgacgtcatgattactgcatagagcagtttttgggtctgtggatatcttgtttcacgtcatggagagcttcgctgacgtagtagactggtctttgcaccttctctctctcgacaacgatgacagtacgcacggaatatggcgtggcggcaatatagaggaataattcttcattaggttggagagcaacaagtacagggggatttgacaggtagcacttgagtgcgatgaacgcctcttcgacttcctgtgtccatacaaatttgtcttgttttttcagcagaacgaagaagggttgtcctcgttctcccatcctagcgacgaacctgcttagtgccgccatgcatccagttagcttctgtacttccttgagtcttgtgggcgacttcatgttttcgattgccttgatattctcgggatttgcttctattcctctgcccgagacgaggaacccgagcagcttgcccaatggtactccgaacgtgcacttctcaggattgagcatgaggcgatatcgtcggaggttgtcgaaggtttcccgtagatcgtcaatcaatgagtcgcttgtcttggtcttgacaacaatgtcatcgacgtaggcctcgacgttgttcccaagctaatcgttaagtgccccttggaccgtgcattggaaagtgtttcctgcggttatcagtccaaacggcatcttaaacgtagcagaatacagcgaacggcgtgatgaatgatgtcttctcctcgatctcttttgccatgctgatttggtggtagccggaataaacatctacgaagcttaacaactcgcaagcagctgttgagtccaccagttggtctatttgaggaagagggaagtgatccttggggcacgccttgttgaggtcagtgaagtcgacgcacatcctccacttcccgttggccttccgcaccatgactgggttggctagccactctggatggagtacctctctgatgaaaccagctttgagaagtttatcgagctcttcttctcgtatggcctgttttcga

SEQ ID NO: 47247 - DNA, 8728 bp, Oryza sativa
cctccctggggacccccgacatgtcggacggctgccaagcgaacacgtcaacattgtcgcggaggaaggtgatgagcgcgagttcctatttctcgtccagtgatgccccgatcttgactgtcttgtcggggttggcgctggagagtggaacgattttgattacgccttctggtttcggcgtcttggttgttttgctcactttcttgggtggctcggttgcggtgggtgggctgggcgtgtgctcgaccatgtcgaggcttcgcttgtcgtattggacggccagctttgcgttcccttgaatagtgattgttctcttcggcccgggcatcttgagtacttgatatgcgtagtgagatgcggccatgaacttcgcgagtgcagttctcccgatgatggcattgtatgctgtgtcaaactcagcaacatcaaacgtaatctgctctgttcggaagttgctcgcttggctgaaagtcataggaagcgtgatcttgcctaatggcttggacgatgactaaggagtgattccgtggaagggttgatcggtgggtgtcaactcacttcgtggaatccccattgcatccaaggtgctggcaaagagaaggttgatggagctgccgccatcgatgagaactcgcgctaccttgatattccgaatagtgggttcgaccacgatcggatatcgtcctaggataacagcagccttggggtggtcctcatctgagaactcaatcttctgttcggaccactttatcttgggtgcagccccctgccatgtcgaacaaacttcacgctccactttcttgtattctcgctttgaggagtatgccatggaacctccgaagatgtgcgagacatggagaccggaatctggatatgccgaatccgagtcctgagtggttgcctcggcagctttctcgactacccgtactcgcttgcttttctccaatgccagttgcttttccagcgactttttgaagacgaggcaatcctctagagaatgtctgtccgacttgtgtatggggtaccatattctcttcgtgtcgctgccggtttgggtgtttaggagggcactcatattccgacgcgaggacttccacttgagctttccttttcccactcttgttacttttcttcttgcttgattcaggtgcgtctttggctggtttcttctcccctcccgtctttggcttgtcgttcttacgtctcagtgcgtcgtccatgtgagcgcatcgatcgacgatctcgaacaatcttcgagtagttgtgattcgccttgtcgccaactcctgggtagtatagtgatctctgacaccggttttgaaagcgcgaatcacagaggcgtcagtgatttcggggattgtatttctgcactcattaaagcgccgaaatagtccctcagagattcgcccggattctgtgcaacgcatgtaggtcgtcttcgatcgcgtgacgcttgtatgttccttggaagttagcgaccaattgctgccacagatctgcccatgaagaaatcgagtggggcgggaggtgcatcagccacgaacgcgcggaacctttcaacgccgtaggcagataatttgccaatgcgttgtcatctgctccggcagcgtagagtaccgtggagtagacctgaaggaattcttctgggtcggtactcccgtcgtacttctctattgctcccggtcagaatctctcaggccatcggacatcacgtagcgaacggttgaaagctctacacccgacgctgggggcagtgggttgtcggcgatcatatgtccttcgtggatgtctatctgacgatgaggatgaagtggatgatgacgatgacgacgggtcacttggctctagtgtgcgattccgaggatgacgtccgagttctcgggaatcctgtcatcgtccaccattgtcgttcctgcgccgatctctgtcatcgtcaccattatggtggcgtcctcgaccaacatcgcccgacatccgctgttcgcgatcatcgcgctcttggcggttgtggcggtcatcacggtctcggttctcgcccgagcgtcctcctcgctcttcgttctcgcgacgtcgcgaagagacgcgatgtcgggaacgattctcgttgtctcgcgcgcctcgcgcttctcggcggtcgttcagatggtcgtggagattgccggtgctgtgaggcggaggggtggctcattgaggcgatgtccgttactccggtggctcgccgtcggcgccgccagctgtcggttgttctgtctgtgctctggtagtggcctcctcgaacgcgttactgagattggctactgattcccgtagtcgttctgtccaccgtgcgagatcatcgttgagtacgggatcattggtggtttctctcagtattgcgttgatggtcccaaggtgttgggccggcgtggccgcttgattctccacttctgcattagcgtgcgcagacgtgctggtcccaccgatagcaaatacgtcatgtggtgtactcgctaacaatgagccatagtcttcgagcaagtgtaggactgatggctcgtggggatcgatgtcgatcaccccaacgaatcgactgggatgaccgtcgctcctcgttccttgttcacatctctaggaggaatttgtgactactggaccttaggaggcgacgtcttcatggctttgagaagaatcttgcagtttgagaagtcgtgattctttgtcttgtggataggacaatagatatcacgagttggagaagtacgctgaattccatgctctttgcaggcacggatctcagcttgtgcgttgagaaaaacccagcaagcttgcagggtgtatttcctagttttgtgaataggacaccaggaccttgtcgcctcaaaagttgtccttgtcggctcgtgattcttgtcggaaggacaagatttggccgcactaagatcttcctcaggcttggatgtcgtcgacattccttctccgcttcggcgggaggatcgttcgacagggggtcgtccggggttacggccacggcattctcacttctggtcattgatggaccagtcgagaccggcaccatggtgtaaatcgggaagacgatttcaccgacttgagtacacaccagcattgttgaagtcggaactccttggttgacgatggggtcgacgctattgttgacgagatttgacgacatagtagtagaatcttgagcaccaagtccccctacttggcgcgccattgtcgacgggggatacccgtagactggatatagagggtattggggtacgctagtatgaggatctacgtaatatgacattaagcaaatagaaaacaggaattatactggttctgaccccttggtaggtaatagccctaatccagttgatatgggattatatgatggaaatcacatattacaaagggaacagtggaactcgatgataccgacgagaccgtagtcgagtcgactagatcacccggcgacttggctcctgtaggctccggcttcgtaggctatggtggttgtctcggatgtgagattcgatgccttaggtcctcccggggggtcccttttatatcgcaggtcaggtagtttccaagtaggactcggagacatcggattctacatgatacagtgacgacccagtcctatccggttaggaatcttttcatctgtggactccgtgatgaatttccttagcgcatacaaaaaacatccgtatacgcacacatataccacaccgatgtatagcgtatatctaagggtagagggtataccttatccgtaaccctgacaatatataattttaagacttacatatgtaattttagaacttacattgtaaatatactaaaattacatatgtaatttagagacttacaatttaaatacataccaactatttttttaaaaaaaatatgacgccataaatatagctagtcctattaattaatgttgaccgtgatatacaggtccattgtattagctatattgtcaactgagagtctgcgaggacgccgataacaggcggccggtggccacaacacctaaaactgagaccatatccacgtacggtgtcacatacagctgtagtctagcgtacgaggatatataccacggttggcagaatggcagttggcacgtgcaactacgtacgtgtacggcgtaatatcgtcggcatcgatccaagggccgacgatggggtacgtaagtacgttcgagtcgttggctgcgcgcgctgccaaggcgtgtgcgtatttcttgtgagagctggatttaccgtcccggtcgcgatcgaattacctccggccatgcaaaccggataaatagagagcaactagacgaaggtgtaccacgggcggacgggccccctctcctcctccttctcctctgaaacggcgagagcagtggtggtcgtcggatcagcgtccgtcgcgtcggcttccgccaccagcttgggcagaatgaagaagcggctccgtaccacatgtccttcaccgcaacatcgccggagttggacggccccaacgtaaggtagctggtgacgcgctcgccgtcggtccctgcgacttggtcacgaacatcgcccggacgggaaggggaggaggatgcccgtccgccatcctgcatccgttctttttttttttctcgttactgctgcagatgaaaatgacaccaaatgatctgttcatttttttcgctaaacttttgttgcttggctgcagttacataattctgggagcacacctgtagatatagcagtagcactgctcttcacatgggcagtaattgcaaaccaacacctagttcttcagaaaaagacagcattttcctgtaaaaatctcacctttggctctgttcgtcatgcagatttcagttggagggaaatcagaattgactgggaatcacatgaactccagaatgacgtaattaatgatcttggcattacgtttcttgccaattttatcatcagttaatcaatggactcgttgcttcttacaactgtaagcaactgtgccgttctttcttgcgcagagctcgcgacgacgtccatggcgttctcctccatcacatgtgcgttcatcttcttcatgttgtcgtatttgatactccgtgaatgagatggtgacacttcggtggatggccggatgcaggacggcggacggcacggggcaccctcctccccttcccctacggtatggtgacgttcgtggccgagtagcagggaccgacggcgagcgcatcaccagctgccttacattggggccgtccaactccggcgatgttgcggtgaaggacatgtggtacggagctgcttcctcattctgcccaagctggtggcggaagccgacgcgacggacgcggatccgacgaccaccactgctctcgccgtttcagaggagaagaaggaggagagggggcccgtccgcccgttgtcgtccagaagagcggcggcgtgcgcggtgcgccaaccacgactcggaatcggaaatggagagagatgaatggagaagagaggagaaagagatgtcgtggcctcagtgtttttttttaattttttaattagatactcactgacaggtgggtcccgtgccacgtcaacgccgcgtatggtgttacatcagtcgaaaccgtcatccaaaccgccctgcgatcttctttgcactggttttgtaaattgagagatgcacatatctggtattgtggttcggggacaaattgagggacctaaagtgaacttattcccacgccaagaacacaccacacgaaacatgcaaataagatccatggcatggcagcacggcaggtcggcagcccacgactcgatcgaatcccatcctcgggccttggatgtcgtcttgtggccgccgctttatatcggctcgcagttgacaacctattacagtggacctatatccgaaacaattttgttatatatttatcgataaattcttttaaaaatttaatagatataattacagtataatcgtataatcgtagtgttattacactgttaacttgcatgtaactataatataatttgcatataactttcacataattttgaaccgttagatttcttcaagatttgtatgagtggagaaagaaaaaagtcactgcgcgtacatatgtgggaggattcgttcccaaaacctccggtttttatcgaaatagcatgttactgtcgacgggtgatacccgtagaccggatatagagggtattggggtatgttggtacaaggatctacgtagtatgacatcgagcaaacaaaagacaagaattatactggttcaggccccttgataggtaatagccctaatctagttgatgtgggattatatggtggaaaacacaggttacaaagagaacgatggaacttgtcggatccagcgagatcttagtcgagtaggttcgactggatctcaatggctttgctccttgtaggctccggcttcgtagactgtgtgggttgtgttggtttcgagattcgatgtcttaagccctccccggggggtcctttttatatcgcagatctggtggtctccaagtagaacttggaggtatcagaccctatacaatacgtcaacgacccagttctgtccgggtaggattcttccctactgtaaattacgcgaaaggtttccttagaatatacaggaaatatccgcatgcgcgtgggtatgccatatcgatatgcaacgtatatcgaagggtaaagggtatgccgaacccgtaaccctgacagttacaaagagatttttgaaagttccatacaaattacatgtaagttagagtgtaatttcacaacgattatgttatagttacatttgtcaattttttagagaaaatttgtcgacaaatgtaggtaaatcttccctattaacttggatcaaattaagctacgatcaacgtggtcaacgagttacagtttatgttgccgagaacaattgagcaattgatcattttttgaacgcgtcctcacctattaattttcatccccaatcgacacgatgcatgaacctaaccttggctcttcttgcatgcaatggccagcacgtccatcttcctattgttgccgacttgcggagaatataccgaagaattctgaggtaaaacgaaagacaagtggcatataaaattaagcatttcttttgctttgaatgtttcagccttacttatcactagctgtagctactcaagtatcccctccttagcttcactcttcggaagtgtttgtcttgggattgtatcttaggttctactactaggtaagttcatcgccctggaggcctggacccggtcgtccttctatgagccagtgatgaactggatcaccggaaggcggaagcaactcgagctaggtcaacgcatcagcctttcatcttccctcgatgtgtatgagcatctttacttaatttccagtttaaggtaaaaggctatactgcgtgttttactaactgtaattagctcatgaccgaggctataaatagccgtgcagtctcgatcagtcgtcaattctacacagagaatctgtaatagggcttgtttagattgacgtcatttcaaaccataccattttttagcaaagttgctaaatatatacatctatttagtttcttactaaactctaggaaataaataagaaatcataccaaaacttagcaatattagctagcctcatgttcgatcaatctccaacacaccttccgtacacacaacctgttgaatgatctggcgatgcatgtttcaccgtctgccatcaaagacctggctaaagtctgtaacctcgacgaggctgccaccaaagagctggaactggtgctcacggaaggcatatgaatcagtcaatcacacaatcttttgttcaagggaggctgctctgttgctgtcttgggtcttcgctctggtgctggtgctgtgccctgcagttcttccctgttgagatgcgtcccccccccccccccccttcctttgcttttggtgtctttcctatcatatgtcaagtaacgttagaactctatctattatgtcctggaatgttcgcgggcttggagacttaactaagcgccccattatctttaattcagttagctccgctgctttctccgttgtcttatttcaataaactaagctatactctattcaccacccgattacctcttctttcctgccgtccttcctcagtgcttttgattttacccctgcaatgtccacgagcggtggtctccttacggtttggaatccaacaccctaaccaaatccttcctcatctcccgcaaacataccctaacaatcggcttcacccacaatatctcaaacatttcgtttgccattaccaatgtgtatgcctcaacagacccacaaacaaaagccatctttgtagaagacctctccgagctctccaccaatatctctggcccgtggttactttttggtgatttcaatcttactcgctacccctatgataaaaacaactcaaacttcgacctccacttagcaaacctcttcaacgaaaaaaatgacgatcttgcgctcttagaaatcccgctcttcgattggctctttacttggtccagtaaaagagaaatccccaccctttctagaatcgatcgtgccttcataaaccaagcttggaacctatctcacccaaacacctccctctcctccctacctcgcactacctctgaccacgtccccctaaaaatatccatttccacttcaatacccaaaactcaagttttccgtttcga

SEQ ID NO: 47248 - DNA, 7182 bp, Oryza sativa
ggctcagcaaacaccacctgggattttcatctccaagatctctaccctgagaatacagtccacaatgcgagctagcagcagatctcggaacctttcactcttcaagaagcaaagtctgcattggactgcatggataattacaatgccccaggtccagatggttttggtccaagcttctataaggcagcatggcagcaaatcaagccctacatacagaacttgttgactgaatttcacaaccactctgcccagcttgaaagacttaacagagcatacatagtcctcattcacaaacccggtaaactaaactccccatattgttatagacccatctcactgcaaaactgccatctcaaactactgtcgaaagtccttgctaactgcctacaatccgttcttggcagtctcatagactgggagcaaacaggctttatgaaaaggagaagcatctcagaaacttttctatatgcaacagaaattctccagtgttgtcacaaatgtaagctgcctacggctgtcttgaaattggattttgcaaaagcttttgactcagtgcaatggtcaagcctccaagctattctgagagctagaaatttccctaattgatggcagaagtggatccaagctctgctaatttcaagcaagtcagctgtcttgctaaatggcatccctggaagatggataaactgcactcaaggtctccgtcaaggcgacccactctcaccctacctgttcattctggttgctgatatcttgcagtagatgatcaagaattgcagtgctatcaagcacccaataattcacaacctgctaggagccaccctacaatatgcagatgatacacttattatctgcccagcagaagcctcccagctaagtgctctaaaaacaattctcaactcctttgcacaggccacgggtctctgaataaacttcagcaaaagtaccctagtcacccttcacactccaccagaagccagcaaagaattagcagacatcctccagtgcaagctagaatcttttcctcaaacttatctggggttgccactatcagctactaagctacccctcactgcctttcaaccactcatagcaaaagttaacaaatacctagcggggtggcaggcctctctcttaaactatgcaggcagggcggtcttggtgaactcagtgctagactttctaccgacctatgcaatggccgtcgggctttcctatggactggggaggaatcatgtcacggctcgaaatgcttcattgcatgggacttaatctgcatagacaaaaagcaaggtggccttggaatcaaacgccttcacacacaaaacatctgccttctcatcaagatgctttacagactgtacacctagaattcaccctggacaaattggatatggagggagcatgctgattcagccctgggcccccactggcgatccttgattgccctgtttccacttctcagatctcaaactaatttggttgtccgagatggcaggcgcaacaatttctggcacgacatttggctggatgatcagcctcttgcctcaagattccaagctctctacacacactctactaagtcaaactgcacagtgcaagccattatccaaaatggcctggctgccacccttgtcccacgtctttcaatggaagcgcataatcagctcaataccctcaggttttattgtagcaatcccccctctcggctacccaggatgagctaatatgtaaaaccaaatgcaaaaatggtgtcatctcatcttcagctctctaccagctacaaatggcaaagtttcaggaatggcctcaatgggcttacatctggaaaagcaaagccccccccccccaggatcaaattctttgcctggcttctagctttcaaccatcttccgaccagagtaaatctacacaaaaagaagattctcccatccccaacatgtgagctctaccagagctctcctgaagatacggatcactttttcctcgattgccctttttcatcagctttctggaatttgatcaagctcactccgtcagtgacaaccctcttcatgctgcacaccaacaaccttgctggtgccccggtaccgttgaacaacacattgtttcttctctgctgctggtgcctctggaaccatagaaacgaagtcgtgttccaaaatgaactcccatccataagccgcctcctcagatgttgctgccaagatgccaagctctgggttcatcggttcaagcaatcgaatagagctatcctccctgtgtggctttcttttttctcttcccccttatctcctgtaattttggtttttcttgttttgcttttcccgcttttgttgtacagtgtttgttttggcctttaatttaattcccggcggcggtgacgatcgcctgtttcgtggggtgggttgtgcactcgtgctggtggtgaacatggtttcgtgaaagctactctctattttaccttccttcgctacttgaagttcattaatttttcgttcaaaaaaagttcattagttttttcataaaacattattctattacggaaatgctaatgggcgggtgatcgctcccctgtccgcccagcgatcacctgcctgccctctcccctatactactcgatacactcctccctcctccccttcttatcttcctactacagtacaccataaaatttttttaaaaaaaacaaaaagttagaaaaaattatggagtgaattacactttggactagttttaattacataagttgcatactggactaggaacgtacaaccattttcactttgaaccaggttttgttaccaaactatgcaatttggactagttgactcacatgttagcctcagccattcatcttcctcttttattagtccctatcctgatcgggcagagctcatctcttccccagtaatgcagcagtagcagcctagcaggctgcacgaacatcgagtggccgctggcatgtcctctgcagctctgccctgcatccctccctcttgaagatgaccgctcgtcggctccataggttgtgcccgtcgacgaccgctccaccggctgacgcaatgcgcgagatggaatgggctctgtcgttggcgctgccactgggagacgagtgcgggcgcccctcgagcttgacaggtgaaggcacgtacaacgtacagcctggcgctccatcgatctcggtccatccattggccaacctgcgttgctcaagatcggacttcaattggaaccccaagcaaatcacaccaacaaagctgcactcattctggactgctggtcactaaccacgggcccaagatgagattgatgcattcgtcggtgaagacgggagagatggaagaaaacactttctacatgatatgtgggccactagtccaagatgaaagttttggtaacttcatatgtattaaagtgaaaatatggggtagcatccagtccattgtgcaacacaggtaagaaaaccaggaccaatatacaatttactcaaatttatgtatggaaatacttatacataaaaaatttgaattcaaattcaaatttgaatcgggtaggtaaacttttgacttataaactttgagtctataagctttaggtgtataaactttatatatatagaaatactatatatagaaaatatttgaattcaaattcaaatttgaatcgggtatgtaaacttttgacttataaactttggatctataaactttaggtgtataaattttagatgtatataaatactatatataaaaaatatttgaattcaaattcaatttttaattagatataatttaaattcaaatttgaaacgggtatataaacttttgacttataaactttaggtctataaacttttgatatatagaaatactatatataaaaaaaatatttgaattcaaattcaaatttgaatcggatatataaacttttgacttataaacttttggtctctaaaccttaaatgtgtaaacttgaggtgtataaactttagtgtacaaatttactaaaataggaaagtaatgtggtacccaagaaaggaaaccagatggagggggaagaaaattctctgcggcgatgccgcatgacacttcatgtacaacaccgcgtagtctagcgacgcatgtctaagtttttactgtagcccgagttctttcgagccgagccgatgtccaatctctatagtcgactcaacgcccaggagctggttctcacctacgacctcatcgtggaggtcctgatatgcctcccgtccgtcactgatgtcggccgcgcatgcgcggtctgcgcctccttcctcggttccgctgcatcgtcaacgatcctgctttcctccgccgtgtgcgtgcgctccacccgccgacgctcctcggcttctacgactacgcctcacccgtcggggcgtcgggttccccctgccaaggagccccacccatccgccgccgccgccatctcccgtggcatgttctgtgccgccaacttcagcttctcattcgtgatatccttgacggtcgcttcctcctcggcatcatccaccgcattccccttctcaaacggcggagggcttgtgagcacactaattccaatcccaatgagcaccccattgtaaagagaagccaggatcaatattcaatatcgcttcaagaaacctgatatcttctcctcggttggagccttgaaggaagtgatattggtctctgcctctccggtgatgcgatgaattcgattttggggtagtccgccgcagagaattttcttccggtggagggagggagggagaggggatcgatcgctaacccacgatcgatcgcccattgggatcccccgttctattaggcctttacaatgcaacacggtgtcgttcggcttgaggcgtacacgtcgacaaatccggagaaatcggcgccacgttcgcaagtgaaaacgaagcaactcggtcttgggtgaaaacgaagctgcgcgcggctgggagaaagcgtggccggcgcgctgtggggcgagtggcttcgtgctcgtgcccaggcgcgcgccgcatcccggttttgccctcgccatcgccctctttcccgcgtccccctctttctcccgcgcacgggccgctttctttttcccctttccgcgtggtccatggttggaatcggaggaggatccagaggagtctgtgctctcggcacgacgccctccggcgacatgaccggcttcccctgccccagtggctcgccgtacagcagccatggcaatcacagccatggccggctctcctgtttttctaggattgggattatgttaagcacctaatcacccaccgcaatcacaagaaccaaaaaggaattggattagattaagcaccaaatcaggtagtgagatgcaggaagagaggtgaaacttgagcaagagatgaaaggtcacaagtctccatttatcaacaaataaaatgcaaaggattagcaaatggaagataacaagacagatgaagcagaccaagaactgaaagaggcaaaaaccaactttaccaaagaacccatgtgtagcagatgcaagaatctcacacggcgcagcaagagaccataccgaaaggatccaagacatgcacgggagtagcaaagaaagaaacaaagccccactcacatttcaggctttcagcagcagcagcagatagtttcagagaagcctgtgcatggctggaaccggagggagtggagactgtgccgcgtttggggatagccgctccggagccacgaagccactccggagcttcatcgtcggcgaggtcagactggcgtacggtggcgcgggaggaggagaggaaggagatgctgttaggaggaggcgatgagacatggttgtaccggcctcgtcaaagggcagtgtactagttgatttcgagggtacataggtaattttatgtgctgggacaaatcttggctccgtgggctaggccatgccacatgtgtgtcttcaaacataaatgactcggttttaggccacattgcattttgtagtggcttttgaagttctttagtctatttggcaccccaggctaaatatatatagtgacacattgctcttacccttaggatgttcaataacatcggtttgaatttgatgttgttatcggttcattcatgcgtatgtccactactttgttttggatggcaaaaatgtgagttattctgatcacaaaagaaagtcaaaaatctgatttgttctgatcacaaaggaaaattaaccagtcaataacacaatacgctccatatgtcactctctcttactattacttaaatcgatgagtatagattgcagcgtattggggttggatgcaactcgagacttggaatgttagatcgagacaaactcataagccacatcgctcgtagtagcgccgtcccaagagctgcacaacctgtgagacgtaccgcggctaccgccccgatctaaactcatacgagaacacaccaacattcgagaacccttatcggaattgctagattagggggaaaactttcaattttagaccattagatttgctttaagattcgtgctagcaaataggagaaaaaataaattagcaagtgtagctgctaaaatttgatctcacaccgttgagctcattgaggatctatgctaccaccgtgccatataattttttggatatttttattttagttacgtataaattatatacgagttacaatgtagttactttctagttatatataagttattataatatagttacactatacttacatttgaaagttttataaaaaaaaattgcgaagttttttttaagatagttctaataacacatatctcagtccatccgtagcacaacacaagcagttcacacgaacatgcacgccacgacagaccacacggaacaggcgatcgccgcagccgtcgagatgatccgcggcaacgcggcagccgaagccgaggacgcccggttggacgacttggacggctggtcgaacgactcgaaccacagcgacccgcggccctggatctggatgtcgtagtacatcatgtgcgtgcccgtctggatcaggctgccgaggagcgacagcccgccggccaccgccgtcggcagtatcgtcaggcactccagcccggtagccgtgtcctggtagaggtagttccgcggctgcagctccatgaccgcgccgtcccagaacacgagcg

SEQ ID NO: 47249 - DNA, 3186 bp, Oryza sativa
ccggcttagaaggtcgtaggcgttcttctcgagaaaggtgatgggcacggaggtgctgaggtacgcaacgagtgggtctcggccgcccgaccccgcacccaacatgttgaggttgttgctgccgactcgcataccggagagcccaacgaggtaaaggtagctgtaggcaccgttttcgtaggaccaaaactgagtgtaccggggattgctggtctgcgggacggcgtattcgccgaagaggatgaagcttgcgttgccggcggcggtgtcgtcgtattcaggggcgaagtagtaggagaaccgcccgagttgtagctgcgaaatgagggagagtctccccctgtttaggccgatcacgccgaagtttgtttcgggttcgaggccacacccgaaaatcatattgactggcatcgtgttgtcacctaacgtgaacggttggaggccgaggtgtccttccgtttccgttccgcccgcaccaccgtacctgcaggtgtatttgcatgggccattatacggtgcgccgcagtccggctgcccgacgattgtccggcagcgctgttctccgcatgagtaaagctcccggggcagcgtcttgtaaacgccggttttgtcgctggggcaggagtaggggctcacgcactcctcgcatggcacccacacgaactgactggagatgtcgaacgcgccgtagacatactgcggaggcgtgccgacaccgacggtgatgaggtaggttccgccggtggtggccggggcctgacttgggtcactgctgctgccttcgccctcgcccttgctggggatggcgtccgcggcgaggccggccaagtccgcggcatggtccttgaatatgtcccggatctgcttatttgcctttgggcttagcttgaaccgtggaatgaagccggaggagaccatttccggcgtaacgacgaggattagggaggcaatggcaatggcagcggcaacagcagggattcggtccgccattggaggcagcctggagtaccttttttttttgtgagaagttcaactaagctggaatgttctctacttctctgacagttgggaaaaccagagattctgtgtagaatgcgtgaccagagggcagagtctgttctcaatttatagcctgaacaaatgaaaacttatctactccacttcataataattaaatgctccgcagctttgctaaaatgcccccacgttaattggtaattgctataaacaagttgctgagtccttctctaagaagtctaacagacggcaacatgttcgacaaagaacaggtcaaccagtggcgcatcttgatatgagtggggccgaacttaagaggtacttacccattttatattataagttgtttgactttttctcagttaaaatttttttagtttgaccaagttcataaaatgtattgattattatatgcatacagcagtataggacttaaaaagtcgatctataatatggcctgtttggagaacgggaatggggtccccggttccctggaatagtcagggctccaaatgatgtgtatcacaacaagagatagacatataagatttacatatttaagagacgtacaaaatctatatcttcaagagacgtataagatctacattcagatcttaagaaaagtgtagaaacctacaagatctacgtatccaaggtaccgagaagagggtggagacctacaagaatatctccaaggtgtatggtgcttctttgacgaaggtaaccactttgaacccgttcattaacgacatcttcgagaagctcgtccaaagtaacaagaaacctgtaaagaagcaagaggaaatatccctggagacctgggaaactcagtgcgccaggcatggaaacaagccccatggagtggaggcaccctcaatgcgcaataccaatggacttggggccctaggcaggggcccgagcacacctcattgccccgggctcactatggggtttttttcacctcgcttggtgggccaacgggcttaactccaactcaatattattatttccgttgtaggagggagccgtttggagaacagctcatccacccacatcttagggacatgacgccgcatgtagcctcccgagaacccatgtctgccgaaggaataggtggggtggacatgcccctcccatatcactccagcatattcaatcttgccaccttgtaagagttgactggtgggcccaatggtgagaagatcaccttgcctctgcatcgtgtgtcaatcggagagcaaagatgtcacttcctgccatcttgctataggggacatcgacgaaacaagacacacccaactctttggaatagggcccgctcttagatgcaagttttagcactatgcacttcccttggcatataaaaggaggatctatcccaatgaatagaaggttgaatcttttagcaattagagctcacataagtcctatatctcatcgtaatacaagttcatcactgatagtctacatacacacaagagtaagatgttacgcatccgtatggctcaaacctgtatacttcatcacgtccatttgatcctgagggtgactcaggcttagactcgccccttgtccaaatcttcgaaagggggtcttgcttccccgatgtgggagttacatactgcgacatagcccatctcaatctcatcatccccaacatgataggaatcaaaagggacaattaaaccctagagtctgcatctgtctagacgcatgccgtatggctaggggtgacaatttccccgttagggtaggggacccgcccctacaggggcgggagagttctcacccgcgggtgagtggggacggggccccacaaaattctaggaacggggatggggatcggaattaacccgcaagtgacccggaggggtcccggatgtgagttacttctctaaaagtagcccattacaataatatagacccaacaatcccattcaaagttgacatataaaagctcaataccctagtcccctcaatcgtaatccctttccttccttcaatccacccacactgtcgagggttattgaaattttatcatactattatttagtgtattgcaatatttggatggagtattaactccatccagctgatgcggggacccggtcacccaccaggtcccctatgggggtagggacgggtgaagttttcacccgacttcctttg

SEQ ID NO: 47250 - DNA, 2800 bp, Oryza sativa
ccccgccccgttgccacccctacaggtcaccgacttgttactgaccttcctaaaaaaacttgtttagtgaccgatttactattctatcagaagaatgacttgttgatatttattcatctctagaataggagagagattgtgtaagacacctttatcgagagaccattatggtttttagacttctttctttttcatagagtttagtttgtgagattaatatagaggactgcctcggatgcactatggaaaacatttggtgtaaagtgttgcaatttcgctctctatcatattgttttagttttctggtttaatttatttaacatgttgaaaataatgctgtcttttcttttggcggtgaatatttattctataagatttgctgttttgcacccgctactgtttatccttttttaggcttggtttaccgtgtttcaatcctatggcttagtttttatttctataaaaaaggcactggcttggatctaattcaaaatggaattttgacaattatctgcaggcaaatgcaaaatttacccaaaacatagtaatatgtcttagaaaatgaatttttcttaacgtgtgtttagttcacgtcaaaattgaaagtttggttaaaattggaacgacgtgacggaaaagttgaaagtttatatgtgtaggaaaactttgatgtgatagaaaagttgaaagtttgaagaaataatttggaactaaacccagccgaactaaaagtagaggatgcattgacctccggtagttttcggtctgctccctttgttttatagaaaataaatctacagcccgttaagaaaaataatttatgaataaagctttttatacatgttcttagcgatctaaaagcaaaagcaaatgctgaaaaataaacttcgatgaaaaaactccaaaatcaactccaaatttaatttaaaaattcaaattttagatgataaagcataagcacaagtcaaaagatgatgccgctaatacagagatgtaacgtatcctaccacataaatctagaaaaagaatatatttagatttatagtattagaacgtatcatatatatctcgtgctaaattttttattgcccctgggaatttccatttcaattggggatgccgatagaggcgagactgaaatctgacataaatacagtcatggaaagacttgcaattggaagagtgaagtcaagagggtgtgtataattgagcaggccgacactgaaaataatgtcacttatgtctttcgtcctagtggtggttgggagatataggccatgtttacattccaatctttttcttcaaatttttaactttttcgtcacatcgaacttttctacacatataaacttttaactttttcatcgtattgttttaatttctttaaacttttaattttaacgtgtaactgaacacagccatattcgcggtaataataagaattaacgtgttgatcgagtaccgcttgcatggttagattcttgcatgccatcttgtcaactgtggatgccaattgattaagaggactggctcaaaaggtgatcgatcgttctcagctatagcagggtacacaaacctgcattgactacgtaattgacttggtccactatgcagattaatcgatctttttttatgaggccccttagattgtaggtggagtggtggaccataactactcttgtctataagaagatggttctatgaaaacggtttaagaaccataagcgaaaatcaattttttatacgagcctcttaaccgtagatgatatttggctataataaggtttttgaattattgacaatataaggaaatcaccttaatatttgatgtagaaaataagagagtaaatcataacgatgtaaatttaaattatgatagcgtaaatcaataaacgatgtactctcaacaacaggaatatgaaaaaaaaacatgatatcagtgtaaaccatgaaaataggcatatctaactcatttgcgcatatgaaaggaaccaacagagaagggaagaagagaacaatagcatacagtgatacaatagtggttgcaatggtagcagaaggagaaccgttgccgttcccaccgttgtcattgccattcttgccattgccattgctgttgcctttactgttcttgttctcgccaccagccatgattaaaaggaagtagtcgatgtagtcgcactcaagcacaagcgggcagtcgtgcaatgtgcttgcaaaaagcctgattcgcctcctctcggtgcaagatcaaggatgtgaggtttcggagccttgttctcctagtgcatatgcacacacactcgccaggatggaatcaccatagaagcaacagaagtggaagtggatggaaaatgtatgttctctctcatgcgtaggagatcaaatccattctcgttttataggagaaaagaaaaatgaagggtaagagactcatggaataggaagaaaaatagagtaactgattgtcatcaactagccatcaaccttcctccactgcactactatcaaccaactatcaattagatgtaatcaatgaatggattaattctcagaactcttcatctttaccattgataactcatgagagaatgaatacacataaatactagcatatgagccttggaatttatttgatatcattgatttaaatggatcaattgtccaagtaaatttaacaatctccaccaaatttcaaagcttacgaaaatgctctttattccaatgcaactttgatataccagtgtttcggtggagaccgattaatgaacatccacctataacaagagctacatctatc

SEQ ID NO: 47251 - DNA, 952 bp, Oryza sativa
tttttttcatattgcatacattatgttacaggatacatgtatatttacagcacaaaaagacaatcaaaggctacaaagatacgggcaacatcaagcaggctgtctagccggctcaccggaagaggagcttattggtctctgcctctcagcagaagtgcgtgcaccggcatcatccgcgttaaggaacattgtgttccagtggctgaggatcatgaacgtcacgtagtctctggccaacttgcccaagaatccatagccgtcccagcaaacatgccaatcttccatgtcgaaggcctgatgacaacaacaaagccatgaatatggccaaaatgatcagcttagaccatacggccggtgtctttaaacaatggttcagccatctgcatttgtctaatcacttgtcaaaggtagcaataccatagttcatgcagatccttttggctgatgtgatcaaaagtttcaggaatgctgttaaaagtatcataatgcagcataaagttaaataaatgaagcaacaatctcatagctaaattcaactaagctggttcaaaaagttttctgacaatatagcaaaaaatcatgtttcaagtcatagaattccactctattggtcaagcacacgatggagaactaaccttaaagctaaaaaaatccaccataattattgccttttgttgcagctcaacgatcctcttagatcactccctggaaggaaaatttaaacaaataagtacaagagtaacaagaccacaattttagttgacatactggaatgtaagagtagggcgctacaccgttccagcaaatatgctacgaacaaaacaaagttccaaaatattccactttacacggtacagaacagtaagatcaagatcaactcaaacctcttttctatgagttcccaacccatctccctcgttttctgcatacatgttttttgggctgcaggaat

SEQ ID NO: 47252 - DNA, 9837 bp, Oryza sativa
ctcacttccaatgggagatgaagctgctcaagcgcttgccctgatggatcgtatactgaagctgaaggagcagggtctgcaaggggaacagatcacccagcattttatcaagagccggctggccccaatcaaggaaagatctcgcacggcctttgaattcgacggcaagcatgaccctaaccgtgaagatcctgaatctcttgaattcaaagttatgaaggagagaatgtataaaatcttctcaaatgcaatcgtagtcagctactcgcacttgctgccagtggtgccgtacaatgctttcaacccccctccaccggtatgtatttaatatctcaacctttctcaaaagcacgcttttatcatctacaaagttgagaaaaaaatttgaaattaaactgttttttgattgattgtgcaaaaatatgccggatagcaaacgatttgcagaaataaaccatctggaagagcgataccgatgttcgctcctggaaagtgcgatagcgtggtgaaatcgctatccgaaagagcgataccgaagttgagctggcgctctcgcgcaaacgagacgcaagaccgcagcggtatcgcttttcccacgcgcgagagcaccacgtggagaaatcaatgcgactacctcgggcggagccagcgctctcgcacttttgttgcatgagaccgacgtcggtatcgtaatatgaaatcgcgagaccggttatgacgcgacgggggagacgtgggcacgcggcatcacgctttgcgcgcgcgagaccgatgacgcggcatgcgcgagagagagaaagcctggtgggcccgcggcgtcgcgctttgggagcgcgagaccggtcgcggtttcgctttaggcgtgcgcgagagcgactgtagagagggagcggcagtgggctcggtctcgcagtatgtgcgcgcgagacctccctcgctatcgcgctccacatgcgcgagagcgtccaccgatacctttatttcccatccctgtttcttttttgctttttgtgctttttgcacgggtttttttttgtgcttttccgacaccacatgcgcgtagctttttagggagaggtggaggagctcagtgcactcttatcagtttactattttagtcacatcatgccggccatttgtaagcgttgtatcgatcgaatccaatgcgctcacgggttaaattgagaggagaggagatggtcctcacagaggaagacagaagggaatgaactgaggaggagaggcagagcaagagaagagaagagaggaggcagtgcaggcagtggagagaaggaaaaaaagacacgtaagttgattagttttctattaggacaaattcatacgatgaggatttagaaaattttagttcacgtagttaatatttgtttttaattatgttagtgaaaaatttagttatgtattagttagtactacattatattttgttaggtcgtatgtaaaaatacaaatgtagaaagttaatagagtcgattcgggttaaaaaataggtagacataattaatttataaggtacaaaagtataatataagttacaattaattggtacgtagtagtaattatgtgacaaaattaattagtagttcatgtgatgtttaattttatatatacggccaatattatatgtaacaaatgaaaaaaactgaaatatcaatagttatatttgtagttattgatattgatattaatagtattgataattattaaatgtggtagaaaaattaaattaaagttgtaattaatttgtagtaattttaagttacaattaattagtagttcatgtagttatttatttagtaagaaatggaaaaggtataaatattcgttaagtagcgggaaatatatggtgtgcttaaacacatgcttaacattgtaggtagttatgaatgaacaaagaaatgcagtagtacgaagaactttgaaattgggacttttatatgagcaaattggttgaaaagaagaaggcaagacaaggtatggtactataatggaagacaatttgtaattaatagacagtttgtaatttatttggtattgtaactaaagtgcagttaaataaatttatgtcatggcaactagttttaaactataataaattggtagttatgattaatttgattatgtaattaatgaagtgaagttgaacttagttctattaatttatcatgttatgattaatttatagataattttgtactaactgatagttacaaatattttgtatttaagtaaagttacggtccgttagataatttatataatttatagttaaagttctaatatattaaatgtactcatccaaatttgcaatattagtattgtttcagaggtcatatctaagtatgtacaaacagtctgtagcaaagaacatgatgcggctaaatgagtgtcgttgtcctagataaagaatagaaagagctaaccaaaatgatttttaacttagctttcgtcaatgtttcttcggtgcaagtagtcatttgctgtattaaacttaattgattgtataattaatttgttagttaaacatatggattatgcagtgaactaaactttgaggcagcaattgttatacgagcaagctggttataaaggagtaggcgggatctgataaacgtaggtaaatattaaagacttcatatttatgtacgatatggtatggttgtgttgttttaagtattacatactcttttatttaaattaattgccatagttatgtttaattacgtgttttaattaattaatttgtattaatattattgtcatgtgtttattttttatgtcaaagttgtagtacaattataaataatgaattgcattgtcatgtattcgtaagtaaataatttatgtttacgtaattatttatttataattttttattacaagtacatgatttttggttaaatacagtggaaatataagtaagtagttattgataaagaatatttattcaaaaaaacagtatgcgtgtaaagtaattttggtcgtgaataggacacgtttgttctgtaagacttccatacggagtagtctgtgttttctacaatggcaggaatgtcggtatttagagtgtatttcggtgaaggtgaaattatggaaaatgaaagtggtgtcgatctgagcaactttaggcaatgcacactataccatccaaatcctgacacacttaccatgcccgaagtttggtactggttaactagcacattttctttagatccgggtatatatagtgttaacgtgagggttatgtggagccgatcggccaacaacataaaatgggagttaaaaaatgtgacacggagtaaggcctggcaggattggctcgctggctgtaggagacggggatatgaatatgtcatgctggtgcaagcatgtcaaggaagagtccccacggagagcgcagcggggcaatccaacaatcgtgaggagatgggtctagttcacacgaagaagatgaagttgtagctccccatcatggtggcgatgttggtcctgacattcaaaatctatccatacaaggagatgaagtggtcaaccgccatccaactggtgaagccgatgaaggggaggacatacctgctatagttgaagaaattgagagggtggaccgacatgcagtcgaagatgaggaaaacctcgctgctgaagagaatgatgacgaagatgaacaagaagttgaggaagtacctatgcctgcttcgtggaaccttgaagaccctggttatattgcagaaaactcttgtcatgattcaatatggttctacggggatggccaaatcaatctgggtgcaatgttccgtgacaaaattgggttgcaagacgcagtgaagtcatggtcattctagatgcaaaggcagttcagggttgtgaagtctaacaagactgagtacacggtcgtcatggtcacgtgccaaagtacgagtcttactggattgtgtccaaattgcaggaacactcctgtctgattcggaatactagggagtcgcaccgcaacttgaccgcggcgtacgtcgcgaacaagtactacaaggaaattattgaaggtgatgacctgcctgtgcggcacataataaaactggtggagaaaggtgaacaatacacaattagttaccacaaggcttggagggcgaagcagaaggccatggagaaaagatatgggacatttgaggaagcatatgacacattgccacagatgctaaacattctaaagagcaggaaccctgggacctatgttgctgtgcaggattgggagtcaattcgtcctccaaattatcttgtgatgcaacgggcattctttgcattcggagcatgcattcatgtgttcaagtgctcgaggccggtgctgtgtgtcgacggtactttcctatctgggaagtaccgaggccagatattaacagccattggtgcggatgcgaacatccagataattccggtagcttttgcttttgttgaaagcgagaactacgaaagctggttgtggttcttgcaacatcttaagtggggagtggtgcaaaaacacacatcgatatgtatcatccatgactggaatgccggtctgttgaaggcaatcaaagagctccaggaggatggtgatggtgcatactactggcctgacatgcatagccgttggtgcatgcggcacatgggggccaattttttcaaacaattcaacagccggcggctgatgaacatgttcaagcggttgtgcaaggaaaatcagtctacaaagttcgatgagctttgaaaacaacttgacgaggggacaaggacacatatccggtcaaagcagaccaacaacaacccgcaggatgtacatgtcccccaggccctggaaccaatggatgatcttattccatcaaatggaaagaagcgtaggtcatcaaagaatatcaaatgctttacccattggattgagtgcaagccgaatgataagtgggcactcttgcatgacactaatggggctaggcatggcataatgaccactaatcttgcagaggcgtacaatgcggttcttcgcaaattaaggcctttacctctaactgctattgtagaaggcattatgcacaggacaacgatgtggatgaggacgaggcgggccatagcgttgcaacaaatgtctaacacacaaacacctttctgcaaaaagatggcagagtacctccaagagaaggctgagtgtcacaccctgaagttcttttcccaagcctaaattgaatttataaatcacctcgagaaaataccggtgtgaaagcaagagtgaaaccctaataaattaatgcaaataataatcgaaattggcatgtggaatttttcttgagttctacatgtcgaaatatgctaacaagatttttagtggaattttcaaagctttagaaataattttaaccaattaaaaatgagcacaagcaatattccaaattttttatttatagtaattaataagtcttgaattaaataagtggtaaatcttaaattgaatttgtaaaaataggatggacgttgtttcaaagggcgtccagatttggacgctgttctaagaagtgttcagaggtggacgctgtaccgaagcacgtccaggctcagtttggggcgcccatgccgccatgcggagaggcgccatcgtcgactctcctcttctcgggcccaatgttggtgcagggctcgggcaaggtgttgccatgcccgccgttcacctcgactccgggagactgcaatagccgccttccggcttccacctccacaacgtcaggaatctgccgttgcagttcacctcaactcacctcgaaggctctcgaatccggagaggacgccgccgctttctgccttcacgccgggaggtcgcagccgctatccacgttctggttgagtcatgctggaacaaaaacccactcgtgccggcttgtgctgcgtcgtctgtccgcccctcttggttcctaccagcaagtccaggcatcgcctcactccaggtggctggccgagcaagtatgctcaattcatagatcttggtattcaggtgtatatgttctgcaatagaaagtttagaaagaatgcaaaattacgaagggtacgacgcaaacatcctccttctatcagatcatctgtcgcccgatgacttccaatctctggcctgttgcaaaaggaaaaaaaaagcatcgatcgaagacatcgcatgcagttcatctggcgaccgcttctcaagattcagtcagcagagagctcgatgcgtagtaaacaatggaccagaacaaaaaccaaactaatcaaatatctcaaaataaaagtggtggctgttcacatatgaccccgagtagagtgtccgtcatgtggaatagtggaagcattgaaggagggccgggggatggcgaccctgtctggcagatcaggtagagagcggtgcctgctcggcaagcaagcaatcaacgagagacaatagtctgcataggagtaacgaggcagagttcgaccattgtgtgattggatccaaagtccaatcttagtccggtgaattggacggctctttggggtcttcaactgcagcattatggacgcccttgtaagaagcgtccccatctggacattgtctacaacagcgtccacacctggacgccctatgcaatagcgtccttcctattttcgtaaaaattgactttgctttattatatatttaatttctgcattattaattattatgaataaaaaattcggagcaatatttaatcccaggaaaattcatttccttctttttctttttctttttcccctttttctttttcgaatgggccgccgccgtgcatcccgcaaccgccgccgccaaatcgcgcctgcgcctcccgggccacgttgcccacgtcgccgcccgcgcctgctttccccgcgaccccgtgcccactccctctctctctcccgcccgcgcccgcgccgaaacggccgatattcaattttgaatcccgccggccacgccctctctcccccttcccactactccggtgaaatcgggccgctcctggccacgtccgagccctctttcccctatttaagcatccccgctctcccctctctctttttctccatttcgccgagctctcccgtgacctctatcgccctagcgtcgtcgccctcctctccgccgccaccgccgccgctccggtagccgctagccgccgcgccgagccgcgccgagctgctgtcgggttcgcaagcccgagggccacgccgtccgcctctccgccgccgctttccgccacgggaaccccgttcgcaccgcgcgccggtgagctccgccatggccgccgccttcagctggcgtcctcgccctcttccatcttcctctctctctaacccctttcttcgtgttcgctaggtggttccgaagctcgtcccgccgtcgccatcgccctccgtcgctcaccgtcgtcaatcatcgttggtgaggcccctcctcctcttcctctctctctctctctctctctctctctctctcgccgcttagccgccacgctgccgcctagccgcttagccaccgctgtcgccgtccgcgtcgccgcgacgccgccaccctccgccgccggccggtcgccgccttgcgccaccgctacgtcgagccgcgctgccgtgcgccatggccgccaggccggtttgagccgcccgtgcgcgccggccacgcgcttccgccgccattcgatctaccctcgggtagatcggggccgtccaaccccgccgcccgcgtggctgccacgtggccgccatgtgtgcgccgcatcggcgccacgtgtgcaccacgtggtgcgccgctcctccccggtccgtggacccggtccaccgtggattttaattattgcggaataaatcaattaaggatttttctggttatagtaaaaacacagcgaatcttctaaaattcatatctaattcatccgagcttcatttaagcccattcaagtctcagtaaatcaagaaaaatgcatagaatccattaaaaatggttttgttctctgtttcagtagtcttatagcttgtttgtattgtttgcttttgtatgtcgcttagattccggctctcccgacgctccggtgtactttgaaatagttgccgaggttcccccagcagcagagcaaggcaagtcatgcttgtcacttgaacatgttgatcctatattgcaaatgctctaccattttcctttaaatactgcattgttttataataatactatgagatgtttacctgctgttacagccatactacttttgtaccatgctcctttgttagcttgggatataacatgactagagattggactagggattgcttagccatgcttagtttaactagcacaccgtgggggaaatcacattaattcatagacttcaggttctagtgttggtgttggattaaagccaccgtcctggtgttagtcaattaaaatataccttatggtgggctgtgggtgcatggttttgatggtcgcgcccatggcacttaaggaccggttcgcgggaaaccctggaaaaattcctcgtacttaccacaagccagcgtgggcaacggctgggcttgtagtgtagctttcctctagttgacgcattcaggcaagggtgggcatgatggagcggggcgggccctacgacggcctctgtcgcttccgaatttacctaggcacgagaggggactgctcattgcccgctggggacgggagtgaaacctgaggtgtggtgtgcttggctagagggggttatgcgaagggtcctgtcacggcctctttttggtatgtcgtggtggtatgtcggtgcacggaaacgtgtcatggggctgtgtcttgtgggtacaattgtacacctctgatcagagtgaagctattcgaatagccgtgcccgcggttatgggcagtcaaccagattcaccgtgattagtctcaccctagtctagtctaatggaattgattaattcaggtggatggttgggcctgtcgcaatgtggtgtagcgttggacagttgatggttaatattgagtaattattacaactgttttactgctttcaactaccgtctttaaatgctcgctttatgcaaatgaaccgctcaagctgtccttcgattatatcctgcatcataccctctattccgatatgactcgctgagtacgggggttgtactcagtcttgctctattttccccaaaaccccagagttttagtacgcgtcagatggcggcttctccgaggaataggcttcgtccgtgccgtcgaggatgcctgtggagtggtgttccaactgcggtccaagtcaaggcttagctccagttatcttttaattttccgctgcatttatgtaagacttttataatgtttgtaagacgtggatctgtatgtcaactttgttgtttgtgtaccccggccggtcctggacgggggttttaatgcacattctgcttggaattctattcgggaatttctgggcgtgacactgagaaggcaagatttcacacggtcattaccactgggaacgtcagacgaaggtgggaagtcacatgtcgcactaaggggggttttggatcttctaatggggtcatcacgcatgaagttactctagggcacgaatctgataacacatgttcgtgcttttgcaataagccgaagcttcttcataagccatgtagccatgtcctggccgcgtgcgctaaaattaagcttgattcaacatcatacgtgtcgacgttctacctaaaggataagttctgaatgcatggagtgctgagatcctcgggtggaggtccctccaacacttagtcgaaactgggggtgataaaaggatctatgtgccagacttg

SEQ ID NO: 47253 - DNA, 4812 bp, Oryza sativa
attatcccctcactatcgaggtcgaccgaattactccagaagaggagatattgctcaccctaagcttttaaaccagatgaattaccctctcgcccaatccagtcaacatttctttttaagaaaatggtgggactcacctatcatatctcctcttcccttcttcctctctctcttcactctctctctctctctcacagggcggcgcgcgagacgcggaggcggagaatggagctaggtggcgagcatgggggtgtggctgggtggcttcagctggcggcgagcggcagcgggagcaacaggacaggtcggaagtggcatggagatggagatggaggtggaaggaaaggtcggtgcacacggtagcgctcgtggagggcgaggcagacggtggccagaggcagggccatggcggaaggtgccaggaggcggcggcgagaaggggccgtggctgagaggcgggcggcggccagaggtgggggtgtgttaatgaccaaatttgtgtgtgtttttcgcatcaacaggggctacctcatcttccctgctgatctccctcccctcccagcccccaatggctgatcctggcaacaccgccgtgcacgccgacctccccttccacctccacctcctccctttttccatccacctccactctgttgatgtgaaaacacgaggcttgggagatctgcttaactccagtgcaggtccaaaattcaccttcgggtatgctagcgtgccagttgatttgatcctgcaatcaacaaaaacaaagacaaaaaaaccgtggttaaatccataaacgatagccgatcggctaagtgccgatgacgtatcatttatctttaagccgatgtcatatatagatcgatcggcagtcatgaataggtaaggaagagctaaatctactcgatcggctgtagatattaacaatatataatcctcatgtcaatatatgcttaaatcgagtgattgggatagattggtcgccatggcgagacagtataaatcacttagatcgaaatatatactaacaacaagactatatatgttcatagcatagccgatcaaatagatctagcatgtatcggctaatactccgataccactctaaattaagatattaaagcaagcagaatatactaaacgaaagcctaatatacctaggtgcaacaagatcttaatataaagggtagatttaacatgtcagtaaagcatataaagcaaatatagttaaatcaggtaagatcggctgaaaccccgatactaccctaatcggcaaccaagaagcaggctagagattgagattctaatcacgactcataagatcaatcaactgatgcagctataagtatgaaaagaaggacaatatctagacaatcaagccattggaagtttcatagagtggtggatatcatatataatctaagccaacgtcgatatttaacctaatcagctgccctctattgatagatgtcagccgattgtagattagatagcgatattgccagagattatataagatatatgataactcgacgaattacatagacaagattagagtatcataaagatgaaagcactaatcccgagaacgcaagccgccataacaagttttaccttttgttgaagatcgaaaccgatgcagctcaacctgaaagcaagaactcgtcgaaataaaacgaaagcaaaaagggtggcgatgcgccgagattatattgaacgtgtgtttatttgattacatagggctcggggtctatttatacccgagaattacacaacatgtccatatcggacacgactcttatctctaacaaactctaaaataccataagtctttgcggcagacttttgcccaaacatatttctaaggaaattacataaaatatctaattaatagatacaattgctttctcaggactctatccatgcgtggcaatcatcttgaagcatatcaactcaacctgatgacgtacaccaagtcgtattgtcggaatcggctgtatcgtctaacccagcctgactcggacttagccgatcccgatcgtagccgatttggactccagctgattcttactctatttccgcaacaatcttcatctttgattccgctttgatctaatcatcgtctccgatactggtattaccaaatttggtcgttaacacactctccctcccctcctcaccccttcccctccaccctttcccatcctgtgtgtgtcgccatgcgcaccgtcgtgccgtgcgtgccaccatgcgcggcgcctgcccgcccgtccccgcgccatcgcccgtccccgtgccaccgtgcgtgccatgcgtgcaagagagagttagagagtgaagagagaggggaagaggggaatagaaggtatgataggtgggtctcaccaatattttaaaagaaaatactggctggattgacatacgtatgccacgtaggataaaaccgctctggattgggtcaagggggagtaagtcggtcggtattgaaagttcagagtgagtaatgtgtggtttttgggtaaggggtaattcggttgaccgcgatagttcaaggagtattttgtactttttcctttgaaatatgtactatcaacaagtttatacttttgtccttaaataattccgatcctcccgcaaaaaaaaattccgatccaacttttaaaaattatatggttagatttgttttaaaactatttttaaaatactataactttcaaaaattatctttttataggtattttatttgtaattaataatgagacaagtgtgtcttggtgacccaccaatttctaaaggaacccctgaagtttggataaaactccatataacactctaaactttaaaaatagacatctaacccctaaactttgcaatgccatttaaattatctcctaaagtggtttcggatgttgatataacatacctacatacacaaatcatcagtccttaatttatactctacagtaattatatcatactagtattgtgttgtattatgttagtactcatttatataagtaagagagaaaatgggataaaaaggtgtagatttaacatatgcgttcgaggtgtatgtgaaatagtcaaactcatttaacatatatgcaaatttatagcaactattttgtaaaaccatcgtaaggtgttttatgtaaaaagggttgcataaaacagtgttaaaaaatttagggggtgcatatctggttttaattaggtggacttttatgtaaagttagatagtaactttttttttccatttccggaacgacggttattttgtggtcgaagggagtaccacatatgaacagaacagggaagctgtaattagcatgctaattaatcacggtaggctacgactttgatactcgtactccgtaattcggtagtactatgattcatgatgagtccttaatcagtttttgtcggtacacgcgacaatccggcagatacagataccgaactcccctgtcgtaacaggtactaagcggtaagcctggaaagcgatgccgatcggggggtggtggtggtttggtggctcgggcggccgtgtaacccgcgagctgccgcgtgagcgcagcgcagggcgtgcgtcgtctgatctggccttttgtccactgatgcatgcgtacgtttgtggctgttagtattgatgttttgtggacgtcgatgctgatggcagatatgcgctgttatgctctactggacgcagtggcgctagtgcttgtcagcgtccaatgaacgtgtacgacgagtcgacgactgcattgcggtgaaacgatttcaaaatcaatcgttttgataaattggcaatattactaagttttagtaggataggctaaatgtgatgttgtcaaattctctaagtattagtaccaatatatatgcaagtcattgggtaaatgcttctagtaagagtcattaattaacttctgcagtaacgatgatgcgcaaaaagaagaaattaaaagacttgcttgtaaacaaattgtacggtacttaagagggtaactgtatatactaaaattttgcactaattttcttttatcttgcgttacttggtatctgaaaataagttttatattagaaaatatgatatctgttggtacctttccaaaaatatggtagaatcactcttgttttcattatgcctgaactaattaatcggactacactgcgtcctagacgaacaaatcaatttctatacgtgaatcttgataaacaactataaatcttcgataaactttcatcaacaattacgaatccattgatgatttatcattaataattataaactagcataatataaaatacttttaatcatgaacatatcgataacatatgcatatgacaccacacaccaaatatatacgatcttaacttaactgttaacaaaagtacccaagttacaaagtgagtgtagttcaactgattagattccttatgatagaaccaacctacccggttcaagtcatagacttgacatgggtgctcgtatttatagttaactaaaatttcagtggtagacgatatactcttcaagatacatatgacttcgtcaatcttaatacacggtggtccattctttccgatatgtttataagggtatggtgtgtatgtttatatagagctgaaagagcgcgcgttgtgaacctcaacgtttatcatgtgtttctaaaagaaaatttttacccaagatgatcgaatttcctaaatacataactttaataatcctttggaacatataaactttacaggatctttgcatgaaatagttcaattcctcctaatcaaatactcccgggctgcaggaat

SEQ ID NO: 47254 - DNA, 2214 bp, Oryza sativa
attcctgcagccctaccttcatctaaaaatattttaccttcgttctaaaataattgttgttttaggatttaaaatttgttgcaaaaagtttatcactttagatagtgtttggttacaaggatgggatgtgacacgatgggacgaacccactttcaggggtgtttggttgagggacgagtgggatgggttggttcctggagaggaatattcctctcagacccgggaccaaccgatataagaaaatctcgcgggcgaactcatcccacctgggacgagcgaacggcgtgacgacgccttgctcgcgcgctcgccctgctcgccctcgggagcagtggcatacggcttgggcgacggtggcggtagggggctcggcgacggcggatccagtggtggggagggcggcagcggcagatccagtggtggggagggcggcggcggcagatccggcgatggggaggactgcggcggcggatccggaggcaggggactgttacggaggaggagcggcggtggcgtgcggggaggaactcgcgaaggttgaggggcagcggcatgccatggtcatgtgggaggtgagcaagccatggttctcttcctcttgctcttactcgccgctggctttctcgtccacacgcccgctcggagaccatctctttctcttgctcgccgccggcatgctcgcccgcacgcccgcccgatcgttgacggtggttgcaaacagcgtccatcccatctctctcttgtccctttaatcaaacaaaaaattgggatcatcccatcctacaaaccaaacatgtgagtggaatcatcccaaccaaaaaatcagggatggttccatcccatcccacttagtcccgaaatcaaacacatgcttagagtaacttttgtcgcatcaatcaccttcaattcaatttttttttcattctactcccaattactccctccattccaaaatataaggcataaccaccctgacccaaacaccaagaaacaattattatcacctctttgtttgaatcaatccaattaatacaatacatgcacccaatagaattaaacatcttgtgagtgtatgatttaaaaaatactccctccgtactcataaaggaagtcgtttaggataatgtttaagtcaaacgttgggaatataaatcatgaataactctcaagttgttgagtttgaaaatataaaaattatatgaatagatttgtcttgaaaaatactttcataaaagtatatatatatatatatatcacttttcagaaatatttttatagaaacaagaagtcaaagttgtgttttaaagaccgtgtcgctgttctaaacgactttctttatgagtatggagggagtactaatttaggagagaagagatgctaattaattgttatgcatatatgcacgccttatattatgaagcaactttaaaaagtagttgtgccctatattttggaatggagggagtatcttcttatttacattcccataacatttaatagggggtgctgtagtcatttttgctcttgagttttaatagatgacgccgttaattttttctcacatgtttgaccattcgtcttattcaaaaattttatacaaatgtataagatataaatcacacttaaagtactatgagtgataaaacaactcataacaaaataaattataattacgtaaattttttgaataagacgaatggtcaaacatgtgagaaaaagttaacagtgtcatctattaaaaaacggaggtggtattaaacaacctataacaacaactattgtggacgaagggagtaacattttcggacggaggaaatagctgacgagattcaagatgaattatatgttgtgttcagtttaatccctcgcgcacgtaaaacggaataattattagtatataattaattaagtattagctaaattcttttaaagaatggatcactatgttttttaaataatttttgtatagaattttttttaaaaaaatactattgtttagccattcgggaaatatgcacgtcgaaaacaaaggagaaaaagtgggagccaaacacagacttagcattagtttcaagtttcaaccgtgattattatttaaattgttagtgctattattactctttccatcccaaaatataaacatttttaagcatagtgacaagtactctctccgtcccaaaatataaacatttttaagcctagtgacaagttaaa

SEQ ID NO: 47255 - DNA, 701 bp, Oryza sativa
ataagcctagtagtctccatacggtacctacgactaccgtcaagagggatctaacgctatctctgatctcgccggacacggatttgaggaggaagactactctgttgtcgactacgtgtcagcacttcagacagccatgttgacaatagatagataggctaccccaaatattgtaccggtgtgattatggtaaataagagcaacgaccggctacggccaacaggagtagggttattacctgacaattcaagggcctgaacctgtatataaatcatcgtctccatcttttttactataatctcgcatatattctagtaccaacgatccccatactatgcaaataccggaatcgcgacatcaaacgtcgataaccttttaaataacatttaactatttatcttactaaaaatactataaatatgctaaaatatatatcatatatacttaaagttttttaaatgataaaacatatcacaacaaaataaataatattatatagaattttttaatagggtgaatggtcaaacataataggttaatcgtgtcatctattataaaaaaaatagagtatatgttttaaagaaaggttggtatgtaaaagtaacctatgcgcttgtttatttcctaactttttcttcaaacttccaactttaatttccatcgcatcaaaacttttctacacacataagggctgcaggaat

SEQ ID NO: 47256 - DNA, 773 bp, Oryza sativa
ctgacatccaaatgcaaagcatatttgataatatataattatatagattccaggatcttaatagatattatcaaagttctagaaataccgattctaggcaaaacccaccagtatgactagtattgatttcacaattattcttgctgaaagtgtgagtagtatcaaagcattcactatgctcagcaacaaataacaagtgatctctgcaactctaccctagttcaaactagctatcttcagcaactgaattatgctgtactgctgattttactaccatcacagagctcccaagcaagtaaaaaggagaagctaagaggataaaactcatacctcgatagccaacaacgggggcatctccacttgggtgcatgccaagaatgtcaccccatttcgataaacttgaaacaagtaatgcgtcggtgagaccaccacctgcaagaccttccaaaaaatcaaagcaacataatcagcagagctcccccatcaaaatctaacagctaaagcagcactgcatcacaacaaatcaaagctcgaaaatccgaaagcaacagccctgaggaagagccgaacatcaaccttggaagcgtcgccggcggcgtgggcgagcacgtagtcccagaaccagccgcagatgccgcggtccacgcggtgcgccgtcatctgcttctccaccatcacctccctgccatgccgaaaaaattgtgttcagtcacaaaatcaggtcaggacagtccggcgacagaggggaggaatcgatgcgaggaggaatacgg

SEQ ID NO: 47257 - DNA, 725 bp, Oryza sativa
attcctgcagcccgatgttgcagaagattctcttgcatgcgtcgcatcacatgaactaagtcgagacttcgatggtggtaatgccatggtgatggattggtgttcacctgcttggttggtgtcgcaaggatatgtagattcagaagaaagttatcatcgtcgttgttgtttgttgttgttattgccactgccgtttgtggtgtttgtagtgttggcaggtggtgtggcgccatcatcactggtgttggtgctagagcttgttgtagatgcattgttgcactattgatgatgatattggaggtgccacggatttgctggtgacattgaagttccaaagaggttgaagcatgggtctactaggaacctgggactacaccactagggatagagccactcgtgtttgacgagcaaaccggtcgccgagagcacaaaagatggactcacaaccgcatgctcaatattagggataggtataggctatggctgggcaatcgatctggagaccacaccatccgctaacaccaccacgacatgctgcaacattgctatcgctagcgtccgctccttcagcaacattttcactcgagcacgtgagttagaactcagaatcgatgttcgtctaatcgccgtagaccatggaccgagtgacaacttcagccacgatagcagtggcacattgtaccaggaacaagctggctacaaagctctagataggtagaatacaa

SEQ ID NO: 47258 - DNA, 16403 bp, Oryza sativa
agcttctatgttgtagacaatctccttgtgtgcattacaatgccttcatcgagccaagcctttgatggtgatgatgccacgttgagacggctcaaagatggagtagtgtttggccttttggtttggtggctcaaggatacgatggattgcaaagaatgttaccattgttgttgttgtcatcgttgctgccaccgtttgtggcgttcccaatgttggcatgtggtgcagagacatcgtcgccgctactgcttgctatgaatgtgttggtgcgatgttgatgataatatgggaggtgtgatgagcctactggtgacgttgaaggtccaaggaagttgaagcatggagctaccgaaactatttcactagggatcgaaccactcataccatcggtgaataacaccctggcggccatgaaagcagctcagtcattgccatggtgatatacaagcaaaccggtcatcaaggtcacaaaaaaccgagccactaccgcatccttggtattggggacatgtacaggcgatggctaggtagccgatctggagactacattgactaccaacaccctctcggcatgaagcagcacatgcgtggttggcgtctgctccttcgacgatgtcttcactggagcacatgagtattcggagtcgacgtacgccgcgtctttgtagaccatgggacagagccacaacttcaaccacgactacaacgacatgttgtcccaagaaaaacttgttacaaaggtctagataagtagaatacaacacctatcctttgcgccaatgcgatgccggttgttaagcacatagaaaaacttgagctaaccaagcatgcacaaacctaacgtctccccaagcagtaggagctaccagctgtttgtctccttctcggtcgtaataaccagatgggttctactcttctggtcatagtcgtcacaatctggtatggccgggttcatccatctcgctggtgcatgtcatgcatgggcatgtggtttaggaggaaatagttggccacctctcgaaacttggccataatattgtagatgaacacttgttcatgtcgtgtgcctgtgctgaacctcaccttcgagtgtggtgatgccacaatgagaaagctcgatgagagagtgatgtatggctgcttttttggtagcccaaggataacgttgattcatgagggctctatcatttatagagccaacaccatttgtcattgtcgttgttgccaccattttcaccgttgccaatattgccaggtgtatcagctgcactaccactagagtttgtggtggacgcgttgctgcaacgtcattggttggaacatggtgggtgacacacatgcactgtggaggattggtgatgatgttggagttgcaacgacgagcctggtaacattgaatgtgcaagaaagttgaagcgtgaggctacttggatggcaccattgacattccaagacactaggattggaatggggatcgaacctcttgcatcacgtgtgaaaagatgttggtatttctgttaacagtgaaatttggaaagtccctaagagaattatcgcatcgccaatagtcggattcctgctatattcggttaaggaaattaatctattaaaggaagcttatccagaagtgaccgagtttaaggaggatgtggcatggcaagttatttattaatttggaatagtttgttagtttccttttatctttaggaaagtgtgtttagtgtcctataaggacattatgttttccttttatctttaggaaagttgctttcttgtcctagaaggactagtatcttcccatgggtataaatatgtacacctggggtcgctgtaaactatctctccacgatcaatgcaattcggcgcatcgccaccttttaccttttttactttattttatcgtccggcgggacttggcacctgacgtggggctgcattggttttcgatctccgtcgaaggggtaagcccaatgttccgccggccaaggcaattgtatcatctacgtcggtgtcgttcaaggctgcattagtacattcgacctcctggattgctctggtttggttgatatatttgcctggctatttatcatatgtcctagttaatctagtcttagtatatcaatttagctatattggttgtctctcactttagggtttctaccagtatcagctaaattgttttactagattagattagctaaggcatctaccaccctaaaaatcagtcaacgggttgattgtctagatattgcgtttcttttcatacctagtgttgcatcaattaagttttatctactaagacatgtttagaactataatcccgagcctgcttcttgactgccaataagggtttcattggggtctcagccgatgaggtatctggatgttacatcagcttataaggattgcatataagttggatttagccgatgataacaaagatttcaccgtttaatctaatatgtggattttatgacatcagatctccagccgatgtatgctttaaccttcggatcaatacttgttctattatatcattgtttaccgattggtttctattggattatattgttgctttcttgcattatcatcagtcgtttacctttatattgttatttacacatcaagcgtcaaaatctacatcagaattatagccgatagctcaaaaccctattactatcggctggtatcggcatcggctggaattaatctatcggcttgtcagccgatcggctcattgatctgctatttgtatatcttgtcggttgcagagtcaaactgactggcacgcccgcatctcatcaacctttggtcctgcactgaagctaagcagatctccagggcgttgctgttgtcgacctagcccgcgccaacatagacctagcaccataggccaagcgcagatttctcgtcgacactacctaccgcctacctcactttccgtggagcacataacaaactaaagtaatttctaacctagataccataactaagttattaattactactctagctttgcgcaggaacttccctctttatccatagtcctagtactagagcactcaattggacactaagcaacgaacccgcactaatgagaatatatctcacttaaataactaattaatgaacataaagaaactcgaacacttgcttgaataaaggaagcatccgccgaagtacaagtgagagaaaaaggccgacaatcctggctttctctggaactccattgaaagaatgctgacactccgcactcctccataaaattctcgtaggaactccgatatttcgaggcactccttctggagcttcccctcactctctaccaaactaatatattaaatatgaaactacaagtgagttgtactctacttgagctcaaagttgtatttattgaagtgtgtgaggcatcctccttatatagccttcatatgacggttgagataatcccttatatgcgactccaaattaacaggttctcttatatgccaattcaaattggctcctcccttctatgccactggttcaagtttaccctcacttatatggcattgccttcactccatcgctaggtgaccattaactttatagtaaaaagactcatttccattgagagttggtatacaaccaatgataggtatttttcgtttgatagagaacttggttgatatgtatatgcatatagcattttactaatatagctactacatatgaaaattgatttttttggatcacgtgcaattttagccatcaccactagaaatgaactttcaacaaagagagaatctactccatgccactgacattgtctcttactataatataccggtgactttatccattccttacaatatgcctttgggttggacttttattaaaaatacctaaaataccttatagacatacaatgttaacaattaatttatctcattagaagtttaaaaaatttgaaaatttttatgtggcctccttacataacatggggacttgtatataagtttcaagttttttctaatatatttatttttagaagaaatatttttgtgtggtatatgagagacagtttggttacacaaaagataatacacaaatattttatgtagtgtatgaaagatgatttatattaagtattttatatagcatataatagataatttatattttataaaaaagtagaaatgcaaaaaaacttgaaacttgaatacaaacgtccatgttgtgtaaggaggctacatgaaaattttcatatttttttgaaacttctaatgagataaatcaattgctaatcttgtatgaccatgtattttgggtatttttgaaaagaaggttcgatccagtggcatattgtagaacaattgatgaagtcgttgacatattatagatattatagatagagacaatgttagtgtaaaattgttaaactcggacaaactcaatggtatagaatagattcaaacatgcatctcttcaataattttttagtacaaagagcatttttcactggttctaaaaaaattgttcactcaaataaggattcaaaatgaatcagttatgaatttttgaagtttaaacttacttcagttatagaataaaccattttatcatattctcatcttttactattccaacctggtcgggcccacctgtcagctgcccagaccagatgaggcatgggctggcttggtcaccagtgcttctcgccggcgccggcggcgaacggcggcgcgactcggtttggtcccaaaagagaaaacacagaggagtaaaaggcgaactctccggtggtggttttgtcgtcggatttggctggaggctcgctagcgactttgatttgcggtggccgtagtcgggttgaacatgcttgcatggctacgtctgtggagtgagcaaggcaatgcatgcaggagcaaacacggaccccaaggaagcttaccgagctccgagacaggtccggcgaggtcagggtagctcgagcgccggtggactagtctcgcagcaacagggcaatggcgaacggcaccatcggttagatgtatggacatccatcatatgcacgacgtcaagggtggtccaggttgctccaggtggaaggaaacatatcgaaactcactgggtcgacaggatcgtgcggggcggagctcagtcatagccgggaaagatgacgctgatctcccacctcgctgcatggatcttggggctatttagggcgttttggacctggaggggagttaaatgtgttggcgaggcaggtcgactcgagatggtccatggcggcaggaacacgagctcgatgccaaggccgcgcgctgggcgtgcccttgagctcccacggggcgtcggcgttcccaacgctacaaatgacgaagcaaagtgaggtcacagggagaaatgcttagcatgcatatttgggtacaaatcaattgaaagaaggagcttttgaagaggaatcgagaaatggcagcggcttgctctccatggctaacggcaagcaagtgaagacgagaatgacagagcgctctctttgatcggatttggatcctctaccttcacggcttgaaggcacgagcgtgcagtcggcacctcatccaccgttcaaataatccaatggctcacgtcgctgtgcacgtctgaatggatatctgtctgtcaaagcccacgaagtactactgctatatttcagtccgaataccaatgatgtttgcattataaatttcgtaatttttcttatcaatcctatgctctaatcataatttttcttttgctttttatgatgtgacttgacattgcgtcatactccctccattagttcccaaaataaaaacttttcatctagaaaaaaaactaattacacagtgtgcgtgtaaattgcgagatgaatcttttaagcctaattgcaccatgatttaacaatgtggtgttacagtaaacgtttactaatgatgaattaattaggcttaataaatttgtctcgcagtttcctagcgaaatctgtaatttgttttgttattagactacatttagtatttcaaatgtgtgtccgtatatccgatgtgacaaccaaacccaaaaattttctccaactaaacaaggcctaagtcgcttgacttttttttagtccaacttcttttttttaatttttaacacaaaacaaatatattataaaaatatattcaacgttagatttaataaagctaatttgatattttatatattactattttttatataaattagtcaaacttaacgatttttgactagaaaaaaagtcaaatgacttataatatgaaaaaagatggagaactactttgtaatgaattagtgttgttatttgaaactttcggttttcttgtatttttaatttggtgatatcatccatttttttcatgtgtattagcactaatatagtttgtaagtttcttcagctcgcgtacacttcccagaccaaaacaaccatcgtgggattttttttttttttttttgcgatagaaccatcgtggtctttcacagacaaattcattcgtctgtttaagcgcacatgtgacgtgagccgttggattacttcaatgatggataaggggctgactgcatgctcgtgccttcactctacaaaggcagacgatccaaatccctctttgaactggggcagtgagggatgatgggtgagcttgctaggggaggtagaaaagacgagctggagccttgaggcttgggacatgcgggcgtcgacaagtgacattggactaaatactattaacagtcaacaagtagtggtataagagggtaatcaaacttaaaccaatgccatttttagtggcataaaaggtaactaactaatttggagtggcatataagaaattctctcatgatggttatgacggttgaaaatgtcgttaacacccccccctccccaccaccttcatttagagacaatctaggatgtacacgtggaagaccaggatcagaggcgctagtgacggttcggccgaaccctgggccctaggtcctagtctctcctttggccaagagactgactggtgggcccttatggcggttagatggtttggccccattttaagttggttttgactaatttgtgggccctccaatccttgtactcacacataattggccagaggttcattttcgtcttatgtcgggtgtattttctccttaattaacctgcatacatataattaccaaaactagcggaagtggttagtagtaaactcctaccactaagttttgatatcttttatacatgagttgatggttaaagtttacacttaacgaccgtcaacaacagaacattgattgccatgagagcagctctgttgccatggtcgatcacccacactggttaccgagaccacaaaagttggagccaacacatcatcggcattggcggcaggtgtagatggcggctcaagcaccgcacccaacactcccacagttgtatgttgcaccaccgatgccagtggttagttctctggcaccgttgttgtcaccgaagagttgtcgatatgtttatcgcgtcgccgtagaccacaagactgagcaatagcttcagcaacttatcctcatcgccgtactgatccatggggaacatcttccttttctgccccaatgaggagccaacgtcgcgcacaagcgatgtcacctctaggggcgtgcctaggttatactacccggtgtcacaggacatcgggtagattattcaaatcctatataaattacactatattaattaatatattagtcaataattagataattagtatgtattaaacccccggtaacttttattctgggttcgccactggtcacctctgtcctcatgacgagggagagcacagaggtgcccttgcccacttcaacaattaactcatctgtggatatgcaatcactagtgtagatcttgtgatattggagattgaggacacgaggctatgccatggtagtaaaacaagtagagattaaagcggctcatcaaaatctttcacgcagcgtggtatcgcgtcccctcgtttcaatcgtgtttcaccgaccggactgattcgatcgagtgtagtacactactggagaaatgatctttactgggtcggccgatttccacaatagtcccggttgctcgaaaaactgggactaaagatcatctttagtcccggtttatttgtgcaaggggactatgtgatctttatcaaccgggactatatttagtcccggttcaactcgtgtcaaaggctgtcaggtcctcagagatatttagtcccggttggtaacatgaaccgggactaaagatcctaaattcagtcccggttgttattcccaaccgggactaaaatttatatagatttttaccaaccaggactaaaaatcaatataccgtatataatacctttgcacttatcctcaaaaatttccatctcctattcctcctcctctctcacgcactcttatcctctcattatcttcctattcctactcctcctctctcacacagtcttatcctctcctttttctcacaacgccggcgaggagcgggtgggccgcggcggcggcctgcgcacgatagcggggccagcgggcggcggcggggcgcggaggcccacgcgcggaggaggaggctaggagggcggtgggcggcgggccagcgaattttttttttagaatttgtgattggatctgagatgtattttggtttgtctgtgatgtattcacgtgatgtatttgcgatgatttttttagaacttgtgatgtaattttttagaatttgtgatgtattttgagatgatcgatttgaagatttggagatttcttttgttctgtgatctatgatgatctatttggggatgatgtggagatggagtaaaatcaatattcaatattaaaaacaattaaaaaaagtagtaaccagtcctggcctggctacactgggactaaagatgtatctttagtcccgagtatttgaactgggactaaagatctttagtcccgagtatttgaactgggactaaagaccgccatctttagtctcggattctcccacccgattcgctacccgggagtaaaggggttgcgaactgggagagaagagggtttctccagtagtggtacatactggtgtagccatacagctgagtatgtaaggcaactgcgagggggcgacctaccatgcaactgactgcacgcgagtgcaggctcgaggtgagtccatcccctatagcatatgtacttcatatatactttatatacgtataaactttgtatacacacctataaaaaaaatttgtatatgtataaagtttttatgcgtacgcacacaaactttatacatacaggtataaagtttgtatatatacgtacatatatgaatagaatattccatgggccaagaaattggaaaatcgagaaattttgtagaaattttcaaaattttgaacactgctagcgtgtggcccagcttacgagttacgacacgagtagctaaccttatcacagcgactatcaccagccacagagtggtctacgcatgcagagatatatctttcttctctcccaggttaggtcaattcatgcacaactttctcaaagcgatcgaagtggctttttattttgtctgacgacgaaactgacgagacggccgggccaatcagcctcccctgcccgcatgccggccacgcactaactcccatcgtttgccggccgcaatttgccggtgaaatcaccgcacgctcggctcggcgacgacgatggccggggatccactcgggatgctgcttttttttttcgctaaaggcgacgcggatctcgcgtaatcttttgctcggcttgctgtgattgacacggtgtctacctggcacctctcgctgccactgattagcattacaagtgtggttagtactagtactagagcttttgtttccgttaattagtgtagcgtgagcaaggtatgaggagaagtgtggtttgacccgggagggtgatcgcaaggggtcaactcttaggttgggagtatttatcactttatcagggttgagaaatcgtcgaaagtagtggtgtttgaatcttctaaagatgaagatgaagataaagatcgagtgtttcacgcaaaacgatatggtaataatatgtgattaattgagttttaattattacaaacatgaaaaatcgattaatctgatattttagagcaactttcatatagaaagttttcacacaaaacacatttgttttggatactcgtggcacgattttcaaactgctaaacggtgcgttttgtgtgaaaactttttatataaagatagaggtaatcttatcatcattaagaagatatatacatggttgtaccatatttttttctactgtaaaactttgcatctccagatagtaaggtttctcgaggtattaaaatttttagggtgaaatttcggtacctacatataaataatgcaagcataatatcgggttcattaggagcaccagagtattgagattaactacgtgaaagagttggtagtcgaatggtgaaggcatactcgtgtgcaacttgcttgatctttggtgtatcaaattatttttcctatactttatgctaccatcttttaacttgttattggtgttttcagctaaatcaaattgttgagatgaattctattgtcaaaagaagactgtaattagacgaaatttatcttattaaatcaccatgcaccacccggcctgaagtgtatggcttaatccttctctggtatctttatttgtcccttcatttcggtcattttctcatcagtccctaattctatcagcatcattgtcccctttcagctccaacatttttagtagaccatgcaagattttttgcttttgacctctaaaattttctgaaacaacgttgttggttatgcccactgtactcatcgggacaattgattgatgtcaatttggtctggaactgagctttcactagctttatacatggagtaatgcaatgacctaattacctaactaagagttgccatattctactcgatgcactcgatccatctctagctaagtaaccaataattatgatgaactggcgactgatgtgaaaattcaactttcaggtaggaaattcagatcaagagaacacaagaattttctctgttcccctactaatgaactactgataaaattcctacaaaaatcatgtgaaaattttcgttcggaacggggctaagtttcagatagaaatcaaattggaatcaacatgagctctccgatgccatttcctttcttgaggttaagggaactatgaaatttaagaaagtattgacggccttgaggaaaattggactataaaataattctaatgccacaatgcaaattttttcctcttttcgtgttgaaattgatcttgctgtgaaatttctccagaaatcatgtgaatgtcctcctctcggaaagggagattaggattttgaagtttccaatggtgccatttcgtttccaccgaccaactggagacaggagtcaaaacaaatgaacatgaactgcaagaagtatcatcggccttgcggcaaaattggacggtcaattaattcttcaatttgccaatttttgcatcaaattttcatctaatttgactgtcttcaaaatgagctagaactaaatcaaatccgtatacttgtctccatccgtatctatgcacaaatccgaactcttttttggcgcggccgccaatgctatcttgacgccgccttcgccagcgcgaccagcctcaccggcgaccgccgccgccgccgcttctcggcctccgatatcgtctcgagccccggcgaccacggccgctgctgccgcgcgcccaccagctgcatgtagtgcttcctcagctccggcgtgctgcacagctggtcgtcggccgccgcctcgccgcccgccttgccgccgcccgcgacgcgggccacgcaggtgatcgccctctcgatgaactccgggaggaccctgatgagcgccatgccgtcgtcgcccgtcacgtactcgaacggcgacgacgcgccgccggcgagggacaccttcgcggccggggacggcgacagcgacgcgagcgacgcggcggtgagcgcctgctggcacgagaaccgcgcggcggggagcacgaagtacgtccgccccgccgccagctcctcgccggccggcagcgccgggatcgggaggccgatgaagaacgagtcgccggcgcagacgaggtggccggggagctccgccatgacgtcgccggccgtcgtcgccgcggacgccaccagctggctcgccgccccgccccagaacaccagcctcgccgccgccgcctccgccgccgcctcctcgccgtgcacgggcggggagcacaggcacggagacatgccgttgcccatggatgcactaaccacgatctagaatattctagaagcttctggactagaagcgaggtcgcggaagaggcgctctctcttcgatttcttttccacaagatttgaggatttgttggtgcgaagatgtatatatagggggagcgttgaataaaaaaatggaatcgtgggggttgacatttaaaaagtcaaaaattggggtttgaattttttttttggttagttttacgtggggttgaccagatgggtgttcaaaaatctaaccaggtgtgtcattaattaattagtggtgagtcttgtcatgtcaacgaccgattggagcttggaatggaagcttctagcgttaatcgtgcttagtgagtggttcttctcgtggaaagtagcttaattaggtgggggtgctgataattgggtcaaatccccgggtccatcattagcaagcagggttatatatactcttgggctgcgcttgattgtgctataattgtaacctaaagctaatttaaattttttaaattttgtttttttattaattttaggtgctcttttactttccttgaatagcacaattacatgatttctagggaaaaaaatgctgaaaaatatagatatgttgttaaaaatcaatgtttaaagtttaaaattgcttttgatccaaagcacaatcagcgctcagcttttttttatatgtcaaagtcaataagctatatggagtagtagtatatgccacacataaatgggaagagctccttttgtaattgcgatgtccggcagaaataaaattagcttaaattaaaagttatttactctatattgggcttaaaagacgatggtacctgcagatcaaatatagagatgtgttacctagccactattttgttgcttttcaatgtgtgagtaaagtgctccctccgctttaaatttgtatgaaaacgctattaacttttggtatgaaatttgtccattcattttataaaactatgtattatgagaaaatctactccccggtatcccgtggtgtcgggatagctcttcaaccttattcatccgaccacccgcatcctcatccacccgacgcaatccccatctcactctcatctcactcccctcctctctctctctctcaagaaggccgagtggagacgaagccggccgggaggaaggggtcgtcgtcgtcgtctccggcggccgaggaggacgacgacagcactgcgtcggcgaggtcggccaaccctcagcggggtcgccctcaagctcgcctccccttgttgcgccgctctggctcgccgccctcgtcggtcgggtctgcgccggggactcgtcaccccggggagggcagaagtgggagctcccctcgtcctcgccctcggcctcggcgtcaccgtcgtccccgctgcagcctgccgctttgcgcctccgggatggacgccagcagcctgcgtcaacttacaacaggtatggctgtcaacctcctcctcggcttctcctcgagacttctcacgctctctggctcgggcctcgaccctcaactcgccgttcctcctcgatgccatccttcgccgttgcggccctccctcccccacatctcctcctctttttgacggtaccctctgataccccacaagtatcaggctgatacctaggtaccacccaataccttggcaccgggtatcagatatcagtcgatacctagtcggtaccaaaggtatcaggtaccaaccggtacctaaggtaccaggtatcaggtatcaggtatcggtcgatacctagtcggtaccaaaggtaccaggtaccaggtaggtaaggtaccagatatcaggtaccagggagcacacgtggacataccaggtatcaggtaccagggagcacatgtggatatactaggtatcaggtaccagggagcacatgtggacagaggaaaggaaaagagagagtcacttaaaatatcccgttgcaacggtatcccgttgtgtagctgccctcatgttttatatagtgattgttgtggctacattgcagctatagccgcaacgccacaataatagcagcaatacaagcaatgttgcaacggctggaaccatcgcaattgctttcgaatagggcattaaaaaaatagtgcaaatataaaaaatatacttaaagtgtatttaataataaaacaagtcataaaaaataaatattacttatattttttataatacaaatggttaaacattatgttcaaagtgatttatcatatttaaaaacggatgcatattttatacgaattacactaatatcaatagtgagaaagtcttcccaaaaagccagaaacagagtacttcctgcagatataatctaatacttaaaattagactccacacatttaaataaagtttatgcatgacaaactgaaccatctaattaatacagcaaattgaaagagagaaaacaatactcgtagttgtttttcaaaacagagaaatgacttttctttcagttctagactactacgtacgactgcgttgcattacaattagctggtgccttgtgtagacaacggttcagtagaggaaattttccatccattgttttgatatctgtcagctaggtcattagtcaatcgtcaatcagcttccttcttcaagcggtgtatcaaccaatacaagctagctatcagctggccgacatgcttgagaaaaaatggaattgcatatcgcatgaatgatgaatggtcctgcgtcaccatcagctgcatcaaaatgagcagagatttcctcatttcgtgcatgtgtacgttttcttgtgccatagaaacaacgataatacctttttgtttgaacaataatactttctgcataagctaaacccgtgtcggtgttgactgtcgcattcaagaaaggtaggcatttttttaaggatctaaggtaaccaatttaccaaagaaattaaaccacttggcccaaccatggtgtggattattattttaactgatgcaacatctttgttcttgtttcctaagttgatttatctatactactttaaatgttgatggtagttctgccagccatccaacatcactgtcgggttctcatcctttatcgtaatgccattaccattatagatacttacgtgtggggcaacagggtgggatccatatgcagtgactgtaatagtcaactatcactgtcatatgagcccaaggccccaaacaatggggttggtgggatgtatctcaaactaacaactggaaaatatgatggcatcttcgattagacaatgaaaaataattttatgtaatgtatgtcagcctaatttctaacattcaactaatgcaagtattatcttatagttagataatagaaaatggtttaagattgaaattttgttgcaacgcacaaacatttagctagtactagtagaatcacacagaatcacaggtcacactaaccaaactttgaagaatgtcataagtaatggaattactaatgtttatcaattgaaatgaagtctttatgggcggagatagtacttatggtcatttattttaacgggctataaacaagactttaaagcctaaaaaaatattatcattataaaatcttcacatcatattatttctcatcaattttgcttcacttaaaaaaattcttattttatggcttgaggttgggggatccatatggccgtggtggtggatggtgacaattcccccctcaccacaactattgggaccttttaaatgagtatagatatggcagttataggaatattaggatacgattgatgatttgtttagaatcattcatcatatctaatctttttctcttatctctattgttatacgtcatctcttgaggctcaatacaattactcaagttacgcaatatatgtctcttgtataacagtgaacactaaaaaaatgggtacttgtgcctctgtggagagcctatttttccgtgttccaaccaaatttaatttgttccatttgattaacttcatgattcgtactccaacattcttcagggctgcaggaat

SEQ ID NO: 47259 - DNA, 717 bp, Oryza sativa
attcctgcagcccgggttcgcgtactcagctgcgaggacttccgcttgagctttccttttcccgtttttgcgatttttcttcttgcttgactcagatgcgtctacggctggtttcttctctcccccggtcttcggcttgttgttcttgcgtcttagcgcgtcatccacgtgggcgcaccgctcaacgatctcgaataatcttcgagtagttgtgatgcgtcttgttgccaactcctggtagtgtagcgatctctgacaccggacttgaaggcacgaattacaaaagcgtcggtaatctcaggaatagtgtttctgcactcattaaagcgccgaacgtattccctcaatgattcccccgagttctgtgttaacgtgtgtaagtcgtcttcgatcgcgtggcgcttgtatgttccttggaaattggcgacgaactgttgccacaggtctatccacgaggagattgagtagggaggaagatgcatcagccatgaacgtgcagaacccttcaacgcagttggtaaatagttcgccaacgcgttgtcatctgctccggcagcataaagcactgtcgagtagacttgaaggaattcttccgggtcggtgctcccatcatacttttcaatggccccgggtcgcaatctctcaggccatcggacatcacgtagggaacgaccgaaagccctacacccagcactgggggcggtgggttgccggcgg

SEQ ID NO: 47260 - DNA, 1917 bp, Oryza sativa
agtaattttattacaacaataaatctaatagtacttatattaccaaaagtaaaagtttagtaactttgtttagagtgtaagcactgtgaggtcaataaattacttttgcatgagatactcacaaattgaacatgtgatagtttagtaagttggttaaaattgtttcctttaataaattttaataatgaaacaccatattatctggctactactgtaatgcaaaattaaacaataccaataaaaattctagagtccacaagagtttggacaaagaaccaaaggataacattataagattctagagtccacaagagtttggtcatcatcttcacacatggcatatcctgcagagcaacaactccaacagcaagctttgatagaagatgcagcagtttagtgcatacctcatgcttgccagttagcttacaagctaatcaagaacaaagagagaaccttcattagaccttcggaacataaatgaggaaacaggctagtgtagcagcatcctgcaatagcaagcaaaatacttacggttccggtgtttcagttactatttccaattaaacttctttgaaagttgaaacagtacagtactaaggtaaagcaaaacttacttcagatgtcaaagttatcagctaaaatagaacggtgatggccaagttgtcatactatatactaaccaattcacaactcttcttttagaaagtgtccttagatgaaacctactcgtacttataaactacatgggccaataagcacttgaacagtatcaaactccaaacatccatgctccagaaattaaattcctgtggcatacaaaggagtttgcaagacaatgcaaatagcaacatactcacaggatgtaattgcacaaaattatacatagattaattccaacaagctcagggcaaccaattaaccaaacataacataggactacagactatagtttcccaaaagcatgcccaggcaattccacacatgctccagagaataaaactccaacgagtgacagaggaatttacaacagttgaacagaatgcaagtagcaaccatgtaaatagttccacaaaaattagatctagttatcactcgttgaccagcagacacagggcggtcaaacatcacatacccaggaatcacattcacatggtttaaaatcagagctactgttccagatcactgacatctgactaccaagctaacgatctaacatccattttccaatcatcgatagcactaaaactaacacaaacagatcaaactacaactattagcaatagcaatagatagatgcaggggtgaagcctaagcggaggtgaatttagtgacggccttggtgccctcagagacggcgtgcttggcgagctcgccggggaggacgaggcggacggaggtctggatctcccgggaggtgatggtgggcttcttgttgtagcgggcgagcttggcggactccccggcgagcttctcgaagatgtcattgatgaaggagttcatgatggacatggccttggaggagatgccgatatcggggtggacctgcttgagcaccttgaagatgtagatcttgtaggtctcgacgctcttcttcgccttcttccgccccgccttcctcccctcgccgctgcccttctcggccttgccggcggggagacgcttctccgccttgggcttcttccccgcgggggccttctcggccttctccgccgcgggctcctcctccgcgggcttcttcgcggccggcttcttctctgccttgggcgccatggatgccgctgctgtcttcttcccggggagaggagaggagaggaaagggaagcggtgggattcgcgagattgcggcgtggggaaaggagacgggggaagatggttttgtacaggaggggacgtgcgccctgattggtggaaggcacg

SEQ ID NO: 47261 - DNA, 6081 bp, Oryza sativa
gggtgcggtggggggcatttcatcgaacaccattcgcgcatcgctctccccgagcgaaccgcattcgttacgttacgttacgtgcgagatgaatcaacttgtcaggtacaaacacaaccggagaatttgcttttgtttatactggagttatacgatgtgatcctgatccaggctcagttcgacctagcccctgcttatctttgcttgtgggtcgttgtcgccgtctttggttacgctaggagaagcatctctctttcttgcgtaggtaatcaactatcttaatttttcttttgtgtcttgattatgtgcaacaccgagtgatgcgaatgggatgtgttcctttcgatgttttttctatataagctctgaaacttggacttttgcaacaaatggttcgggtgcagatgagctgtttgacgaaatgcccaggagattcctgcgtgcgttgcatgcccagcggcggtttgactctatttttcctttagtatggtgtctgctctctggtgatctaatgtaccattttctcttaaccttgttttacccaatcttaatgcaaagatgcataaagagaactctgcatattcctgttttctcttaaccttgtttcagagaaccttgttttctctgaactctgcaaaagattttctgcatattcctgaaaaaaggagaactctgctccggtgcttttaactagacttataaaggctttggcataggattcctgtattggttgatgcaaaatctgctggtaacagtcagctaaattcgcttaaaaagtacacttctttgggtcttcttgctagtgcaggtagagaagcaccatggccttcctggtttcttaggtggtaaacaggcaaagaaagtaaagcaccaagtggcgccattgctgcaatgaaatcaaattattattagcaagtggatgaaaggaaaagaatacacagcctggaagagctttcaacttgaatccccttgcaattgtgtaacactacttgtccttttcacattgcatcatcgttgaaacatttggattttaatacaaaaatcattgtgggtagattttgcctcaaaaagtgctttcatactgttttaattttgtcaggtttttcagacgttttgcaatagagaatgtcaatgtccattgtgacaaaggcagttggtggcaagaaagggaggagaatctataacagctctcttctgcaatctgcattgccctctctgttctcatcaggttttagccacactgcttcaatatctctttccatcttccgtatttaagtgatcggcactcagcagctctgtgagatatctcttctgggatctgcagtttcaagcatctcccataggagagatccagtgggaatccgtaggttctagcactatgggcacagttttggatgctctcgcttggaaattcttggaaaagctgggtcagcttattgaggatgaggttatcatgacattaagtgtgaaaaggggtattgagagcctgaagaaaaatctggaattcttcaacgctgttcgtgaggatgctgaggctctggccatggaggatccagggatagattcatggtggaagaacatgagaaatgttatgtttgatgtcgatgacatcgtggatcttttcatggttcattcacagaagtttttgctgccaccaaggccggtatgttgcaatcagcccttgttctctagctttgcaaagttttcatttgatcacaggattgccaaaagaatcgataatataaatgaaaagtttgaagaaattaaaatgaacaaagagatgtttggcttcgagagaaccaaccggcaacaagtccagataacaattgttgacagaagtcagacatctcctgtagatgaacttgaggttgttggagaagatatcagaagggctgttgatgacatggtcaaaatgattgttagtaactacaatgacaacaggtcaactgtttttgggatccaggggatgggaggcatcggtaagacaacattagctcaaaagatatacaatgaacagaggataagggagaaattccaagttcatatatggttgtgtatttctcagaattacacagagaccagtttgttaaaacaggcaataagaatggctggaggaatttgtgatcagctggagactaagactgagcttctaccgcttctagtggacactattagagggaagagtgtttttcttgtgctggatgatgtttggaaatctgatgtatggattgatcttcttcgatcgccttccgagagaggcttgaattctcgtatccttgtgacctcaagaaacctggatgttttggtcgaaatgcatgcaacttatacccacagggtaaacaaaatgaatgattacgatggcctagaactgctgatgaagatgtcattagggccatacgagcaaagaagagaattcagtggtgttgggtatcaaattgtcaaaaagtgtgatggccttcctcttgccatcaaagttgttgcaggtgtcctatctagtaagaaaacaaaggcagaatgggagagcatccgagatagcaaatggtctattcatggacttcccaaagaactaggaggtcctctgtacttaagctacagcaacttacctcctgaacttaagcaattctttctctggtgtgctttgttaccatcaaattttgggatccatcgtgatgctgtcgcttactggtgggtcgctgaaggctttgtgacgaaaatgcatgggtactcaatacatgaagccgcagaagaatactaccatgagctaattagaatgaatcttctgcagccaaaaccagagtttgttgacaaatggatgtcaacgatgcatgatcttttgaggtcacttggacaatttttgacaaaggatcattccttattcatgaatatggaaaatagcaaaaccttactgaatctacgtcacttagtaataagcaatgatgtaaaagaaatacctgctatagaagagctgaagtgcttgaggagcctcctaatttttaataacaagaactttaagacaattaataaggacattttcagagagctcaagcatattcgtgtcttagttctcagtggaacaagcatccaagtcataccagagtcggtgggaaacttgttgctactgaggttgctagatctaagctatacaaaaatcaaaaaactccctgaatccataggaaatcttaccagccttgaatacctttctttgcactgttgcagacatttggatagcctgccagctagtttgatgagactgtccaacataagtttccttgagctagaacaaactggaatcgaccatgttccaaaagggatcgcgaagtttcagaaactctacaaccttaaaggagttttcgagagtgcatctggattcaggctagatgaactgcaatgtctccccaacatccaacgtctccggattgtaaagctagaaaaagcaacgccagggggtgcatttgtactcaggaacagtcttcgtcttcgagaactgtggtttcgctgcacaatgggagctaatactcatgatattacccactaccagatgaacgagattgagagaattcaacaagtctatgagatgctaagtccatcatcaagcctaatttatttattttttgaggggtttcctggtgtaaggttcccagattggttgtgctcagaaccagagtataagatgccaaatttgggacatatgtacctcaacgagtgcatttcatgctctgagcttccaccagcaggtcagatgccagaactactaattcttcagatcagatgtgcagatgcagtagtgaatattggttcagagctcctaggaaaaggcgtcagcagtgccacgcatataactattttcccaaagctcaaattgcttcacatcattgatatgagcaatttggaaagttggtctcttaacacagggaatttgcgtggtagatctgaacagctcgttctgatgccttgccttaagcgtctgtttcttaatggctgcccaaaactaagggctctccctgaagacttgcataggattgctaacttaagaagaatccacattgaaggtgctcacacgctgcatgaaattgacaaccttccttcagtgttatggctcaaggtcaagaataacaggtgtttgaggagaatttccaatctctgtattctgcaggacttgtttgcacaggactgtccagcgctggatcaggcagagaatctaatctcactaaagagactccacatggttgattgccagaatgcaaagcaattcagaatgtgcctcctagaagaccaacaacttgcagtcgatgttgttacagttggtgcagatggcagggatatctttccagatgaaactctctataattaggcaggtgagaaaaactacatttgttagtctcaatggtttcctttccgggatctgtttgtactatggtttgttatccgtggtacatgttttgaaactctggctatagtgatgatttttcactactcccaatcaaaatatccttcatattgttgctcttcttgcagtggtagagtcaagagtggcgcgcgccaaggaaacggtggtactagtgtacctgaaatgttacaggaaacaattgaatttctgtggtaacaagtggtactcaaagtgcagtccagtggtaaatgcagcttggtgcagacctaacagcaggaagcaacaccgtttaccgaaattatagcttgaattcatcagcttgatctaaatgcaaaaattgagaacttggtcagcactgccgaaaactagatatcccttcaagtgaagttgccttactcaaggttaagactaacatcaatttgccactgctggagctgagaacggtgggtgcaagtgctgcctcaattgcagccatagtgtgatgctatctccaagattgtttcaggctgagcagtctctgagaacttgtgcagatttcaaatccaacgagtctctgaacatgcccttgtccagtaggctcctccgtgtaaatatcttgagctgtggatgcccaaactataagcagctagcatgaccaatagacattcccagtactcaatacaaatattttgcacatatattcgattagtcttgaaagtgatccgatgcaatatgtgaaattagttttgaaagtgagctgtccccatgcaatataaggcttcattgatttaaataccgattaacatcgtttgataaaaagggaagaaaccagttcacaacccccaaatccacgatgggccaaggcgcacaactcccacgtcacggcaggtcccccgatgcgcgccacgtgtacggcggatggcctccctccctctgtataagtagcaaccctctcggcctctcggccccccttcctgtgtgtggttcaggtgcccaaggtgatattcagattttctgagtgctcgtgtgttgtgcgatcagtgcccactgcccagttcgatcgatccgtgttgatctttgaaagaaagatgtcgtgctgcggaggaaactgcggctgcggatccggctgccagtgcggcagcggctgcggagggtaagatccgatcaccatcttctgaatttctgttcttgatctgccatgtatatcaactgtctagtcttggtgttggttagatgaaaattcgttggatctcggaagggatattgttcgtttgctagggttttttgtgtgctgtgatctgtagaggatttctgtttgtccatgttgttgatcttggtatgtattcatgacatgcatgttgtatgtgtcatatgtgtgcctctccttggatttgttttggataatagaacatgttatggactcaatagtctgtgaacaaatctttttttagatggtggccaaatctgatgatgatctttcttgagaggaaaaagttcatgatagaaaaatctttttttagatgatggccatgcatgacatggtctttgttgagagaaaaaaaagattcatgataggagattttgatttagctcccttccaccgttataaaacgaggagcatgcatgcagatgactgatgaggatctgatttcattttttatcccatcttcttataacagacaagaaataggctctgaatttctgattgattattt

SEQ ID NO: 47262 - DNA, 9832 bp, Oryza sativa
  unsure (1)..(9832): unsure at all n locations
aaaaatccctgctaccctccaaattgcgatttcctcgttgatgtcattcgctagccggtcaaccaacttggcgatgtgttgaaagatccttgtatttcgctctttccagataagccaacaaattagcatgaacagactatcgaaatccgtcctgtatgtgttctgaaaacgccgtcttgtcgcgatccaccaatctgcaagcggcctgacatcttccgcagtgattgcaatgttaatgttgcaccaacgtctcagcttgcgccaaagccgccgtataatcacaggacacaagcaaatgatggcagtcttcgttctcgcgttggcatagggagcaaatggcgtcatgcggccagtttctcttcgccaggttgtccgccgtgagacagcggcccttcagtgcaatccacatgaagaagcgaacacgcgacgacaccctggagtgccacagcgtgtccccgtaggaacagtcctctgtcgctatgaaaaatagatcatacgccgaggccactgagaaattaccatcagcagtcaacttccatttgatcgtgtcagccatctgctgcagtgacacgtcgcgaacttcatcccaaagttggaagaattcacccagagcttcattggacagggcaccttgtaatcggcgaatccatctgttagcaatcagggcatcagctactgtcagcttggcacggctcacatgggaaaacaacaccggccacctccaggcgaagcaacctttccctgtccaattgtctgtccaaaactgtgtgtccaccccatcaccaatgatgtgctcagcgacggatcgaaagatctcttccacatcgcttccaggacggaaagctgctaaggtccagggtctatccttctgctccaaggatttcgcaagccatttcaaccggagagcttgaccgaacaaattaagatctttgacaccaagtccccctttctcgatgggtgatcaaacctttcgccacgagactaggcaatgcccgccgctgatctcttcctgtccttttccaaagaaacccgcggcacttccgctcgatgtccttaatcgcccatcgcggtagctgcaggactgtcatgtaatgcaccggcaacgccattaggaccgacttgatcaagcacagtcgcccatcaatagacagcattttcggcttccaaccggctaccttctttgccagcctatcaaggatcggctggatctcggccttcgtcggtttcctagtggagagagggagtccgagataagtgattgggaacttttccactcggcaggagagaatggattcaacttgcacatactgctgctcgtcacattggattggagtgattgcgcttttggagaaattggttttgagacctgtggcagccccgaacaactccaggatacccttgatgactcgagcttcttcagctgtagggcggaaaaacagaaccgcatcgtcggtataaactgaaattggtggcaaattctgtcgtacgttgaggggcgagagcagtcttgccatccttgcctgggaaactgattgattatttgtacatgcagatgcaagatgtacccggggatggctgaggaggtgaccaccacccagactgtcatcatgggtgttgcaccttccaaggggtatgtgcactaatcctttccttcttcatatcctgtacttgttgttcatgggcaaaatccatgtgttatattactgaatttgttgaatagtataaggagagggaaatattgtgattattgacaccgttgtattgagtctcagggatcactatatatagaagtacatggtgtagagataagaaagaattacggatatggaagaagtccacgtaaatcaatcttatcctactctaactaccatatatatactttaatagaacagaattgagtacctccatctttctagctaccaacctcttttgtcaattatcatatgtttcctgccttttttccccttctgaatcacagagaacaaaagtacaaaacattttgttgagaggctcactgccttccattttacgtgtacgtatgacaaaattgcagcgctagctacagccaatgaaaaacgactaaaaacttcatgcacgttatgacaaaaactctctcctttatctgaagaaaacgattatgccttttactctgaaaactgcgtagcaacaatccaagatcgtttcatgtttcgctgagttctactcccttcgtttctaaatgtttgacaccattaattttttaacacatgttagattatttgtcttatttaaaaaattttgtggaatatgtaaaactatatgaatacattaaagtatatttaataataaatcaaatgataggaaaataattaataatttcttaatttttttaataagacgaatggtcaaatatatttagaaaagttaacggcgtcaaatatttagaaacggagggagtaattaattactgatctatggttggttaattctctgatggatgcagtcatgccgaagggttggaggccggcgccgccgccggagcaggagcagagaacgggtgcaagtgcggcgacaactgcacctgcaacccctgcaactgcggcaagttgaagcaagcaacctcctgatcaggaaaccaaggagatggaaggacctagtactgctaatctagtagtatgatccagttacgagtgatgagttgttgtcactgtaactttgtgtttcctctgtgagtttgtgatctaagacctgagactgaagaaatgcatcctagttaataagtgctaagaataaagatgttttgagacatctatggcgtctgtacgatgatagtccttcctctccagtcttgtggtgtgtacgtaattaagaatgcaatgctgtgtgtcatgtatgctttctatctagtgaaactgaactagtgagttggtatactaattttgcttttttgcttgaatgttgctttaatgtgacttgtgtcactggatgtttatcttgcttgcttggatgttgctggctacacgaacttcatctgaagttcatgctggtaaagaatctagctttgagcctgcttggactaatacactacaaaatgggctgagcccatggatttgtgtaccacatgtctacaactctacatcgtgtttaacctcagtgggctggataattccttcatgtttctcgaaggaagaagtacatcgaaggtccctcgtcttatacctgatatttgctatcctcatcttataggcggttttagttttggttttattcaacgtgacagctggctgcgggggagcatctgggcgcaggcggcggggggagaagctgcgcgcgggcgagcaggcccctctaccccaccgtcgccacgctgctcacgctctccgacgccgtctgccaccacggagacccgggaaatcgcgcagctccttcccgtccttgccaactccgacggatgaaggacgacggcgtcgagcctgatctcgtcacctaccgccaccatctgaccatcaccgcctcgttgctggcgtcctgtcccttgcggactccgtctccatcttcatcacctattgccaccatcttcttgttgccgccttccgcgccgctctaacgggaagagccccgcagccacggcggtggttggtcgcggcggctgcgcctgtcacccccgcccaaattattcaggggatcgccataattctcgtcaccagcaagggatgtgcgtcgccggggctatgcctataaacaactacagggaccagctctacagctatggcgattcaaagagttcgtgtaagcttttctgcagcaaagaatgccaaatgcaaatactactttgattgtgcatgcaggacacggatgtctgctgatctatgaacatacacatccacatgaacaaaacgagctcggccacgagtgcttcgccgacatcgccagaggattcatcctgctcatcggctttgcgtggccatgtccaccctggcgacggagaagctctaccgcatgctcggcatgtacgaggtgctcaccgacatcaagtcggacctcgaatccctcttcacaggatacgcgcgcaacttcttctccttcgaggtcaccagcatcgtggcccagctgggcaacaccatccgccatttatcgatgcagttttggataagaataagggaaggggaggggaggaggcagcgtcgggaggagggcttcgtcgggacgctgctccggtgctcccgtgtcaccgccgtcgtcgcgtcgccacgccatcagaggctgttgctagtgctcctcaccccgccgcccgagcctagctgctcccctgccggccgccgcccgtggccagctgctcccccgccgccgcccgtggagagggaaggagagaggtggagaggggagggaaagaagaggctgatgggtaggatccgtgtgggtcccatgctgagtcagatgtcgcgttgggtaaaaccagagtcaaaacccccgaggactcaaagtgattcggttttataagatgagggatggcaaatacggagtatctggttttgtggttggaggatgattttgtaatccgatgacaaaatgaggggcatttgatgtactttttccatcctcgaaatacaatccaaatcgacttgtttggcattcgaggaaggggattgggagtttacacgagggaattgatggtgagattaagaggggaatttgatttttaatcccaatatcttgtttggtagaggtaatggaaattgatagggagtttagttggagattaagtcattaatgaaaacggatggctgagatttgtttaggcaaagtaaaggaggaatccctcccaattaccacctcctacccaggtattgaaaaggagagagtttcttcgtcaattctctatctccattccactaaaatttttatgtctcccaaccaaacaaaatagttaatagcctatccctctgaacttctaattcctcctaaaaacttcctccaaccaaacaggccgaatgttcctcgaaatgcaatccatatgttcagagcttggaaaaagttcacttcttgtccctcaattatggatcgaatttcctttacatcacttagctgtaaatcaccactcttacggaactaaattttctgacctccacgtcgccctctctcgcgagcggcacggagggcgaaccctagccctcgccaccccctccctttctctcccacccctcgccgccgccggagcgcgccgccggagttccgtgcggccagccgtgagggcggtggcgaggcctttcctccggcgatgacgcgacggctctgcgcgaggacgacgacgcggcgtgcgatgggcgggcgacggcgacggcaacggcgcagagcgaagcttcgatccggcacccccgtggctggatccggagccctaccgctggagacgagcgtaactgccgttcacggcggtgtgacggggcgcggaggaggcggaacgtcggcgcttgtgctggcggccagcaaggtagaggccgaagtgggtgtgtacggtgctggccctcccgcggcctgtctgaaaaggggcggcggggagcgctggacccggtggcggctggcggcgcaggctgcagcggcagcaggcaggcacgacctcgtcggagccacacctcccccccaccccccactcgtcggtgcgcgcggcgcggatagcaacctcttctccttcccctccccctagtatcctcgtttgtgtgccctctcccccctagttccaaacatcgctggtgatcttgcccttcaacttcttctcaatctggcgtgcttgtttggaaattgtgctcctgtagccgcttggattacagtggttctatgccctcctccaaagttgtcgttgatgttcttcctctgtgagaatccccttggccatttccccttctattagcccctgctcgtcttcaccctcttcctccagatgtccaggaccgcaaggatcagtgtttctccctcctttgaggcttccttcccttgaagggcgttggagagagttgatctaacaagcaacttgataaagcctgattgaagaagacttaatgtgggtggcctcgagccgcaacctttagtggcccaccctcctttggggcttacttccccaaaagggcgttggcgagctctgatacaaacagcaacaagatcaagtcagcttcttgatggcttcatgcgggtggccttggacttcaacaacattcccttggcctctcttttcttccgacatgcttgtggctgtgtgaggaattggatgttgatttgttggggtttagcagtaggttttggattttggcaagatgattttgtaggtgtcattcatcaattgtaatcttttaggaggttttctttctctgttctctcctcgttgtattctccgtgtattctgttctcctatcctccagggcccttgcgcttgcgtaggtaaagcttgccattcaggtggggattctcaccccccccggtgatttagtcaaaaaaaaaacttagctgtaaaacagctattgaaaccagcggaaatacagtccttctcgagcacgtggcggtgacacctggtagggaaatttaactgtttgccacttttaggtttggcaattatccaaataccatttttaggtttgcagttatttttttcccttcttaagaggtggtctcttaactatttgttacttttgtccacgtggcatgccaacttgacaacctatattgaagaacggtgtgagacccactcgtcagtctctccttcccccttcatctctctctctccccccacgtccatggtcccccatcgacgccggtaccgccccgccgtcgaccaccgatggcacagcctcacagacaagtagaggtgggagtggaggacgacgagggagatgaaaaggaggagcgtcgtcaccacgggcggatgcactagaacgacccagggtgcgcggcgaagacgcgagacgacgtctgtaacatcgcgccagaggatttggggtgaccaccgctgtcgtggggaggaggtcggcgtcgtcaaggacgagcggcgtggagattgctagcatggggacagcacaacggtgtggcgccgtccttgatagggaggatttggggtagccgccgctgtcgatggggagaaggtcggcgtctttgaggacgagcggcgtggaggttgtcagcacggggatagcacagcggtgcggcgtcgtcctccttctcgtcatccccatcgtcgaaggcccaagcagcgtctggtagggttccaatggtgggaggcagcaaggggcctcacagcgtcggctgcgagcggtgccatcagtggtcggttgcagggcgacgttggcgtggtggggcagcggagcagtgttggcgtcgatggcggcacagcggggagtggaggtctgcgcctctgcagcttggaccgggcagatgaggcggcgcctcggcggcaacagtgttggcttccatgggggctgtggacgcgtgggggagagatgaagggggaaggagagactgacaagtgggtcccacaccgtttttcaatctaggttgccatgttggcataccacgtaggtaaaagtggcaaataattaagagaccatctcttaagaaggaaaaaaaaattanttcacacttaataagggtatttggataattgtnaaatttaaaagtggtaaatagttanattccccccccccccctccggtgtgacggcgaagtggctccctgttcagtcaaatctccttctagatgtgcacagcaagaatggtcggcagagtccagagtcccaacagccaacaccaaaagagtaggggtggaaatgagccgagcttggctcgtcttagcttgtagtgactcgcaacaagctaggcttggcttggctcgtttcctggctcgagccagcttgagctagcttgcaagccttcatgttgaaacacctcttcatatatattttataattattaaaaaacaagaacaaatcatcaacctataaaatttaaataagtttatatattcaattatttaaaatcttaatgataaattttaagttgacaaataataacttcttaaaaaataatcgatataaacacatgatggcctaggcttgtgagctagctcggactcgactcatttcagcaacgagctaaataagaggcttgggcttgacttgtttaacttacgagccgagccaagctcaccaagctcgagccaagctcacgagcccaagcttatttttccactcctacatacgagtccagagtccagagtcccaacaccagacgagctcgagctcgccggctctgggaggtcacagcgtgacaggaggtgctagcttcgtttttcttttttaaaaaagtgatattaatcaatttttcaaatttaaaatgattaattaatcatatattaatactcggctcgttttaagtcttaatccccttaacacaccttcttaatcatttagcattccagtcaatgtcaattttcctttcgtcgccacggacacactagtttgtccggcatgtatatgctcacggcatgtcggcatataagtgccacttttccagaaaactcaaatcatttcttaaatggatatcttcttatttttacatgtcacttaaaagtcatcaaggaattttcagagggatgctgatcacttggggaacctgttggcagactttgtgtttgacaagcttctgacagaggccctgcttacttcccaaaacaaaaattttctacctatcacattgaatattaggacatatgcatggagtattaaatataggaaaaaaaaccaattacatagattaagactaatttgagagacgaatcttttgagcctaattatttcatgatttgtcaatgtggcgctacagtaaacatttgctaatgacatattaattaggcttaatatattcgtctcacagttttctggcggaatctataatttgttttgttattagactatgtttaatacttcgaatgtgtgtccgtatatccgatgtgacaaccaaacctaaaagttttccccaactaaacaaggccagatttcactcttcaggttggaaattttgagtctaactagtttgtaaagtacacgagcggtccttaaacttgtagggatgtatcatttaggtccctaaactcttaaatgcttaaccagagtaaagtgcattggcggtccttaaacttatagggttgtgtcatataggtccataaactctcaaaatgcatatccaagtctcagaacttgtcaaagtatatcatctagtcccaaattgacacatcccctctaggatcttatgtggcgctgatgtggcaatgccacatggacatgacgtgctcttttctcttttttttcttcttttctttttcgttttcttctcattcttatttttttctttcttttgcacgggtcacagaaaggagaagaaagggaaaaaagagaagaaaaaaataatgtcgcgttatgtccgtgtggcatgccacatcaacgcctcgtaggatcataaaggggttgtggcgatttgggacctagatgacacactatgacaagttccggtacttggatttgtattttgagagtttcggggcctagatcctatgcactttactctctctcttttttattttgccccctaattttgttggtctagctgtttctacagtggaaggctatgttatcctcatgtatatattaacattctatttgttatctccttgaagagatcaaggtttggaggggtggttgttacttgttacttgttagggcttaggaattcaattcatgtgctgaaaggttttgaaatttatatactgggtgaggttgaagcagcaattgtttttaaacagtttttggagggctgca

SEQ ID NO: 47263 - DNA, 10214 bp, Oryza sativa
tggtgaaaatcaccctcaaaatcaccaagagagtcattttgcatattaaacttgtaactaggtgtaatcggtgtcatgcatgcagcaaaccgacagggacatattaaacttggacccctattcgggtctccgcggggagcggggacaaggaaaggaccatctccgcccccgcgaaaattgacgggggcatgtcttctcctatttatgtccccgtgaaaaaccaattgtaaccatccttgcttcctaataggtgaattcaccacgagaaaacggtgaacatctctaggcatgccccgccacacccagtgaacaacactcgacatgaggaagatgccgcgcgccaaacattggtgaacagaaagactaacggagaactgtgttttgtcggttttgggcctatttagttcgcgaaaagaaaatttttggatgtcacatcggatgtttgataggatatcggaaggagtttttggacatgaataaaaaactaatttcataactcgtctgtaaaccgcgagacgattgagcctaattaatccgttattagcacatgtgagttactgtagcatttatggctaattatacactaattaggctcaaaaaattcatctcacgatttctcccctaaccgtgcaattagtttttttaatctatattgcattattgcatgtgtttaaagatttgatacgatgtttttgatagaaaaaattggggaaaccaggcctttgtttaccggcgcagggagtcactattcactagcactgaaaatatgtcatcacctcagggagcaaaaaaaaaaagatttaagaaaaaggagatttttagagcacggttggcacaagagaattttattaagataatatggagttcaaacgtaataaagtcattaaacggttagcaagattaaaaaggttgatatagcttgacttaaaaacaatactgatttgaatttcattactaataattaaagataagaaaattacatgcatattcacttgcagtatgtaagtagagaaattacaatttaaaattacaaagaactaccctgatcacttttcttagtaataaatttttagagcacattactctcatggaacatatgcaaatttcaaaatctgtctgttacggtaaaagaagcaactggatctgaatggaccatgaacttaggcacttagcccatgatagcacggaagttaacacacatccatcagtacaaaatctgattgttttctcttaaaaaaatgtcaacacaaatctagcaaatcccccaaagaaaaatgctacgagaagtggacacaggctgaccgtactttagcggtctagctaaatttccaccatttgcctgttgccttattaatccgcatccatagtttgatttttgaaatatactacctccgttttttaatagatgacaccgttgactttttcttatttgtttgaccattcgtcttatttaaaaaatttatgtaaatggataagatataaatcacacttaaagtactatgagtgataaaacaactcataacaaagtaaattataattacgtaaattttttgaataagacgaatggtcaaacatgtgagaaaaagtcaacggcatcatctattaaaaaacagaggtagtatatagttaattttaaggttttctgattgtagtttattttctaaaaccatcgctaagaacaaatataaagtttaaccaaatttattttgttgttctgttagtttttccacggcttatgagatgtaaagaaaacgatgaggtctaggttctacacggtgcgaattcaacctcggggtgactgaacaaaatgtatattttgtcaaatagtcagctacaaaaaaaaaaggaacaaatccaccttgcacctcatatcattgggatacaacttttccgcagcaaaacgcagagcttttatctagtttcatcgcaattcgtccatttcaaacagaacccgtggcttcaccaacgaatataagcatatttataaggatccataacgattccattgctagccacaaattaccataaacaagacaacagacaccggagaagttgtctagttcaagcagatgcataaccaaaaccaagtcaaatttcgcatgaaacaccaaatctaaaattatagctgctaaattactgctgctttcaccaaacttacattcatcatagtggacagtttcagtccaaatacagcctagtcttgccactgttcgttcaaaccttcacatggtcattctgcttccctgcatcaggcaaaataaggattcagacataactcagaacacaagttattcccagcaaacaataaaataaaataagtaccatcataggtctcatgacaatgaattaaaataaatggtcaaatggttaagaaattccaatcgtcacaagagatcgggtgaaattgctttatgaaccaccgaatttacatactgcagttcggtaacatcgtaccatgaaaagaacatataaggatttcttgttccagaccgtgaagctacctgagtccagtgcatacttttgtaaaatataagtattgtgttgcgccgtttaaccaagcacagacttgttgacagtttaactcaacagaataatcaccggatatcaatctaagctaaccatgaggcagaccggtaacatcataccatgaaaagagcatatgaggatttccaattccagaccatgaagctaccctagtccggtgcatactttttttgtgttgcgcaattttaccaagcacgtacttattgacggtttaactcaatagcataatcactggatatcaatctatgctaaccatggggcggacgtcccatatgaacaggtagatatttgggttacattagcaatggaaacaaccttaatcacagcttttgatgatttgatcaagcgtgccaaataaaagagccacagccagatctgaatctaatctagagcataaatgcaggatcgcagttgtatacaacaattgttggcttgttaaacatagttccagattaaaactgtattcgctagttgcctacctaaaataaaaaaaactcaaatgtttaagcaaatataatagataacctaagaggatgattactactccgtagttaactagtacttacttttgtgggcatgtgtactttaatggtgtataccagattaataagggttgggtgagcacaggggatggagcacagtccctaaggaacaatacatcgaagcagatatctacactatcttaacgacagagtcaagtggtacaaaacaattcagtgaaggctagaaagcaacttaatgatcagttataacctttacagagtaaccccccccccccccaacacacacgcacacaaaaaaagagaaggaaatccatgcagaccataaatgaccttcatccaggttgcctaatactaaactgattagtcagctaatcaaattctcaaatgcagcttcctgacaatttgtcatgtcataacttgggtggaaaactatactgcattagtcagcaaatcgaaatctcaaatgaggcttcctaacgatttctcatgtcacaacttgggtggaaaaaaggaagactgcattagtaagcaaatcgaaatctcaaatgcagcttcctaaagattttctcatgtcatgggacctgattgagcagcaacgtaagggtgtaaagaatggaaagtgtttgaagcttacatagttaaagcagcaacaaccggcgaaggatgagccaaatgacgagtccgatcaataagtttgtaaatctgtctgtgctgtttggttatgacagtataattattgtcctcagtgtcatcccctccaacctgagagtaggtgcgatgaacgatacgcgctttatgcagcttggcgtctggaccaggagtagcagcagatcgaacgtcgatggaagagaagatgcccttccccaaggagcagaaaagctgccctggaacaatgcccttggacaccacggggatgttgaggatggacaactccgtcttgtgtgaccctgaacttgttggctgtaaggggaagaccctgatgtcgtacactgcagcagcaccgccattggctatggagcgggcaatgaagaggtggccaccaaggggaacagccttgccgatgaaaggcaagttgttggcgtccaccatatcccactggttggtgtccatgtcgaaagcgcaggtgcccttgtcttgctgcacggagagcagtatgtgggagccgaccacggcgtaggaggcgacgcggacctccggcgggtcacggtactcgagcgggttgaggcggacagggaagatgggcggcggcggcaagtggtgccatcccatggttctcgcgtcgtgaggggcgaccaagacgtagttgaggtcgaggtacacgaaccagggcaggaagtcgaggccgggcacgacggaaggggttcgggagagcgcatacagcttgctgccccgcgggatgaggacgggccggagcttaggctcgacgaggaaggggccggggatctccatcgaggtcttggggtcgtacaccgtggtgaacaacttgccgccgacgcctacgatccggggcccgtagcgcgactccacggtggcgaaggacatcccgcggacgttgtgaagcacaaggtgggcttcgccgccgccgccgccgccgccgagctcgacgatggagtgcgcgggcacctcctggtcatcgtcgtgctccaccgcaaggtacaccggcttcccggcggcctcgcgaggagaagcacgacccaggcgattaagcctcagtcccaccggcgccaccgcgccgtccttccccttactcctcctcttcttctggctaggcgtcgacattgtttggtctgggacttgggatggggaacggcagcggcggcgagtgcgagtagacagagaaagaggaaggaaaccctacataggccgggtcctcctcctcattggcccgagtgaaacggcccatgctccgccatggcttttgaatcggaagtaagtccactttgactccctcaaatatagctgcaccgcatatccaacagcctctccaagtgactttccaagccaaattttagccattattataaaaaaaaaagggggttaattggatccatgctattgcaacttttctaaattaaaaaaataccactactattcgtcatatcagctacatatgccactcgaaatgtctaaaattagaattatgtcactctagtcactttttccgtcctgctctctcacgccgtctttgttcccgtccttatccccctccctccttcccgtcctcccgctcccaggtcaccactgctggggacaacaccaccaccgtcgtcgtagcctacgcaagggtcggcggcggcggtgcaagaagacgaggctggcttgtggttcctgttcgctctcaccgactcactggagaaggacatcatctcggacctcttctacgaggcgctcatcgcagcggtggtggcggctgcggctgctggcccaggcgccgacagcgacggcgacgggcataaacctacatccacgaccaaacctatggagtaatccacacttgaacacctcgagacccctacaccttctccaccacccggaagcttcctcgccctcgccacgcacggtcgctgactgagacggcggcggtggcggtgtcgccgcatacggagacggcgtgcctccccatgaagccgcccttgtcagtcgtcggcctcatgtaggaactggtcgccgccttcctcgtcgtccccttccgtctacggtgcccatcacccgctcgtccgccaccaccaccgttgcggcacccactctccctcacgagcaccctctccaactcccgcgtgatccactccacctcatatatgtccaacagcatcatccccttccccggcgaccgcgccggtagtggcggctgcggcggcgaaggaaagccttgcaaggacgacgcggcaatggtggaggaggagcatggcgggccaggcgcagcgtccgaggcgccacacgacctgatgccgccggccaagtcgacgcacgcgtcttgctcaaggcagcaaatgatgagcctggcggatggcgacgacaatgccggggacctgtcggtgctcgtccgggcgaggacgtccagtggcgcggcgcagcagaaggcggaggctggcggcgccacgtcgtcatcgatgctaagtgcgatcgggtcgagcatatgtggatttgttcggattcgcccttgtcgtcgtcgatctgactcactcggacctccttgcctagttcgtcgtcgacgtttccctcgccgggaggtccaccgcggtggtcgggatgaggacgggaacggagacggcgtgagagaggaggacggagaaagtgactggagtggcatggttacaattttagaattttccagtggcatgtagctgatataacaaatagtagtggcattttttcaatttggcaaagttgcagaggcatggatccaattaacccaaaaaaaagcatcttccaacagcgtctccaaatggccaaaaccttccctccactagccaaacatggccagccaaagtcactagtcaaaggtgcgccccacattcattcctcctcccatctacacattcttttcttcgctggtgctcgttgctgttagtcggctagcgttgacgacggcatggagcagagaggcgccggagctgcctccctccgcccgcataccccctgttgtcgtcccaatcttccctggagacaggatgcctccgccgcccctgccgccgacgatggcatggagcaaagatgcaccggagctaccttcctgtgacatcctggcccaatttggattaggtttgttatgcccatgtgagttgtgtgcgcatatttagtaccaccttactagcttagtatgagtggaaccaacttataaagcctattcccttcaactatatcactctcgggttaacccttttacacgaagcgaggacgaaagtgtaagtggggtggtatgtgtaagtgggcctgcccgtcggatgggctggctacgcggttctggagggacgactgttacaaatggtaccagagatgacccttgcggttgcacgtaccggtcagtgtgcaggcatatggcgcatagcgatgtgggatctgtgtgatgcattgcctgtgtggaaccaacttataaggcatatttggatgtgtgcgcatgtttactaccaccttgctagtttagcatgagtgaaaccaacttataaggcatattccctccaaccatgaggcatattccctccaaccatgagtggaactaacttataaggcatatttctccaaccatgagtggaaccaactaaggcatatttagatgtgtgcgcatgtttactaccaccttgatagtttagcatgagtggaaccaacttataaggcatgttccctccaaccatgagtggaaccaacttataaggcatattccctgcctccctccaaccatgagtgggaccaacttataaggcatattccctccaaccgtgcctccaacccgttacaaatggtaccagagacgacccttgcggttgcgcgtacgggtcagtgtgcaggcatatggcgcatagcgatgtaggatctgtgttgatgcattacctgtgtggaaccaacttataaggcatattccctcggttgcgtgtacgggtcagtgtgcaggcatatggcgcatagcaatgtaggatctatgttgatgcattgcctatgtggaaccaacttataaggcatattccctctaatcatatcaacttataaggcatattccagccatatcatattccctccaatcatatcaacttatatggccgttacaaatggtaccagagacgacccttgcgattgcgggtcagtgtacaggcatatgacgcatagcgatgtaggatctgtgttgatgcattgcctgtgtggaaccaacttataaggcatattccctccaatcatatcaacttataaggcatattccaaccatatcatattccctccaatcatatcaacttatatggcgcatagcgatgtaggatctgtgttgatgcattgcctgtgtggaaccaaccatatcaacttagctgtgtgcatttgccatgtgagctgtgtgcgcatgtttactatgtttagctgtgcgcatgtttactatgtttagttgtgtgcgcatgtttatgttaacagtgaaatttggtaagccccaaagtcaccatcagcttggagtcaatgtcggcttcaaagttctagaatcagccgatgagagtcaagtcgccacgatgtcgtgttctcgatggagtcggatcaaagagttcgagttcaagaaggatgcggcatggcagtttatctattaattaggaatagtttgttagtttccttttgtctttaggaaagtgtgtttagtgtccgataaggactttatgttttccttttatctttaggatagtttctttcttgtccagcaaggacttgtattaacccatgggtataaatatgtgcacccggggtctatgtaatctatcaatctatcgatcaataacactctcggtgcatcgccaccctcttccctgaggtttttacttctcttctggcggaatttgggcacctgacgcggggctgcattggcttttgatctccagcgaaggggtaagtcctacattccgtcgggccctagtgaatctgtcatctacatcggcgtcgttcaaggctgcattgttatgatctcttggatcactctggtttggttgatatatttgcctaccaaatatctcaattatatctctaattgtattgtgtttagagacgaatcggtttagctgggattatctcggttaggtctgatctcctgtattagccgatatatctctacaatcataatgttgttctaaactgatttgttacatccatcacattagacagatctatcggctcatcgagtattagattatcatatacaatctcgtgctgcatcggttaggttcgacctactagattgttgttgataatataagtcttattaagccgataggttcatgctaatgttttatcggggtgctagccgataagttatctggacgttgcatcgacttataaggattgcatatacatataagttggatttagccgatggcaacaaaggtttcactgtttaatctaatcttgtggattttatgacattggacctccagccgatgcatgctttaaccttcgggtcaatacttgttctactatatcatattgttagccgattggtttctattggattatattgctatattatattatcatcagccgattgcatttatatcattatctacattagacatatagccgattgtttaaaccctatcgctatcggctggtatcgacatcgactattatcggctatcggctggaactactccatcggtttgtcagcagatcggctgtttgatctattatttgtatatcttgtcagttacaggatcaaactgactggcacgcccgcatctcatcaatctttggacctgcacaggagttaagcagatctcccaggccggtgtgttcgattttttcgtcaatagtttactaccaccttgctagtttagcatgagtggaacctgtgtgcgcatgtttactaccaccttgctatgccgtgtgcgcatgtttactaccaccttgctagtttagcatgagtggaaccaacttataaggcatattccctccaaccatatcactccttgcatgtttactaccaccttgctagtttagcatccaaccatatcactccttgcatgtttactaccaccttgctagtttagcatgagtggaaccaacttataaggcatattccctcactccttgcatgtttactaacaccttgctagtttagcatgagtggaaccaacttataatgcatattccctccaaccatatcactcctttgttcggtcacttctcttctctttgttcggtcaattctcttctcgtttaaccgaaaaaaccgaattatcaaaaaagtctaaatgcaacctacaatccactacgttcaattaggactaagctctaattttcacatccttacttattataggcatgcaacctaataagagtatttactcataagtgcttacgaatttttttgtaacttttgtgttgaaaatttccattttctttgcatatatgaaaatgttgttgaatttcggtcaggaccgagaccgaatttgtctgtcctgacattttttgcattgaaattcggtc

SEQ ID NO: 47264 - DNA, 2924 bp, Oryza sativa
ccaccctgctcagggtgtatgtgacatcctggcccaatttggattaggcctatgtggcccatgtgagctgtgtgtgtgggccatgtgagttgtgtgcgcttgtttagtaccaccttgctagtttagcatgagtggattcaacttataaggcatattcccaccttgctagtttagcatgagtggaaccaacttataagtaaggcatattcctttttacacgaagcgagaacgaaagtgtaagcggggtggtatgtgtaagtgggcccacccgtcgaataggctggctatgcggttctggagggacggctgttacactcccttcgtctgccggctctgctgcaagccgaggtagctccaggccctcgctgttggctaaagagggacggagttgacgccgctcattgcctcctcctctctcatctctcgcatgccatcaaggagcagatccacgacgttgccgccacctcacatgcccttcgtcgccgtcacctcacacgcccttcatcatcgtctgtcgtcgcctcctgtgcacgagcccgcctcatgcgagcacggatccgccgtgcgtcattgccttgtgcgcccgtcaccatcgatgttcgtcgtcgcctcacaccacagtaaagggagagtaacatcgacgcctcacaccacagtaaagggagagggcgctgaaaggagcttggggtagttgtagaggaggaagagtaacatcgacacaccacagtaaagggagagggcgctgaaaggagcttgggggtagttgtagatgaggaagagtaacatcgacgcctcacacctaaagggagagggcgctgaaatgagcttggggtagttgtagaggaggaagaataaagagtaaacatggctaggaaaaaggggagaaagaggaggaggaagaagaagaggcagtagaggctgacatatgagtcccacctgtcactgactcataatagagagtgtagatggagagtatgttgaagtaaagtgtttgaagaggctgatttgggtattatgttggagatgctcttaaaaccagtgtaatttgattccctcagcggttttagaggatggtttcactgacgtgacacgtagacctgatctatactgtggagtcatcctgtggagcccacacaccattctcccattcctttccttcttcctcttcctcttcctctctccttcctcttcctcattcggcttctccacagtgggctgtgggatgattactccgctgcccgtgaggagatggcacagccctagtcatttcttttttaataatagaatataataccggcatttgcttaacaagttataaccaattattacacaaatttgctcaaaagagtaccacaaatgcacacaaaaaatcttgtcatcttgggcaccaccgcaccagcaaattatgaatacatatcgaggaggctttcgattatttggccgaactcacctatcattttcttgtttctggaatcaaacacaacccggcgaccttgaacactttatgctcttaaaacacaactgttccattgcaatcatacaaatcgcattattactgtaaaagtgataacaaatcacgagatgttcttgaccatcatcagtgagatctgatgtatatcactactctacacaacagctaaagatcaataacaacaaagtggtattttagctggagtttgagaaaagagagtggcccttcatgcacttctcaagctctcatagctgttctggtcctgaactccgccgtattacttctgatcatctctgtcatttgggcatacattacaattttgaaactgcactttagtatcccatcaaaactgaaaaaaaaaagatgatctaagagctgcaaatatgtatgtttagaacaatgaagaataaactgattttacattttctgattgctttactcggccatcacatggatcttgggctcagcaatatttatgaataatgatgttgtggtaggtgtatcatccaagaacatgaacatatcacttgtttctatatcatgctgctgcagtgtccctattagaaatctaatcaagcatctctgaattccatcaaattacaactacaattgtgacataagatagtgccgatgatagatcacattttattcaacgccatgtcaaataaatacaaagtcaacgtgtcacattagccgaaaccaccatccaaaatcatcttgagactatagttgcactcgttttggaaaatgagggatgtgttggtactggttttaggtttgagtgacgcgatccaaactcgagcattacatgagtgacttaaattgaactttttccgcgtgagaactagcaagtgggctgggccgtgtccaccgtgccgctagcgggccggtccgcagaagacaaaacaccgggccatgtcgacacggcctactttgtcagttccatcagacacaaagccacaacaaaagtctaaacctctagctacccaaaccaaaccctaatttctcttctcaaaaaaaaaaaaaaaatccagcggcggcggcggcgcacatggatcagatggcggagcggcagcacaagaagcggaagccggagaagatggccggcgcgcgcaccagcggccatgataaggaggaggagaagaaggtgaaggctccttctgtgtacctggtggtaggccatgaggtgagctgggcaacctactccgtgttcaaggtggatccctacgcggcggcgaaaagaggcggcggcggcggcgacgaggaggatcccgctccggtgcctatccctcgccggctcgcccgcatcagcgccaagttctgcatgtctttcgcccccgtgcccgtgcgctcatggatcgtcggcgtcgggggcgattcagcggatgaggactacgccccggagaccatcgtcttcgacaccgagactcgcgccgtgatccgggggcccaac

SEQ ID NO: 47265 - DNA, 3651 bp, Oryza sativa
caatggttactgtcgagtcctacgttgcatggcctcctgcattctggtgtcattatctcagcaggagggcacgcacatgtttgatgtcgacaaggagcaatggtcgaaactggatgacaacagcctgccattcgtcagaggcgccgttccacacggacccatcttccttggcttatcgagagccaagaaaatcatcaccgcatacaatatcacagtggtctgccaaccaaggtcaggcggcacagcgccgtccttatcaattgttgagttccctgtggtgtctgacatggaagaggagatcttaagcacaccaatatttctttctctcggtagccctggcttctgttctttgaaaagttggagcgaccacccaacgacggatgatccatgtactcgtgcacgtatcaaattgatggcataccatacagaggaacccatatcacaagagtacatcgagtcttctcatggcttattgataccgaaccagtggaaacaggtgtacgagatatgtgattcgtccagggaattgatttggcaatgcctgatcactgcaatgtccttatgagtaagcccctttgtcacatctagtccctggagtcaatggattgtggatttcatttgatttcttgcactgcctgtttatttacaactgcaaccataaagcatctataagatgacattactgctaatcatggattaacaccttagcacggtactgctacaatgtatgtcaggattgttggttcggggtgtgtatgtttgacattgctatgcctgttattgatttgcgatagtgaccacatagaccttgtcttcataatactgaagataaatatcaatactggctttagtttatataagacgacataaattgcccagagctgtctttttttttttttgatttttagtttttttaggaagcttctcatatgttagttctgtaaaggtactcgatttaagatttgtatctacaaaaagcaacaatctacaacagcaacagtatatttgtttgctgttaattagtttgagaaatatattaacattgctcaatcctgagctcaaaaggtaaaagcctactaatcctccctaatcttgccgctctttatacatgttaaccattggcgtctttattcttatatctcgtgttgtttcatggctttgagcttgggcccattaatgtgaatggtgaggcagcagagttatcattgaccatccttcatttctaggtcataaccttttctagactacataagcgacaatttttgttgtaaacttgtgatggcttttcatggttttgatttacacatcagctgtttactactagagtgattttagttgcactcttaaaatatttcagatggaaaaagaaaacagatattatagaagaagctgggggtgatctatcactctgcaagattgtatgttgctagctgtatgtagatatatgttgttttcaattttctttgcacgatgatggtggttatagattgatctctttactcgtgtacatgattgttagatcagaggacgaatatctctttttccatttttaacttaatcttgtagcttacttagtaagcacccatctcctggagccggtgcaacactataaaattcaaccacataccacaaacaattgctatatgtctacaaatatttttcctggattgggagaacactgcaaataatataactagaattcggcaaaaggatcattggtgctgaagctcctattttgttctatggttgctacaaccatgcattgattttttatctctttctttggagattataaggcatgtgtagaaagctttggttgcatgcttttattaccagctttgtgtggctactgggctagtggctatattcataaataggaaagcacattagctccaggatgtgatgactgatgagagcacatatggtgattggggaatgcagtaaggtcgtaaattctggcaataaacttgttatgacttaccttgcttcctatggtggatattagctccagcagtaatatgcctttaagttgaaaatagcattcgttttagtttgatgttgtcacatgcatacctgcttttttgtactgtatcataaaactgaaaaaaagtattccagtaagcccataattcaatcagtcaataatatatttacctcatgaaatgtactgtttgtattgaagctgcttgtattagctgtagtatgttatacatgttgcctatttatgcagttaatcgtttggaacccactcattaagtatgccgtcttttttggaagtactttgttcaatgtgcagggaaaatgttgtgagagctttgttgattgaacaactgtcattattatgctatttcgtctatagaaacatgttttttgggcatttcactattagttcatcggttaaaaaaactcatacaacattattgggcaagcatatgcttcctataatctttatcagattgccaatatcattgtttgttctgttgtggccttccctgaatctggtatgttgggtaattacaggtgtataatcttacgaacactacaaagtaatgtgagtttgtttgtgttaatcacattccacatgtatactgccttaatctagctcattttttgggtttaaccgtttattggtagcagttttaatatttactctattttacatataattctcaatattttatggttccacaggtatattccatgatgttggagccaccagaagtttattgtagaggctggcttaagaaaacggtttacttgtagcaccctacaattccagtaaattcttcagagtacaacagctttgcatggcttcgaacttagggagtagtgctgcagggcatcttttgcttgtgtattaagtggatttagaatatgatatttgaggagaaatgatcccctgtagtatctatgctggactgatctaattgaacctgtctaaaagagtttcatgtatgaaacagctgtacgtatatgtgatgtgacgtttaatcattcgtttaactaaaaaaattatataaatattatttactagcaaaatatgcccgtgcgttgcacgggtgaatatcaaacaaatatggtccttgtgtacttataacacgtgcaaaaagatattgaatttgtacatattcaaattttatacaagaaaatatcaaaacatctcatactgtatacacattcagattcaggttgtatctcaaattttatagtacatgcatgagatattctaagttttctacacattcagaacatactccaactttcacaaatgttcacaagagggtgtagttacagctctgacttcaccatcctctacaaaaggaaaaaggtaaaatgcatctgcaataggaaagaaacatgcactttgtagtatcataataaattcactcaaaaaactttagtggaatatgttcggattatagaaataatttaatatttaagaaagtaataattatcttgacataaaaccatattaacgcttatcaaatacaatataacataattaataatttctagataattttttagtttggttcatttatctaaaaataatttactgagtgatcaaataatcgatcataatttcgtagcaattttaaatggcttaaaatagtgccaaacaaatttctgtaaatctaaaaataattaaat

SEQ ID NO: 47266 - DNA, 993 bp, Oryza sativa
tagaatttaatatgttttaatttaattttctcgttttttttctttccgttgcaacgcacatacaattttgctaatttatataacgttacgtgaaaaaaaaaaccgcctggaggcagtatatttgctatgtttgacttctataaaatcctttggtttgacttctataaaatcctttggttcgtccgttccaagaaaagccatacaggaaaataaacagaaactatttgccattactaaacaaggaataattaactatctgtcaatcttacaagtagtgaaaaagaatgtctcatactccatccgttccgcaacaactcaacctaggaagaaagggatttgcccctttaggacagagggagtatggtatagacacatgaagacagaccacaaagcatgcagagacttccaaaacatgaaaaaaacaatagcacggatatttgagcaaacaccaccaatacgtgcacacattttcggtcatactcaactaaacgtgattagcacgaagctgtcacgaactgagataaaccacatattccgaacacatcgagcaaactacacctgtgctgtgcggctgttctgaacacatattgtcaggcaagttcaaccaaaacgtgattccgcacaaagctaccacgagttcaaacaaataaaaacattaacagatgtctgcacagattttcaggcatgctcaacaaaaatgctattcagccaatccaagttgtcatgaatagcagatgtatgagaaaatcaatcggtcctactcccagcggatgtatagccaaccccagtttctccatcaaatcaaccacattgtgttccaatgaaaatccagcccgccctctttgtgtgtgaggtaacatcattttaacttcctgaaccaaacaaggaaaggataattcagagattggcatttgcgggatagaaagcaatagaactgttgatatcatcaaatatttaataccagaaacggaagtgtaaagacaaaacttaggg

SEQ ID NO: 47267 - DNA, 2527 bp, Oryza sativa
cttgttaatcaagaatatgtatgggatatgtatcggagggtatccgatctgtatccttatccgagaatgtatctgatacggatacgtgagctgtgtgccgtatcttgcatcctagattctgcatgtgcatttttaattgcatatacattatgcacgatatcatacttgaatatcccctcacattttttcattttcaacaggcattatgccaccgatgggtgaccccactagtgagggtggagtcttccctgatatccaattttggaaacaatgtgcagatccagtccttgctcaagatcctttttcatcattgttgtcaactcttttctgtttacctgttcagtttctaatgtccactgaattcttcatccctttcgtccacctattctatgttgtttgtgttgttcaggtatgctgttttgccatctcctggaatgtgcatattatccttttttattacttcattacgttttatggcatgcattgtgttgtaggcattgataacatgctatggagaagaaacatttgacagatcaagtttcagcaactgcctccttaatgatgtttgccagactatgtcaacaattgatattgctagagaatattttgtatccaaacacattgatccttcttgtcacccaaaagatatggtccggagattgacttatccgtatcttcggaggtgtgcgttactatgggagcttctaagatcgtcttcctcagcacctttgtatgacagttctaatatctgggaaggatcatcacatctttacttgaataatagcgcggcagactcactggcagtggagctgaatgggataagggaattggaagacctgtttcagattcagtcactggatccaattctccaagatgaatctgtacatatgcttgcgttaaaatggacacaacatttctgcgaggattacaaaacccgtaaatatagaggcgttcatttctctaccccagcagtgccatttaggctgatggagttgcctcctgtctatcaagttctcctggaaaggtttaatctgaacctaattttgattgattccctccctttctggttctgggtcttcaggaaccatatattgcttttaaggctgaaggctaacacttactgtttttcccattagatatgtcaagatgcaatgccctgattgcggttcagtgcctgatgaaccagcattatgtttactttgtggcaagctatgttcgcctagttggaaaccatgctgcaggtgatggtgttcatttagttcttgtttcactcttgctggttgtgttttaattatgaagtgagggtaaacttttattttgtatattgtgtgtaggactggaaagtgccttaatcatgcgtctcaatgtggtgctggcgttggcatatttcttttggttagggtatgtattaagttgtgactgcatatcattcttgttatcggtgttgagattgctttcttcaattttgttgtctgttttgtgcagaaaacaacaatactgttgcagcgatctattcgtctcgccttttggccatctccctaccttgacgccttcggtgaggaggtactggattaatttaaatactgaatagctttttgctggcactaaagcatgtttatttgcctcactatccccgcttgccttgctatccttgcattcttgcgccagcatgcttctatgctagtgtgcctcatgaaattatgctcttgaatggaccttggctgagcaatcttctccacccataattcgatgagcaattgtaagatcgaacactaactgccttgatgtaaaataccatcatcaaatgaactgaagaattatcctgtcaataccgtgaagatcccattgactgaaaccagacgtaacttctctttactgccactgttgagtatacatacacggaaccagggcagggtgctgtgaagattttttacctgtatgcatatcgtttaaaacattgcacctaggacggattgatggcatatgatttgatttctagatgggatgaattagagtataggatgcatgccttgtagattattgagatatttccttgcaatgcaaagaagctataaaggttagggtaatgctacaaggatgaggcttgttctcacctgaggttggggcatatgctaccaaggatgtgtgagccaaacgaccccttgatggccttgggcaatgctatgggtaatttcattatatgtgatcctatgccttttttcttctcatgtattgctatttggttgcaggatcatgacatgcacagaggaaagcctttgtatctaagccaagaaagatacgcagccctcacatatctggtagtaggctcacccgcctttattaacggctccatttcaatcatcaggaattttcgaataacatgccctccttttgacatgataggtggcatctcacagccttgacaggacttctgaagtacttaggcagacaaccatcagcatttatggatctgattgagtgcagtgtgctgtgggacaatatccaaaggtctgtatcatctatattt

SEQ ID NO: 47268 - DNA, 1889 bp, Oryza sativa
ttacaattcccctaatcgatagtttgtctttatagtagtaactatattttgtttaatcattgagcgttcccacagaggtacttattcgttgtagatatcacagatttattaaacttgtaaaatgatgatgcacgataagttcacatagtacacggcaactatctcaaggacagtaaaaaacctgtagcttgtagaagttacgtcgaagccatgggtaccaaggtcttacaatctccatggccgacacaaatgacgtcccaacaattcacgagctgggtctgttgggtcttggaggggagaggctgatctaaattgtatgcgctgatgtctttcttggctcgggtgagtgcgagtgcaaagaagaggggggctcggctccgatgaaggaaaggttcttgctaatcattatggttgtgggccagatgcggtagaggaccggagaaaggatgtcagtgggcaattccactccgcttattagttcatggacctcatggtaacataaattttagaagaaaaaataaattagaagaaaaaataaattagaagtgggatgaacaggaaaaaatcccatttgtccaccccacttacgtccctagtaggatggtatctccacgtacaacagatggtatctcctgccactgacttgcttagctttagtttctttgtttccgccgctaagcaccttaccatcatcgtaatttccacacaggacctaacagaggccgtgtatcaatatcccgtgtaataacagagaactttttcacggtcatgtctttatacaactaagacgtcgggcggttgaagacctacacgagattttgtgcatatatgatatgaagtctttgtaaaatagttttccacgtgtcaatttttccaaggagcaaaaaacaattcagaaaacgtaagagccaaaaacaattcagagtacggagagaagtggaacacgaggttttcaagtttgataatcgctcgttcgtccgttgtgaagccatatataacaagtgtcccggcatccagccattaacaacacggagaaaagactgatcatacaataaaagttatgaacagttcgcgcagcaacagaaccgcgaaaccttgcagggaatctgaacgcgtgagacaggagtcagaacgtttataaacatacatgagcacaaagcgcacagtggttaatttatactcctacattaggcttcgggtgacaaagcattttgttctcattggaaaattacacgtgggtctcaggtctcgttgacagctccagaaatatttcacatcaaaaaagcctgtcgacacaaccaacagttagcccacatcagcaccgagtgcaaactagccaacttggatggcatgtatttggggaaaagacaatatatttggccaattgacgacgacaaggtgaaatcgtacagacaaagagtagcagcagcagtatacatttacattacgttcgatcaaaggtgggagtcaaaacgttagataggacacaaactttgcagaattcaacacgtcaccgagttacaaaataagttatatgcaaacagttttgaaatattttcctttccaagggacgcaaattcaacatgatatgattcgtaggttaccttgcaccagataggtccatcaccgagaatcgccacagtaggtaactgtatctggcacatatggcacaatcgtcatctctggttctctctttgcagtgagtgccttagacgcacgatactctggatcatctgtataacaacaaattaaagcaaacatcaaagttctgcaaatctaaactgaacattgtcctacgttaaaaagatgaacagaggtaaacctgatattttgactgtgcaaagaagactgggacatgagataggcagctctacagagtagaaaattta

SEQ ID NO: 47269 - DNA, 1421 bp, Oryza sativa
tgacaaggataataaatgaagtatttaattacctttagtcacaatcatggccttcctacgaagacccaaaaatggtccaaaagacaaatcattgcattgtggtgcaaccttggtagggtagagcttatagtgacgatggcatatcatatgtttctcatgtgatgacattggatcatcggccatcagttttggctcagctgcaattcaaaacaacaaacaaaatcaacaacatatggagccagaccagcaccaaactttttttttctaccaactcacagaaagagagcctgcggtaaaaaggaaaagaaaagaaactgatccttgccaaatatgcacacaagcaaagcaacaaatgtccgcgacaagaatgaaaactgcaggggctataaaattattctccagttctcctacaaaacctaaaagagttagcaaatgaagcatggaaggatcactaaagcttttccggtgtaacaattgtgcaccatatgccagtaacgcattgcttctacctagagcataacatggatactttctagcttgacgaaatatcgtgagttcttaagtatacgaaaaatcttgtagtaaatagcttacaagtaggtgtaaaatcaacaatatgaatccctgaaaacaagagcaaaagaacaagccttagctcatacaaaaaccaacacaacagactgcagcttccactaagcccctttttttttctttgggtaagaacaaacaaatctcttagcaagacgcccgaccaaattaactgaaacgtctgagccccgctcctctcccaaattccccaattcatgtcacagctagcagaagcaagctatccaatattgcaaattagtttacagaaaccaccgtaatctagtgttggtttctaacaagtcatcaggaggcaaccagtaaaatcaacataagctgcaactgctgcaaaccccttgtttaaggaaactataacatagggtagtggacaatcaaagcaaggagggaaataagcaagcaaagatgagatctatacctgaaatttccttagctttcgccgagcatccttgctcagaagagccttcgtgcaccaccttgtctcctcctcctccccgacctgtatacatacagcgcacgcaaaggcatcgccgtaaaaacccaagaactcgaaaccatcaatatcccaaagaaatcccgagcaaagaaccacactcactggcgttctccacggccaagccacgccgccgcttgtgcacagccacgccagcctcctcggccaccacgggcatcttcatctttcggcggcagttcttgctgtgggatcggcggagcctagggttggggttggcgttggggtactcgtacccgcactcagggcagagctgacccccgccggcgccaagcgcctcctccttccccctccgcaccctgtcgcc

SEQ ID NO: 47270 - DNA, 6627 bp, Oryza sativa
taaagaaacaaatagaaacccggtaaatactactccctatgtcccataatataagggattttgactttttgctcgtacgggttcgaccactcgtcttatttagaaaatttgtgcaaatataaaaaatgaaaagttgtgcttaaagtactttggataataagtaagtcacaaataaaataaatgataattccaaaaaaattttaataacatgaatggtcaaacaaaacaagcaaaaaatcaaaatcccttatattcaaaatcccttatattatgggacagagggagtatactataaaagaggtaatttgcataagaatacaacaaaatttggaaacggacggtatatagcaaaattgtttacgtttttttttaccgttttagtattcgtcagtaaccattttcacattgcttggctagttaaagtagaaaacgagcgtcaatcggttggaaatttctatgactgttttcacccctagttgtagtaattagcagtgtgccagcatatataccccactagctttgccaattgaaaagatcttctcttctatcatccatcagcttcatcaactacttcagcatgatatatcattactactctctccgttccaaaatattgtattcaggacaggattagacgcatactaaggtgtgttctttactacatcttcccaacttctattcccttgttttttcacgtgcaagtttctcgaactgttaaattgtgttttttataaaaagaaagatctataggaaggttgcttttttaaaaaaaatcatattaatccaatttttaagttattttaagctaatacttaattaatcatacgctaatccatgcttcgttttacatgttgaagggttgggttcctaacccctccttttgaactcagcagcctagaactgtgaacctagactggcaatccagatttgtattagtaggatgtgtttaatccggtcctaagttgctatattttgggacggatgtagtacatgctaggcaatgccactgcaataatatgtaaattcaatattgtttgtgggtgttttggaacatgggaattcgaataaaacacacgaattattatatagtatgttgaatcccacataaatgaaatacgacacgaattattgaattcattcatttggacacgaatagcttatagaaaaaaataggaattttgacgtcagtgtatatagatgaagttcgaggtcagttctaaaatattatataatatgttgaatcccacataaatgaaatacaacaggaattttgaggtcagttctaaaatagataaagtttttataatgagtgtagtcaaacctagaaatctgaactcacaaacaatataaaaatatgttaatatttaatatctgaaaatggtatcggtaatttgttatgaaaattactttcatgtagttgttttttaatgattttgatgaaaaaaaggtaataatgcacaaacatgtagaaagaatggagataattatttatctgtactacttgaaaagtgaagtcatcgtccttctccccgccattgtagttcctcacttgtaaaaactacccctcctaaaaatccagcccagtatttaaaaaaagaaacaatatttccaaaggagcctatgcttataatcctatggaattgaggaatacgataaattaattgtgtaagaatttgaaaactcaaaatcttatgtcccaaacaaaattcatgagtataattcttcattgttcctatgaaaatcctataatccaaaggagccctaaattatatattcaccctactttctcattgccccgcttggcataaccgcaaacaaactcgctaggttattgctgttttatatttcatttatattgttcaaatatatttaaaaaataataaatgtgaactttagttgatctaaactactattaataatcctctattaaatcatgctcggttcatatggagccacataagaaatcctcacaaattatgtttcatttagtaaaactagaataacaattgtaagtgtttgtttcaaattgcactagtatttccttaacttaatagttctgtacacctggctcaagaggatctatcctttttttttaaaaaaaaaagaaaaaccaacatactatctctttggggtaaactgtttcacaaccctagatttatgcaaaatcctcatgtgtacaatgatatatggtattttcaagcgtatatttacattcgttgagatggtgattaatgcatgtgtgaatagcagagatagctatgatatgggatggagatagtatatgatatacttttgggaaaaagcaaagtgcccttgccatccaaattggacttgggtattgtaatgatgagggaaaaaagttgaagaccaaaataatgtatggtatattatattattgggaacttctaaagaaaagctttgaatgcaatgtgttcttatcatagagcccggacaaatggatttaaaagaaaattggtaataacctaattaggtacaaataaaatgctatagtttggttaacccaacatcgatgatatgcttgtactagatgtcggtgacacatatttttagataatgaaagtttttattaaactcaaccaattatacaaaggtgatacaaccgtctaagaacattccctgtatgtgcataactagtacgcgcacaaccaaaccagtaacacttatatcacgaaaactactcttacaacggcaaaatccaaatgaagcgcacaaccaatatacaaggttaaggtggttagcatcttttgccgaccaaatgaccacttaaacgaaccacttcttttgggtgcaggggagctagtactgttggatattatataccggaacttctgagctttctttctagctaacccatgagatcgatcttcatcattagttgcttgggtactgctacttgattccagtcaagaggctcaagagcatactaatgggaattgggaggtcatcgctaatgaattaagaatcgataagtaaatttcttttcatcaacttaattaattggcaaaccaaacccctcattaatctgatatgataataagtgcagcactaattaaggagagagatctagtcggtgatattagctaggtatgcaacccggcctcgatgcgaagttgatttggtcatcaaatatacaggagtacatatgtatctagtactgcatgaaataaatgaaatcaaattgcagcttagcgcgcgcctctgcatcgattaaaggggggtagctaggtcgatcgggagttcggagttcctcacctctagctagactcatattctcatctttgcattatttacttcggcgaagaagaggagggcggcccgaatcgcagatgcgcgtcgcagctcagctccatggcggccagccggctcgcccggcggcggcggcggcggcacatctgatctgctcgcgtcgagagagagagagagagagaaagtgaggggagaggggaatcgaggggatgcgtccgtacctgacctgacctaacctgcctactggagcctctactgggaaagcggatcctcgcacctgacgtggtcactgacaggtgggcccgtgagcggtggggctcacatgtcagccaccacgttcctctgacttgacgtatgcagtatatgtaaagagaagataattacaccaatgccatttttgatgcatctttaaccttatcgagtaacgtacgaggtaccaactactgccttttctttttacggctcattttttttattattattcaagggtacatgaagttaattaggtattgtaaagttaataaataaataaaaataaactaatttcctaagaaatttatttatatataagtatctctctaaatacatgtactctttgtttcaaaacgttttgattttgattaaagtcaaactactttaagtttggctaagtttataaacaaatatagtaatatttatagtactaaattagttttatcaaatcaataattgaatatattttcataattatcgacgggggatacccgtagaccggatatagagggtattggagtacgctggtacgaggatctacgtaatacgacatcgaggaaacagaaaacagagattatactggttcaggccccctgatgggtaatagccccaattcagttgatatgagattatatagtgaaaaccacatattacaaagggaataacagaattcgatgataccgacgagaccgtagtcgagttggttcgactagatcacccggcgacttggcttctgtagactccggactcgtaggctgtggtaggtgtgttgatagtaagattcgatgtcttaggtcttcccggggatcctttttatactgcaggtcaactgacctccaagtaggactcggagacatcggacccgcatgatacaatgacgacccggttctatccgagtaggaatctttccatatgtggattccgtggtgaatttccttagtgtgtacagagaacgtccatatacgcgcagatataccatatcgatgcatgacatatacccaagggtaaagggtataccttatccgtaaccctggcaataataaatttgtatagggttgaaaatgttactactctctctgtttcaggttataagtcaaaaattgctttaagtttgaagtttgtagaaaaagtagtaacatttttaacccatgacaaatttattatgaaaatatattcaagaatttatttgatgaaactaatttattattataaatattattgtatttgtctataaacttagtcaaacttaaaacaatttgactttaaccaaagtcaaaacatcttataatctaaaacggatggagtattttttttctacagactttgatcaaacttaaaacagtttgactttgactaaagtcaaaacgtcttgtaacctgaaacggagggagtactacatacatatagagagagtgagaaacgtactccctccatctcaaaataagtgcagttctgcattgttcgtattcaacgtttggccgttcatcttaattgattttttttaatgattagcatttttgttgttattagatgataaaacatgaacaatactttatgtgtgacttttttttattttctcataaattttttaaataagacggatagtcaaacgttggatacgtatattcacggctgcacttattttggaacggaggtagtattcattcttttgcatatcctcaaatatggcgttaataaagaaattactgacctgaatcctaagaatcatcagcgatttgacggacaagaccgtaagtgccatcattttgcttttgacggttaaactatatgaataaaattctttgtctatagttttttttccaatgtctttgtctagttttttttgatgtgaaaatgaaaatgatgacagataaatgtttcaaaatttgtctctatatccaaaagtaattaagctgtagaggttttttcgcacaaattttgatctctagcctaggatttgccttccataggtcctgggcggtgactcattttgagtcttctttttttcttttccttttttttgaaaaaaaatcatcgtagaattaaaagtttctcatttttattttttacttaaaaaataccatgcattacaaagatgaaaataaaatatattgaatattaatatgcgtttgatgccattccctgtataaccatatcaatgacaataactattaattacaattgagcagacaaaaatttacaaccaacatttttatatccattgttgtaactaagaaataatgaaaattataacacactactccctccttcccaaattgatcatcatatacgtttatacaccaagattaaggataatttcaatcacatcaattaagacaccgtacacacattctcccacaatgcatgcatcgattaaaacatcataacaattacacattagcatgcacacattctgtcatgctgtattaattgtattctgatgaaatccgtgtctatacggttatatgatgatcaatttgataaattttaaatttcattatatgatgataaatttgggaaggagggagtatctcgattggcaatctctactaaaaaacttttttttagcgacgttgtccttttatttttccagacggatatgaccctcggagtcaaatattggcctacgaaaatataaaccgaggtggatttttgtcatccgcttgggaaaatcaatttttccaggcggatcactgaagaggtccgcctgcgaaaatcaccttaaaaaatgatttttgcatgcggaaccttatgcggtccgcctgcaaaaatcatacctacctaaaataaatcttaagtcatccttatcttctccaccaccactccccaccgaccaccactgattttcctctcaactctctatctctccctcaacacttctcttctcctctccacccctccccaccggctcactctcctcccctcccctcccctccctccctcccaatccgagcggcggcggtggctccccgtctctccctccccgttggaggagggggagcgacgacgacggcagcggcgcgaacgcgcggacggtgacctggcgaggacgggccgacggtagcggcggcggctccccctttctctctctccccgctcctagatctg

SEQ ID NO: 47271 - DNA, 10730 bp, Oryza sativa
ctccccctctctccccccgctcctagctctggccggaggatggggagcgacggtggcggcgcggacgaggtgaccgcggcgcagaaggggcgacggcagctccccctctctccctcccgctcctagatctggccgaaggagggggagcgacggcggtggcgcggatgcggctcccctcccctccctctcccagatctggcccctacgaggagaagggagggtggtggcggcggtggacacctccctccctcccagatctggcctgacgggagaggggggcggcggcagccaccgcatgcaaaggagttcgccggcgaagatgattttttttataagtttacatgttgattgatgttaacttgcaagttgatgctgtggatttgaatccaattcttttgtgttgatgtatggatgttagtgattggattttgtttcctggatgagatttgtgatttgaaacttagggaggggtggggctgacgggaatgttttttatggtgccgcgagtattttcgcaggcggggctactatagcgtctgaaaagatcccaactgttgcctgtgaaaatcatagtccgcctgtaaaaataggagatttttaccatcgtttagatgcaggcagaaggtttgtccgtctgtcaaaacgtgttttgaccgcctgggaaaacgtcttttctggtagtgaatgttaaggccaaaccctcgatgatgcagtgttaccaacatctgtttcggccaaaagaattggattgttcgtgacatatgaactactctttttcagttagctatggccccccgtgactgtaataaggtggctcatgcctttgctgctgaatgtccgcctggttggaatgtttggttgccagcgatttagttgggtcattaatctaaagtcatcggttcatcttaaaaataaaaaaccatcctcaccaccaaaaagatgatcaatcaatcatccaccggccgactctcgtggctaagtctaaacaaaatagaaccaccttgacagttaaaaacaaaagtattatctttctttattattaataaactaatgtgaaaccaaacatttagtttgtttagagtatttttacataactgcaggctcccacacctcttggactaaatttctcacgcactttgaaatgagacggttggctctctcccatccttcacgagctcctcttagattgggtaagcgctagatttgctagctgactttgatatactcctaagctacaacgaaaatcatcgtaaaaataaataaaaacatttttattgattattgagagggagggaaagaagaagatagggaagatatatatgtaaaacgagatgatctattagtgtgtgattaattaagtattaattatttaaaactcaaaaaatgattaatatgattttttgaaagcaatttcctgtgaaacttatagaaattaaccaaaccgctcagtggtttgggaagcttgcgcgtgaaaaatgatactacctcctttttcaaaatgtataacgccgttaacctttttataatgtttgaccatttgacttactcaaaaatttaatataaatatgtaaaagtgtaagttgagattatattttatttgatgacaaaacaaagtcacaataaaataagtgatatttatataatattctttaataagacaaatggtcaaacattttatgcattttaaaatggagggaatatatatcttctctctctcgtaggaacaaatacaacaaccttattgcaagagggcactaattgtttattttttcccttattaagtgagctcacattaatttcaggacgcctggctaatctcttctttctataaagctaatgcccattaaacacctaaatattaatatgcaagcatactatttattatcacttctaaaatctaccaacagacatgccacatcaacccattaaacacacgaagcttaacatgtaagcatataataatcatgtctacaatttattttattctaaaactaaacatagacatgttaaatcatcattctcaaatcattttcataatatttcaatccaaatcatttcatcatttatccaatatctaacatatatcctgcaacaaagcgcatgtcatcatctagtgaattagctaatgatatactccatatactccctccgtccaaaaaaaaaagttaatctctaatatgtcacattcagtactaggttggttttttatgggacggagagagtacatagcggtatactatatagtgcaaagtataagcttatcaatttctagttggtgagcgtgtacgcacattataaacctccaaaatatcacatgtttgctattactccatgtaagcattatttttcgggggaaatatatgtgtgtcgggttattcgttcgagttgagtatagtttgtcaatgtggcatttgtcgttgggtttgcaattagcgctcctcagatattgtttgtggagtccacaataatcgtttgtggagtccggtgaagcctatccaaaatctacgaatcagctaaaaacctcgaattatatgtgttcccatgaagacagccgaaggggatgctgatttgtcaagtggtgtgcacgtcactgtagactgtagtagaggcttttgaatgtaatcgttgcgacaacgccgttgcccttgtctatttcatcctttactgttgtattgtttcggccgcagagttgtttccgtaattcaggttacccttatatgtcaaaggggtggccttgttctatatgttattttgctcctagcgatgtaccggggatctaattcccttgaaccttgtctttaatttttaataaagttggtgtaaaaaaatctataataagcttcccttgttttcaaaaaaatatatatgtggaaggatagcatcgccacaaacctgatctatatataggacatgcatgctgttagtggtgggatctttcaggggctttatggagatgaagtactgcatgcatattactatatcaaaatgtttgcttcgagccgagcatgtttgttgcatagtgcaatgcaaagaaaattactatatcaaattactatatcaaaagtactccatgccgagggacgcggcgtggacggcgtcctccatgctgacgggctcgcggtggctgcggcgcctgctgctggggcggtcggagaggtcaacacggagctcgtggcccggctgaaggaggccgcgcaggaggtagccgtggaggttgcggcaggcattgcgggccatctcttcgtcgcctacacttgttggtggctaggtcggcggcgaggcagagggaatggacggggccgatgagttcgcaggcatcatagagctcgtcatcggaggcgtcgaaggcgatattgcccacgaagcctccggttctccccgcctatcgccggcagtgctcctcccccgtcgtccgtccgccgcaccggatttccttcccgtcggccctcgcaaataagatggagacccatatgcctatgggacccacgtgggtcccacattgacccacgtcgaacaaaacaaaaacaaagccacattataagttgaggaatgtcatacattggttttttggtttaggaatgattttgtaattcggtgaaagacgagggtcgcatgtacttttttcaactttagccttagtgccaagttctccttttaagggcccatttgaatcgcaggattgaaaaaacggaggaataggaaaaacacaggaatctgataggaatgcaagtgtaaaacagaggattgcaaaacacaggaaaaacataggaatgaccgtttaattggaccacaggaaaaacacaggaatcagatgagagagatagacttagggcccctttgaatcataggaatgaaaaaacggaggaataggaaaaacatatgattatgacaggaatgtaagtgtaaaacagaggattgcaaaacacaggaaaaacataggaatgaccgtttgattggaccataggaaaaacacaggaatttgaggagagataaagactcaaaggatttcttccatgaggttctacctcatgttaaaattcctccaaaacttgtatgggaagaggcattccataggaatttcataagattcaatagggttcattcatttgattcaaagggctttgtaggaaaaattcctataggaataaaatcctctaaaattcctatgaattttctttgaatcaaagggggcctcaaaggaaattttccaataggtcagagtagatgttaaatttcctatgtttttactctagaattgtaggaataggaaagtttcctacgttttaccttttcacattcctacaaatcaaaggcatgaatagtgtaggatttcaattcctttgtttttcctccatttttcctccaattcaaagggggcctaaaggaataagttcatttgagtacaccaaatccgatttcgtcctagaacccaaaaaccagatacaaccggtccctgaactattaaaaccggtgcaaatgaggtccctcagcggttttgaaggcggttttggctgacgtggcgcctacatggctggtttgactaggtctccattccacgtggcattgacgtggcacttatgtggcaattatattgcagaaagataataaaaaccatggccccacatgtcagctactcacagaaagtattttaaaaatggtggggcccacgtggccccacatgtcagcctcacttccttctttcctttcccttctctctcttcttcatcctcaatcctctcctcttccttcttccctctctctctctcttcttcttcttcttcttctttctgagcagcaaacgagcgggtgggcagcagagcgggtgggcagcagagcaggtgagcgaggcgggcagtccgagctccggcggcggcggcttggcgtgcgccgcgtcgggggtgagggactcagcgatggggcaaggaggcaagccttgactggggaaaggaggtcgtcggcggggtggtgggcgttgcggtggggatggtcggcgcggcggcagccgcaggcgtcttcttggaggagaccggcggcgtggtggcaccgggggagggggggtggatggatttcaggctcacagaagcagtcgcctcgcctccgtccttcgaccgcgacccatccgcacccgtcgcgatgcccgtcgtcgtgcccgaccccgcgtcgccgccagaggcggcgtcggcgaagaagggggttttcatgcaccgcatcttcccgttcatcctcgctgccaacatcttcatcggaggaccacccctcgtgcttggatccatctccctccctccctcccgtgtggtagccatgacaaggcggatgcgatgccactgcaacgaggcagcgggcggcgatgcggtggtggctgctctcgctcgccgcgacgggcaccaccatcaccgccgtcgccgcgctggtcgccatcgccctccacgtctcctcctccttcgcctctggccccgattcctcctccagcgtgtcctaccgcctctccaagttaatgcgtgctgcatcaatgtgcccttctccgcgccacgaccccttagattgaactctcggggtgtgctactaactgacggtttgcctcctccttgttatcgccgacgccacagcagccgcgggaggtcggggagctgcggtgggagcaggagttcacaccgccgcaactcgcttcgccccagcccgctgctggaggcgacctctgcaacatggccccaccctttttattattttgtgtgtaattgacaggtgggttccatagttttttattatttttttaagatccaattgccacgtaagcgccacgtcaatgccacatgggacgagaacctagtcaaaccaaccacgtaggtgccacatcatccaaaaccgggcacaatactgccgagggacctcgtctgcacggttttggtaagttggggatgtgttgtatccggttttatgaactgaggacgaaaatcagactgagcaacaaattaagggaccttaagtgaacttatttttctccccgcaaaaaaaaagtgaacttatttctctttttaaaacaagcccagtgccaagatattttgagacggacgtcacaagcccatagaaaatgaagcatcggcccatactggcccatccagacgaggatgaaggggatattctcgtagtatcacacacttcacaccacgtcaccacgccctctctgctcagcagattaaacaagacaaaaaaaaaacaacggcggggcggggcgccgacatggacggcggcggcgggggcgatccgggcggccgggtcggagaggccaaggcggatgccacacgcgctgcgaacaagcgaagggccccatcgccagccgggggtgggggagtcgaggccaagaggaggaggaaggacgccatgggctcgtcggtctccggcagcagatctggtggcggtgggggcaggaggctgcgacatggtcgaggtagaagagctcgtgccttcagacgcaagcttgaggaggtaattcctgtcacggcccgagctcgaaatggatgcacatattcagacttctcacataatattcagaaaactcagattggacatggataaatttagggatctagggttctattgttaggaataaacttgggcgcgtgaatgaattggtcgtgcgccgttgggttcgacgtgcgcgaacgggagcgccgctacgggatcgtacacatagcgtccacattctctgttttgcaagaaaggaaaaaaaaaagaaggaaagaatgcagaaaacgctgcaagttttatacgaaagcaccaaaacacgtgtgctcatcgttttgtcgattcttctctctctcgcacgtgtttgctacatcctctgttgcagctaacaagtggtataagggtgaggctacacccctggcatgatgtcactccccataagagctgaagacctatgcaaccggtggctctccgtcttgcccctaccttgccacgtgcgccggagtaagggaggtcatcgtcgatcgcctgatcaagtggagctcaggttctgtcgtctaccccacgttgacaaggaccaactacactgagtggtacatggtgatgcgtgttatcctgcaggcgcaaggattgtgggaggcaacctgctggctaagggatgacttgaccctatgacttgtagtctaagacttgactccctaaggaaactgattccctaaggaaaagactttattgactgcagcagcaaggattatactactacctcgaacttttctgtatttgaattcattgcagtacttcattgcagactttgttggcacatttctctgaacttttctgtacttcattgcaggaaaataagaattcaaataatagaccccgtgcctcaaatgtggttattgcttatacgcctaacctcattcggcggtaaattctttcggaacacatacacacaaatatatatgtatgaaatgcaattttagttgatatctaaaatgatatttgttaataggtatgggactctcttgagaaacatctcatttctgcttccttatgatggtcaaggaaaggcatatgcttgtccttcggacaaaatcaatgtgtttcttaaatggagcagatgcaacttttgtctcttctttgaggtataatgaataatctgctttttttttacacgcataacattattttcattcatttaaggtaatctttttttttccttatgtcagtgggcagaaggtgatcagatgatgatttgtcatatgttcaatacattgaaagagattcacatatcgtttcttataaatccaggtaatttcaatgttttttacaattttaaataagagtaaaattttcaaaacccttgttttggggttttcttaacgcaaaatcctaggttttataatttgtttcaaagaacggtagattttgttacaaaatgtttcatgaaaccagggcagatttggataaaaccaattttctggatctgccactgcataaaacccagatacacttatataatccgattggcaacagtaattaattataatattgataactatgatgatttctacatgatgatattgataacaattaaaatttcttgcagcattcctagatgaaagtatggaagtgaaagtaacaaatcctttactttcattttcatccaattttgttgaagatgaaacttgggctcttgtgaaggagatgctaatgatggtaagaactcattttattcaattttttggttcagtttttagcgtgtatataaatgccatatctgatattgttaaacagatgttttctccagttcaagaagatgagcgtgcagcttcagatctatatgtcttcacaaagagtagagattctgtttacttcaggattttcaaggtattcaactaacttatttgttaagaagttgctggttattttcaataaatttcataattcatgtataatcttgtcctgagattttttttttgtattacccagatcactagtatccctgcaggcgagagtgaaaattcactggttcttgatgaggtataaacttctcgtccattcctgatcttgattagtttattgattcatccctaaacataaagcatgtgtggtccattcctaaacttagaacatgtgaactgcttttaggttgggctaaatttttgcctcaagcttttagatgtccacggtgcttttgttggctcagactgtgatcaagctctggatggtcttcaaagtcaggtaactgttaatttcttatgcattaaatgaatgattgtcccggtacttaaaaatggatggtacctagcatggcgtagtggattgacatgtcaacatattgttgtaaaaactataaattgtttattgttgtaaaatcagacagtaagggactgagtttacctgataatttctcaagactgagggagggaaggatagatgatagtagtagaggataataacaatgggtactgtctgcttgcctactcaaccatgacttctcgcattaatgatcaattgagcataggaattacaagaatcttatagagaggcagagaggataaatgggattaaccatggatggtgtcagtttctattttacaattgcacttagtgaaggaaaagaaatggttgtgagtcgagtcacatgagtgtagttgacgggggtagtagagtgtggagtctgctggctgggcctagccgtaaatatgggcctaatttatgtgcgtatacagatgctgaacttattatcgaacggttgatgtggctgcatcagaaggctgctttatggccataatttcctacataggttatacttgtataggaatgtaggaattaggataggatatagaatgcagtaacaaccaatatgtgccagtccactgtatcttatttctgttcaatcgtggcttctatctcatttgttagagagttaaggagtattctgaatcacctgtttggattgcacatttcaattcctagtcctatggtcacaatactttacctgatcattggtggcagtgcatagttgcacttctatttatatttcccagtacgataagtgcattgacacagcaatagttaacataaaaacaatttagcgataaattgtggtctatcatgcatctgcaccatggagattctctgaatttagagaaaatttaagtccttttgtaggatatctgaataatactagcaatacaaattataatatacatttaatttttttttcgtcttgaacacaaatttaaacacggttattcataaaataggtatatcctgtttctttatcgttatattttgttttggcattaaagcattgatgttagttgcatttatggcatttattttttattcttaatataaactaacaatatatggaattgtattttcagacaagaaatgagttgaaattatccccagatatatattactgtgtgccaaatgataaacttggatgctgcactctccactcagttgctttgaataatcagaactatttattttttttggagaatggcttggatttatcacattttgaaggtttctgtttgactttggaagaatttctcgagaggaattcttttctgaagataaagcatattgttgggtcaaggaatgatgaggaatgtaattttgttcgaaatattgctaaggcaattattcgttccatgctgtcacaccttgttaacttgttctctttggggaaatgtttgaggatgggaacagaccttctgagaaggaggaaaattcttttaaaaggatctgatgtcaagttctttcaacttgaagtgattgcatatgaggaggatgaagcaataaataatgtgctgcaggttgttgagttggttaaaagttgttttgttggggaaatgataccggctgatctgcaaggtgatctacatgatttaaaggaaaatcctttgaagagacttgaatcagtgatagacagcagctcattaatgtcagctaaagagaagaaaggattattggtcaatttgcacactgaatataaaaccaatattagtccagctattagcgaagatgatcgtgatagtttatttaagcacatcccgtatttggactgctggatgaacagaacggaagacaatgagtatctaaagctcgttgctaatttggattcaaaaaaagtggctttgaaagttaacaaggttggaacggataagagaaaaccatctaaaaatggtatcttacagtttgattttatgaggaattccgatgttcatatacctgaaaaggcattaaag

SEQ ID NO: 47272 - DNA, 1831 bp, Oryza sativa
cccttgttcgatggcaaggaagggaggccgaagtatcctcggcgatgggtgattcttccaccattcctgtaaggagttggtgtcagcacgatggccacatgggattgaatctttggtctggtctcagtgttcggaagttgaagccttcagtgtaccacttctattctatgatctaaaatatctagtccacaatggaatccctcttagctattgttgaacttctctttgagtttgcattggccctgttgtaatggttaaatacaatacaagtttcatctgatatcagcttattgacttcttgtccatttgtccaagcagtagtaatgcgatcataatttcattttgacgcctggaattgctgtcctattctgtccttctcagctgaagcctgccattttcatgcttgacattgttgcctgttgtcctctgaaaaaccttaccagaagtcgtcgatttgattacaaagtatatactagcttcgtggtgtacattggtgctgtttcctttttcttgcttccctgggtgacagtcacatactcacatgcatattttgtaccaagaactttactcgtgagtttgtcatcagttatcactgttctggacgtgtttttaaggacatgtttggaacaaaggaacggagaacacatgaacaggaaaaacataggaacaagaaagagcgtaaagtggaaaaattacggaattgaaaacacatgtaactgtaaaatatgtggtgatgaaacatgagtgtttggatctaatcctaagcaaattcctaaaaaatcccatgttccaaactgggcctaaggaatcctgtacaaaattctcctatgtggacttcttgcagatcacctttttttttcttgcaaaaagactgaccgcattttgttttactctgaccgttagtctccatgagactatgactactgtaatttggccaaagaataatgagcagcagaatccaagttcatagtaacaactcaaacaattcttctcaaaatcatgttctgacctcatttttgtcgaaatgaagttgtgtaatcgaactgtgagctggagctcggccaatcaagtactacgatctcatccgagattcgttcagtgacctgcaaatattttaaagaggccgtatgtttcatatgaaatgtacgaagacctacagtcccagtagccggtttgaccacaagagttcatgctgaccatcactttcgtatgctctattttgttcaaaaattaagtaaactaaatcaatatggtgtcttgttgtcgccgatgatctgtagttgcatggtcagctagtacaagccacaagttgcagagcacagtaggtagtactagcaactggtaaccagtcaattgcaatgcttccagatagaatcatccggtcaattccaacttgttttggtagatttttctgcaccatttgaataaaaatagtcagtttcatctcaacaaatttacagccatttggtcgctacatgacagctggtcaattgcatttgatggagatctgtgagcacacgaatttagcagcagaattatcaactgggagatctgtttgtaactaaggaattttacctgaatttatcaaattcatgcaacaatcagggaaaaaaaagaggaaaaaaatccatatttcaaacgaggcttggaatctatcatgtattcagcaaatccaaagttgactttttactccaaagttggtagttgactttgtagttagtgctcaaaagatttaagtatttttactctgaagatgatgcagcatgcaggtctcaaattagtcatgataaagtgagacaattcttcatggcattgcagcgcagcaatccta

SEQ ID NO: 47273 - DNA, 1779 bp, Oryza sativa
tgtgacgatgaccatactaatttgtcaacagaagcaggtatgcatactactaaagtttcagaagacggaaggatttcagaagaacatacaacaacttcagatgacaaacaaattcattcatccgatgttctgaagtcaagagaaggtactttttgtgttcctcgtcccagtcaagaaattgaagctgagataaatctaagctgtgaacaagaaactgatagtccaatgtctgttcttgacatgaccttcccagatgatcctgctagtccagtgaaatatacaatcctggatggtgagatttccgtttagtagcagaaaacttacatacatacattagttttctataatttgaaaaaaaatacgatgtttagtttagagcctttgattttggagcttcagtgacctgtcactgtaagtgtctgaattaaatttacataaaggtagccagatcaagtatttttactttatgagttgcaggggacattaaaaagtccaatacagttcaatcattaaaaaaatcatttaattagcttttgtttcaagcttcagcttcaattttaaattgagtttttttttccttttccttttgcagattcgtcgttgaagccaagagtcctccatttaagtgataccgatgattcagctgatatggatctcaataccagcacttccatggaactttcaactgctggcctgggtcacaaaaatgttcaagaaagtgactctgatgaactaagctctctccaagcagatccaaagaatgaagatgggttgatctatgtgaagaatatattcatgaaatcaagcttccgcaatgaagtactatttgatgaatggtgctcacagaacattacagttctccaagaagaggattgccaacactacgaggctgctgccgctgcatttgatttcactgagatgtcagctgatcagctacttctgtctgacttgacaaatgaagtgttgctcgacatctacaagaaatattctgtttccaagtccttgctctcccggttttcgtcttttgatagaccgaaacctgtgggaaaccatgccctcaaggaattgtggtctaaagtaagctggcatctggatgaacagccacagtccagcatagaaattgacacaattttgtcgaatgatctatccaagaacgatcactgggtgaattttcagagagatgctgatcacttggggaacatgttggcagactttgtgtttgacaggcttctgacagagttcactcttcagcttgcaaagttttgagcctagctagtttttttattttgcccctaaaaattttgttggtttagctgttctatatggtggaatgctattatcctcatgtatatattaacattctttctgttctctccttgaagagaacaaggtttggaggggtggttgttacttgttagggcttaggaattcaattcatgtgctgaaaggttttgaaatttatatattgagtggggttgaaggagcaattgtttttgcaccagtttttggaatgcgtaatcttgtagaagtaatgctggaaaaaaaataccagtcaacaaatggtgaggagcaggaattcatgtatctatctgaaagtttcctagacttctatcatgtcaaaaactctgattctgcctaaaattccatgacagaagtgtaataataataatattataggtgcaaaatgcctcttactggcgctcatgagctcacaggctttgtgacaagtaatccaaatactaatggcccatttggatggcccaggatcctgggctggtc

SEQ ID NO: 47274 - DNA, 9571 bp, Oryza sativa
atttttaaaataagacggacaatcaaaattaaacgtaaatttatggtcgcacttaaaataacggtgggagtactaatcagtgggattcgcaaagtcaaaagtcaatgatggcattgtctcttctctatccgataatgacacgcccattttcatttgccgtggaggttcaggccatgtcctcttcagcttttcttatgcttaattttttaaaaaattattttaaatttaaaacaaagtgcggcgtgtccattctggccagcatagacaattatggacgtgtggattacacgtgttccaactcgctgcaatgaatatttgaactcttctcctctctttcttttcttttatttgtgcgtgagacattatccgtgatccatgcacgtcaaacacgaaaaaagtttcaaattggcaccagaatcagagaatcggtggacctgaaatttgtgccactacccttgcaagaacattgtctactgcatgtatgtttttcttatgatcgaagtgaaataaactggtattatgtgcaatatatcatcaggtattggaactaaaagaaaattcagacttttaatatattaacttgttgacttttgaacacgacgtttaaccgtccatcgtattaaaaagctataagtatcatttattttgctatgatttttttattatgaaatatactttaaacatgccatattatttttgcatatttaagtaagacaaataatgaaatgttatttttaaaagtcaatagttttaaacctgagaaaatatatgttagaataaaaaggattagaaaattttcgatgcaaaagatcagcagattgatatggagcttattttatttgtcacgattatctcttcctagttcccagcgagtggtggtgactaataacttcacaaaaatagagaaaacataaaataacaataatagcttttcagtaaacaaccattgatagagtagacatgaacctgctttatgcctacctacgaccttaccatccgggccatttccaggccattttcagtgttatcaagtgcttgacataatggcatggcccaacacatcaataagcaccatgaatttgtgatcttctgaatctcctctgtgctgcgagcgatgcggcgtggtattttgattcttccttgaacgtgcattatacacctctagcgcgccgaatgtatgatgacatattataaagaaatgcataaactttgtggaagaaatatataaagcacatgaatgatgagaatgaaatctatcccataatatagggcatattcggcaagctggttgcggctgcgcttttcggcactgtcggtgtcagctacgccgtttgcgcaaaacagacagccaaacatacccgtaatttatagttccaatattttctttctttagaaaatatttttcgataaagtttaaaaaatatttgctgaagtttaataggacatctacttttagataagccatgactaggctaggtgattgtgtacctgatctatcactaacttattagtatgtccacaagcacatatgtaaaagaatgtaaactttagtaccataaatgttataacatatattgtaaaccctacacatatcatcgccaggcacgtaaataaccctatgttggtatagttgttaataggttgatgcttgacaagtctattctcgttgatgtttttttttaattatactcattcaaaataaaatataattgatagttctgtgctgatttagtttagaaaaatatacacgaactcccaacaactcaacaaacaaacacgtacacaaccttctcaattctcactatgaactagaggccacaaaccagacgccaaactcgcggatcatacgtgatcacgccatgcatatgcgttcggttgtccgcgagcgacggacggacggttgagtcccgaagaatcgctcaatcaatgaggggcaaaaccgtaaactcactcacccccacaggaggtgacttcccccccttccccaaatcgacgatttgttcacggcaggtctcccgatgcgtgccacgtgtacggcggatggcctccctccctctctataagtagcaaccctctccgcccccctccctgcgtgtggttcaggtgctgaaggtgatattcagattttcagagtgagtgctcgtgtgttgtgcgatcagtgcccgcagttcgatcgatccgtgttgatctttgaaagaaagatgtcgtgctgcggaggaaactgcggctgcggatccggctgccagtgcggcagcggctgcggagggtaagatccgatcaccatcttctgaatttctgttcttgatctgtcatgtataataactgtctagtcttggtgttggtgagatggaaattcggtggatctcggaagggatattgttcgtttgctggggttttttttgtgtgttgtgatccgtaatgaatttgtgtttatccatgttgttgatcttggtatgtattcatgacatattgacatgcatgtgttgtatgtgtcatatgtgtgcctctccttgggatttgttttggataatagaacatgttatggactcaatagtctgtgaacaaatctttttttagatggtggccaaatctgatgatgatctttcttgagaggaaaaagttcatgatagaaaaatcttttttgagatggtggcttaatgtgatgatgatcttacttgagaggaaaaaaaagattcattataggagattttgatttagctcctttccaccgttattaaatgaggagcatgcatgctgatggctgataaggatctgattttttttatcccctcttctttgaacagacaagaaataggctctgaatttctgattgattatttgtacatgcagatgcaagatgtacccggagatggctgaggaggtgaccactacccagactgtcatcatgggtgttgcaccttccaaggggtatgtgcactaatcctttccttctccatgtcatgtacttgtgattcattggcaaaatccatgtgttactgaatttgtagaatagtatagggagagggaaatattgtgattatcgacaccattgtaatacaatgagtctcagggggcagtatatataggagtacagtgtagagataagaaaagattatagatatgaaagaagtccatgtaaatcaatcttatcctactctaactatcatatactctaatagaacagaattgagtacctccatctttctagctaccaacctcttttgtcaattgtcatatgtttcctgccttttttttttccttctgagtcacaaagaacaaaacattttgtcgagagtcaagaggctcactgccttccattttacgtgtacgtatgacaaaattgcagcgctagctacagcgtaaggaaaacgactaaaaacttcatgcacgttatgacaaaaactctcccctttatctgaagaaaacgatgatgccttttactctgaaaattgcgtagcaacaatccaagattgtttcatgtttcgctgagttctaattaattactgatctatggttggctgattctctgatggatgcagtcatgccgaggggttggaggccggcgccgccgccggagcaggagcagagaacgggtgcaagtgcggcgacaactgcacctgcaacccctgcaactgcggcaagtgaagcaagcaacctcctgacgaaaccaaggagatggaagggcctagtactgctaagctagtagtttgatccagttacaagtgatgagttgttgtcactgtaactttgtgtttcctctgagtttgtgatctaagacctgagactgaagaaatgcatcctagttaaataagtgctaagaataaagatgttttgagacatctatggcgtgtgtacgatgatgtagtccttcctctccagtcttgtggtgtgtacgtaattaagaatgcagtgctgtgtcatgtggtatgctttctatctagtgaaactgaactagtgagttggtatactaattttgcttgtttgcttgaatgttgctttaatgtgacttgtgtcactggatgtttatcttgcttacttggatgttgctggctacacgaacttcatctgaagtttcatgctggtaaagaatctagctttgagcctgcttggactatacagtacaaaatgggctgagcctatggatttgtgtactacatgtctacatcgtgtttacttatggacctcagtgggctggttaattccttcatgttcctcgaaatgcaatccatatgttcagagcttgaaaaaaagttcacttcttgtccctcagttatggatcgagtttcatctacatcacttagctgtaagacagctattaaaaccaacgcaaatctagtcctttgtgacggcgaagtggctccctgttcagtcaaatctccttccagatatgcacggcacgaatgctcggcagagtcccaacaccaaagctcgagctcgccgtctctgagaggtcgcggcgtcacaggaggtgctagcctcgttttttctttcaaaaaaaatcatattaattaattaattaaatttaaaataattaataattaattaatcatatattaataagtcatctacgttctaatcccccaacacaccttcttaatcatttagcattctagtcaagtcaattttttcctttcgtcgccacggtcgctgaaaaggaacactagtttgtcataagatattctcacggcatgttggcagtatttgtcacttttcctgaccgaccacttgcgtttggtggcatagtggaatgtacactgcttctaatagtccagcattagcaaatgtccggcactgataaaaatacttattacaaaatccgatagtaagctatgagataaatttattaaacataattaatttatcattaacaagcaaatatttactgtaattagacttaaaagattcgtctcataatttacacataatctatataattagtattttttttatatttaatacttcatatatttatccgaatgttcaaagtgacagagttaaaatttttattttgagaactaaaccgggcgggccctagtgcaactgagaaccagtcccaaccaggtcaacaaagtcaggtgaaatcttccaaaagaagaaaaagaaaaatgtactggtactggtgatcagcaggaaacagagatatgctagtatctccatttaactaaaatagctagtcgtgttaactaaactctgctccaagaacgctccctcaaaccgaaccaagaatccacatggcgatacgtcggatgaggcttgcattgtccctcctctgcgtcctgatgacgatcggcaccggcacggcaagcgatgagccggcgctgcttgctctcaaggcagggctcagcgggagcagctcaagcgcgctcgcctcatggaacaccagcgccagcttctgcggctgggagggcgtgacatgcagccaccggtggccgacgagggtggcggcgctggacctgccgtcgagcaacctcaccggcacgctcccgccggccgtcgggaacctcaccttcctacggcggctcaacctgagctccaaccagctgcacggcgagatacctccggccgtcggccggctccggcgtctcctggtcctcgatatggaccacaactccatctcaggtgtgatccctgctaatctgagctcctgcatcagcttgacaatcctgcggatccagtccaacccgcagcttggcgggcgaattcctccggagctcggtaacacgctgccacggctcaagaagcttcagctcaggaagaacagcttaacagggaagatcccggcctcgctagccaacctttcgtcgttgcagcacttgtctctgagttacaacaagcttgagggtctcatccctccaggcctcggcgatatcgcaggtctgcgttatctttttctcaatgcaaacaacctttccggcgaacttccgctatctctgtacaatttgtcgtcgctgatgatgctccaggttggcaataacatgctgcatggcagcatcccttctgacattggtcgcatgcttcccggtatacaagtgtttggattggatgttaaccggtttacaggagtcatccctcattctctctccaatctttcaacactcacggatctgtacctctcagacaacaaattcaccggatttgtgcctcccaacttggggaggttgcaatatcttcagtatttgtatttggtaggaaatcaacttgaggcagataacaccaagggctgggaatttccacttcactgtcaaactgcagccagctgcaagaatttgtcctcgctaacaactctttcagtgggcagctgccaaggccaattgggaacctgtcaacgacgctacaaatgctcaatttagataacaacaatatctcggggagcatacctgaggacattggcaatctggtaggcttgagctttctcgatctggggttcaattccatattatctggagtgattcctgaaagcatcgggaagctaacaaacttggttgaaatttccctgtacaataccagcctgtcaggcctcataccggcatctgttggaaatcttacaaatttgaataggatatacgcattctactgcaatttggaaggcccaatcccaccaagccttggggatctaaaaaaactgtttgttctagatttgtcatacaaccatctaaatggttcgatccccaaagaaatttttgagctgcagtcactctcgtggttcttggacttgtcatataattctctgtcaggaccccttccatcagaagttggtagcttggttaacctaaatggaatggatctatccggaaaccagctatctggacaaatacctgacagtataggaaattgtgaagtgatggaagccctctatctagaagagaactcatttgaaggaggaataccacaatctctgagcaacctaaaagggctcaccatactgaacctaaccatgaataagttatctggcaggatccccaacaccattgctaggattcccaatctgcaacagctgtttctagcacacaacaatttttcaggaccaatcccagcaactctacaaaatttgacaacgctgtggcaattagatgtgtccttcaacaaattgcaaggggaagttccagttaagggtgttttcagaaacctgacttttgcatcggttgtggggaataacttgtgcggtggaataccccagcttcacttggctccatgtcccattctcaatgtaagcaagaacagaaaccagcatctgaagtctcttgcaatagctctgccaacaacgggtgcaatattggtgttagtttctgctattgtagttattctgttacaccaaaggaagttcaaacaaagacaaaatagacaagcaacatccctggttattgaggaacagtatcaaagggtttcatattatgcattatcaagaggaagtaatgaattttcagaagccaacctgcttggcaaaggaagatatggttctgtttttagatgtactttagacgatgagagtgcacttgttgctgtaaaagtgttcgaccttcaacaatcaggatcttcaaaaagctttgaggctgaatgtgaggctctgagaagagtacgccaccgttgtctcataaagatcatcacttgttgctcaagtattggtccacagggtcaagagttcaaggcattggtttttgagttcatgcccaatggtagcttggatggttggattcatcccaagtcaagcaatctcactcctagcaatacactcagcctttcacagagactcaacattgctgttgatatctttgatgcactggattatcttcacaatcactgccagccaccaatcatacactgtgatctgaaacctagtaatattcttctatcagaagacaagagtgctaaggttggagattttggcatatcaagaatcctcccgaaaagtagtactaaaactcttcaaagttcgaaaagctcaattggaatcagaggttccattggttatattgcaccaggtagatttttttttttaaaaaaaaactgaacttcttacattaattcccataatccctccccctcctccctcatgggtgtggattggagtactggggcactttgtatttgttttacatgtggagggtacggttgacaactaactttgattgcaaacattgcagagtatggggaagggtctacaataaccagagcaggcgatacttacagcttaggcatattgttgcttgagatgtttactggaaggagccctactgatgacattttcagggattcaatggatctgcacaagtttgttgcagcttcttttcttcaccaacccctagacatagctgatccaacaatctggcttcatgaagaagaaaatgttgcagatgttaaaaatgaaagcataaaaacaagaattattcaacagtgcttggtgtctgttcttaggctcggcatatcatgctcaaagcaacaacccagagagcgaatgatgttggcagaagctgtatcagagatgcatgcaaccagagatgaatatctcaggtcttggatggtcggccatgaagaacatagcactgtgagctaaacgttgggcaagatacatatgtagacagtgttgatgattgtaccaggaataattggaggaacacaaggttgcgtagttaatattcattaagcttagatgcatgccactgtaaagatgtaaacagaatgtagttaacttcaattcagcatggaatgtttaatgcaaacaagcccaacagaaattcaggatgctcttgcagtagaaccttcgaaaaaaattatacacctcaaacaacctcactggacaaagaaccaaaggataacattataagattctagagtccacaagagtttggtcatcatcttcacacatggcatatcctgcagagcaacaactccaacagcaagctttgataaaagatgcagcagtgtagtgcatacctcatgcttgccagttagcttacaagctaatcaagaacaaagagagagccttccttagaccttcggaacataaggccccctttgattcaaaggaaatttataggaaacaggctagtgtagcagcatcctgaaatagcaagcaaaatacttacggtgtttcagttactatttccaattaaacttctttgaaagttgaaacagtacagtactaaggtaaagcaaaacttacttcagatgtcaaagttatcagctaaaatagaacggtgatggccaagctgtcatactatatagtactaactaattcacacaactcttcttttgtttcaaacgcaaagatcaaaaaccaaaattgccatcaggctaaaaaaatattggactccatccagaaagtgcccttagatgaaacctactcgtacttataaattacatgggccaataagcacagtatcacactccaaacatccatgctccagaaatcaaattcctgtggcatacaaaggagtttgcaagacaatgcaaatggcaacagcatactcacaggatgtaattgcgcaaaattagatagattaattccaacaagctcagggcaaccaaacataacataagactacagactatagtttcccaaaagcatgcccag

SEQ ID NO: 47275 - DNA, 1890 bp, Oryza sativa
tcttgcgtaggtaatcaaccatcatattttttttcttttctgacttgattatgtgcaacgcgactgatgcgaatgggatgagttcctttcgatgttttctctaagctctgaaacttggactttgcaacaaatggttggggcgcagatgagctgtttgacgaaatgcccagtagattcctgcgtgcggttgcatgcccagcaccggccagcacctgtttgactctattttttccttcggtctgctgtctgcactctggtgatctaatgtatcattttctctgaaccttgttttacccaaccttaatgccaatataaatatattttttttgttgcatattcctgaaaaaaagagaactctgctccagtgcttccaggcttcttaggtggtaaacaggaaaagaaagtaaagcaccaagtggctcctttgctgcaataaaatcaaattattattgtcaaggggatgaaaggaaaagaatacacagcctggaagagctttcaacttgaatcgccttgcaattttgtaacactacttgccctttttcacattgcatcatcgttgaaacatttagatttgaatacaaaaatctttatgggcagattctgcctcaaaaagtactttcatactattttaatttttttttcaggtttttcagacgttttgcaatagagaatgtcaatgtctgttgggacaaaggcagttggtggcaagaaagggaggagaatctataacagctctcctctgcaatctgcattgccctctccgttctcatcaggctttagccacactgcttcaatatctctttccatcttccgtatttaagtgatctgcagctctgtgagatatctgttctgggatctgcagtttcaagcatctcccattggagagatccagcgggaatcccggttctagcactatgggcacagttttggatgctctcgcttggaaattcttggaaaagctgggtcagcttattgaggatgaggttatcatgacattaagtgtgaaaaggggtattgagagcctgaagaaaaatctggaattcttcaacgctgttcgtgaggatgctgaggctctggccatggaggatccagggatagattcatggtggaagaacatgagagatgttatgtttgatgtcgatgacatcgtagatcttttcatggttcattcacagaagctcttgctgccaccaaggccggtatgttgcaatcagcccttgttctctagctttgcaaagttttcatttgatcacatgattgccaaaagaattgataatataaatgaaaagtttgaagaaattaaaatgaacaaagagatgtttggcttggagagaaccaacgggcaacaaatccagataacaattgttgacagaagtcagacatctcctgtagatgaacttgaggtggttggagaagatatcagaagggctattgatgacatcgtcaaaatgattgttagtagtaactacaatgaaagcaggtcaactgtttttgggatccaggggatgggaggcatcggtaagacaacattagctcaaaagatatacaatgaacagaggataagggagaaattccaagttcatatatggttgtgcatttctcagaattacacagagaccagtttgttaaaacaggcaatcagaatggctggaggaatttgtgatcagctggagactaagactgagcttctaccgcttctagtggacactattagagggaagagtgtttttcttgtgctggatgatgtttggaaatctgatgtatggattgatcttcttcgtttgcctttcttgagaggtttgaattctcatatccttgtgacctcaagaaacctggatgttttggttgaaatgcatgcaacttatacccacaaggtaaacaaaatgaatg

SEQ ID NO: 47276 - DNA, 1413 bp, Oryza sativa
tgcttctttttacaatgcaagtgatctaggaattactactacaacatagtgtatcttctagtttttacaacaatatgttgacacgccaatccactacgccattgttattgaatgagaacttcttatgttgaaagacatgattcactctttgtggaaaagtaaaaaactatgtatcaatattgaaaatttcttgggatcccccagtacatgccccttgggcctatttataggcttagtgcaggctcatgtgccctagggttactaagtacatgggaatttacatgattacccttacaatagggacatttatgaggataattatagacaatttatccttgggcctcttcttgggccgccaagtgggcctccattggttggttggccccctcgggccttgaatccctcggcttgggggcgaaggtcttcggcttcgctcgacgatttgcccagagcctctgtctttgtgacatttggcgttttgctgtcgtgcttcgtcctagcgattgtagacttgtttcggcaggctcggttgaaggccctcgtgacatgcctccaacagccatgctacgcaccatatcaatttttaagtacaggaacaatcattcattcatatgatgcataagaaattaacagttatgtgactttgaagaccatcaagagcttgatcgggatctgagccaataaaagcattgtggacatctaaaagcttgaggcaaaaattttggccaacctaaaagcagttcatatgtttgatcaagtttaggaatgtaccttgagtgctttatgtttagcgatgcattgataaaataataaagatcaggcataggggtgtaagtgggtgttacgaaaaatccgcgctttgctaatggtgccagaattgtattggcgcgaactaagtcacgaacataacggccctaggagatctgtttagctctagtgcaggtccaaagcttgtagagatgcgggcatgccagtcagtttgatcctgcaactaactagatatataaatatgttgatcaccaaagagctgatcggctgacgagtcgatcgagcgatactagccgatgccgatagcaaccgatgtcgatagagttttgagcaatcgactatatgtccaatgtagagtctgatacttgagtaaataatgatataaagataattggctgatgataatgtaataaaacaacaatataatccaataaaaaccaatcggctaacaatgatatgatagaataagtgacccgatggttaaagcatacatcggctagtggtatgatgtcattaattaaatccaaatgattagataaacagtgaaatctttgttacaatctgctaaaaacaacttgtatgcaatctttgtaagccgatacaacgtctagataactcattggctgaatcctcgatgaaaccctt

SEQ ID NO: 47277 - DNA, 711 bp, Oryza sativa
ctgcagcccctaacaaggtttgtcccaaaatatagcaacttctccactaacattcacttcccaaccaatcacttttcctaccaagctccacttctcaaccaatcacaaactcttcctatttagttctacttattttcttaataaccgatgtccaactctaaaacttcttatattctgggacggagggagtacttgattatttctggtgatcatgattgctacttatggttctagtggttgtgtcttttatcatgtccccctccttgactatattttgctgtggtgatgacattaaactagttacattttttccctttctagttgtggaagtgaaaccatttgaagatgcttcttttaatcctgtagaggatgagaggaaatattatctattgaaggtttgagattcacacatcacctcttcaatcttcttgttgcttttgcatattttttcttacttctgtttatgcttgttttgggttgcaggtcttttcaactgcgattcctaaagaagaaattgatgtacatgttcgatctaacaaggaagttaaaaggcttggggttatttcatcttatgacacttcattctcctgtaaattggactttgaagaccagtttactctatcacatacttcacaagaagaggatgtggtattctatggatacacacttcgtcacgtacaatatcctttcttttacctttattatcataat

SEQ ID NO: 47278 - DNA, 1330 bp, Oryza sativa
cttgcaaaagtgggaagggtctcccaaaatagctcagtgtgcaatttaggcagcaaagacagttcttcagtcggtggattgcaccacctgctgcctggttaattcttcagtgcctgaaagctattgaaggttggctggcaccaggtatagctctgaggggcaagttatctttccttgatgcgagcagtagtgatcctcacaattttatggctttgcttgaggagcctttgacttctaacaaaggcaaaccaaatataaatattgctgaagtgaatgccaagataaatgaagaaccccgaccaggtgatattgcagatattcctgagtcatttagttcctctgttcaagatccggacaatctgatgctaattgatcaaatagggttgcctcatcctagtaacatggcaggcaaaagaaagatgcacgaaagtagcaatgcagcagatacacaattgcaccctgagaatgccatttcttatactatgactgacggcagccttttgtatgcccaccctgattctagaattgaggaactaggtataatcaacacagtaggctggcctcatgttgttttcgatgtcagctcacaagaaacatcatttcatatccctttgcatcgtatgctttctttcctattgcggaaggcaatggggaaatgttttggagaggatgtcaaacctgggcattgttcagttgtccagaccaatgagtttttttctcaggtacttagaggctgtgaaccctatgggtttgcgtcaattgtgatggagcatccattacgactaagagtattttgcgcacaagtgcgtgctggaatgtggcgtaagaatggtgatgcagctatactgagtgctgagtggtaccgctctgtgcaatggtaatttcatcgtgaccttaagtgagtttgttgtgttcaattaatagtcctgaaggtaataatgttactcgtctttccaggcttgaacagggtttggagtctgatctgtttcttcttcaatgctgtgctgcactatcttctcctgagctttttgttaagaccattcaggagagatttggactgtcaaattatacgtctttggatcttgcggaacagaatgagtaagtcacaggttgctttatcatgacagataaacttctatttctgtcatgtgttgtttttcgtaccacatgtagctacaatttagtttttggggttattacaatcacctttatttgtgtcgcaatcaagcacagctataatgatcaagaagttgaaaatgaacctgcacctatagttactttcttgttctccctcttgttttctcttttgattttgcagaatgttatatct

SEQ ID NO: 47279 - DNA, 6266 bp, Oryza sativa
aacggatggataagagaacatttatgaatgtctgcatccaacatggctgttgcaacgctcttggtctgtttttcaacgatgcagcgcactggcgacagaagacaaatacaagctactttgagaacgggaaaaagaacatatacaatgaaaactttattcttatgcgatccaagatagaccatttgtaatcaactttagacgagcaattttacagtacttaagaaggtaccataagatatcaccttttctattgtaaatttggtacctcacaatacctaggtactaataggtactatgaggtaccaaattttacataaaaattttggtacctcatggtaccttatcagggactataaaaatgctcacttcataaacatatatttatactagtcgatagcctgcgttttgctgcgggatatgtttaaataatgcaaaaaaatgatgtggagataatgatttgacattgcttctttattaagttagttttaaaaatacaacaaaactgcaaatgatatgttatgtttgtatgatatttaaaatattctaaataataattgctatagtgggtaatgatgtgatatattttagctttaaaagtcggtgggcatcaactatatagatattacagatatgtctccgtttgtgcatattcaacatatttgtcaacccaaatattagtatattaagaggtacagaaaataccgctagctgtagcctatagtactactacaggatagcgccactcaaaactgaaaattttcaatttgaaaaacattttcaaattttgatttgaaaataggcaaggaaatctataaatatggtgcttcttcccaagcgagcctaatttgccacaattgcatggaaaaaccttctttccagttgagccgcttaactccgtcatgttagggcggccacctgggataatcattttccttacgtggttgggtggccagccttcaataattaccaaacatttctcatagacatctgcgagccgcctaaccgctttgaaaaactgattttagctgtccgctatctgcagaaatcttttccataaatcttttctatggtagtggcttaaacaaatctctaatattataaaaattgaagatgtttttgccggtattttggtacgtcgttcttgtttgagtcggtttttaatttcgctcacttttaaaaatatagattaatgtttgagtcagtttttatatttgttcgcttttgtaaatacaaaaggagtcgtataagaaatatttaaaaaaaaactcatatgctaacttgagatgaaagtcggactcctaattgcagctcatgattttctttaaaaaaatcaagtgaatttctagagtaaattttatcttagctaaaccgtataacaataataagattaaaatatctttcaccagttgcaatgcacgggcattttttctagtaaggatgatgtggcacaatgtgagagctggtaatgggttagagatgaaccctgagctcctttcgataagctcatggctttgattggcatgatatttaggcgagttgatgataactataatttggaagaaacgttaacgacatgactacaaccgtacgagacattattgtgttgcgctttagtgatcaatatacctctccgcgagtttttaatcttgccggtgcagatcaaccttatttctgcaagcaaatcaaagaaacaagcaaaacaagataaaagcaatctggattacaaatagaaatttaatacaaataataagttgggtttccgtaacgagcaaaccggcgatctaaccaatcacaagattacatggcaaatagcgaagctaaactttaatataaacaatacccaagaaaccctgaagggtaccttgttatttaaggaggtgggaggaccgccaaggggtctctagggtcatactccaccaggttgggatgcacccacatgggctccacttgtgccagggttccaaattgaagttacaagcctataggctcatcataggtgatgtagcatattgtttttgtgatttcaactgactaagatggaatttggagatgatgctagattcattggaaagagaactctgagagctttgcatcatgtactcacaagttaaaaacgaagcttctatgtatatttggtggctgttcgaaatcaatattgttgtaggtgactgaactagattccgtaccttttacggcttgatctcgatatctttcagtaaccatggtcacattagttggatgcacttgtatccaaagaaaggatggcatgtttctaactcctagcacatgaatgtaattctagtttttgcagccacactgccactcaatggctagacccacaagatgacccggtcgcaatcacgctagacgcacccgagaaaatgacccggtcgcgatcacgccacacgaacccctcacctgccgcgatcatgccacacgaccacctgcagtcgtcctcgctgctccggttttaaatgttcgctctggagcctcttgtccgctgccgcggcctccctcgttctcccgttggtgagccggtgagtgtcccgggtttttactcccatcgcattgcacccaaaaatttttttttgtgctgctctctgctctcagattcatcacaatttactgttcgctcacagtttcaggtagctccagggggcctatctgccgcggccctcgtcgatctggccatcagtgagccggtgagtgtccccggtttccatttgtttgcctttcttgctgccattttcttttttggtcctgcatctcacattgtactgttcgctcccagtttcgtcaggcaagaaaagccttgtcagctgccgccggccggccggtcggcggatgagacggtgagagagcctctcctccatccccagaccccagtgccgtccaattgcctatatctaatacttgtcgactttgttttcattccaggtgtatgcattccggcgttgcaacggaaacccgtatggaagctcgcggtggactgaaacttaacaggtacatcattcgtcccaaaatatagctatttttagcacagtattttatactaaaataaagttatttctccactttcctcatcctttcaaccaatcacaaccatttttctccacctattttttcttttcaaccaatcacacacttcttcaaatcattctcatctaatttcttaacctgtaccaatcttaaaaatagttacattttaggacggaggagcttcgttaaaaaaaatgtataggtaattaatgtttacattgctgttattaccgcagaaggatcacaacgacacttttcatatttgaaccgatctttcgtcacaaattaacttttggtcttctaaaacattgcctcaacatccataaaaaattcccagttataaaaagaaagaatatgagctataaatttaattaaattcatcttaagcccatgttttcggtgattatataaaatgcttcagttagagttttaggggagcagctcattttgatttaatcagtttttgctaaacgaatgaaatggaccgattaatcgcgactatatatccactgtgccgcacgccgaactgcccgtatctaatacgtacttctctactttgttttcataccaggggtatgcatccccgcgttgcggcgaaagcatgtatggaagctcgccgcggactcaaacataacaggtaattaacgttaacattaattaattgctgtttatcacctcggtaggccgacttgttttgaactgatctttcgccacaaacttatataaaaatatatgaatcggcatttaaaattctaagcaaacagaaggagcaacacagtgataaaattcaaaataactgtatgtatgtatcgccagagggcagaatatactccgttttctaaatatttgatacagttgactttttttaatatgtttgactgtttatcttattcaaaaaaatttaagtaattattaattctttttctattatttgattcattgttgaatatgcttatatgtatacatatagttttacatattttataaaaaaaaaaataagacgaacggtcaaatatgtgctaaaatatcaatggtgtaaaatatttagaaacgaagggagtacattatattaggaaaccttgttttgtacttactagtggtttatggggtgatttataattattttcataagagcatgcatgtttaactccctagctagctacacagtcgtccacaacttttatagctggcctgctgcagcctgcccatattatttgtcctgcaaagcgaagagcagtcatcacgcatcagtagggtagatacatagattatgcatgtatacggtacgtgagttagcataggcagctagcttgccctactgttatgtactctactcgaccacctgcagctcgtcgaccccggcgcgcagcaacaggccacgggcaaaacgccagtgaacacagactgctgtgagattactctgcggcattttttttttccaacagctttgtctcattttactctgtgccatatactcacaccttctcattttaaatgcagcaatgattttctacacctaactttaaccgtccatcttatttaaaaatattttaaaaaaaattaaaaacataagtcacgagtaaagtgctattcatattttatcatctcataacaaaagtactaactataaaaaaatttcaaacaacacggacgatcaaaattgggcgcataaacttatggttacacttaaaatgcgacggagcgagtatataatagcccgttataactagttttattagtcgacaaactagctatttttccttaaaaaacaaattaactatattttttgttgcgtagtgtgtttatccatgcaatatatatagcctacacctttttagttaataatcaactatgagaccttgcttttgtgggaaaaaaaatactacattgttagcgcaagggaacggcaaagccatgtaatggtacagttcagtagtaaattgtcggactaacagtagatcagatcgaaagccatttaagtttgttaatttgttcacttttttattgttataatatatatttgctcccgcataacatttttaattccttgaatatatcgctaaccattttaccaagaatttgtaatgttttctgaaggagtaacacaaaagtgaaagaaatacgaaacaacatttgacaatttaatttggcttagcggtaaaatttgtaaagttttctgaagtaacacaaaagtgaaagaaatacgaaaaaaacatttgacaatttaatttggcttagcggtagattgtaactgatcttaagcatccctaatgttgtaattattttgtacatttacagaaacttaccagtattatatgttgagatttgcgtagggtaatgtttggtcaggtcttaagatattgaaaaaaatacgtatatagttaatccataaaagaaggatgtattcttttttttttaacttggacatgtttttattatttttgctccatataatattctactttagagtgttcttttaattgcatttcatgatagttttctaaagtgtgaaagaaatccatctttatattctccctactatctgcagatgcagtacctccacgagcttgaaagaaattattagcactaatttgttgatcctggtggcactatcatatctagttcatgctgtcagtgcgcaatcactagatgaaccattcaggtatatactgtatattaaatgcttttatattgtcaacgtgcataaacataagttatttttgaattgatcttcctttaattaaagtagtttagagtataaaatgaacttttcctttgttaaataaaaaattggattctaaaattaattatagtaagaagaaaactttatgcatttctctcatatataattaagagaataaattttaaaacgtttttaccttatgtttagacatttcaaaataatttatacctctaacattatattttatcctattatataatattaaaatggatttaaagaataattttattttcttttagtacagatgtgatttatttatacactttattactttcagttaagcaagtttcaaagactttttttaagttgtaggtaaaattttctgcaatttaattgacgggaagaaatgattatttgaaacaaataattatgtccaattgtactttcctattgtgttcttcatgcatttctagtgctagtactccctccgtctcataatataaggggattttgagttttttacttgtattgtttgaccactcgt

SEQ ID NO: 47280 - DNA, 851 bp, Oryza sativa
  unsure (1)..(851): unsure at all n locations
ttgagatataaagcgttgaaatacactttattggatgatgagctttactatcgaacgattgatggggtgttgctcaagtgtttgagtgccgatcaggctaaagttgcaatcggcgaagtccatgaaggaatttgtcgcactcatcaattggctcataagatgaagtggttgcttcgacgtgcggggtatttttggccgacaatgctggaggattgtttttgatattacaaatggtgtcaagattgtcagaagtttggggcaattcagcgagcgccagcatcggctatgaatcctattattaagccatggccattccgaggttggggaattgatatgatcggtatgataaatccaccatcgattaaaggatataagtttatgttggtagcgaccgattattttaccaagtgggtggaagcgattcctttgaacaaagttgattctggggatgcaatacagtttgttcaagagcatataatttaccgatttggtattcatcaaactattacaactgatcaaggttcaatcttcgtgtccaatgagtttgttcaatttgccaagagcatggacaacaaatcgttgaattcttcaccttattatgcacaagctaatgggcaggccgaggcgtctaacaagagcttgatcaaattaattaagcggaagatttctgattatcctcggcaatggcatactcggctggccaaagcattgtggtcctatcggatggcttgtcatggatcgatccaagtcccgccttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47281 - DNA, 2596 bp, Oryza sativa
tttatgaaatgacatacgacctcaaacaggatcagcaggcttcatttattgttagcttcattgactgtgcaaccaaagaatctgaatttcacttagggaccctgaaggttcttagaaatcaaacagataccgatcgagaagtgccatttggttggatcctacccagactaattgcccgtaaggggtccgttaccttggcttttaggaccgataacttatacttgatagggttcacagataaatatggaggttggtatagtttcaatgggtacaaagttttgatcccgggttccactgaattggaaattaatggaggatacggagagggtgggatgggtgggtttagaaaactggaagatctacccctaagcaggagacatgccttagatgctgtagatattctttgggattacgacccatctactacacccaaggaagtcctccaaaatgcaacagcaacactactgttagtaatccctgaatctgcaagatttaaagaagtgtttgagccggtcattgctgattgggacagtaatgagggcatcagcttaaaggaaaagattaaaagcataggactactgcataattggggtatgctttcaagtgtgggaatgatcggattaccatgggatagcagcgaagtgcagggctatgttaaaaaaatgagaaaagacgaagtttatataaatagcaaagaggatgcactccgacctcttaaggttttacttatgtcgaaagcaatgagaccaaaagaactcgtcatcaaaaggattaatgacccccagtcctagagtgtgatgtcaacaaacggtatgatcttcaacttttaatatgattggagtctaaaattaattttactctgctttgcattcgtaacaatagatccttggaagtaatgggtgctcatattttctttatgatcaaaatattagtaaatccctagaagtacatgcacctgtagtaggttgctaggatgcactcagaaattgtgtataacttctgtaaatcttgcacactcccaattactaaacttccataatacatgtactagatcgatcccagtcattataaaaatatttaaaataggtataacatatattcttagtttaatgtgtaccttttcttgtacaatgcagtgatgctttgaggaagtgatatttgctagaaggaccacaacaaattttagttgcagtacattggatggaactgtgtcgatatgtccagttttattgaattgaaataaatttggtgcactctagcaatgttagatttattgttgaaaataacaatcgtaggcgtatattatttacactgtggatcaattagcagttaggtaatgccaggttgagatgaattgctgttgtggtatgagtaaaggacgaaacactgagaaaattcattcagcacaaaggctgtgtttagatccaaagtttggatctaaacttcagtccttttctatcacatcaacctgtcatacacacgcaacttttcagtcacatcatcttcaatttcaaccaaaatataaactttgcgctgaactaaacacagccaaagtcctatttggattaatgcgtcagttgccacgtcttggcatgctagtactgctagttaattagtgtagtgctagtttgcttaatgcaaattagcctgcgccaaaaagttagccatcaacgaactgctttgccaaaaggtttctttgtcaaatgtgtgcgctcaaacaatattcgctagattaactagctagctgtgccccccgcgcgttgcgcgggcatatgatgaggcaaactgtaatatctcaagataagaaaagagcacatcacaagataacatgcaacactgttccacagtaatagctctgcatatcataagataagtgcaacaccgttccagggtaatagctcaagatcaaaaaggacatataacattgttctcaattttgagtgatgtaatcaaaccgttgaatagtctaacattagttgtctaaggacaagggacctaggctgtgtttggagcaatatgggttcctgacatgcatagtgcgcacggaaaatggagcggtccattagcgagtgattaattaagtatcagctaattttttttaaaatggatcaatatgattttttaagcaactttcgtatagaaatttttttacaaaaaaacataccgtttagcagtttaaaaagcgtgcgtgcagaaaacgaggcggaggagctgggaatcagtagttccgaacacacatccctaagagcaagtttaatagtatagccaactagtggctccaaatcatttatagttaatctaataatagccagttcatacaatagttaccaagcatatactacacaattaatatttggtcccacctatcatacacacatgcatcttggagtatgtactgcagctggctataaatctgtagcccactgctcttctttatcgtcttttattttctcgaaatatgtttatagctggtttataatatgttattgtacatactctaatatataagtgagggagcccttcacctcaatggctagcttttgaggtggcaaaggcatcttacgattctacagttggtattagagcctggctagtt

SEQ ID NO: 47282 - DNA, 3742 bp, Oryza sativa
aatatatttttataggtatatattttttatgtatacaaaaaatatacacatatgcatcctttgtatacgacatgtacaaattttgtacaaattttgtatatgatgtatacaaactttctatataacgtgtacaaactctctatacatacatattaaaaaattgaaaaaacaaaaaaaacatcatgtatattcgaatacaaatgtacaaactttatatacgacgtatataaagtttgtatatacgtcgtatacaaagtttgtatacacacatacaaactttttatatgtatacgtatatactaaaaaaaccaaaaagaaaaactggaaagaaaaaaaacgaatggaaaaccgcaaaaaacggaaagaaaaaaaccgaaatcagaaaaaaaaaccaatggaaaaaaccgcggctccaccccgacacgcgctgccgcgcggcccactctacgcgcgccttgtgccttgcagcgcgcgggggtggggggggggctgatcgcgttttagctggcgagacccgtatacctgagggactgtggtgaaacggtgaaatattgaatccttcagctactcgtagacccatccttttattgatgcggaattcagatagacaacctctttgtaatcaggggcggatccagcatggggggcggggtctcgagcccccactactggcgtgaagactatgagagactctacgaaaacctcactaaattttttgttaccatatttagatgggaggggagactgtaactctatttagtttgctcagaccctattgctatttctttctggatccgccactatttgtaagggtgaaatccaaggaattcaagatggtcaccatcattaagactgttgccttgattgtctacaatgttattatcatcatcagaataccattcgaaattatttccagccggtgattcaccattctgaagaatgaaaattagcgggatcatattcccaattgtataaatcccactcccctagaaacttttggctataaagataatagttaatatcccctaaaatccacggtccataaacttgtttgctatggttcagacaaagcatagggcttaaggttgttttggtgcttcaatacccacttaaactcgccacacgattcattaaggacccaaattgaaaggcaatagtcagttttaagtgatgcaaggtacatccctttctctgattttccaatgtaaatatatggtctgctcttgtaaatcccagtaggatttttgattacttggtagatcccattagatatactaggtgattccccgcgttttgctataggaattactaattaattttcaatattatttttcgttacaattgagctagtagcaaaaaagaaaaaaaacaaatcttaaggcttatcagtatttatcatgaaaaaaatgaaatttactctttaatgtataacatattgtaagtatgcttgcatgaattattgctagtggatgatgtggcatggttgtatgtcaagctttagagttagtgggttataactttatagaaagtatagatatggatatcctacgaaggaaaaacacaaagatctattatatagtaaaagttcattaaacttcctacaaacgctcctaagctactacatagtaccttaaaaacactcttaagccgccacatggcatttcaacaaattctaaaaaagacaaaatatctaaccgtcgattttcatttaatctgatggacccattattttcaaccattagatctatcttaaattaaaaaaatatcaattaaatttatcttcatcaatcctacgtacacatgcatgtaagcacaacacgtacgagaatgatacctagcgatcgatcgctaggggtcgctagggggcaatcagattctgattccctctctccacctggtttctttttagataccatattacttttctattttagtaaatttatgcaccctaaagtttgtacacctcaagtttacacattttcacaagcattttgtttattagaaaaatttatgtatagaaatactatatataaaaaatttgaatttaaattcaaatttaaatcaggtatgtaaacttttgacttataaactttgggtctataaactttagatgtatagaaatactatatatagaaaatatttgaattcaaatttaaatttgaatcagatataattcaaattcaaatttgaagcgggtctataaactttaggtttataaaatttaaatgcaaatttaaatcgggtatgtaaacttttgacttataaactttgggtctataatgtatagaaatactatatatagaaaatatttgaattcaaatttaaatttgaatcagatataattcaaattcaaatttaaaacgggtctataaactttagatttataaactttaggtgtataaactttaggtgtatagaaatactatatataaaaatatttgaattcaaattcaaatttgaatcggatatataaagttttgacttataaacttttggtctctaaactttagatgtgtaaacttgaggtatataaactttaggtgcataaatttactaaaatagaaaagtaatacggtgccaaaaaagtaaacaggtggaggaaaggagggggatcgatcgctacccctgtcgccgggcgatcgatagcccattaggcgtaccccaacaggtacgtatgtacgtaactagctggcctcatgtccctctttttctttcctttttctttctgaaataaaaaaataaatacaccgttaaaaaaccattagatctatcatgaaaaaacaattaaatttaagtctacaaatccctaaatacacgtgcacataaaaaccgtatgtaagtacgtaagcacaagcactttggcctcacaaccctctatttctttctttttatttctgaaatccaaacaaacataaatacaccataaaaaaattggattcagctcaaagctatatttaggatctaaaattaaaattctaggctcctttggattataggatgtaaaaacagtatgcaatttggattcctattgattcatcgctatattatcctttggtttccacaaatattagtaggaattacacgaatatgtcataacaattctgaaggaaaacaaatccatttcccaccgataccatgcaagaaacacacaaaaatttaagcccattaaacatcatcaaaacgctcctaaattatcatatgacatcctacgaacactcctaagccgctacatggaactttaataaattataaaaaaatcatataaaaattataataaaaaatgcttagttatctgttataacttaaatcggttgacccattattttcaactgttagatcaatcgttcaaaaacacaaaccccttccacctcacacctcccttatgtacataatcactcgtccctccccaacatccatatgtacaaagcatatatcttacgtacaacagtcaatgaaccctgagttctacaagacacttaaggtagttttttggtccgatctttcggtgagttgtggataactacaatttgagagaaatgttgacgatccgactacaaccgtacaagacgttgtgttgcgcctttgcgatcgatacacctctccgtgggttactgatcttgccggtacagatcaaccttattcctacaagcaaatcgaagaaacaagcaagaacaagataaagcaatctgaattgcagacaggaatgaatacacacgataagttggggtttcgaatacaagca

SEQ ID NO: 47283 - DNA, 9862 bp, Oryza sativa
ttagttggacatggaaaatcagtcttagcaaataatttctcctccaaattattgagctcacaaaaatcatcaaactgaacatagcccaaagtatttaaataagttatcaaattacgttcctcaacatcattagtaatgtgaacaacatgcttaaaatcagcacacaatgaaacagtagatatagcatgttcattcactagttgtggcatggatataagtgaagcattatcacacaactcttctttatcacaaggaacaacaaataaatcaacttgtgacaaaggcaaatcagcaattggttccactaatggttgctctattatagcatgaaaattgacacgtgtagctcagcttgagaatactcaccttcatttatctcagcaccaattagttgacgttgcaaactttcttcagactccgctggtgcaacatcctcttttttctcaagtacaccattctccttttgttgaatgttttgaactccctgcaaaacgttagtaacgggagagacaaaagattgctcctccaatgtttgcacatcatcattttgcacatcatcattgcataaggatataggagattcagaaataggagataaatcacattgttcatacttcctcccatttgatatgatccgactctcaatgctaccagcaagcatgaataggtgtccaatatgattatatgtcacattagcaagcaaaacctgaatttcagaattaagcccattgaaaaatatgcgcattgtattttcattgcactctttgagaccactgtagatgatacagacctcaaattcatgaatgtactccctaatagttctatcaccttgtttcagatgttctaatttctccgaagagtacatttgtaataagaagtcacaaagtgttttcgaatcatggttttgaattgatcccaagtttcaggtttattactcacataactccaccaaaagagagcagaagaggtaaacttattactagcagccttaaccatttgagcatcagaaaaatcatatttatcaaattcattgtctactgctagttcccaatcaatatatgcaacagaatcatacttcccatcgtaaaatagtaacttagattcaactcgtgcaaaattatagtcaggtacctcatatgcatcttgtggagaagtcgacatctctcgtcgatggtgaagaagccgatgttgagcatggccgtttcgtgtccccttgcgcaatcctgccatggttagtagcaaacaacaaacataaacaacaatatgcatggtcctatcaactactaggtagtggaagctccaatatcacatacactcaagctttttaccaagctcttacaagttcttaccaaagcaagcggaatggtgatgtacaccgactcaaccaagcacctcaatggaggttggatatatcgatgccttggcaaacaattgttgtacggctgcaatcaaatctgtggagctctgggtaggcttaaatatttagcaaaggatagcaattgcacaaatcagagaatgcaaagttgaataatcgtttaaagtcaagtaccgtgctagtcctaggctagaacgtactagagacgcaagcttagatacaaacgataccacaagataacaccagaaacaattgaagcacactctaatatatccaaattcagctcaaagatacaactgcttttttttatttctttcttcttcttcttttttcttcttcttgttttttttcttttttttctcctttttttgggtgcggctttttttttctctttttttagcacctttctgcctttttttttcgtttttctttaaaagaaaagactcaaggacctcaatgtaaggtcatagggactcaaatgtaaatataaaatatacagggactcaagtgtaaaagtccaaagtaaaattaaaaattatataaaaatggaatgctgaatttatacttgttccgtttctccaaacagatcttggaaccgacaccaaacaaaaattcaccaaggtgtttgacacaactcggaagaggcgaaaccgacttgagagggagggagtcggactcaggtaaagtgggcgacaagaggagatggcgccaaccggtcttcacgcgtgggggagggaatagactcggcccaagtggaaagtttggccttagatggaaactaaccaaccggattgatctaatatgcaaaacttcctctgaaaaccgatctgttatcctcttttctaccgatctgttatcttcttcctcacacacacatgccgttccatgcacacacatgcacggcacaaccaccgaacagaagcccttagatgcaactcaagaacttaaaaactaaccgacagaaacttctaaaaactacaaaaatagaaccgtggcagcgagctgattccattttcgtaaatcccgatgagagcaaacatacggcggcggcgatgatagtggtactaaacgtgactaaaaatcgaaactctaaacgaactagacgctaagaccagcaacacgacttgacgatgcaacacaaattcaacaaagcaaaaacggaaaagaacaatgcaatggcacaaatatagctaggtgatggatgtaactttttttttagctttttctggttataggtagataaaaactcaccgagcaacgaaaggtctgataccacatgatgaaccctgagttccactcgacactcaaggcagttgtttggcccgatctttcggtgagttatggataactacaatttgagagaaacattgacgatctgactacaaccgtacaagacgttgtgttgcgcctttgcgatcgatacacctctccgtgggttgctaatcttgccggtgcagatcaactttattcctacaagcaaatcgaagaaacaagcaagaacaagataaagcaatctgaattgcagacaggaatgaatacacacgataagttggggtttcgaatacaagcagacggacggtctagccgacacgcgcgctacaaaagtagcaatggttaaactttcatcaaaacaaaacccaattaaccctgaaagggtatctagctatttatggaggtgggaggaccctacgacgtcctccacctggttgaggcgtaccccacatgggccccacttgggccggggtcccagatgaagttacaagcccataggcccattacaggtgatgcagcaccttgttccctcaattgcgcatgtttgagaaggagtttggtggtgaggctggatactttggaaaaaggactccgagagctttccgtcaagtactaatgggtcgaaaacggatgtcgtatgcagattcggcggaagtttgaagtcagtagtgtagcaggtggccgaataggattccaacacttggaaaacttgatcttgatatcatcttgtttatccatgatgtgagcaacggttgtatccgtagtaaccatgggcacatcaacagtgttttaaataattcaattaggttaaaagtaaaaaaaaatgacacataagttgtttcgtagtaagtatgtctaaggaggaataagtttacattaatcactacctttcttataaataatggaggtatagttccaaccttttcatataaaaggttgtgtttctcaaatgtgctttcttgcgcactcattttaaaatatacaaataatcagtttgaaatatatattttatatttttataaataagaaaatacttagaacatgtgacaagtttttaatacacgcatattgttatgatgccagactcagtcgtcatatagaatataattacgattttagtctcttactgtctaaatatgtcactgattgttaggataactaatgctcaacatttaattttgaaaatatcaaacactcatattcaaaagaaaaagatatggttgtataattttatacgatattaacaaagtgcccgtagagtgagctataaatattaatcttggtggtttataaatatatacaatctagctactaaaaatttttttaggacaaagatcatatatttaaacattgtcaaataacatgttaagtaaaagtcactatatatccctacggcaataaaaacaataaaataaaaaataagatgtccatgcatgttttattccttcacatagcatcgagccaatcaagctgctaatgcaaagtttttttggttattatttatgcattgattgatgataatttgatctaggtgcgttagtaaattttcaattcctgtgttttctatgctccattgaaacattcgttcttttcaatactctactttacacatgtattattttcacacttttcaattttttttttcaatgctgtgttacaaaggaacctttaatttctttcaccgagagacaaagtcataacatttcataattgtaataacacaaattatgatagcttaaataagatgctcgcgcaaatgcgtgggctaccttcctagtttgtattaattaatatataaaaaacagaatacaactttaaggagttaactaagataaaatagaaatattaaggctagagttgaaacctaataacaaaatgtgatttcacatagagtgctcctcgccagtagacatgttgctcgaataaatatagcctctgagcgtcagccatggtccctgcaccatccccttatctaatgaatgatctctcctcccatcattccgttgctgatgagaagacatgaaggataagcggcgacggtggacattctgattccttcaagacgggatccatctttcaacgctgtaccgtccggtgttaacaaataagatcttaaacacctcgtagtgcggtgatacggtggggtcgaagacgatgcattctttgtcgaagaacccaaattatagctcgggttagtggcagggcaatagtggcaagctcacccacctccgagtggctgggttcaccacgaggagagagaaaagcaaaaggaggccgttacagtggcccatgatggtgggatttttttcacagaagtgctaaacatcagtcgactgaaaacctacctccaaatcttgcaaattttggttcactagatgtgcttcgtgattcatgctccagctgcttcttctccaactttgtcacacccagaaattcccgaatagatttccaaacagaatgtgcattaaaacccccgtctaggaccggctggggtacacaaatgacaaaattgacacacagattcacgtcttacaaacatcataaaagtcttacacaaatgcagcggaaaattgaaagataactggagctaagccttgacttggactgcagcgggaacaccactccacaggcatcctcgacggcacggatgaagcctactcctcggaaaagccaccatctgacgcgtactcaaactctggggttttgggggaaatagagcaagactgagtacaaccaccgtactcagcaagtcataccggaatagggggtatgatgcagggtattatcaaaggatagctagagtggttcatttgcatacgagcatttataaacagtagttgaaagcagtaaaaacagttgtaatagttactcaatattaaccatccactgtccaacgctacaccacgttgcaacaggcccaaccatccacctgagctaatcaattccattagactagactaaggtgagactaatcacggtgaatctagttgaccgcccagaacagcgggcacggctgttcgaatagttttactctgatcagaggtgtacaactgtacccacaagacacagccccacgacacgtttccgtgcgccgacatgccaccacgacataccggaaagaggccgtgacaggacccttcgcataaccccctctaatcaagcacaccatacctcaggtttcacccccgtccccagcgggcaacgggcagtcccctctcgtgcctaggtgaatccggaagcgacagaggccgtcgcagggcccgccccactccatcacgcccacccttgcctggatgcgtcagctagaggaaagctacactacaagcccagccgttgcccacgctggcttgtggtgagtacgaggaattcttccagggtttcccgcgaaccggtccttaagtgccatgggtgcgaccatcaaaaccatacacccacagcccaccatttagttaattttaattaaccaacaccggagcggtgacactaaaccaacatgaacactaaaacctgaagtctagtcattaatgtgattcccccattgtgtgctagttgaactaagcatggctaagcaatccctagtccaatatctagtcatgttatatcccaggctaacaaaggaacatggtacaaatatcatggcggtaacagtaggtaaacatcccatggtaacattataaaacaatgcaatatttaagggaaaacgatagagcatttgtaatataggttcaatatgttcaagtgacaagcatgacttgccttgctctgctgctggaggaaactcggcgactatttcaaagtacaccggagcgccggaagagccgcaatctaagcgacatacaaagcaaacaatacaaacaggccataagactactgaaacaaagaacaaaattatttttaatggattctttgcatttttcttgatttactgagacttgaatgggcttaaacagagctcggatgaattttctatgaattttagaagattcactaagtttttactataaacagaaaaacccttaaatgatttattgtgcaataaataaaccctgggagagagagggggcggcgccgacatgcgggccccacatggcagtgactcgggtggcggtccgcggtggaccggttcgacggaccgggaaaggggcggcgcaccacgtggagctaacgtggcaccgatgcaggggccacgcggcagccacgcgggcggccgaacggacggccccgatcgacccggggtggatcggacggcagaggggtggcacgtggccggcgcacacgggtggctcaagccggcccggcggccacggcgcgcggcgacgtggcattgacgcagcggtggcgcaaggcggcgaccggctggcggtggagggcggcggcgcggcggctaagcggcgcgcgagagagagagatggagaggaggatgggcctcaccgaagaatattgacgacggcgagcgacggagggcgatggcgacggcgggacgagctccgggatcacctaagggaacaaaaagggaggagttagagagggggagagaaaccatggatggctagggtgccggccatggcgaagctcaccggcgtgcggtgcgaacggggttcctgcggcggaaaacggcgacggagaggcggacggcgtggccctcgggctcgtgaacccgaccgtgacgatggcgcggctcgccatggcggctagcggagtagcggcggcggcggcggagtggagggcgatggcgctagggcgatggagggcacggggagctcggcgaaatggagaaaaagagagaggggagggcggtgatgcttaaatgggggagagggggctcggacgtggctgggagcggcccgatttcgctggccgacgtggggaggtggaggtggagagagaggcgggatttgaaaatcgaatcccggccgtctcgagcgcggacgcgggcgggagagagagggagtgggtacaggagacgaggggaaggcggcgacgtgggcgacgtggctccgggaggcgagagcggcggttgcgggacgcagcggcgccagccagaggtgggagacgggcccgacaggtggggcccacctgtcggtgaccctaggggagaggggcgtggggcagccggcttagctgggccgtggccttcggccggcccagtggggagggggagggggaggggaagagaatgggccggcggcccattcgaaaagaaaaagaaaaaaagaaaaaaagaaaaagaatttctagggattaaatattgcttgtgctcatttttaattggttaaaattatttctagatctccaaaaattccattaaaaatcttgttagcatatttcgacatgtagaactcaagaaaaattccacatgccaattccgattattatttacattactttctttagggtttctctcttgcttttacaccgatattttgttgagaccatttataaattccatttaggcttgggataagaacttcagggtgtgacaaacctatcccccttaaacggaatctcaaccccgagattcggaagagctggcgaagaggtgcagatgggcggccttcaactcgtcctccctttcccaggttgcttcttcctctaagtggtggctccactgaaccctgcagaacctggtaaccttatttctggttctcctttcactggtctcaagaatacgaactggcttctccacataagtgtggacccccatttttataacaggaatcaattgtgtaaacagtaccatttccctggatcaagtagtctggtacacacgaattcatagctaaaataccaagtgcacatacacgagtgtctagtacgaattattacatcataagcccgcaggcatagttttaaatcatcgaaccgagcggtccagaatacatcccaaaaatagaagtagataaggcagcggagttaaggcagcggcacgccattgccacaggcaacgaccgtaactaagacctactgagcgccatcgtcttcatcaccctcctggtagtaagcgtaggggtccaccgaagcttcatctccgacctctgattaagtttgtatattgcaagggtgagtaccaaccgtacccagcaagccaccacagcaacaacacacatgataaagggtattcaaggaatggctatggttcttttgcacaaagcaagttttgtaattcttttcacaagcctaagacctagcatagactgatcaagttttaataccagtgttcgcattagacaacgacggttctatccaccatccattgtgatcccaaggatagcttcccgccattgaatcgtcatggttttctgaggacgtccaccttcccgcctctcaggaagtggctccatcagtatagaaatcattatgcaatatcccatcccatacaagttaagaatttagagtctagccaagtgtaatacatgtcccggtgcttaataaccgcgagcacggctattcgaatagatttggtttactcacactgcagtggatatacactttacccgcactccacgattgcccaacacatgagcctcatcccaacacatgagactcgtcacggcaaagcttttcgataaccttgcattggcagtacccgctccatgaacttaaatcctcatgcactctaggcgtccatgtttctagcagtgagaggagttctggcgctcccgggaaagagaagtctcacacacatattaaattatggttcaagttaagttctctctcacacacactcatggcagtcctaccaatggcgacaccgatgtagggcacgcctctcggccctacctcaacggctgtcccaccgtagcgcacctgcctcactcggggtgaaccatctatgcagggatactgcctccgctgtcacgtcgcaaaacgactctaaaatacatcctctaaattatgcctagaataattaaaatccgtgtgaaagcctccaacaattaaaatgtggaaagttaaaagtcaaataaggcttggaggatttttgtatatttcctaaaagcctaaaatgcgtaaataaattttagtggaatttttagagcacaaataataattattaagaaataaacaaagttaaaatgattttataaaaagaaaaactctaaaaagtcccctttccctgcctctcccacttgggccggctcggcccatctccctccccctccctctcctctccccgcggcccatccggcctctccccgcgcgcgcgccgctgacggg

SEQ ID NO: 47284 - DNA, 12803 bp, Oryza sativa
ctaatcccgccggcgccattgatggagcccgagagcgccgcgccggttttcttcccctccggccgccctctcccccttccaacccaatataaaccctccccgcacctcctccgttcgtttccgcctctcgccgcccttcctcctcgccggaatcgagctcgcgccgtcgctctctctctccgccgtcgccgccgagctccagtccgccgccatcgtcgccccggaccacctcccacctcggcgccgcctccttcggcttcgccgcatcctcgccgacctcgtccacccctccgtttcgctcgtcgaccgtcggagcgccgccgtccccgtctacccgagccgcgccgccgccttcctccgctccggccgccttttcgtcgtcgccgtcgacctagggtgagccgtggaccgccgcctcgtttccccctttccctcccttctctcggccgccgctccgccgtgcctatggccgccgccggcgaccataggggcgcgggcgcgccgcctcccgccggccgcgccgccgtggccgccttcgggcgcaccgagcggctgccgcgtggggcccggccgtcagccgccggcgccctcgggtgcggctgacgcgtggggcccacggcgccggccggtgtgagcccgggtgcacccggttcaccgtggaccgtgaggctgccgtgtgggccccactcccgtggacccggtccgcgcgccccctcccctcggctgacgcaataaacttttgtttaaattaaaatttaaatgaagaaattcgcaaatattcacttaaagagcatataaacttcaaatagccataacttggccatttgaactcggaattggaccgttcaagtctctaattttttcttaagaagtcaagaacccatttttgtgctttgttcctgcttgttatatggagtttattagagtaaaagccttttcttttccgttggtcgtgtagacgctgcagcttcggaagatccgctcttcgtgaaagttgaagccgacggttgggaaagcgagcaaggcaagtcacatcatccttgaacatattgaatcccagtttataaaattatgttgatttaaattattgcattatcgctttgttcaccctagaataaacaaaaccccaactagtggacactctactaatggtaccactagtataattttagatagatgcttcgccgcttaattaggcaacattaggtggttttacaactctagactttgggatattcatatcacctggacactatggaatggttggattattgtgtaattggattcacacctccccatctattcaaaatcctcaaaatggttttaggctggtctcggggtgcatggttttgatagtagcacctcggccataaaggaccggtcttcgggcctctgttgcaaagcactaccgtagttccacatgtctagtgggtaaggcttagtttgtggctcagtctggttataaacaaaagtacacggatggagatggacgaagtcgggggtcgatggacatctctaggataaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtctgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaaccttcttaacaactaaaatgtggaatggttgccctaggttggcttggaacgagctgggacccagggtcgggttgtcagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttctactcagtcttgctcaatttttcccaaacccagaaaaggagcccctggaagatgaaggctttggtgtctagctcgtgcctgccatcaagcgcctgtggtcgtcgccctagtcttccgctgtttctcatttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacatccgctcggctatctaatccgctaggtctatacccattcaagaagtacggttgtacgggggtcgtttcatgcttaacttcatggctcggtccttaattgaccggggacggtactagccttttccatatatcaccaaaatcctccgtccgccccagtcgaaaacagttgtttagttttatttcttctttcacaaatcatgtcatcaatatcatggcaatgtggcgctcatgtcttcacatgccgcatctcaattaccttcccaaaggtaattacccaagcatatatcatttgataaatatgagtgtgcatgattctagaatagcatttctaagcaattgtcataattgactagggactcatacgtaatcatagttacaaagatttaaggataaacaataatcaaggcatggcataatcacaagtgggatgtttatcattgcatgtaattttatttgtaaacaaaatagtttcgcaattgggatcaatatgttcaaggaatagtgatgacttgccttgctcaaagtcttgcgggtcttgaccttcgcttggatccgcaactccctcgggctctatagttacgtgcgaaaatctatttgaattcagttataattcaaataaaaatccaagtaaatccaaatggaagtcgaatgcgaaagtcgattcttttatattaactttactattcgcgaactagggcaaacccaatttcgatttatacatcctaaactattttgcgggtataaatattttgttatcataagtttttaatctaatctacccaagcattatatccatataataggttagaaatttctatcgtgagctaaatatcggacgaaatcctaaaattatcttataatattatacgatttaatttagtctatgactaaacgattaaatataatatacgtctaaaattcctagtaattaaatccgagtatctaccgggaattgatcacctatagagattaccaaaacaatctataattatattaaattttgcaattctacgactataattgatctataattaaattctaattattttaaattttctaacttccctaatctccctctaatttctatttatttttccttttctttttctctcctcttttctttcttttctttttcctccctccatttctttcttttctcttccttctccctcccggcttctcccttcctctctctctcggctcaggctacccggggcggcgacggcggcggaacgagggaaggggcgacggcttaccgacggtggcggtggcgacggcggcgcaaggcgaggcgacgctcggcgcggcacacggcgcggcgcggcggcaccgagggcggcagcgcggcggcacgaggacggcggcgcagtggcacgaaagcggcggcgcggtggagagggaagaggggaggaggagggaaatggagtgggggaaaatggagagggggtggggtatttatagggaagagggggagaaggagaggggaaggggcggcggcttaatggcgacgtgacggcggcgcacggggctcgggacgacggcgacgcgcgggcggcgacgcgatggcggcgcggggctcggagcggcgatgcgacgggcagcggtgtggggctcaagacgggcgacgcgacgggtggcgtggggctcgacgtggcgacgacgacggcgcggggcgtcggcgacggtgagggcgcgcggcgatgggacggcgatgcggcggcgacgggcgacgcgacggcgacggcggagcggggctcgagacgacggcgacgcgcgcggcgcggcagcgggaccggtgacgcgacgcggcagcggcggcacggaagcggcgacgcgacgggcgagcggcacggcggggcgcggggcgcgaggcggctaggggacgggcgagcggcgtgtgggcgcggggcgtgagacggcgaggggacggtgtgcggcgacgggacgacagaggggaggcggagcggcgagcgacgcgcggggcccgaggcagcgcgacagaggaggggctagggaacgcgatcgaacacctagggagcaatgaacagtgtattttcctatttttcccattttagtctatttcttatataaatttgattccacaattcctaatttttgcatatttgaatattactcaatatttgtgttatcttaactaatgaattcaccctaaatcaatattactcatattttatttatataatttatttgaatttttaattagggttaattcttattctgtcgcatttaaatttaattgacactattatggtcgcgataatattttatttatttctatccttacataatctttattttaaattataatttatttatttctttaaccaacctaattttagggttaattcctaattaatttttcctctatttgtgatcgatgaactccgagatcataatccaataaaatcatcgaacaaaatcggcatgatgcaatttatttaaaaagttttcgcaggtccatatttttagagttttgtttttattggtcaaattttcagggtgttacaataagtcaggtcctcctgaatgtcaatgtgctccgaatcggcttgttctttgggtaccctcaagcacttctttaactgggacacatggaacacgtcatggataccagccatgttggatggaagttctagctgatatgcaacttatcctcttcgttccaagattttgtatggtcctacaaagcgtggtgccaacttgccttttatctggaagcggtgtactccgaggagcggagtgacacggaggtacacaaaatcccctgcttcaaaagtgagctcccttcggtggttgtctgcgtagcttttctgtcgagactgtgcaattctcagcctctctctgacggtcctgactttttcctctgcttctattagcacttctgttccgaacagctgacgttcgcctatttgatcccagaagagaggtgtccggcacttccgaccatacaatgcttcgaacggtgccatttgtaaactggcctgatagctgttgttgtaagagaattcagcataaggcagacttttatccaaagctccaccaaaatcgagcgcacaagctcgcagcatatcctccaagatctgattgaccctctcggtctggccatctgtatgcggatggtaggctgtgctgaaattcaaacgggtccccaattcttcctgcagcttctgccaaaattttgaggtgaactaactccctcgatcagatacaatcttcttgggtaccccatgcagacacatgatccttgctaagtacagctctgccaatttctttcccgtctatgtggtatgcactggaatgaaatcggcaactttagtgagtcgatccacgactacccagattgaatcgtggccagatgatgtctgttaacgaccaaatttggtaacctcaatatcggagatgaagattagatcgaagtggaatccaaaaccaagattgtttcggagacagagtaagaatcggctggagttcagatcggctacgtcaaaacacggccgagttcaacttagactgggttaagtgattgtcacgtcctgataaattcatcccaaaataaaaatcattttctaaaaggaataatagaattaattaaaattcgaaaagaaattggcaaacactaaaatacgtacaagaaaaattcgaatgtggtccggagaatttttgttaaattctccttggtctaaaaggagccctcaaattttacttgaattttcatagcaccggaaatatttattaaacaacaacaacaataaacaaagttgaaaaggttttataaaaagaaaaaccctaaaaatcccccttccctctcttgggccgaatccggcccatctccctccccttctctcctctcccctgcggcccatctggcctctccccgcgcgcgcgccgctgacgggcgggcccgcccgccaccctcgctgacgggacgggtttcatccccttcctcccgccgcttccgccgctccgcctgcgccaagcgccgccgccgaatccgccgcatcctgtcctccccgcgtgcaatcaatagggggaaattattccccgtgattccctccccctttccccctaattttccctccctctctcccttggattcgtttggaaaccctcccctaatcccgccggcgccattgatggagcccgagagcgccgcgccggtttccttcccctccggccgccctctcccccttccaaccctatataaaccctccccgtgcctccctcgcccgtttccgcccttaccgcaccgtctccccgccggaatcgagctcgcgccgtcgccctctctctcctctgtcgctgacgacctccggccggtcttctctgctcgccgggaccgtctcccgccccggcgtcgcctcctccggcttcgccgcaccgccgtcgaccccgtccaccccctcgccgagcccgcggaccgccggaacgccgtcgaccccgtcgacccgagccgcgccgccgccttcctccgctccggccgcctttttcgtcgtcgccgtcgacctagggtgagccaaggatcgccgcctcttttcccccttcccttcccctctctcggccgccgctccgccgtgcctatggccgccgccggcgaccataggggcgcgggcgccgcctctcgtcggccgcgccgagtggccgccgcgtggggcccggccatcagccgcccgcgccctcgagtgcggctgacgcgtggggcccacggcgcaggccggtgcgagcccgggtgcgcccggtccaccgtggaccgtgaggctgccgtgtgggccccactcctgtggacccggttcgcgcgccccctcccctcggctgacgcaataaaccctttttaaattaaaatttaaataaagaaattcacaaatattcatttaaagagcatataaacttcaaatggccataacttggccatttgaactcagaattggaccgttcaagtctctaatttttccttaagaagtcaagaacccatttttatactttgttcctgcttgtgatatggagtttattagagtaaaagcccttttattttccattggtcgtgtagacgttgcagcttcggaagatccgctcttcgtggaggttgaagccgacgtttgggaaagtgagcaaggcaagtcacatcattcttgagcatattgaatcccagtttataaaatttttttgatttaaattaatgcattatcgctttatttaaattcctgcgttatcactgttttatttagccatgcctatttacctttgttatgaccttattattattgctaatgttattattaccttgttcaccctaggataatcaaaaccccaactagtgggtactctattcatggttccactagtatgaatttaggtagatgcttcgctgattaattaggcaacattaggtggttttataactttagactttgggaattctcatatcatttggacactatggaatagttggcttacgttggaattggacacacacctccccctctattcaaaaccaccaaaatggttttaggctgggctcgaggtgcgtggttgggttttgttagtcgtacctcgggtactataaggattaagctcgggcctctgttgcaaagcagtaccgtacttccacatgtctagtgggtaaggcttagtttgtggctcagtctggttataaacaaaagtacacggatggagatcgacgaagtcgggggtcgatggacatctctaggacaaatgaaggctacacgagctgcggcccggtagtcgagatgtcatggcacagggctggtgtcctgctgctacgggctcaatcctgcctgcctgtcccggaggttccggccgtaggtggggttgggtcggtactcttgtttatggctaggatgggttgggaactatgtcacttcttccgtccgtataccgtggtggtatgtggcacgtggttacacgtgaggaagatgtgtcttgtgggtaaagatgtacacctctgatcagagtataacctattcgaatagccgcgccctcggttatgggcaagcctagcaatgtacccaagttagtaatttaattcttaaaattggctcaacaactaaaatgtggaatggttggcctgggttagcttgggacgagctgggacccagggtcgggttgccagttcggtctgaatcatcgtaggccttgggttaaggcaggttcgtgagggttcacggccttgattaataacactatgtgtaacatcctgaaaattcaatacaataaaaatcactaaaattttgaactttttaaaacttttgcatcatgctggttgttatgattgctattgcttgccaaaccataaatgatcacaaagaaagtaaagtaaggatcgatatttaaacaatagatataatttatgagaatatatttaatcctacaaataattatgcacaagatagtaaagtcaaatattaatttctattacaaattacaaatcaggtattagatattcgaaccatgattgatagcttgatgtcacaattagctaaagaaatagtaagattaaatctaattcatttgaatcgaatctcacatgaaatataagaacacatgaaatgatgatcaccactatagtgatcgtgtttataaataagtaattcaccggaatatatagattgatacttgcaacatgtcgccgagttacccatgacagaaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaaaatatatataagaataaaatatgggtaatattaaaatttggtaaactttcatctaaattaaaacatatattgggtaaacctcatttatgtaaaatttggatttatagaatgaaatttatacaagggataaactaaaatcgggttaaatagaaaatggcactgttcattgcgcctaaggtgttcgatgtggtccctagccttccccctcctctcccacctcttcccctagccgccccgagcccgtccatcgcgtcgccgctgccgcgccgcgtcgccgttgcgtcgccgtcatcacgtgccgccgcaccgccgtcgccgtcgcgccatcgccgtcgcgtcttgtcgccgccgccgcaccgcgcgtcaccattgccgctgccgcgccgcgccgccgtcgcgtcgcctcgcgcctcgcgcccgcacgccgctcgcccgtcccgtcaactgcgacgcgagcctgccgtctcgcgccccgcgccgctgctgtgcgccgtcgccgtcgcatcccgtccccgctgccgcgccgcgcgctgtcgccgtcgcgtagccatcgcagcgcgccgcgagccgtcgccctcgcgctgccgcgccttcgaagccccgagccccgtgctgccgcgcgccgtcccatcgccgtcgcatcaccgcccacatcaccgtcgccgtcgtcggtcgcatcgtctcgagcccctcccctccgcgcgcgctgtcgccgtcgctcccgcgttgcgccccgtgccgcgtcgcctcgcgccccgcgcccacgcgccgctcgtccgtggctccgccgcctcgcgccccgcgccgcgtaatcatcgcatcgccgacgtgccgccatcgccgcgcgccaagccccgtgccgcgccgcgccgtcccatcgccgcgtcgccgtcccgtcgacgctccgccgtcgccgtcgcatcgcccgtcgccatcaccgcccgccgagccccgagccgtcccgagccgcgcgcccgccacctcgcgccccacgctccgcgcgccgtcgcatcgccattaagccgccgccccttcccctctccttctccctctcttccctataaataccccaccccctccccacttttccccactgcatttccctcctcctcccctcttccctctccaccgcgccgccgctctcgtgccactgcgccgccgccctcgtgccgccgcgctgccgccctggtgccgccgcgctgccgccctcggtgccgccgcaccgcgccgtgtgtcgtgccgagcgtcgccttgccttgcgccgccgccgccgtcggtaagccgccgccccttccctcgttccgccgccgtcgccgcccggggtagcttgagtcgagagagagaggaagggagaagccgggagggagaaggaaaaaaagaaaagaaagaaaggtgaaagaaaaagagaaggaaaaggaagaaaagaaaagagaaaagaaaaaaaagaagagagggtagagtgggccccacctgtcagtcactatagcttgtggataaggttgtagtataaataaatgaattaggaacagtagccttttacaatttttcggatttattccaatttgaatccataaactagcgtaacttattcgttttaactccgattcgagtgaaacttgaacctaaattcatctaaattcataagcttaccaatggtatacaattaactatttaataaaatatatttataattataaattaattaatatcaaatgattagataatagttaacctaaatagtgtgccaataaataaaaatggatattgtacagtagaataattatccttaatatgttttgtcactgtagcaaccacataaattaagtataatcaatgtttgaaattaatggatatataggaaaatattagtgccatttattaatctatgtccaaatataattaaaacccacgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatattaggagaggtgagcaacccttagttaaccaagcagtaaatagaaactattcaaataaatgattcaatatattaagatattgtgcacacgtatattgtacatcccattatagatatatggtatcgtattaatttgcttgttgcatatattaatttagagggagtataagacaaacatgaatattagataaatactagctatacatcttgtcctcgtataattacagatcaactgtaaatttggattattcattgtaaaattatgtgatgggataatccgtaaccataatatgattaacctaaacaattctaacatacaaagcaggggtaattgttaaccttttataatttattttgacaagtgaaatatgtacataattaaaataaagcctccattaataaaataataatacaaatgattcacagtaattatttgaccgatccaaaatccatccggcaacagaacctctagtgtataaccgtgctatgtagataaatgcatgcctagccataatccttccatagccatttgatagactaaaccaccgattagccaaatatatatgtatcctataaatgctatgttggttaactcctaaataggccacgttgacaatagaaagattaagaaaccttagcccctagcgagattggaatccattagcagacatgaatagtatattttgttgtgcatatttggttgttatttgaatattggtttttcttgcgtattatagaatttatgtatcggttagtcgtgaggcaacgtcagcaacttccaggaggtgaaggttgatcaagaattatatcaagaataaggactatcctgagcaaggcaagtcatcactattcgttgaacatgttgatcctaattgcgaaattgttttgtttacaaataaaattgcatgcaatgatgaacatcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccg

SEQ ID NO: 47285 - DNA, 2430 bp, Oryza sativa
gtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaattttatgctgatggagccacttcctgagaggagggaaggtggacgtcctcagaaaaccatgatgactcaacggcgggaagctatccttgggattacaatggatggtggacagaaccgtcgttgtttaaatgtgaacactggtattaaaacttgatcagtctatgctaggtcttaggcttgtgaaaagaattgcaaaactagctttatgcaaaagaacctgaagccattccttgaaataccttctatcatacgcattgttgttgtggtggcttgctgagtacggttggtactcacccttgctatttatatatcttttaggagagtgttgaagagaagcccttgtcggtacgcctgcgtatccaacaagatgatcggagtgcaatttcgttctaggtctcgttccccagtcgactgcctgtggcatgttaaccgggcccttatattattttgtcttccgctgttgttctctgatagttgttggcctacctggccctaatgtaagtatttaactcttttagcccgaattcattcgtgatatgttgtgatacaactatgtatgtgtgtaccaactactgatccagggattggtacagataaacacagaagatttccgatttccaaaatcgggggtcgacactatgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcatttttgctcaatcttttccccccttcagtaagagaagctttggagaagaagtcttaggtggagtcctagcttataccccagttgagcgcctgtgaagatggagccgtaggcccgctaatccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacagtaatacagccgattctaacaatgcgacttggtgtatgacatcgggttgagttgatatgcttcaagatgattgccacgcatggatagagtcctgagaaggcaattgtatctattaattaggatattttaagtaatttgcttagagatatgtttgggcaaaagtctgccgtaaagacttatggtatcttagagtttgttagagataagagtcgtgtccaatatggacattgtttgtaatttttgggtataaatagaccccgaaccccatgtaataaaacaacacatgttcaatacaatttcggcgcatcgccaccctttttgctttagttttatttcgaagagttcttgctttcgggttgagctgtatcagtttcgatcttcaacaagaggtaaaacttgttatggcggcttgcgctctcgggattagtgcttctatctttatgacactctaatcttgtttatgtaattcgtcgagttatcttatatcttacataatctccggcaatatcggtatcaaacctacaattggctaacatctgtcaatagaaggcagccgattagcctaaataccagtgttgacttagatcatatatgatatctaccactctatgacacatccaacggcttgattgtctagatattgtccttcttttcatacttatagctgcatcagttgagtttgatcttatgcatcgtgattagaatctcaatctctagcctgtctttggttgccgattagggtagtatcggggtttcagccgatcttatctgatttagctatatttgtcctatatgcctcattgacatgttaaatccgccctttatgtcgagatcttattgcatttaagtatattaggcttttgtttagtatattctacttgccttaatatcttaatatagagtgatatcggagtattagccgatacgtgctagatc

SEQ ID NO: 47286 - DNA, 1233 bp, Oryza sativa
aagaagacatccataagatagcttttaggtgttctggtgcaatcggcttgtttgagtgggttgggatgactttcggcttgaagagtgctggcgctacatatcaaagagctatgaattacatttaccatgatctaatcggctagttggtcgaggtatatattgatgatgtggttgttaagtctaaagaaatagaggaccacatagccgatttgaggaaggtttttgagagaaccagaaaatatgaattgaagatgaatccgacaaaatgtgtttttggtgtatcggctggccagtttttaggatttcttgttcacgagagggggatcgaggtaactcaaaggagtgttaatgcgatcaagaagattcagcctccggagatcaagacagaactacaagagatgatcggtaagataaatattgttagaagatttatttctaatctgtctggaaggttagaaccttttacaccattgttgagattaaaagctgatcagcagtttatttggggggcagagcaatagaaggctttggataatattaaggagtatcttagttctcctcctgttttgattcctccacagaaagggataccttttagattgtatctatcggccggtgagaagtcaatcggctcagtcttgattcaggagttggatggaaaagagcgagttgtattttatctcagtcatcggctcttggatgctgaaactagatactcccctgtggagaagctatgcttgtgtctgtatttttcgtgtacaaggttgaggcattatctattagccaacgagtgtactgtcatatgcaaggccgatgttgtcaaatacatgttatcggccccaattttcaaaggaagggttggaaagtggatattctctttaaccgagtttaatcttaggtatgagtcgccgaaggcgattaagggacaagctatagccaattttattgtggaacatcgtaatgattcaatcggctcggttgaaattgtgccatggattttattctttgatggatcggtgtgtactcatggttgtggtatcggcctagttataatttctcctcggggggcgtgttttgagtttgcttgtactattaaaccttaggcgactaataatcaagctgagtatgaggcagtgctcaaagggttgcaattactcaaggaagttgaagccgatgctattgaaatcatgggggattctttgctggtagtcattcaattggcaggagaatatg

SEQ ID NO: 47287 - DNA, 1260 bp, Oryza sativa
tttgcagagcacacttgatcctcttctagcgttattcgcgctggccgctagttggtggatttgttctgtgttcacagcatatagagctccaaagtcaatgacactgtgagtcccttcagctatctctggtctgtgtgcacgttcactgtcattgaagtcctcaacatgctgattctgctgcaggaagcaaaagcaatcaaaggcttctactcagccaatgtataataaaggatcacctaaccctcgccaaatccaattcttaagcccatccaagagggatattggaagaaccacatcaaacagttcagccacacagtatggctggagcaatttagccaatggaggtaacataactgctactgttgtatgccttcctggaaatgattttttggggctggtctgtaccccctatagtgaactgtcagtaagaatattaacacatttgaacttttgaagtgctgttttaatttttgtctgtgtgttgtactagaatggtgctcttttaagcatgattaacttgagtatctttaaaagcatcgtatttgtagcatttgaaattggctttctactggtttttgcaggactggtgtctccaacacttacaaagagggtggtacccgataatcaagatgaagaccactactccaccttccacaatatccaaccaaggaaatattcaaaggaagaatgggatgacttcacccagaaatccaccagaaaggcacttatggagtgcacggcaaccccagagtttgctagatgggttgctgataatgctcaccggctacgagtagagcagcaagatgacgcctcggaggacgagctcatcgagagttcctcaaattcatccgaagaaacagcacaggaagctgataccgggctgttcaggtggtattgatcttggcatgctaagaggctatgccgaattgctgatgctgtgcacgctctgtagaagtaggaggcagtaagaaagctagttagcagtagggttagcatttctattatttccactattgttcccacggttcatgcttcttggtgactgtagttagttagcgatctcaagttaactaatggtagatttagcttagttcgtaacgggccatggatcggtagttagctagttgcctagagttgatcgacttaccagagggctcgaacttgtgtaaatgcagtctattcgatccatcataattgataaatcaatcctgttggaacgttggatcggtattaggattacagtggtagctcatcttatgg

SEQ ID NO: 47288 - DNA, 18673 bp, Oryza sativa
aatgcttgggatctccgtgttgacttcgatgtcgatatgaggtaagggcagcaagaagccaagggagtatgatgtcgataggatgtgggcttgaaagaatcatgcaactacaattctcttcctattgttttagtttcttttacccctcagttccttgcgtctgctcttctgcaaggcatcccaggcgattcttttctccttttcaatttttctaaaggcatgcgtgcccatcgtttccattctatgacaggggtaaagaacgaggaccactgttttcttttctaaattaggaccacagttgcttaatcaactacggagtaatacgagtgtttgctttttctcatataggaaaaacatttatgtgaagtcgtgttcgtcgtccagccgcacaaacgtcgtccacaattctcacgcatctggacgaggctactgatgcagaatgtttgctggtacgaatgtttggtcccttcataaaaatctgaaagctgttaaacaagaactagtgctgcttgtagcataatacagtatcatttggattccgatgttatcaatcagctgacgagccgtgcgtatggagatggaataataatcggacgcgcacgctgcacgaatcgattcgattcgacccatctcttgtggatctgtgtcttggccgtctcttcttcctcccaccagcctcctcccctgggtctgcctgcagagtgcagacaaaaccctcccatctccagtggatcctcttctcgtctctcgaccccacaccctccactggaggcctccaattattggccaacgcacgaaaaaaaacgtgaatactaaaaaaaatgatcggatgggacgtttactataaatctggatatggacatgtagtactaggaaacgtcacatccggttatatgttgttatattctgagatggagggagtaattagaaggggtaagacttcgaatatagaccggctaacctaccaccttttcacaaggctatccggaagactcttgagtgtttctcgccaacgcacgtctctatcgcatgagtttctccccattctaatacggataatttcaaatttctattccatcacttccgtcttagtgtccggatttctcattgcctaacgcctctgctgcatcttgtgctgccgcctgcgtcaggtactacgaactactcaccacggcatagattaaaggagatagagagggacagaacaaaataatggtttggtgagatgatagtattaatcagtatataaaccagcttatgacattcctgcgcgtggagaacgtgtgattacgaactcttgtcgtcaaagacccactccacaggaccacagccttgtctgtgtattttttttttagaatgaagaaaaaatgaattttagaatgaagccttgtctgtgtattggaaaagaataaagatatttttatttgcctcgtattctcgtgtaatggcatactacacctactctatacaattaaatggtactgtgttaaggaatgaggtaaacatggcatgctgattgagtttatgttcaggtaagctatgagaaaatgactcactgatttgtttagatgatcgattaattgcattacttgtttatttagtttatttaggctgagttcttttctgcatctccaaataacaacttcatttccgttatcatactttacgaactactacacaatatatttcgtgcaacaaatttctatatatttttctaaagtgaaataaaatctatttttaattttatagtagttaataattaattaattatgctctaatgaactttatcgttttacgcatggctgaatattctatgaaaaacatgcagaaataaacaggcccttagccatgctacagtgtgtttttcttttaaaaaaagacgtggacataaacccgtttataccctcatcatgtacttgtttgtttactaaaattgtaaacgagaatctcgggaatcagttgaataaggcaactgaatctcaaagctttcgttgtatcgagcgtacatgtagcaaaaaaggaaaatattccttttcccaagttgttttctcctcctctttcttctttttaatttaactcggctatctttataccatggtaaaaagtgaaaccctccacgtggatcgctataagattctcctccccctcgctctcctcctcgcctccccccacagcggaagaggattccaacgagaaggcgagcgagagagaggagaagaaaccaagagagcgagggcggaggaagcagtcgagctctcccagcctcggcggctaaactccccccccccctcgctttcttcccctccttcctcaatctccaagcctcgatatccgtgttcttctctgaccgaatccgaatcccgcgtttctttgttgcgcgcgcgaccgcccgcgggaatcttggtggttcttgggcgatcgtgatggcattggatggcggcggcgaggttggcaggaggaggaggaggaggggatggggaggcgggttcccgagcctgatgcggcggaagcaggtggactccgaccgggtccgcgccgccgagggggaagggcaaccccagctcgccaaggagcttaacatcccggcgctggtcgcgatcggtatgttcatcgaattcctgattcttatgttttttaatgagagaaatgatttgttggctttcttttttcttttgtatgacgtgttttttcttttcttttcttttttttttgaaattttgattacttgtgttgaaattagtttatgcatatattcattgtgaaatgtttatgaatgtacagccttttggaaccagagaattattagatgtttattgtggtttcaatgtttagttggttggcctatttaaaagtttgaagattcagctggcaaatttatatttgttctttctttagaagtttcattctttcattcatggagttggaatgactagcatcatacattggggaatccattttttaatagttctccagttgtttattacatatatctgaatgctctgcattagtttgtgacagaaattcattaagtgtataggagtaagtgtgtgtggtactgtggtagtatactagtataacgctatttctagctgctgtgcttctactactttttagttgtctatctccaacttcttctacttgttagttgtctatctccaagtctctgttggtgttatggtgtatctctcatgatctttgactttcaaaaatggaaaatgatcctccaactttagacctgtaaattccctcaaacaaaaaaaactttagctctgtaatacataaacacttgtttttgtgggaggcattaactaattacactgtagtgaacttctttctacacagtaaattaatcgagctcataagttctacgcagtaaattaatctagttcataagttgatgcaaggtgaatgattgtaattctacctaggtgtagagaaatactccctttgtcccaaaatataagcatttttagagttagacacggttattaagaaagtaagtagaattaaataggggagagttgtgattggatgagaagtggatgtaggtaggaaaatcgaatagtggatggttgtgattggttgagaagagaatattggtgtagaagttgttatattttaggacaaattctagcggctagaagttgttatattttgggacggagggagtatttgtttacatgaactgtccatgttacatgaattgttttagtgagcgtttgtgttatctaccaggtgtcggttcaacaattggagctggggtatatgttcttgtcggaacagttgctagggagcatgctggtccagcattgacaatttcatttctgatagctggaatagcttccgcgctctcagccttctgttatgccgagcttgctagtcggtgcccatctgctggaagcgcctaccattattcatacatctgcgttggtgaagggtaaattacttacaccataatggaatacacactcttcatggaagaaatattgcacctttgatagtctgtgatattgtcaaatctattgtcataaaggaggattaacaatctaagatactgtaaacagatgactagagtttctcacatgactcatttttatttttctagtgttgcctggttgattggttgggctttagtgctggaatatactattggtggatctgctgttgcccgtggcatatcccccaatcttgtaagtgtcgtttttccttcatctagttctatggcatttgatcaatattcgaactacatgtctcatatattctattttcataagtttcgctcgtctttcaggccttgttctttggaggaccagacagtcttccatggattttatcacgccaccagcttccatggtttgatgtcattgttgatccctgtgccgctgccctcgtttttgttgttactgttttgctatgtgttgggataaaagaggttgttacattggtcgatttgtaagtttcctattctttcatctgcaaactaggattataggactgttactaattattctatttgaatctgttgcagagttcagctgtacaagagcttataacagttctgaatgcttgtgtgatgatatttgttattgtagctggtagttatatcggcttccagataggatgggttggctataaagttactgatgggtaatgcaaaaaaaaaaaaacagttgattgtattttgagagtaattactgatgcacttaccatttgaacatttcagatattttccacatgggataaatggaatgcttgctggatcagcaactgttttctttgcatatattggctttgatacagttgctagtactgctgaggaggttaagatgatcctaactaaccatgtcgtccacttcctgtatggggatgctgatttttccctctttcaacccttataggtgaagaatccacagagagatctaccactgggaataggagcggcattgtctatctgctgttgcttgtacatgatggtttctgttgttattgttgggctggtaccatatttcgctatggacccagatacgcccatttcatctgtctttgcgaaacatggaatgcagtgggccatgtaaggactcgctctccttttgtttattcccatatatccaattatctataatggtcttgcaacgtgcttatttagtctgtcactatgctgttttgttttaggtatattgtgacaagtggtgctgttcttgcactttgttcaactttgttggggtcacttcttccgcaggtatacaaacacatccctcgatataaaaaaaaatcctaataattcccaagctttaaacaagacagtgagcacatagagttgattctagtcgtctactatatgcttggtccataaggaatttgcgttctaatatcacagtcaattattccgcattatattagtgagagtggtcttctaactagccaaagctgaatctataatccttgtggaaaaaaagttatttttttgttgtacttctcacttgtattctgatttctgaatctgaatcaaactgcttggtccataaggtcaattattctgcagtacattagcgagcagttgattgcacttttcacttgcattctgatttttgaattttaattaaactattcatataatgattaacgttgtttctctccttgcaattttgccgataggctctgttttgacaaaataaactatagtacctgcaaatgtatattgaactaataccatatcaacataaatgaaatttgtagcacacacatcaacactagattgatgatgtggcatgtataccagtacttgttacatttgagctatccctgattgccttatacgtaaaactgatcccatgcctacacagacaaactcaaatgagaacacaaaaacataaacttagaaacagacacccacccgcccactctttccttgcacattattatgtgaaactgagaacttggggatgcattaccttgttttttaaaatacattttaaagattttagttgccatttcatgcagcctagaatactaatggcgatggcacgagacgggctgctgccatctttcttcgccgatgttaacaagaggacacaagttcctgtaaagagcacagtcgtgactggtctctgtgcagcagctctggcttttttcatggatgtttcccagctggcaggaatggtaaggaacttacccggctgttatctttggatatactgatggtcttttgcaatgagaggtgcattctataagaccatacttgccattaagcattacagagattgtaaggtggagataaaattaaatactcatttgttgcaggtcagtgtaggtacactccttgcattcaccatagttgctgtctcgatcttaatactcagatatattcctccggatgaggttcctctgccttcatctctgcaagaaacattctgtttgagccaagaatatgatgaggaaagggttagcggtattcttggagatgagagatgcaaaacatctgaaacaaaggatgtgattctcgcagaatctatggaggatcctctcattgagaagaaaataacaagtaaattgcattcccatttttcttataactgctgtattttatttacttcagttatccaacaagaaatcttctgataaactctgcaggaaagatggacgagatgaagcgtcggaaggtggccgctttcagcataggatctgtttgtgttggagttatggttctcacatccgcagcttctgccacatggctgcctttgtaagtgtcaatgatgcacaaaaacagtatgtagtgatagccaggttccttcctgtttcgagaataacctctatctgttgttgatgccagtcttcctatgtgtattggctgcatcgttggcgctctgttgcttgtagccggtcttggcctcctctgctggatcgaccaagatgatggcaggcattctttcggccaatctggaggtacatagcaaactgttctctctttttaggaaggataaaacactgctttattctgccagtacattcggactaaacagcacacttcttgtgcaggatttacatgccctttcgttccacttctgccagtcttgtctatcctcgtaaacacatacctgttgataaatctggggttcgtgtctgacttacccaaattattactccctccgtctcatattataaaccactttgggtttgtgctagaaaaatgtagtaacatctgcagcaccaatttagtttcaataaatccatattgactatattatatttttatagtaaatttattttttgttggagatattgatatatttttctgtacacttgatcggactagaagaggtttgacgtaaaaacccaaagtgacttacaatataaaacgtatggagtatttttttttctttttccataccactagatgcctttaatctcaccattttctctaccatccatcatgaacattaattcattttgcattgtcttgttcagtggagaggcatggatgagagtaggcatatggctgctgataggcgtcttggtgtacattttgtacggacgaactaacagctccttgaaggatgtcatctacgtccccgtagcgaggccgatgagatatacaagagttcatctggatatgtgtcctagaaaaaaatattttttagtttgcactattcttcagtgacaacatgcctcacctgtctgcaattggaagattagcctggacagaggagatgctaaatcattcatacttggggaaaaaacatggatgcaatattatatttaggatgtgcataggtgtatatataaacccaattggacagtggaatacatgattttgtgtatataagccctttgtactaaatggtaaactgaaaagcagttatcgatgaaaaaaaagtgcaatagacgaagtactactatacttatatccctattgcattatctttgctgtatttgttttctttttggttgtttgttcggtggaacacgtatgggttatacctctatacgatgcgagttgtagtagtatacgtacgtactgcatgatcccagtccgaatcgaagtctcatatatatgtgttagcctgtatttttacatgcctagctagtcgatcattgtaatgtaataaaaaaggagttgctgtccgtcgacccgttccaccaatacgtacgtggagatgatggaggaggatcaaccggccgacgaggtggtgctgctgctaccggaggaaatcctcgccgagatcctcgccgcctgcccccgcgcagcctcgcggcgtcgcggtgcgtttgcacggactggcgttctaccattgactcccgccggctgctacgtgcggacctcctcccgctgtcgctcgctgtcatatttatcgacttctggggccttaggtttccggacttcttctcccgcccaacctcatcgacctcaccgtcgacgatcagcggcaagctcgacttcttgcccatcaaaatagatctccacagcatctacgccataacaggccactgcaacggcctcctcatgctccccggcgtcgtggtgaacccggccactcggagatgggcgcgcttgccaccattgccacgccacttcaccgtgcctcaaggattgttttataacgaattcatcatcttcgaccccaccatatcgctgcactacgaggtgttcaagatcccatacggtgggacgacggactacgtcgaccggatggatcccgtcttgaaggaatcggaatggccaccatcgtccctcgtcctacgtgtcttctcctcggccacaggccaatgggacgagagatctttcaccagagaaggggatgccacaggaacacatgccgatgcacagaggcagccatggccgtggattcaacacggacatgcttattggaggggagtactttatgtgaacacatgccatgtaatgaggtttgatctctttacactatttgtttactaattttgtaaatttcaaatccttacaagttgaaatcttttttatgtctggtaatgtgtgcatctctatatctttgttctttgcaggatatctctgtctgatggaaaatatcaagtaattaaacatcccacagtttactacaagaagtttaaaccaaattttttaattggaaaatcagagaaaggggtgtacctcgcgtcacttgaatttgaccataatctttcaatttgggtccttaatgaatcatgtggtcattttgagtggttaccgaagcaccagaacaaccttatgcctttgttgctacgtttgaactgtggaaaacaagctcgccggccatggattttacagaatgttaactatcatctttactgtcaaaagtttcctggtgaatggaatttatatgattgggagtatgatccctctcatcctgattatcaaagcgatagtgatgacgacgatagtgatgaagcattggatgaaaataattttaaatggaattttgacgatgatagtgttgtagacactcaagaatgttttgagaactataaaagtggcagtcttgatttcctcggctttcatccatataaagagatggtttttttagttcctcgaaaggattggcatatcattggaatagcacaaagctccaatatttgggaaatttatgcccgaaacatcgtgagtacttcgttcgaaatggaaatataaaccggtcatttccatacacaccatgttggatggacaatttctcagaaactagataactcaatcaagattagcatgcaaagctgtcatttggtgtaggtttttggtttgttatctcaagtaatgattctaagttatacatatcatattgtcttgttgctgctataatattttgttgcataagttagccatgtcaactgacggttgattgtgaacgtcaattttctatagtcattttacaatacctcccactaggggtggcaatattttagtaggaacaagggcgaattaagccaggatttgagaaagaggagacaagccaataagccacgtccacgaaaaaaaagtatatgcctttattatagctaatacataaggaaccaatatatgtaaaagcaatcatccggcttcttgttcatcttggctagatgattcgattttaataagtggctgatttttttttcaaagaacataatacgtgactgaattgtattatcagtggattggctccattctcttaggaactaggaaaattagagctcaaatatttagggtattaagacagagcataaacccgtggacgatggctcgactctggcaaccccaccgcaataccttcgccgctgagtaggaatagatctcactgttgattttgttggtcctcagtcatttgcttaagtggaagggcaatttagtcgtcgtgatcgtatcattggccaagcatgccagctttgcaggtccaataatttcgttccatcacaagttgttgaagcaggaggaacagccgctggcataatcttgtgctcgtggccatagtctgccgttgcacaggcagagtagtgccacccctccttcccccgaattcagtgtgcaccacggtcaccgtgggttagcccgcataagagtgtgcccaaataacaatagcaaagccaaacaaaaccaaaaccacaagcactaatattggtaaataatcggatctaacaactataggcctaaaacaaatccacacataggatatatcaggattaacatgtgttcattaatacagcttccagggatttaataggtaagtacaatactaaataagaactcaacatatagccgtataggatgtgagaattaacatgcgtttaacacttcatttttcagggacagaacaggtacaatactaaatacgaacaccatttttttttcttccagcttcatgacacataattctcaaaaggcaatgtatatattttcctcttcatgatgataaaccagccgcttcatttgaaaagcgagaaacaaactgcttccagcttcatgaacttttctggtctaactccatatttccttcaccatacatacattaaataaagttagagtggacgaattgctgatccaaaattactatatgtacaagatcctgaaggccaaatcacacactactgaaagtcaaaatcatttctattgagaaccataaataacaagatgcggtaaaatcatgcatgacaacatcctgaagaaaatttggctagctgatagaagtcatagaacaaaatgattccatcagtgatttcaaattcagattttcaggagcccgatatttttttcctaactactcaactgcaggaaagcttactataaaccactaaaaaaaattaacgaaagcattatatgttgccttgggaatgcatcggcatgataactatattatctactatccccaaagtagcaaacgtattgaaggatgataccagggatacagtctggatagtttaactttctgtaataccttgattagaaaattctcaatcccactcttcatatatgtgattgacatggtggcactcactaacacacagacgtcaccatagaatatcacatcagagcattggaatggtttagaatccgtctggacctatatgacacacctaagataaatccagagacctaaaaatacattttgtgagtttaggaatctagatgatacacccgtacaagtaatctagatgacacacacgtacaagtataggaccgtcaatgtacttcactcttctactacatcactacccaatctaacatgagcggtagtaacagatctggtccattacatctactacaatagatgactcatattcacgagtggtataaaaagagaaaaatctaatttctacggttgatgcataagatgatctacttgactccatgagtgtggtattctccaggtgtgttcgatggatatggctgcttctatatatacagccacaccagctacatcaaatgcagtaaaatttgtattggcttgtaccgtactgcagccagccacaactggctgcaatgtagctcaagcgaacaagccaaaactttcaacacacctagtttacctcatcatcgagggagggataatatactcttttttttaattctaataagctagcttttgtgactaaagggcccaacaaattccatcattagcatgttatataaatttatcagagtaaatttcataaaaccccacctattatagttcaggttacacaaaaccacatggatctcgacatgtggcatataaccctagttattgtggtcataaaatttcacaaaaccgttaatcaatttgacgtactcctatatcaaaatataaaataccatatttatatttatatgtatgtaacatttgtataatagataaagaattcgtaaattcgagatgtgatcgtaaactgaaaagtgaggtagattaaagtcaaaatgatcaatagtgtgatttcttgaaactttattatcataatgcctagggttatgtgccacgtaccaaaaaccatgtggttttatgcaaatagaccacaataccagtggtcaagtgaaatttacccttctgtgatatgcctcacgccactagaaaaccatttttggggacaccacccatttatttctactatcggatttaaaaacatgtacttgtgaaaatgcattgaaggggtttccgatcacaaactgccagtaaaatttgattttcattggcagccgctaaaacgctctacatgagaaaaaaaacacgatactaaatcgcagtctcctagatgcgagagccagctaaatctatcttctccccaagtctctcctccttctcacctttaccactcccctctctctctctccgtccctactccctctagcctcctacctccaccgcagtgctctcagcaatggtgccacggcggcgatggcgatggcgatggcatatgtgacagcgacgactgcaacacgccaatacgggggtggtggatccgccgctggtaggttcgggagtggcaaattcacaggaggagcttgtccaggcattcggacggtggatccggcggtggggggcacataggtggtggatctagcaggggagagctaggctcacaggcagtggatccggcggtggtgaggctcgcggggcatatatcctgctattgagctcgggcatgaatgctagcgggtgacggagttcaggcaacaagcagccttggtggggcgttgggttcattttgttactgcaggtaagcatagtatcctaggactgatatcggcatcacggttatgcacgagacagttcaccattccccaatggcgtaccctcatttgcattgtctatatggtggtgtcaaggtggggtgtgacatggatgaagacgaactttatatgaaaattgtagctctagaatagatctacatctttgctgtagaaagttttttcatttgagattatttagtattcaaatattcaattgttgcatgtggttctacgtatgaaaaccgcctttaaaaatgagagcagtagtagtacttaaatataaaagaaaatcataactcttttaaatgaagtcggatgatgacatactttgtatgaaaaaattgatctacaactttgtagatgaaagtttgtttatttgagattgtttacggattcaagtatttgtttttctatctcatatttatttttcttttatttgtaaacgaccgcagatggatactgtcgacgtttgatgtcgcgattccggtatttgcatagtatggggatcgttggtactaggatatacgtgagactgaggtaaaagagacagagacgatgatttttatacaggttcgggcccctgaattgttaggtaataaccctacatcctgttggccgaagccggtattgctcttattcaccataatcacaccagtataatatttggggtagcctatctaactgttgtcgacatggcggtctgaagttctgactcgtaatcgacaacagggtagtcttcctcctcgaatccgtgcccggcgagattagagatagcgctttcgtctctcctgacagtatccggagacaccgtaggggactagccgtgcttatccctgaagtcgatatccggcgtcttgtcttggcgtatgttggcttgtatgttgatcttgtgtcttgatctattgttccgtgtattctatggtgggtgtgtcccctctcctcctagggggtcttgtatttatacccataggtgtccccttgtccaagtagaactaggaaaaccaatatggatacaatccgagtagtccttgtcgtttccatgtagaactctggttgtctttccttatccggaactctctccatatccaaggtcagtttccgtataaaacatggtatgtggtgggtcttgccgagatttagtcaactactattagatatgtggtatccataaccctgacagatacgtattatatatgaaaattgtagcccttgacgagatttacaactttgtagttaaaatgttctattcgttttttgttctcagatctatttttgaatttgtttcttttagttttttaaacgaccttggatagggacatattctatattaaaattgtagagctcaatgatatctataactttatatttgaacttttttttcaattgagattgcttaggggagcaaatattcattagaaactctctggtatatatgtttataaaaaaaattatttttttttcaaatgagcttgaatggagatatgctttatattaaagttgtagagctcggtgtggtttacaactttttagttgatgactttttcattttatattatttagagtgtaaaatatatgttgcaagttttatgagaggtagagtaaaaaagaatagcattcaactcatagtcagaagtgcttcatatgtgagatggtaaggagactatgcactaaatgataggacttaggttcgaatcctattcatgtgtgaaatcatgtgacttgtgacataagagagatgcctgctaaaatacgagatttttttttgagtttttttccctatagagatcaaaaactaaaaattcattttcacgggtaagtacttaagagagtcacccgtgaaaatttccaaggatggtcggtattccgcccgcacaaatcatgtgatatctacataccatagctacatgcatgtctgaaaacacctgtgtaaatgggttattggccgtatgcacaaacgcttcttaaaagtagtggatgatcttgggtcgtgacctcaggccattgctccactgttgagttgtagtcttgcagattcagattcagtttgtattagaaacaaaaatgaaaatatattttatttttagcatttttacagttatatacatgctttggaaaaaaatataaaaatatacgtgtgccacgaaatggtaacacgattgtttggcgcaatgtgaaggtacgggaccgtctgctgggacaatccggtgtcgtggacgaacggtaccgtgttgcattggtccatggcttggccgtgcggcactgcagtcccgcgggtcagccgcgcatgcggcatcgcgagccggctgagtaatgccgcgagatggctgcgcgcgacatagcctcacacatgcatgcatatatctcacgtatacctcatgcatgcacatagtatttatttgcatcttggccggtgtcacattgccagcccaaggaactatgcggtgccgaacagacagccagcccgggacccaagcggtggtccacatttttacgccgctccaaacactctgtcccgcgtttccacctggcggtacaggcatattttcacaattctgcttaaaaagaagtatataattaaaaaaatagaaataatgcatatttttcaatttttttaaggtgccatgctgtgtgattcgtgatggaatttgtgacttgtagtttctgtaattgtgtggtgtgttaatttatggatgacaataactgcaattttgttccgtgatgagcatattgattatgttggatttgttacaataactaattgtcatttcgtgcattttttaatggaaaaatcggctcgattaagtcgagctgactcttttttgttttttttcttgtggaatcaaaatatgtaggtgccggttctcaaatcctcgtgtcctcattagcaccactttggtagtgcctgcatcagatccgacagtaataaaggtacgaactggtactgtttatatgttctaaagtggtgatcgatcacagcagacgcaaccattttcggtataaaccacctgaaaatgcacctgatccgcatgctaagttgctgctactaatcacacttctgtttacatgttctaaagtggtgagcgatcactgccgacgcaaccattttcggtgtaaaccacctgaaaatgcacccggtctgcatgctaagttgctgttactcttcacacttcatgctttttgagttgttgccatataatgcatgcatgcctgatgccttcaacaaccaagcaccacatgcatgcctcaatgaccagtgaaattcacatagccacacctaactccacgcctccacctcattatgtatctatatatctctatatcctcatattctcgttgctcgtataacttctcgtgtgttaattatcccgtattaatataatggggcacttgcactcctcatgtgcatatggattattttgcttgatatcgcacactccgaagacgtggtggtggcgcagacagttttatgcgacagcatggatatgtctttcgaaatggagaatgcttgcttcccaaacacaatgcctagcatcgattgttgcatttttgctgtgcatgtcattgacatggcgattttaaacgatctagagtgtctctgcggtttgaaggatgaacggtcattctttgataacggtttatccctacaggatatggctgatttctattccagtagtatttgccagggtcaggatcttataaatgcccaggttgtcgtcgacgcatgtgaaggtacgcacgtaaaattatttccacatattaccccccctttattgatcgtgagtatattcattcggtccttgcatcgatatctttatcgccttttccccctccccttttttctttctttctttctctcttttggaaactttaatcttgaaggtagtctcctttcttttggttctctgttaatgcgaccaagcgtgcatcgttttctgtataggtatggagcaacgtagcaagatgccctcaatgcctcctcagcggttgctcgaaagcagggtccgggtcgaggctagccctgccgactcgccaactccgccggcttctacctgatttgctccttggaagaattgttagctggggctggtgatcatatgcctgatcagttctacttgagcaaccgtggcccttttcattaatgtagtttagtaaatcgatttttccatgctattatttggttcttgtatcctgggctccgcccaatctatctttaatcgtgctagctgtgtccttgtagtttagtggaatctatcctcttaaagaaagtggttttcgatcaccatcctcattgtaatcgtgttttgtcagttgtcaaataactctggtgttttttttttctttcagtagcagttatttcagttccagctcctcgattctgtcctttgctcccttgtttagtttcgtttggtttccacatcctttttcactgtcaggttcatttcttagtttcttttggcggcaacttgaatttcttttctgtttagtggatgacaccgcgtaccatgtcaacatgtccgctctgtttgatgaaaagaaaagaacaaacacagaaaaatatgataaagtctacttcatcctttgaagtattgaggttggtttacttaaaccctctagtatgaaaccggatattttattccctaaaatatagaaaacggtttaaataacctcatacagtggttttataggtggttttatggtaaacatgacgatgcagcagtagttttagccacatggactatatggagtggctatagcgatagactcgattaagttttatatggagtggctaatgacatggcgatagactcgattaagttttttttataagtggaacatcttgagaacgatatcattactatagaaagtaacaaaggatacgacactatagatgtcggaataggtaaaactaacatctacagtgcttttcctaccttcaaaggatgaaaaaagaaaaccgccacctttaagcaactataaatgtaggttttagagaaaaccggcaccaatgctataagtccttttttttaaaaaaaacgaacacttttaatatattatagatgttggtttattaaaaaaaaggcacatataatattattatatatgccaattttaaaaagccggccccataaaaatcgagtcgggtcgagccggcgggtaggagaaaatatttttggctagcggggctcagatccacaaggaggagaggataaggccactacggcactacctctcctctctctatccatatccagccacaacctccactctctctatctatctctctatctctatcgtcgctggcggctgcgtcatccttgtcgctcgatgaccaagtcatccctgccatcctcgtccggtcattgccgatgcccagaggcagccatggccgtggattcaacgcgggcacgtttattggaggggagtactttatgtgaacacatgtcatgtgacaagtatttacttactaactaataatttctaaaagtcggg

SEQ ID NO: 47289 - DNA, 1754 bp, Oryza sativa
cccttttttgatttgagattatttagggttcaaatattcaattgttgcatgtggttctacgtatgaaaaccgcctttaaaaatgagagtagtactagtactaaaatataaaagaaaatcataactttcaaatgaagtcggatgatgacatactttgtatgaaaactgtagcccttgatttgatctacaactttgtagatgaaagtttgtttatttcagatcgtttagggggttcgaatgtttgtttttctatctcatatttatttttatagttaaaatgttctattcgttttttattcccagatctattgttgaattgctttcttttaatttttttaaacgaccttgtatagagacatattctatattaaaattgtagagctcaacgacatctacgactttatgtttgatctttttttttcattggagatcgtttaggggagaaaatattcgttagaaactatatgatacctttacttattataaaaattaaagatgtttttgccagaattttggtacgtcatctgtgtttgattaggttttgagtttgtcctatttctctttcgtatgttttttgtcagacactagcgctaggtcgcagcctcacacgggatcggctccgtttccacgcgaatccgccccgcacaggaatacacaatcactccatcatcctggacaagattgtggtggtttcggcatgggaccaaatcggactgatcaaagtagtaaaagctaatccagcccgtttaagttctggccgagtcatcttcgagacaaatcatcacgcacgagcgaggagtacgcatatcgatcacaggtgaacatatggctgctctttgattagttgaggaaattatctgaatagcatatattattcttagtgataaacatgtcggtgaagtatgccttgcaaaagtgtacgtacaacatcttgaatcttgatgattgtataactaattaaaattgatctctatatctatatctctatctcttctctacttctctatcccatctcttctctatctctactattataaaaatcgaagatatttttaccggttttttggtacgtcatctttatttgagtcggtttttaattaagtttgttcgcttttagaaatatagatctgtgtatgagtcggattctaagttcgtttgctttcggaaatacaaaagaagtcgtataagaaatttctttaaaaaaacatgcataataatttgagataaaaatcgggctcctaattgcagctcatgattttcttaaaaaaatattcaagcgaattcacatagtgtatttcatcccagctaaaccgtataacaataataagattaaaatagtattctcccgttgcaacgcacatgcattttgtctagtatatttaataaagcaacatttttttttcaaatgagcttgattggagatatgctttatatcaaagttgtagagctcggcgcggtttacaaatttttagttgatgacttttttatttgatattatttagagtgtaaaatatgtcttgcaagttttatgagaagtggagtaaataaagaatagcatccaactcatattcacgaagtgcttcatatgtgagatggcaaggggactacgggtctgtttggttgctactttgatggagatttgcctggcctgtagcaagcctgagcaacatacagctatgtttggttgtctccctgaagacttgcctgacttaggccaccgaaaatgaatgcctgacttaggcacggtgcatgcct

SEQ ID NO: 47290 - DNA, 14857 bp, Oryza sativa
  unsure (1)..(14857): unsure at all n locations
tggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaacccaggcacacacatggctattctcgatgaggtgaatgaatatggggagaatgttcttcgtcgggctttctggtcatttgggtgcatgatagaggcctttaaaaattgcattcctttgctctgtgttgatggcactttcatgacaggcaagtacagaggaacaattctaaccgcgatcggagttgacgcggatagccatgtcgttcctgttgcttttgcatttgttgaaagcgagaacacatcaagctggctatggtttttgcggcacattaaaatgtgtgttgttgaaaacagaccaaatgtgtgtgttctgcagaccgacacgccggtttgctatccgcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcagaatcaacaaagaaagtttgatgccatatgggagcaactggatcgtttgaccactacacacatggaagaggttaggaaaaaacccatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtatataattgggttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtgtggcctgctgggaatagagagttgttatttgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgtgatttcactcgtcctcctccagggcaagccaattgggttcctgactcaaatttattagttgatactaagggtcgtcgccagtcacgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgttccaaaggggaagtcgaagaagaaaaataatccttagttcgctattatccttggtggactccctactttgaagatcgttatcgttcaatttatgtttagtgcgtctgtaattttaatttgaactttcttgcacttttattacccgaatctatttgtaatggccttgtaattttcattttgaactgcactgcacttttaatatcgtcatgtatttgtattggaattgtaatttaaatttcgaactgcactgcacttgtaatatcgtaatatatgtgtcgtgggcttgtaattttaaattgaaatgtattgaactattcttatctgtatctatgtgtgctggtactgtaattttaaattgaaatggcatgcaaatttgttaattgaattatgttgcatacatttattgtactgttaccatacgtgcattgtactaatgtggttttcgatctgcaggtatggctgatcaaaatgatgggcagctgatagacaaggagatcgataggaaccatcgatcgcgacgtcttagtacaggaactttctgcaatgtgctaaagatgcgaggaccggatcaatattggcgtattgatcctcgttgggttccaaggtgtgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttatgagtgctcttgtcgatagatggaggcctgagacccacactttccacctcacagttggagagatggtgcccactctgcaggatgtgtcttatttgttggggctgccgatagctgggccagcagttggcccaacaatggtgaatgctggatgggcggatgaccttctggccagttttggtggtgtgctgcctgttgcactggaggatctcacagatgggcacgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcggtacttgcggcgacatatgccggactgtgtgatgcttgcgtgaggaacagcaagcaaagttcactccctggatgctcgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtaatttttgttaaattcgtttatgttatcattatgaatactagttcacaaactttccttatatgactgatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggaggacgacttgtcacctcgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacagttcagctgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcacctagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggtctgacgacgtggcaagtgtccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaataaattacatattattaaaaaaaataacttattacaaataaatggagaacgcgaccctgtcgaactgcggcagttcgacggacatcctgtcgaactgcggcagttcgacagcccagcctgtcgaacgggggctgttcgacagccctgcctgtcgaacgggggctgttcgacaggtcctgtcgaacggcagccttccgatctcgtcgccagtcgcgctctggccgttcgataggcgccctatcgaactgcacccgttcgacagggacctattttcgcgattttccccggttgaccactacttttacgattttccataaaaataatattaattctcaaaaaaattcgttattggccgcctgcacaaacgctgcttaaaagtagtggatgatcttgggtcgtgacctcaggtcattgctccactggtgagtggtagtcttgcagatttagtttgtattacaggtgccatgctgtgtgattcgtgatggaatttcaaacctgcagtttctgtaattgtgtgatgtgttaatttatggatgagaataaatgcaattttgttccgtgataagaatattgattctgttggatttgttacaataattaattgttattcatttcatgcaatttcattttttaatggaaaaatcggatcgattaagtcgaactgactcttttttgttttttttctggaaataataatatgtaggtgccggttctcaaatcttcctcccctcattagcaccactttggtagtgtctgcgttagatccggcagtaatagaggtatgaactggcaccgtttacatgttctgaactggggatcgatcattgccgacgcggtcattttcggtgtaaaccacctgaaaatgcacccgttccgcatgtcaagttgctgttactcttcacacttaatgctctttaagttgttgccacctacctatgcattcatgcctgatggcttcaacaaccaagcttgcatgcatgcctcaacgaccaatgaaattcacgcagtcacacttaccgcacgaacgcaaggtagtagttggtagctctaaccacattatgtatatctatatatctctatatgttcggttgtcgctttactcgtataacttcttatgtgtgttaattatcccatattaatataatggggcacttctactcactcctcatgtgcatatggattattatgcttgatgtcgcacgctccggcgacgtggtgctggcgcagactgttatatgcgatagtagtgatatgtcttaccaaatggagagtgtttgcttcccaaacacaacgcctatcatggattgctgcatttttgttatacatgtcattgacatggcaattttaaataatctggagtgcctctgcggcttgaaggacgaacgtgcattctttgataacggtttatccttacaggatatggttgatttctattccagtagtacttgctagggtcagaatcttagaaatgcccagatcgtcgtcgatgcatgcgaaggtacgtaaaattatttccacatgttacccttttttatcatgagtttcatcctggccttgcatcaatccttatcaccattttccctccctttctttctttctttctttttctttttttgaaactttcatctccaaggaagtcacctttcttctgcttctctattaatttgatcaagcgtgcatcgttttctgtgtaggtagggagcaacatagcaagatgccctcgatgtctcagcagctgcacgaaagcagggtccgggttgaggctagccccgccgattcgccaactccgctggtttccccctgatttgctctttggaataattgttagttggggctggtgatcatgtacctgatcagttttacttgagcagccaaggtttttcattcatgcagtttagcgatcagtcgtttcatgctattattcggttattgtatcctgggctccgcccaatctatctttaatcgttttgtcctcttagattagtggaacctatcctcttaataaaggtagtggttttcaatcattaatcgtaagagatgtgcttctatgctctacaaataacaaacagcacaatttttaaaaaagatgagaggcccaaattagatggtacataattaatagtatgattatgaacatcatttagagagggcaatttcatcattgagggagttaatctccgacagccccaccaaagctcacacttttcctgctcgaagccgtcacaaactgaaaaccactaatcaacaatcacgatcaccattgtgtttgcaacgcatcacaaacacaaatcgttcatcagttcaaacggcgagcccgttggcgcagtagaccttatagaggaggtggggagatgttttgcttccggacacaacacaggtgaagcccatgaagaatgaggatggggccgacgactgccaatgttacccaccctgcccatcacaaacggatggttagattcgatttgatacctcgagacatgttggaccgaagcaaatttctacttaagtactcttggataatttaaatagataaaatgaacctctcaactcatgatgcaggattagggggaagttacacatcaattctctaggaatcttcgcagatttgattcgaatcttggaatatttgtacgtcctccaaagcgagtttgtcaggaagactctagtttaccaaaaaaaaagagtatacataaatcacatgaactattatgttcgtaatttaatcttctgagacaataagcattttaggataaacaaaataattggatcaaaattatgataatcaatgaatatgcaatggcatgtattactgaaattcatagatgtatttctaggtcattaagtaatggggtgaaattcattttccatcctgcaagaggccctaagcaatatatgccaaaacaagaaaggtatccataaaatattttccttgggattaatgattagtttatgcaaatattattggcttcgaaatgaggaatgatttatacttgaaatgccctgttataacgcagatgagcccacgttatgacaagatagcctatcatgctcatggagtgaatttgagtgtctaaacttaggcctggtttagttctaaatttttttcccaaaaacatcacattgaatctttggatacatgtataaaacattaaatatagattaaaagaaaaactaattacacagttaagggggaaatcacgagacgaatcttttgagcataattagtccataattaactataagcgctacagtaacccacatgtgctaatgacggattaattaggctcaaaagatttgtctcgcggtttccaggcgagttatgaaattagttttttcattcgtgtccgaaaaaccttccaacatccggtcaaacatccgatttgacacccaaaaattttcttttcgcgaactaaacaaaccctatattaatgtacctaactttgtacgatagatatgggcggatcaactaatcaacacgtgttgaggtgggtgtttttctttttacaataaaataagttatgggatgaaatctcataactaagtaacaattttgatggtttatgcttttctgccttaggaaaatggcaattactgaaaaaaatttgataatataccttcctttttaatgatttgcatttatatatctgtataagaagaattagcacaaatatacccgtatcgcacgatgggaatacgggagcggtacgtaaccgcagccgggttgttcacgcaggttgaacgagcggcactgcggtcccgtgcactgaaagtgcggcaccgcgtcggtgccgtggtctcggagagctggaacgtggtggcgaggcggtgccgcggctgtgtcctgcgggaccgtcgcgtccccgcagattggtgatgcgggatggcgcatgctcctccaatacatgcatgcttacgtgcatatgctttgcacgagccagccaatggaatgccggctcacaggatgctacagtacgcacgtaatctaacttactgctaatgcatgcatgccactaatcccgagcaaccaatccgcggaactgcgtcggttccgcgcaactgtatcgcggcaccgctagactgacacggtcccacgtcttcaagctgcgccgccggtgcggtagcgcgttcccgttcagcgggaaacgtatgtttcgtatatatgtgtaaaactacaaaaaataatgcatatttcaaaatataattcggcaattactccgttagttactcaccattgaagatcatgagcgtacaacgtaagtaggagaaaaaattgaaccatgtgtatagggaagaggctgccctgctctttccagcttatacaccggattattgaaatgaattatttgctctagtttcttaaaaaaatcttgttctaatgacgtttaggccacttgttttaagttatttataaatttattttttaaaatgttttatttatccacataatcaaattaataatcgatgatattaatatgctcagtaattgtaacatacccgaattctaaatcttaaaaaatttcctatcaaaatagttggaagctaacttttccattttcgagagccgaaaattttcatttttaacctaggagtggtcaatctgacttgtactaaagtaaaatttgagaacatattaaaaccatttcatctctaacgtaggacataaatgcgaacacaagtgtagacatgcatactcacatatgatatggtttaacttaagtctttcttgtgcatttggatctttgtttgcatttcatatcaggactcatgagcatgattaaaagataatttcactaagcaaaacctaaaagtgttcatgagtaataatattaaagacatgaaaaggaagtctaatattaccacttcaggtcaagagtagtctaaataaatttcttataactatttagatgcatctaaaaattggaaatgcacatataaagaaagaccttgctaattatctaaaataatttgtgcaagataaaatcatgggaaaattcatgtaggctctaattaacacgtagaactcactgtaattttggtacaatttaataactaaatttgataccttaaataaatcagtcaaaccagtcaaataatagactaattataattcctaatcggctaaaaccatattttgtctaaaagtgcatttaactgcatggaagagcataagggaaataatttattcaaatattaggttaattttaaagaataaatattatttttccagaatttatttcttctgtttagacctcctaaaaattcaaacaaagttctatcgagcccattttctccatttttctaagagcaaactacacatactttttgagtgtaacccaagaaaatggaaactaggtacatacacctacctccagaaaaatccacctgaatttatctacaccacaaattaatccatgaattaacaaatatggggaagagaaataatcctgaaaaattcctgaaaatctctgaaaatcaagtctttcaccactctcacccacggacccacctagcttacatcgacttgggctcacttggcagctacttgggcttgcccactccctatccatctcttccaaccgaccagtagacagaaagagagagatcgagggcgctggcagtgctcgacgtgttgggagcgacgtgtcgacgccttcaaaatgccgagctccttctctactctcccagacgcgtcgccactcttcactttccatcccagtgccgatccaaccgagggtgagagctccagctctcccactccacctctatttcatcgtcggccgccgagaaagagggcgccaccgatcaccaacaagccgtcaacatccctatataattcacgttctattatcttctctccatgccgatcaaaactcgttttgacaacctctcgattcatgcagccaatcgatgggaacgctgccatgcccaccggagctctggagcgcactctgtgcaccgccgcagcgacatcatcgccgttcccgcttctgtggtcagccaggccaagctgtcgcgccaccatcatcgtctcatcactacgaccaaaatccctcaagaacccccaatatttatgggccatggacggagatcggtattgtcttctctggcttcggccaatcgtcgccgtcgccgattccttctcctctggtgagccattgtccgatactttgcacatgaagcatccctgagacctcgctaacaatgtatgtcctcatgaatgccaattagattggtagatcaagccgtcgacatcatcccggagtgaagcgccgtcgccaagccatctcgtgtgctgccgccatcgtccggacctcgtcaactccggccaacacctcggtagagacccaagaacctccaatactcacatgcatgcacccaatgaaccaatacatgactgcggatgcacatgcaccatcacccgaagacaccttccgctcacactcgccatcggcggtactccgatgtcccctaaccaagaaaactagaggaatggaattgcgagaacatgctcttcattttatattttgacctgaactccaaccgagccgccgtttgccgccggcgaagccatggcttagctctgctttatctagagcacaaggacgtctcctgtgaattagattaagtacaggggtctgtatataaatgtagaatcacactgacatatgggcctaggaccgagtaatgatttatgaaactctaagggcctttttgcatattggactgagactgacttagacccataagcttagggccccctttgatttggaggaaaaacataagaattttagaggattttaatcctataggaaaatttcctatgaagccctttgaaacaaaggattgaatcctatccaatcctttgaaattcctatggaatggacaatcctatagagattttggaggaaattttgcaagagcttcaacctcttgctaactttcctttgagtctatctctctcatccaattcctgtgtttttcctgttgttcaatcaaacggtcattcctgtgttttgcaatctctgttttacacttacattcatattaaaatcctacgtttttcctatccctatgttttctcaatcctgcgatttaaagggcccttaaaatctgagaatataagagaaaacaccaaaagcactcatttttcaacagaaaaacatgcaaaattgtagagtccataataaattgaaaacaactcattttggagtaaatcaaatttctgtgaactcaccggattatgaactttaaagttatgaaataaaaacttgcactcacagtacaactttcacctctaaaatttatctaagaaaaattttacataaagcatgcacaaacttataaaatgcttacaaaattcatttcaactcattttggggtaaattcactttacacagattcaccaacttacactcccgtggtaaagtgaaatagaaacatatactttntgccaaatgtctctaaaactaatatcttcaaaataattagttttatgtagcctgaacttttagaagtttatataaaattcatattaactcctttttcagtaaactcaatttctgtacaatcacaaaattatgcacttcaatgatataaaataaaaacacacacttatagtacaataaaagcccctaaatatttatataaagaataaacaaccaaatatacactttagcttaaaaaatttgtagaaaattcatctttagtctaaatggagtgaaccaaatctctattaaccagcaggaaatgaacttcatcccagtaaaataaaatatggcaccttctgtactaaatatatctctaaactttaaattgataaaactatatgctaatcacatattactagttaagcaaattataaaaaatacatccaaacttcaaatgaacccattagatcctagatggaccagagaacctataactccaacctctcccaccaaaacttaaggcacttagctcatataataatttctatgttgacataataaattgctagcatagactagagctcccctagtttataaaaatatgaaccatgataataaagaccataagcttatgaactacaaatggattaattaaccaaattattccttgagtaaattgcatcgccagtacatgaactcggcaggtaggtgcaatctagtgcacaaacttgtaaaatgcttgttttggtgcatgaacttgtccaatgcgtgcggaggaaggcgaaaaggacactagatggctaatcttattgatttaggagctaattaggatactatgtaaacatatatctgagaaggataccattagacatacaactcttcaataaagaaaatagaataggatagagggatagtagaaaaagattacaaaaccaagcaattatataaaggttagaaatatataaaattcatcatttttatgatgaaggataaagtagagaccaaatttataaatattgcatgtcttttgcatactcactacatgtatgcatgttacatcctaatcaacatcaacatcataaaattaacattgccaagttattttggtcctcgttcacatgaactagacaagttcatgtactgaaacgagcattttataagtttataaactaaattacactcacctaacaagtttgtataccaccaatgcaatttactcttattccttttactcaactcaatcaagaagtaacatgttctggacataaaactattaagacatatacatgtaaaacactatatgcctacaacacgctataacttgtaaaatttataagaaaatcattataactccaaaaaatcgtgaaaccaagtatgttagtcttaaaaaatagacaccactacacgcctgtgaagtctaatataataaaaatcacttggcaaaaatatttcataatgctacctaagccaatagtacactataccgacgtaacttctaaaattcataactctctaatgtaaagtgataaaatataaaccctttcacctaaattcatatttgactagtacctattcactatgcacaaatcattcattttagagcattttggatttttcgcatattttggtgtttaattgtataacgtgtactttgtatagatgattgcttaaacggtgaagaagtgatttagatgctgactttttccagttactagtcaagtcccacctccctatctctttgatcacattggtcctatgttttggaggttattgaaaatgtttgcaaatcttgcatgtcatttgtacactaatacattaaaattttgttaaacttgttaaaataacacctattgattgcattatcacttgaacttcacatataaccataaccttcattcctagcccgggctgcggg

SEQ ID NO: 47291 - DNA, 1070 bp, Oryza sativa
caataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggcgctcacggcgacgatgtggcgactctcgacggcggctggcgatgtggtcctcaaataaatcgaacaagcatcgcgggctggggagacggggctttaaaccggcctgtcgaacgcccattgttcgacagggtcggtggagggacctgtcgaacgcccccggttcgacaggcctggcggcgcggggtggtgggccctgtcgaactccctccgttcgacgggcgagcgtgtcgaacgccagccgttcgacagggctctgtcgactgcccgtcgttcgataggtgccctatcgaattgcacccgttcgacagggacctactttcgcgattttccccggttggccactacttttgcgattttccataaaaataatattaatcctcaaaaaaattcgccaataacctatttacataggtgttttcagacgcgcaggtagataatggcctgtagatatcgcatgatttgtgcgggcggaataccgaccatccttgggaattaatttccacaggctactctacccacccttgaaaatgaatttttagttttttgagatatatatatatatatatatatatatatatatatatatatatatatatatatatactcaaaaaatatctcgtattttggcagacatctctcttaagtcacaagtcacacgcgaataggattcgaacctaggacctatcgtttagtgtgtagggtcagtttggttgatgacttgagttatgtgcctgaaaaaaaaggtgcctgtgtggaaagaaaatttgtgttgagttctacctggcc

SEQ ID NO: 47292 - DNA, 11396 bp, Oryza sativa
  unsure (1)..(11396): unsure at all n locations
caaaagtaaaataaagaaccaagaacactttactttagctttaatacaaatgcattattatttctataattcatttttcaaattcatatttttctgaagtggtttattagtcatacaacttaacaacagatgatgtgctttgtgccctatggaacagaaattataagcaagcagatagcaagcaaatatactatgtcaagtaataaacggatcagttaattgatatcattgacacattcaagaggaatgacttacagggttgtgcatctcttcactcaaaccaaaattttccagaatagaagcaaccaatgtggagaaataatgtacagcataggagccaacccctacctgaacatcagaatagtaatgataaacatgtaagaagaattaattgcaatttcctgaagagtatatcaataaaattaataccaggaagttgtgggcataggtaacttaccacagatccataaattgtgaggtaaaataaacttttcctgcccattggtaacaatttcatcccctataacgaaaaataggtcagaccatcaatcaattttttttcgccaggacagaccatcaatcaatttgatagaacacatttttccataagcaaaataaaatacttgttaaaattgagtcactgatcgttccttatcaaaagaaaatgttattacttcttggtcttgtcacagaatttagagttgcttcatgctctattttacaggaaactaagagaaaaataaaactatcttcgctaattagagcaagagatctaagtttagacttgaaaatattatgaataaactcaagagtgaggtgttttagcgaaatgcagtaagttaacaatgtatattactccttaataataaacttggtggaagtgccccaataacaaaatgcagccagttaacttaacaatgttgtattttcatgtctttcaatatgagtctttattgaacagtaagttggtgttcccttagcaagcacctagcctgtctaggaactatttaggcagttgctgctggccagccacaatacgaagtgtctataccaacaatgataaaaagaaacatacaaaattatttgattgagaatacctggaaaaggacaatcagaacaacaagcaggaccccaagagccatagaactgctatagtaaaaaggcgcccatttgctaacaatgggtgataggaatagcagaataaatccaataccgaggcaagctagacgccatttctgaaactctgcataaatacacagaacaagaacagtaattatagggaaggaatggacatagatgctcttgattgtatgactggtagaacaaatattaggttcatgaataatacacaccttcttgaatggaaatactgaacctagtagatgtcttatcagccactttaacatcaacatatttgtttccatatggagactttacagcattccacatgccattttgcaaattttgccattcacctgtctcacattggcataatcccatagaagcattcctgcaaaggaaaattgactcatttctttcccgaagcatgtgtatatttacactttggacagtatgacttacccatgaaagcaaatttctattttccaatggaacttttcaggcattgattgggaaacattcattttgactcgtatttgatttgcatagcttccaatatgtaacttcggtattccagacaagcgaactcgctcgcaaaactgtccacccagggatgaaggaacaaaagtcacctctggattttccagactaacatctgcggaagtaatcaattagaccagcatgttaggtagaagacattggaacacaaaaaaataataataataggacattggaaccatataggcaaacctacaaggggattatcatacaaaaatccaagtgttgtgctaaaaggaacatgtaagtaaaagggctatacatgaaaagaagctcataccaaacacacaggtgaatcggaacaaagtgggtacggtctagctattaagagatgttattcaggtaaaaatcatccatctgtatacttcaaaatgacaatacttatccttcagccaaggccgaaaccactgaatacaaaacaaattttgagacattatcaaaaatgcattggttctgaagtaaaaggagaggcatgttactgcagatttattcgcgacaaaagagttgcaactttccaatcacccctccacaaaccaactccaaaaccctattctataactaagccccatgaaaacctaaaatatgaagcagctaccagacgcatcttacagcgaaaaccccaaaccaccccaaaggcccctaaaccctagatagaacggcgctacgatccccgtgcaaacgcagcagcagtcccaaatccggcccatggtgcaccaaacagcgggcacgattatacctttgatggaccgccccacggcggcggaatcgaaggccgcggtgtcatcgccggtggagatgatgaggagcgcggcgagcgaggctaggagcaggagcgggggagccgtgcgccggtacgacgaatgggaggtggaggtggcggcggcggcggcggtcgagggcgcgctaccggcggaggagccggtggtctccgccgacgacgaggagacttcggcggcgggggccatctcgcgcgggcggcggcgacgctgcaaattcaagcgactcttcttcttcttttttttttgttttattgctattattatctgatgaagaaagcgaggggaaaaggagattggtttttatggcgaaacagctgattgtcttcgatggtaagctacggctattgtcactgacaggtgggcctgttttttgctgactcggcgcttcttaggcttattttattgcgaggaaattcctgatgagtttgtgagggagactcctccgttgaccgtcaagacctccgagcaaagaggctgacacgcgggcccatgcccgccaatccgccatggctaccgcaatagtcggttagcgcgtacttggtttcggtgagtacctaaattttgacaaattgaccccttctcaaaaaaattattttaaaaatggtaaaagattttgttttgaaaatgaactacaaactacaaattcagcgtaagcccgatagcattgagatcaaacgtgcaccccaaattcacattcgcctcacgaggcacgaggggactacatgtaagcacacgaggctaaacatacacgattacatatatatatatataaatgatcaatcgcattttgatgaccatttggacaagaagcaaatcacgggtattagaatcccaattacacagtgagagacagaacgtggaagattttcttgatttctgcagaaaataagcttgtttcattgcgttttctttcgtcatggactagaagagtttgcaggacccgtaaggtcaaatgcgtagttggccaagtcatccatgtactcatcaagagcactctcagatatctcgaagttgtgctcgatcagctgcacgcatgggggaataattagggaaacacaacaagaacgaagccaattcaagcaaaggtaacacgaacaaggtggttggtaccttgatttcactcatcagctccctctccatcatctgtatcacacgtttttttcaagaaaaaacacgagcagaagatgcacataaacattgttatctggaagttctgtatcatgaagttttcaatatctgattaattcaaagaggtgcaaatatgatgatgtcattctacctgcaaatcgtccacagagaaactggtctctaccatctgcaaaggcgcagcatcgatgttaagttgcgatcgcatagaacaagtgcatttgcaggtgtgtcgcgaaaaacatacctctatatcgtgatccaacagcaaatcgttcaacatctgcatcacatgttgaattcatcatgacgatatataccctcaaatcaggtacaagaaggcaaaacttcaattaaagatgaaagaagatttgtacctcgatttcagccatagcggcatcgttgtccctaaccatctcagatgccctgcacatcgcaacatgtttttttgagataatgaatagaaatccggtctctatatccacaagtggatatacacagccaactgcaacatgtttcagagaagtttatggcatgcagcactgtatctttttgaaagagaaaaaatgccatgcagcatgtgaattccacaatctagtttcctcaaacaaccatacagatcaagtgcttccttgcttggagaagtggttctcagcagatcatgatcatgaagagacccaacacctgaactgaaactctccctgtacttctgaaaaacaaaagaaatcaatagcacgaacaatcaagatgcatcaagatcttgtgcagcagaacgagaatgataatagagagaaagaattatcaaaatatctgataaaaagctctgcaacatggcaggagggtacctggaggtgactcttgatgttgtgggtcgtaaggcttgtgacacccatagcttgcattgtctccttcactgcagttggtttagcttctgaagattgcaacaaatgtataacacggcatcagttttttttaacaataacatggcatcagttccatcaacgagtattttgagatcaagcagtgaataacaaacagttttaccatagggacctccatggtaggccacagcctccacaaacatcttatggagatcatcagaccatcgaaggtaactccttgttggctgcatagcccggataaggcgagaaaccagaatgctcgacatgcaatcatcctcttgtgctggctggctgttggacattattctgtaaatcatactcagagcacttcagtaaatataaaagacataaagcctgtttggattgtgtatttgtgtaatcaaacaagacagattcattaaattgtcagtatggagtaaatgtgaggatgtgcccttatggtaagggaaaacatttccaaatagaaatgtgagagatcaaacatgagtaccgatgttttaaaatcctatttagaaatcaagaatgcattagatcagaataagagaaaccagaacttaatacaaatactagtaccaatgtatatgatgaagaaaaaggaattgagactgtgccgtctatttttagggagaagagtgagatggcattccaaccttgaaaggatatcaccccttttatatagttcttcctatcactacactgcctatggaagggacattctacattttgtctagcacatcggtcatcacagttggtgtacatggaaggaaaggtaggcagagaagtacaagatttcaaaatggtaagataacaaaatgaatgattatctcatattaagcatggagtataacagggtgctcttttcgcagcacatgcggcctctgcccaatacatgaatggaagggcatcatagatcatgcaaaatcatgaacgtgataaagaaagaagcacagaactgcaaatataaattaggtacaaaatgaatgttgaggttaacttatcaggcaagctggatgtttatgatgtgaacaaagtcctatcctgccaacacctagcagcagcatggcagcatgaccttgtcttgtcattgtgatgtcatctgcacatttttccaatcaagaaaatatagaattacagaaaatcaatcatccatactaggtgcctaaattttgacactgcaaaacgttgtccatccttcaaatgnnngcggaaaagtagggaacaactccaaaagatctggaactggaagtactatcgaaaattagttcaatcatacatgtatttgcacagatgtatcatgaggtgctctttacatggaagatgaaacatacataaatgcaactcttgtcaaacttgtattctaggtatggttggaaattttgtagaacagtagagatcacaaggatgataagaagtgcatcacatgagcagcaactgaattagtgtataatcaaattgctgatattatacataggagtacatcaccttcttgaaatgccatcggtaatacatgctattttacaaagaatgtaattacaagagagaacaagaaaatgtccctagttctcttcagggttgtaagatggcagcaaaacggacactaatcctcagcaacatacttgttcctacgagcaccaaaagcaatcctctgcaagtgaaatcagggacaatggttattcaacacagtggaattgacagtagttgaggatgtcaaataataacaaaatacagtggagatcttactgaaaatattctggagtaggctttcaagcctgtgagaaaacggatgtaggttggtttcatggactggttagtaggtattgctctgatgtttggaacgagataatccgcaacctatcataattcataataaagttataaaaaaatatattttggaccttacagctaactagaagactcaacgagtgtacattaccatcaataacatgtaaggcaggtaaattggatcactcatagatatatcccgtgttacatgaacctggatgtcattggtggtataaagcactgcccatgtcatgtaaagcttttcaactttttaagttcaatcgagctaacgtattgaactataaacaactagtttttttatgtgtcctatgaaaatattagatggccacatttgttctgatcaaaacaactgaagctgtgcgaataattgttttgcactgaaattaataaatactaagggtatgcatgtgtttcatgacagatgtaaaggtatgcatgatcaacgaggtattcattagcatgtttgaacattgataatgcaagtaaatacgtcaggtttaacttaacccatcgataaagaattgtctcatgattttcatgaacatataaccaggtccagagatcatgttcaagctatttggttagatatttcaagctatttggcttgcagtagctaaatcatgtttgctacttcagtcttcagccatatggaaactagaacaagaaacaacgatatgctggggaaaaaagaaatcaagatggagctcttaccacattagcaggttcagctaatatattgatgaaaaatttggcctgccatcagtataaatccagaatttaataacgatgaactatcttgtcaacaattgttaaaaggagaccatgtggatcactcacctgctttgttgtggcaccagacataagaagatctgttgtaaccatgccaggctgcacagattaatatgtactcggtataattattcttgcatcattattaatcgattatacaagaagaatgcaaccaattaacttgcagagatgcatgattcaaagcttacaggaactaatttgctaaactactccagtgtttaatcatctagttaagtctaaagtagtaagacaccaggaaaaaggttggagttatgtaccgacaaattgtgcaccataacattgttcacttcattcatctgcaactcggcctgcaattagaatcaaattattttcttcctgcaaattctaataaacaagaattccagaaggacaaaaaaaagaggaaatgaaaacctacattgcgagttctccagaaaaatcgttccatttaagaagggaagggtctgaacctcaagactcaagtccaaggattatatggatgattacagctttatgttttttttttcaaattattaatgagtattgagtaactatttgataatcacagctttattgttctggatactgagaaatggtggtaatcaatattgcatcatagttgtgatgtcacaatgcagttaacaatttatatgaagttacaatgccacaaatagtggactatgaataaatgctacactggatatgttctgatcaaaacaaaatgatatgaggttatatcctcacataacctttacctgcagagattttgtaaggtgcaccacacttctcttcgttgcaccatatgcagcaaacctagtcattatcaataataatcagtgtctatttctgaaaggatattaagttattaagtagtatcctggtgtaaccacaaaagcactagttaccaaaatataattatatttaatatcgcttgatacccccaaccccccaacgcgcgcgcgcgggggccaccgcagtggtgtaattttttcatttggttgaaactactgataacagtacagtatatgtctatatggaagccaaattcagcacagaaacttatgaggcacagttatgtggaatcataggtactctcctattagcaattagcaataaactaaaaggacataatacatgatgtgaaatttcatagcttcatactgtatgagaattcaaacataatgatataatgattgaattgcacattgagtgtctacattttactacagaacagaacaaatggaaatgcataccttggggttggccttccatcagaaccagcaccatcgatgttaaatatgtggccacctcgaggttggtttctcatcatatttattgcctaagatggcaagatggcaagaagatgaatatttggaaaatgaatcttcacagttgttgtaatgaaattcagaaagctagtatgagttgaaagaaatacctcacgacaacatatcattaatccaagagtgttagttgtgatcacttccctattaaatcaaagaaagagtggagtttgaatatagcttgaaagcacaattgaatgtatttggtcaagccataaataaaaagacagcatgaaaattacatgagagcctcgtcggaggtctcgaccaacggtttgtaactatatgcatttgatccagcattgttgatctgtgccaaaggaacacaaagataaggagaaaatcctgccttcttatggttctagattttacccaaaaagattcaacactacataactgagtgcttcaattaaattactgaagtttaaatattcaaaaagggtagctgagaaatttcgaacactcatgagtatgtagtgagaatcagcataactttatagccagtgattttcatatttgtacatatgaaaagaatataaacatgagtaagttcatgtgcagatatttgatgatgatggggtgattatgtacccaaatatcaatatacttcatcttgtcacgtgcaaaatcaactagtgcctttacatcctttccttccctaacatcacagacaattccctgcaataatacaaatagaagcagttcagttgcataagtattattgcactgtaaaattttcaacaaacataattataagtggagactccaatggcagtaaaagtatcaagtagctcagcagtaggaagtaggtacccacacatgttgctctccaaattcctttttcaagtcagtcaccgcagattctaccctttcagctgtagaggatagactgcatgtcaaggaaaggctaaactgtaacttgtttgcttttttttttttcattctctcactaaaagtgggctcaagaaaatcctagcaatccatttgtttattcattttaaaatttcatgaaagatcaatttaacaggtcagtcatatcaagcagatgacccctatatagagcacctaatgagcgataatgagcatcaaatgacaaaagctggatagtgcatattttagtgttaggtcaatggatcatccaaatgagaagagaggaaaataaagaaacaggtaaacgagacttgaccatgcaaatcaatttgcaatgcatcttaggctcgataatttatccaattttatttatgtcatcactcaaaaataattactaaaactagcgctacctattgaaagcacaaaatcatttctgtacctgatcttgagcagattacaacattatcgccagccttcaaaaattcctttgccagagcatatcctatacctgtttaagagcaaacaagggtcattgagttgtactacaaaggtttttgaaacaagcttccacaaaggaagcgtttaggagatatacctctaccaccattgaccaaaagatctaatatgtcaggatttaaatatttttttaccacaatacagtatcaaagcaattgctccacacagtttcaagctgatttgcattgtttgattaaaaggtcaatgccgaatgcactgatgttctagttcattttgtcttctaaattgtgtactagaaagtaggaaatgaactaattaagcaggttcttatgctggtagcggcactacccacttccacccctacttccaaattggtgttgctctcttctcggctacataaggcacgaaaaaacaacatcgccaccacaccacaccctgaccatctgaattatttccaacacaagcattcagaatttcagaaatatcgatcaccaccagttcctatatgctcctactaaattgcatcccaacaaaaagcatccacagacatcctacttctttcttgtaagcaagatcaagcatgcgaagcaacacgacgacgagggggggagaactcaacaacacctttcgtggaaccggtgattagaacattatacgggggcaccatggccgccctccgcgcgacccctccaccaccagggacagcctccgcgcggataccggcagcctccggcccgcctctcgccgcaagccggcgccgcgccgtccggccgggcaaccgcgccccagcagcggccgagcccgacggccggagcggagccaggcccacctgcgcctgggcacggagcgggaggtaggcggcggtggccgccattgcggcggtagcgagacgaggggaggggaggggaggggagcggagtggagaggcgtcgtcaactgcggtgctcgccttgccggctcgccgtcgcggagtctggataacgattaacgagcgaggattttagaagggagggggcctgcgagttaagtacggatgttaagaggtggaggtggcccacaagtcagtgtgagcaatcatcctttctctctctctctcttttaaactactagtagtatgtactagtactattttgcaaggtttttttaactattatatgcatgtgctttacaatagttttttttttcgaacgcgcaaaagaattgcacgtcaatatattagtaggaaaagagtttttgttacacaaagcaatcagccagattggcttatgcctaaaggggggacttgaagctaggaactactacgacggttaaaaacgtaattccaaacagcgggagggggcaaagccacgctacactcccaataaatccccaaaaaaagcaacgccgactaaagaccacagctggccctccgagcggatggactccagaaccactgcgaccgaagcgagcgcagagtcgaaaaccctggagtttcgttccttccacagctaccaggagactaggaatacctggagtcgnnnnnnnnnnnnnnnnnnnnnnnnnnnnnnnnnnnnnnnnnnnnnnnnnnnnnnnnnnnnnnnnnnnnnnnn

SEQ ID NO: 47293 - DNA, 734 bp, Oryza sativa
tcagaatcggacacttttagaaaatctccatcccaaactttttcagataaacaatcaagaccatccatttcccaaagagccaaatcggcactggcaacattaactaacctgtcggctggtacaatttcaatcttgtcgccttgccactgaatcaagcattgatgcatagttgaaggtatacaacaattagcatgaatccaatcccttccaagcaaaaagctataggaacccttcccatcgatgacaaagaacgttgtagtgatggttttgttgccgccaaagtccttgagcaccatgttcgtcttgataaggtcttcagcatttctaccaacttcctgaatgtagtataaggcatcaagtttaccgcagccccaccatcgaccatcatcttggacatcggtttcccattgacataaccatttatatacaatggcttaagatgacgattccctgtaccttctggcttctcaaaaaccgcttgttgtggtgacaaaacaaacttagccgattcttattcaacaacaagttcatcactatcggatatcggcttgtcgtaccccaaactcagcaggcagcgtgaaaaccatattgaccggagcggttacaacactttttcctttagctaacctttttgcctcatcatctggggcctcatcggctacaggaacctgattcttaacacgccactcctgccttggctttgttttcttcagccaatggttaatttcctgttc

SEQ ID NO: 47294 - DNA, 3173 bp, Oryza sativa
  unsure (1)..(3173): unsure at all n locations
ttttctggaattagactaatgtacacctgcaaacacacctatgttgacctattccatacttcaaagggaaggcattttcatccgaagtttcagcttatctaacatttttcttcagcataaagcaacagtccaccatggtccaagccagcttaatcatagttgaccaaccatggatacattataaaatgacttagagttaaactagaatttaccgtacaattggatggctggatactaaaatatgtttgcatctagaataacaagaattgcatgtttgttactgaaaatacttgtaatgcagcagatctaataaatatctaattagtctatatcgttgcaatctaggcccaccatggtaaatggcatacattttctcttatttttccattatggcagtgatttctagatcttgagggtgaacagtgccaacttcttttaaccttttccttaatagtacaataggccagtggcgaatccatgtgttagatatgggatgatttaactttgcatgtaaaataaggaaaaattaaagaaatggccccactaacatatggaatagcgataattgacccccagtgtaaaatttgactcttccactgtaataggttgattgatttcaaataatatctcaccaaagcaaaggtcatatgggtcttttggcaatgtgtatacttgactgacgtcttagtttgaaaatgcaaatcttgagcatctgttctccagttacagcaatcatacttatccttggtaacatgaagtatacagtttgagtacttcacacagctactggacatcacaacatactagttctatctaaaaacacatcccactagttgttagttcccaacttcctatcacattattttcttgaattaagaaagtaaagaatttgttatgaactagatggagcaaagcaatttgggatgaaaataaaacaagatgcagttttgaatccccatggcaacaagaaccttgctgaaaagttgaaaaagaaaatttatgataactctttcaaggacacatgagctataaaccttaaagaatacagcaaccagtcaaggttgagctgttcaaatgcaaacaattctggcaaaacaaggattggtggaaaaccccaacatagagcaattttcatagagtttctttctttggtctcatttttttaaatgcaacccatccaagcgtcacatattatttattgcaggcctaagtcgaattatcctcagtctaattatgcaccaatggagaacctacacaaccaaaaattcatgtttcaatatgctaatgtcatgggtgcatcttcaatcatccatttcagtcttatagaagtcactaccattcagatgatgatgtggccatgagcaggctgcaaaggctgctagaaagcaacagaaagcccgggcaatgcaaagggtgactactaaggataactcctggaaaagaaagaaacaagaggaaacccatagttgaaaagttcttatgttataccataagacattatgctagttaatgtatgcagtgaaaatttttatcttgttatttgatcatgccctgctgtgagcttgttacagaggacatatgagaagagggtgtagagcacaccaatcaccaactcaatcatgtaagctggaaaagttgcgtcctgacaaaatcatggactaagagtctagctaattactactccctccttcccaaattgatcatcatataagtttatgcacaaagaccaagaacaaaataaatcacatcaatcaatacaccataatgcatgcatcgattaaaaccctaggccaattacaccctagcatgcacacattctcccatactgcattaattgtattctgataaaatccgtgtccatgtagttatatgatgatcaatttgagaaattttgaattctattacatgatgatcaatttgggaaggagggagtaattacaatatgaactatgtgaaagctctacctgtgttattctacagtggctcaaacaacaaatcaacaaatagaaaagcaaaattagaataggaaggagccatcatattaaaatccggcaaaagtccaaacaagcggaaaagactttttgttgatgtgccttgaccagaatttttttcttcaaaaaaatcagttcatggagagaagatatgaccatattgtattaggtaatttgctgatttgcagagagtatgctgcaacctgtgagcatatatccagatcatggaagaggcttactatcaatagagacttgggattgtgtactgaacaaaccttagggctgatgccagggctgacatcgtagnnacatgtacatctttacaactgctgtcacagcattgcatctctccaacagggttttcattgatttcagggttgatacgaattttacttaacttatcttgaatctcattaacaacagtgctcaactgagatgattcttcttccaatattttcataatgtcatccctttgttgtatatgcaactttgaagagttgaaaggccatttctcataaactcatcatagagtgcctgcattccaaagtgtactacacaaattaaagatgtcatgacaaagaaatataatctcagttttcatacctgtcttttctctaatactcgtgcatttctttgcaaatgttgctcaatttcaaggccctaaacatccaaaaacaaatacgtcagcaaagccaaaagattacgcttctcctaccatttaaaaaaaaatcgtcttaccattcttagattgttttgaagcttagctattttagctctcagtgaatctttctcttcttctagagatgcctataaaaaagaatagttacttagccaatggggcatgttcttacaaactactgcctctaattctgaatgtaagtcattttagactttgcatcctttgtcaaagaacaaattgaaaactgtagcataatttaacttaacaaattagaaaaagcaaagttgtttaacaccacaatcatcaagtatccgagtagtatgtatacaaagggggttatataagaaagcttaagatcaaagcataaatgcctctaaaaagagaaaaaaagagagagtatcaacatggccctcatttttgcactattttcaccatagaattggagcgtacgccaggataaatgtctcctaaatagtggatatagaatcaaacaattcatagat

SEQ ID NO: 47295 - DNA, 3723 bp, Oryza sativa
tctgaatatcggttttgccagaaatctcagcacccacaccctggattagcagtcttctagaacaaggtcctgccaagattttggacgtaagttgttgcacgaatttcctgatatatgatattggcactaccgcactaatggacaaaattacatactttcaaggaagattgtgtctgctctttaagcctcatcagctccatttgtaaggcatcgtttgaccgtttctgatcatcaattgatgattgatattctcttgtcctgccaataagtaatcattacgatacattgcactcgtcagaaacttgtgcaggcaagtttagcataatgagaatagcttttaaaacatcaagttagcattccacttacaattgctgaaatgtttaaaagacacaacaatgcaaaaataaaatacatgaaataatccaacaataaactttagggattaacaaaagcagagggaaaaagcacaaagtgataaaccatatgcttaaaaaaaaggccatagcaaaaataggggaagatttaagcagcagccctataaaactccattttccctgccaaaaatctgtaggtcttgtactctcgttcttcttaatgaaataactaagatacagaacccatactttaacaaagactagccatatacttcttcacacgcttgaaatacatttcagtcctttagattgctgcagtcatagctagtaatattttattaccaaaaactaatatatgcatgacaactaatatactgaaaaagaaaagaaaccaaaaaaatagtagtagttactggcgagaggtcatgatcttagagcaaaattgctacctattaatttctgcacattcttgctatcaagttactggcaggaaaacatagcaaaacttcgccatcctatcaattccatcatccagtatgaaaaccaaacctctctagatcattccaatggagaaatacaaataaatctagggtacctatcaaacaaattgaataggaaattatggtacctttcctcgaatttggcaaacttttgtaaaattgcttcttctcgctcctttgctttctcacactatcaatttcaacagaaaaaatatgcactttgtaacaaagagcaaaagtcacgtatgcagttatcaactctcctgctgcacaattagatttggcaggtaaactcaataaaaaaaaccttcattaacgaattgtctcgttcagcaaatgcttgagcaacgctgctttggaaaaaccttacttgcttctctagttccttgttctgcattattgtttccaaaaagaatgtcacctcaaagataagcatgaatacatatgaaaagaacttagaaaattggtgtatttccttaagtaacgaacaccaagaccttaaatatgtaaaaattgaccgcaggctcatgtttaattgtcgcgctgcaggttttgaagtagaactagcattggatttgaaggtatgctatatgaagaaaagagtaatcctttatattcctcgggttatgcaaggttccattcggatttctctgataattttgtcagatttaagttactatagtatgcattagttgtgccttgtgactagaagaaaattttctcagttgaagctcaagttcatgactcttcacccattaaaataaccaaactgttactcactatactgcttacttgtggataatagaggacaagcgcaaaatctcatgccactggaaatttctcattgataccaaaaagcaacacattctagagaaagcagaacagccagatgtataagtcaaagtaagatacctttgatagctcagccccatgtaattcagcaagctgactctgaaatttaaattacaaaagcataaaaagacagaacaaaagaaaagaaaaggacagtatagagagaaaggagggggggggggggtacgaaacacactttaattctataagcctcagcaagctcctcttgcaaattttggttctctcttaaacatccacctaacttcttctgaagattttcaatatcctgctccaaagcagctgtcctgaacagttagaataaacatattgctttatttatgctactgttactgtaaacagcagtggaatatgaacagaagatatggaagaacctctgagaaagcattcgagttgcaacagaaacatatccaggaccagcttgttgttgcatgcataattgctcaatatctttcctaagttcatctcgttctgtcaaaccaagtatatattatgtaaccccgtagttcagtaccacaataaaacaggatgaaacaaagaactatttaataaagaaatccacatgagcaactttctgaaaacagattttaatgttccattcactcaacaaagctgcagtatgatatatgatagaataaccagtcatttgtcatcggaaattccacaaatctcaaactttaaatataaaaatacttgtgataatcaaatttaaggtattgtgtgcataattcacgcaagaaatacagccacctgaaaatatacacaaataaacaatgcagccatttacaaatggcactaaaaatagcacataactatcatccaccgaagaatgaggacaaaacagaaccaccatcaactcctaactataaggaataaagataagcttcttgagggtcaagttatccactccctaaactctagattttgccttccacatggccggctattttagatctatccttcacctactactgtttctacttcaagtcctcaccatccaacttcatttcaacagatgtttatccacacattatgatgtaagggtgtctggttgtaaaaattgttagcttgattcctagcatgcagaatcttttctcacgcgtgcatgctgggaatgtcacattccctgtgatcaaattcccacagttaggacatcagggaatgttaagataaccattgatctcattttcctataatcaaacacacccaaaggatcatcaggcaagggcaaaagtgtgagcagactgctatgcgtatgcgtggttgaaaccaaccaaaacactggggtgactatgcattggtggattctggaagatggggtgttacaaagggtaaaatcatctgtagtgcacatgtatatatttcggcaaatgtgttaaatgcaaacaatgtagggtaatatgcttcagttggttactatcctcagacagagacatgatctaaggcagcagctcaagtagtcttttgcactttgtttactaccatttttgttgcctgccgtatgtgtcaggtacctggcaagtggcaagtcaaaacagatggtgtaactagatgcagctacagtcgtgttcagtttaactcacagggtgtgctgagaaggccaggaacagtgttggcctttatgtgcagaggagagtcgcttcactgctgcaccatggagcaaggggctcatatgggattggtgaatgggtgacacacaggaggggagagaatccatgcagttgttactttcatggttttgaaaaatgccactactatttaactatttggaaccatatcattacaatttaacgggtatttgatatgtgccactgaacaccccttcgctgcactaaaaatttctagtggaccaaaatgcccatgtcttcttccttctttcccttctctttccactcctgacatctctctctagatctggttcctggtgcttctccggttaagaagcccagcaacacgacaaggtacgcagaggcggagcc

SEQ ID NO: 47296 - DNA, 3497 bp, Oryza sativa
cctccggcctcgctaccaatacctgggaaaccatctccgtcggtcgagcccacggtgagcgttctcctcacctctccaccttgactactgcttggggctaacgtctcctgtgccaactgccaagtcgctgccccagggaagagatagggacgaagaaaggctcctgcgtcgtccgaatctagctccatcgatgggaaaagatgaacaggggagaaggggtgcaggaggaacacatgggtaatttggtccaaaaaattttctgagtacaatgaaagggtatgtagtagcacatctcaaatacatgttaaattgtaatggcatggttctaaatagttaaatagtagtggcatttttcagaaccataaaagtaataatggcatagatccaattaacgcttttctctaagggtgcctgtagaatagtcttactcgctaaaacctaatataaattatattaatgtgaacttttttcattggaacaaaattactcatcagcttcatatgaccaatctaggtatggcacatattcttgccaaagtttaaatagtataacttcgtaattccaggataatatttattttttattctacagattaaaatctgtattcttcaaacgtttaactactgaaacctaacagaaaataagttaaaacagaatgcatataaaaaagcaaccccagcagactactatctgccagatgtccttagtttaattttttttagtggttaatagttacaccgtgctacaagttaggctctatgaatgaactacttgagcagagaaagaactttagagagtttatctgatgagaagctgagaactacatggaaaaattaattgattaatgaatgagaatcttgtatgttgtgagtacctcgctggagttcttcaactcgacgagataatacttcaactaggtctgttttctcatccaaatctgcagagggaaaaaaagagggggagggggggaataagaccaatgttcctgaaatcctgaatcaacaaatgcaatcgatatccaattgttcatagatattaataccatgtgtgttaagacctgagtgagaaaaagatcaaataagaaagcccatacttggaccattacccacttttgcaatcaggttcaacaagagaactggtcaatctggcataacaatgctcagatgcatagcattggccaacagtaccataggagaggtttttatgagtaaatacaaattgacttgtcaggacaagactccacgaagtgctagaagcgaggtagctagaaattgtaggttccgagtcatgcatgactcaaaaatcaacattggtaatacgatatttagaacaacaatcagataatcaggatggagagagaacggtcactagctgaccaggaacactagaataccatgggaaggcgatacaaaactggtacccagaagttttaactggttataaaatataaacatagcagtaaggaaatctttaaatcgttcaccactgtatcaggtaatcaagatttcaagttataccaataatcattacaatagaagcacatcggcaagtgctgaatcacctagaaatctagcagtaaaggaagcttcattttggtataacagagaattcaagtatatgaatgtcaaataggaaatcaccatattggagcccttcaacccgacggataaatacttccaaagcatgctgcttttcatctctttctgtttaagaaatataaagaagctaattatatgcaagcaattgcattagaacataacaaaacattaacagtggggcaagtcataaaacaaaatacaagcactgcgcatcaaataagtagaaaatacaattaatttgcatatttatgtttaattttcacactaactctttacatattttttgcattcactggtgtaacaggaacctggagttagatgttgggaaggaagggaaacattggaaaggaaagggtagaatatgaagtgacagaaaactgcaaaaaggtaacgatgagaaacagaatgcaagacaactattcatttacacaaatggtttgtagaaatgtagagataagaagcaattacattttctacaaatgatcccctatgtcccccgaccagctacgttttctaccctgggatttcatcactgcatgtacacatcaggcatgtttggctggtgatctcattagcatgggcacgtcccgctatgaggaatgcctcaagaattcaagatcgactcagttcaaacttcacagtagtttttttttctgaaaaagcatgcacattgaattgcctggtctgttatgaggacaagataacactttgagatgtttgcaaggctaaggaaaacaaacaggaccatcaacaaaagatgtcattcacaaatactaatacaagtgcctcttgaaaaaggaagcctcagtgttgaagcacaaatattacctagaattttcttcaaatttatgaactactatatgcaagaggcatgtccagatgatatatttaattatccctgccatgggtcatgttaggctccatagttttcattgctcactgcatagttcagtagttcacatatctaccaccaatactccatacactattaagtaatatggcacatgctctccatagttttaattgctcactgcatagttcggtagttcacatatataccaccagtactccatccactactaagtagcatatcctccttaatgaaataaaatgcagcactcctgcatttttgagaaaaaaaaaacttcctacattcagcaccaacatttgcagcagaactcctcaactataataagaagcaaggttgcaaacagcacatgcaacagaactctcgaggggtaatattgaggaaaataaacttaaccctcctctccaaattaacaatcatctaccattttccgttctgaattccaattctctccctgactgactattaatcaattacagaacggctaccaaattcctgataaagtaccagcacatcacataatagtctcaacaaaatattcccctttgaaaaaacaaaattggatccaccgcataaagtgttccgccatccataacaaccatcaagaaaaaagcatgaagatactgacactaccatataagctgaggaaagcagcttgtatagtgaatgtggcaactaatattatcaggtaaggatattaccacgttgtagatcttcaacccgacagagtagtgaggacttatccacgccacttgcctcttcagccatttgttactcctcctgaagatggtggttaattaactaagaatgatttgagaagttgcttttcggaaacttgattgttttagctcgctgtaaggttgttctgagttacgaactggccaaaataaccctaagacaaatcatagcttgtgcagaaaagaagaactgcagattaaatgccacggttgcacggttctacatacaatacaaggtgtcttcacaagtcacaactcattgtaagatgaatctgtatatcgtctgttattgaa

SEQ ID NO: 47297 - DNA, 39289 bp, Oryza sativa
  unsure (1)..(39289): unsure at all n locations
gacgcctgcggaggagacgacggccgccgtgggggaggcagagggctctgcgccgggcgtgtcgcgtgggtcgcgcctcggttggggttggggatcgaacggtgacacggtactaggcagaagggatgaaaacagatcgaatacggtcggaaactagctatatcatatttatttttattttttttctcggaatcgaaatcggaattggaaacccgaatacgaaaacggaatcaaatattatcgaatgcagatacagagtgaatacgaatcgaaacgaatacggtaacgaataattatcaaaatatcgacacccctcaaaataagtttcttaaatcgaggaagaaatatagccattagttttcaaaaacaaaacgtcagtattttcaaattttatctctatttataagggcaaggggagatagaaaatgttatgtttacttttcatacaatttatgttatcatgaaattaaataaattaatgtgtatcactgaaattttcgcagacgcattgaaatttttgaaaattggttgaatattttaaattttgggttgaacatttcaattgaaagtttttaaaaattcgagtgattatttttcagaattgaatttttttcatttgtttgtacgtggaccacttaaggacccacatggaaaaatcaatttttccatacgggtaacttaagaagccgtatgcaaaaataaatttgaaaatttgagactagtttatctcactcatatgaactccaaattagatgattcttttttctaaatgtttctaaaatcatactctatcatattattgtgttattactgctattattttggtcattttttcttgtgactttgttttatcaactaaaaatttgaatttcaaaacttcaaataatattttgaagctgtaattaatttcagctgaaaaagtcatcaacataaaagttgtagagctcatcaagacatacaacttttattttgactatttcttcatccgataaagtgatagtaacattgttcacaaagtttacatatctctcttatatagtttatagaaccagatgagacagatgtaaattttgtaaacaatattactatcactttgtcggatgaagaaacgaccaaaataaaagttatagatcttgatgagttatacaacttcgttgttgatgactttttcaattgaaatcatttagtattttaaaatattgtttgaagttgtcatattttgaaattcaaattcaaacggttcaaacaaaatcatattgaaaaatgtccaaaacaaaagttgtagatgttgatgtgttatacaactttgttgttgacaacattttcatttgaaatcagttactacccggaaaattatttgaatttcttatatttttaaattcaaattttatatggtttaatcaaactcggatggagaaatgaccaaaataaaaatggtagatctcaataaattatacaactttgtttttgacaactttttcttacgagttgattttaatgccttaaaattcattttaaagagccacatataaaaaaaattgatttttacattgaaaaaaaatccacctttttttaccccaaccttatctactcttctcttgacccttcctctcctctctctttctcagtttctactctctctctctctctctatctctcacttcctcatccacagcggcgccgggcggggtgggcggccgcagcggcgcggatctggcgccggccacgcggcggccggcggtgggcgggcacggccggctagggttccagtttttttttctaaaaaatattcccgaatatccaatgaaaaatcccggatagtttctgaccgttttccgattccgttggatatcacccttactgtattcgttttcatatccgagaaaaaaatccgaattcgtttccgaatccaagaaattccggatagttccgatcgaatttttctgaatccgaaaattggtccggatggacggaaactatccgaaccagtttcatccctactaggtagggccggatatcgagccgtttcagctcggctcggctcgatcctcgttacgatcctaaggacatccacaatctgggacacatctagacgtagggaaactcctatcacaatgaaagatacccctagaagcccaacgagtgtccctaacccaaaagcccacgtaggtattttactatactatccctctcttcttctctctccccctcatttactcccatctctctcgtccttgccatctctccctttctcgtctccctctctcccgttctcccgtcgctgcccgtcctcgcctctccctctcgctgctcagccgcttgccatcgccggcagctgcgagggccacctccctccaccaccgtcacctctccctctcgctgcgaggccgctcccaccgccgccgcccgctgccgcgcggtggccgacggagggccgcgcgcgggacgcactggtcgacggcgagcggcgcgagggacgggggtggccgacagcgtcgtcaccgtccgcctcctccgcctcaccggtctcctctacctcgcgccatccgcctccccgatctcctcctcctcgcgccgtcgccggtcgggggcggcagatccggcgccctagcgggcggatctgtccccccccctagccagatcggggaggagatggtggcggttgtcgccgtcgcctccgactcctccccactgctagcgacaagaccgagggtggaaggggaaatttgtggagcgggagccgtgtccacgagccacgccctcctccaacacgtagccccgagcggtgtctctagaaaagcagccgaggcgcgcgttcctctgctaggggtcacgcctctctcataatggatgacccggcgacggaaagcaggcgtcgtttgcaagggcacgggttgagggtacgattatggatggcctaatgagctagtactccatagaagtttagctcggtcggctcgttggatagctcgagctggctcgtttagctcgtgagccagtgactaaaaaatacaactgcaggcaaattggtgaatcaataagacaaatcaacaaaaacaactacaagttccatccatgcatacatatttcaagctttcagcacaaagcagcaccacttctgcaagcacaagggcacacacaaccagtccaacctttgttccattgcattagctgacgacataaggacgatgtcatattattaggtgtttgcttcgggattccaagcttgttggtgttgaaagcacttcgtctttctcctccatggtgcacacaggcctgcggcaggtggcaggatgtgcaggtgacaagtggcgtggttagctggcggcaaggggcgaagggaggctagagatggcgtcgccgcgtccgctggactgcgtgaaaaggggatcgagagagagagagagagattgattgattgattcgagagtttgagatggtagatggatagggttttggaggtttatatttgggccttatgggccgcaagttgggagaaagattatatttgtaggcctgtagactactgaggtgtgtcacgatgtgtgctgtgtagtaaggtgcttatgggctaccctaacacgctaagctcacaagcagctcacgagtcagagctggctcgttatctctaacgagctaaaatgctagctcagctcgttagaaaaatacaacgagccgagttaagctgagcagagttagtcacgagccgagtgaactaacgagtcatgagtttttcgtccacccctagtactagggtgacgggtgaccatacgtctagacctgcccagttgtcggcgccacgtggtcgtggctacaactgcaagcctgcaacattgcgtgattgtatcacaagtcggctcatttaggtcacacccccagtatgccatatgtgctacaccacccacgagtgagccactcattcccacaaaaaaaaggttcatttgcatcccccatccaatgttcgagtttgaatggtttcccacaactataaaacccggtacagtataataaaacttgatatagcgcatccctcatgttgcaaaacaagcgaaaatgaggtccattggctgtttggatgatgtttttgtcctatatgtcatgttaactttgtccactcgagatgatgtgtcgcctacgtgacaattgtataaaagcaggggcggaggttcatgttaaaggggggacccaggaacccggttaagaaaatcttttagcattagtttatctattttcatcatatatgcaccctcctcagtgcaaacttaagcacccacaccagcttaaatttggtccaaaagagagtaaagcaagcatgtggcacccctctccatttcactcgcttccaaatgtcagtaaaggtaaatatttcactcgcttcctctctagagctcctcgccatgataggcattggacaacaatggtggtggcctcctcggtgttaacagcggcatgcgctcgctggagctaggaacgaactcgccgaagcccagtagctgcaccacaacacgtggctatttccatggcggagtccaaccggtggtggcttcatacaacaaggagaggaaaagggagaggacatcgagaaggggacgaggcggggctcaacaatgtggttcatcggtgtgcactactccatcaccagcaccagacccctagctcgcctttgccacgcccacaccagtcctagcgttggacccctctccgtcctcccactgccaagtgctcatggagaccacaaaggatgcgacgccatctcgctgagcagcagtcgccccagcagcaagaggagcctctccaccaccgatggcctttggctaatgtaggtccaatcaccgtcgttctcatcaattggctcctctcatcagtacaaagggaggagacagagatagagatctcgctcctagatccatgagacagtggtggtctttgttgcgggaggaggccgagactatagcatgtggtgggacaaggaggaggaggacctggcggacccgatccgaaacaacaataatgaggtgacacaagggagctttgaccggagcctagcagtgatgttaatcttgtcctttgtcaggcaagagctcctgtaatcctgcctactaggctaaggctgaggctgagtggctcagcggtgacaggggagcaccggggagcagcggcgggaggcgttgcttcaccacctcaccttcaatctagagcagaacttcaccaccaccgatgttgaggcacacgtgtcgtgctcaaccacgtcaagaagcaccgtctccaatgtcattctctttgtccatcgcatgtggatgcctcgtcagtcaaaaccgctatccaaactgccttaggactacatttgcactagtcttgaaagatgaggtatgtgttgtatcagttttgcgcttgaggaacatgaccaaaactatactgattatctagattttgtattgaagtcatgacactttatttacggaatcactctactacgaagtgcagtggcagacacacccattggacagggcgggtcggccgacccagctacagtccgtgtcgcccccacacccccaaacatcatttcagtcatatttctaacacattagttatcagtctactattgaataatcagataaatcaagtattttaagtaggaacaaaaacatttatgaaaatttatgtataagtagtatcattttgactgtttctgattttggccatacataaaatttgattttctttctatttctttagtgtataatacagtctacagttgtggggatacccggtttgagtatagtatcccgaaaccacccgcgaccgtctaggatttcgatcgcgcatagattgatatacagaacagctttcgatacatatacccaagtttttacagaaattattacataaaagataactaagacaggttttaggggccgaccggccaaacacactccctacaaacaaaagacccaaacacaaaataggataaaaacaccacaggcaacgcttgagagcagatcgacctagaacaagaactcgtctgcaccatagaattcttccccttcctgcgcctcctcagggaagaactgatcgtctgaaccacattttatgtaagaggtgagtaccgaggtacctaacaagccacattcataataatacaaatagaatatatgcaaggcgtacaaagaatatagttcatcaaggaggttgcataacaagcctattataaatagtgtttccctactttatcaaacattttattcgcaaacaattgtaaatcatcattttaaaacggtagcaatattaatcaccatttattctcatcttcatcatattccatattttaatttaaaatctactcataccatgataaataggaatcacccaatgacatagcttcttaaccggaagcacggcacattcgaatgatttaagactcatctctgcagagactgcccagctttacccacatgatgnnnnnnnnnnnnnnnnnnnnggacaacatagccgttcgagagtcccacttactactagttactgcccagtgggatattgatccgtcctagcagtcaggcacttgctgggcctaagcaaggctagacggtcgctgctttcacgggttccaccgttgtggatcatgtcaacctggccgaagccccttccacatgtccaccccagacctgctcatagagccaccctacagtctttcatacagtgggacaatgtactaggctaagtctaattactcagtcctgtggatgggcgcaaattacatcattttccatggcataagggggtagtccttatatccggggaaagccactgaaactagcacaggcccgtgcatactttaagtgtaaatatacactttccacaaaataattataacaacatgcacggcctcacacaccacaacatccatcttcacccggaattaaacttccatatcactccaggcgagtgactcatatcaaataacacattttatatcacccgatacgccaccacgtgacgacgggtaaaccatgtatatgagtatagatatttggtggtcttatccactagaatattattgtgaagtatataaatctacacctaggttatcaaaggacgtgatatagcaatccatggatttggccaataataacaatataacaatgggtaataattaaactaacaagtttattaaaaaataattcatacgcaaaataattttataaatactcaatgcataaaataactaagtggttctctactaggtttcaatatgatcaaagattggtactgtggcttgcctcgtggaacgtggccttcggaagcttcaacgtagccttcttggtccactttagttcctacgagtccagtgggatcttcaacgcgatctaacgtacgcacaagaagaaacgaccaaataagcctataagaaaaatactataaataaaaattaaaataaatggtgaaggttggagccagaactgtggaaagatgcactagaagttctatggtttcaaataacaaaatatcactgtaaagcaggggtttatggtgtatacaagaatggacatgatgcagaggtttgggtactggaaaccggaagaaattgtgtctagaggtggccgaaccaaaggtgaaccgaaggcaaaattattgaaccattaaacagagccttagccagatttgtttagctctgtttcctgtcttatggttggattcaaccatgatggcacagtaccacgtactactgttcatcttcttcagtgagacgaacctaggggcaagggaatagagaacagggaaaaagtaggaaggtggatgctaggctgtggtgggtgataggtaaggacatcatgagcaaaacacgttctcaagggtcgcgaactcgatgctgttgttagttttcagagacgacacccacaccggccggaacaggagttccagatctggagctatggtgacaccgggcatggaagtggcagctctggtggtgaacgcgggcgggtgagcgcgtcaaaacgcgttcccggatgagaaggttccatttttgtggttagttgataaagaggacattctggacgtgttggccacggtgatggctatgacagcccatgggagcttcggaaaagctcgatacaaaagcggaaaaagagggaaaatagagaaagaagcctcaccgatgagcggaaaagttgatggtgtgctgttgtggcagaaaaagggccggcgacggtggatttggccagtgaccttggcagcagtttggagaggtttgagggcagggatgagcttgagtgctcggtgtttccagagaaagaagaagaaggagaaaaaggaagggagaatagcctctcgctaagattcgcgcaacggctatcggagatcggcgcgtggctggtataaggcggcacgggcgagcgtgtgcgagcacgggaaaggcacgaggcggcacgcgtgtagcgcgagcggccctgagcggcgtcggcctgcagcggctcggctggagccggcctacctaggctgggccaggacatgggctagaacagcccaacacagagagtgaccagggaaaaggaaatccggaatatgggctggattgcaaggaactcggcccgagaagaaacacagtgttctatttgaatttttggagagatttttgtatggaattttgataggatatttttgaataggaattgatgggatttgggatcttagaacatttgcatgatgactccggtttaacttaaaataaacatgagctcttctgatgattttgggaattttctttgggatatctcggattttgtttggtgagggaaactaaacaaggttatgtgggagtcggaaacttagagggaacaaaagaagaattgggaggctccaattcgaaagaacgaagaacatcgactttaaatattttcgcaaaaaatttatcttgaaaaatctagtatgttacaacataatttaagtaatctcttaaattacttatttatctacattctttatgttcgttgtaattaaatctttataaaaatatctcatatgattatattttgatgaaagattacaaattacttttataataatatatataattataattacttttagattttattaaattacttcttagacatgtaaaagtaaattcaataaaaccaaaaagtaatttatatatattataaaagtaacttaaaaaaagaaaaaaaaatttggctgacatcggttcgcttttgcggttgctgttttgcagcagaagcccatcggttcgctgttacggcctaaatgcgaatagctattggtagtgggccctatacatgtcgggatctatctacggccacgcatctggagtcagtgctgacgagcacacaacgcacacagaggcaggcaaagcagaggcaatgcatcagttcaaaagttcacagaagatccagtaatcagccataagcaaaacaatggaattgctgatgcttataagcatcaggctagtactgctgaaaagcagcagcaactgcaaattgatggcgcccttgtaagttgttacggcaataaaagtaaatctattgttgggataaaaacattagccagtcaaaaaaataaatttaatcagcaacttaccaataaaataaactatttataactttatgaatattttaccagtaatttaatcaagtataaaagtaatttacctatgtaatacataaaagtaatttacacgtataataaaagtaattcacaacatatatattttcctttactctaattgtgtaatatcttgttgcgatatgtaattatcacgaacataatagtgtaattggactgtagattaaataagtaatttaaaagaatattttgtttgaatattaggtgtaagcagtggcggatccatagtgtaagcattggtgtcagctgacaccggtgacttcttgctaatctctttgctcatacactctagaaacaagaattactcttaacaccactatatttgtgtaatgattccaataactctatattctgatccgccactgtgtaaggaatcttttccttattacataaactaataatatgcccgtactaacgttacggcgtaacttaatttataattcacttaagaaagaaatgataaagatagttatatatatggagtgatatttgcattccctttctagatcttgagcaaagctatacacatccattaaggaacattgtgagatgagatctaacataatggtagtgcttttcattctgtaacattatctcagattcagtcaactctgttacacggtgtaaaacatcatccacagagtatgaaataatcactaaaagatggggagcaactcaaaaactcaaacacaattagtgggcttggctgatggcagtttgtgtcacatcctctggaattgtccaactcatcatttttctgtcggcaaacaatgcactcatatagtatgaaattcatactatccctcgtaacatttataataacaattagatgcataataaaatgcaatattttcattaaaacaatatatgatggtaaataaggacgacactttgtaatccacttcttttattgcgtcctctgtgttccactgtacttcttgctagattgacaatttatataaggacaacctttcctctgatattcctatcgagaagtagctccaacctaagcagctttggactgattcaggtatccatgtcatctacaccgaacatcagcatctcgccttttacatttgttcaatttcccgcaccttcaatgttaagatggtctcaagccggccaaacacggacacctattgaaaggatccttaggctcccagttcttccaaactatttttgtctactataaccactttttgatgattaacgcaaactgaataatgtgctgcaacaagaaggaagtggcattgcaaggtcatgtactctaagacattgaataattcaaggaaataaaaattttgcaaagatgagtattatttggggaccgacaaatatcaacagtaggatatgccttcaatgtgataagaggaaatcacatggattacaagcatatttagagcctccaatgacctgaaaactacaccttacatccaaccaaagaaaatttaatagaaccagccaaaattccttgcttacatagaaaaaaggagcaggtgccatggtgtaccactgcaaattaataagtcatttggagaaaaaaaaagcaactcaacacattacctgttcacatcgggatgcaacccaaagttattgtgttcctttagccattacaagttcaaattttcttcccaactgtgacttacaaaacatcaacagcctgcaacgagtcatataattaatttgaatcagttcttttcttcctttctattttaaagttatttgttcaagggaattagtcacatgacctcgaaaaatgctattttcacgctccatttgtttttaatgtatgacatgttggttagttcaaattgaactaacgttgatgccattactgttaattacaaagaagggtatataagatgccattacaaagaatttattttcaaactcaacagtgaatctgcatattgattatattattattattattacaaagatttctattattatttctgtggctattattactatcagttcggtgacaggattgatcacaacaagtgcctaataagcgagaattccccaaagcagtgccggctggcgaatgggaggattagcggaatcagtcacactgatccaccagcatccggcgaccggtgagctggtcgtggagttgcatttgcagtgcacaaattaagcaacgaaatccagtgtaaccaatcctaatttagcacaaattaaagcttcaaagcgtagataaatagagacaggtaaagcattgtgcattatactaattctggttcaatgtgatgctgagttgaacctatcagtcgcacaacgaatatataatatatgccatcagtccacattaatatatgccatcagtccaagatgatgcaataatctgaatttttgataaacaagatgatgcaataatctgaattttcaaaaagcatttaaaaaaaactgtagcgcttgattatatcatgtttacagcatagcagcagcagaaaagcatgagcatatggataggaacatgagcacgccattctcatcatcaaataatatatatatatgtactgaaataatctggaaacactgaaaaccaataaatatgttgcacatccccactgttaatgaaccataattctgaaaaaaaatgataggttaagctaagcaatgcctcatgtatgtagatatcagaggctgagtgaaatcaacatctaatacgtgcatagagaagtcacgatcattggttgatcatccaagaagtcacaatcaataagaaacaacgatagcagaccatattcttagggcattatgacttcgcttactccacatcaaaaattccattttttcataaaatcacttgcatagacagaatggataaaaccacctacaaattacaatgcaaccccagatttccagagaattgtagcaagcatgtcaccactatgaaacaacattttctgcatttggacctactgacccacataaaaacttgacattgtcagtcaaatagtctgttatctacaaaatatcagatagatcatataattgagtaatgcatatttctgattcaattcatgatgctaccgatcaacccaataatatggtgctcatttcaataatattttcataagataagatgcttagtttaatttcaattttcctgggtctgaaatcatgcacttaattgaccattgtaaagcaggtatatagggtcattgatactgcaaactaattttgattataaaaccaaagaaattcatctgttcgcaggatgtatattataccttcttgtaactggactctgtaaactgaggaatgagacgagggtacgtcgtgtcgaggcttcacttgatcccgcagaaattatctgaaatccgagtattggaattgattcaggttaaaataccgtgatcatcccaggcgtcaatttcaggttaaataccactaaccactaagcaattccatcgtatatatttagctcggtaaaaggaccagtaaaagtaataggagaaattgttgtctgatcctaattttccaacccaaattaaactgtttttaagtggagcatatcatcattaaatttattagtctgaacttccaagatatcatcaccatacagtatatttcaccaaaattatcagctgagagctatgtcatcatgagtatgaattcaccgacaatccaatgatccctacctgcctgtttggttggagggagtttttaggagggattcggagtttagagggatgtagctattaagtgtttttgtttggttgggagacatgagaattttggtgggatagggatggagaattgagcaaggaactccctccttttcaatacctgggtaggggtaggtaattaggagagaattcctcctttactttttctaagcaaatctcagccatccgtttttattaatgacctaatctccaactaaactccctatcaatttccatcacctctaccaaacaagatattgggattaaaaattaaattcccatcttaatctcatcatcaattccctcgtgtaaactcccaatccccttccctcgagttaccaaacaagccgtgcgattgcacggatcaaaaattcaaaatcgatcctacagtggaaaaaaaacctagacaaatccaactttagccgcaacaggacagacgtgaaaacacccaacaaattaaaaaactcccatccaatcctacaacagcccaaaaatccaggcaacgaacaaaacctaaatcgccccctacgcgaaaacaatgaccgatctgagcagtcggggaagaggaggaggagacgaaccagtgtgtgagagagataggcgccccgctcctcggccagtccccccacccccccaccctccgcgattcaggccatggaactcgcttcaatccggttgtgagtgctcggaatcggattcgccgaggcgaggcgaggcgaggcgaggcgaggatgagaggatcaaatggattttgggggaagccggaggtggaggagaggcggaggcgcggttgccattgcagaggaatgaagcggagtaaggggagatgattgattgcgctatcgatctcccaccgcgtgacctcgcatgagcccctgtcgttggatgtgaaacgttggatgatttttatccgttggatttaatgaatgaagtatctatatctatactaatataaaaagcaccagttcatcaaacacctatatatatatatatttatttattttttacccttatatctatttccaacggcttttatcaaaattggatcaatccctgcaattagcgatccacacagcggttataggaggcgatcgattgcgagaaagaagcgaaaaagaaaaaaaaaaaaccttcgctcccatcccataactcccgtactgcgctagcctaccgccgcctcccggagccgctcaccgcctcctcgcacgcgcccgccggacagccaggcgccgccgccagctccgagcgcgtgcccgccggagccgcgccccctaccccgccgcctcctcgcgcgcgcccgacgctcgccctaccccgccgggttcgccatcggccggcgccttctccaccgccgctgccgcctcctcgggcacgtcctctggagagctggggttgccgtcggccggttcctcctcctcgcgtgcgcccgccggggagccgtgatgggttacggccctacgcagcacatactccaggttaagttgatgtcctctcttcctataaatcctcaaacaataaagattttgtgcttttattattttgggttcagaaaattgtttacctagggtttgggcagatctgtgcaatttgtggcatggggattgatttggcttttcatgcaagaagagaaagctccccgcaaaaaaaaaaaatgcaagaagaaaaagcactaaaaacattttatatagagatgttttagtttaatctatgatgggaagccttgcaaccattaatttcatattttgctgaaactgagtgacaattgattattttgagaatttgccagtatatcagttccattttagaaagcatagaaataaaagagctggatttgggacttcatttgatttggggttgatatacggttatgtttcttagatttgagtgggaatttttgtttttgttcaatcagaggatggaggataatatgatgtgcccaatcaaggaccaagaaaccatgctgtgagttggccaacctctgttctcctgcaattacattttcctttttgcagtagatcttgcttccaattgattttgtagggtagtagcaatggacatgaacaggcagcaggatacggtttgctccaaggaaattttgcagcaccgaaacagtactatactggctagcatctcttgtttatttgcattctgatattctttttatcctgtgggacagattgatctagtctacgatcgaatgccacaatatatgtcaggcatataacacaggggagtgcagaaatcctgttattttcactcaatctggtaatctgctttaattcttttgctattctttgccttgaccatgtactggattgaattgaagatgtttatttcagcataatttttgttcagggttataggattgaaattcaagtatacaagattacaagattgcatataattgaaggattggagtgatcaatgtctagaattcaagcgtgcaagacctgctgagccgtgtcaccattgcgttgcatctgatctaagttggcgttcttggtttaaattgttgaccggtgtcaatgctaatcttttaccaactttttacgcaggggcacttcttggatgctttgatcttatgttcgtttagtgcctctcgatggctctacaagttagccatgttattgtaaagcacagtaactgcttgaatcagcccacaccacaagacaacgagatgctacatatatcaggtgcaaatgcaggtattgacttagctcatgtgtgtctttttatgcaaaatttgttttcctgcaagtgatatcaagatttgaccacatggcattatcaatgtaacagcaaagaatgcgggacaagcttgtggtatatgcatatgtagctgttgagctaatcatatttcactcaaaccggttcaagtagtcttccaaatttctctctatgctgaaacattctgctttatggttgagctcacatattttggtgacagcagaattctgttattctgaagcataaattttatgtcatgtgttcaacgagtccaatgataggaccataggaggctacataaactgaataaattgaatggcatcatagttaactatctccggatggcgctccatccatgcgttcatgtcgttgtgcaagtacttatcattgagtttcttagcaatcatgtcaacatttagctatgctggcaaccatggttgtgtacttgtgttagcctgtaatgtaaagattcatttccttttcatctgaatcaacatgatcaactcttgggtagattctttgtcaaatgtacatatgattggagggaccatgtgtgatttatcattcaatcagactagcaagatgttggtcagttagttctcatgaatactgtcatttagctatatttcttacctcaggaccatattcctgtttatttgtcactacaattcagacttgcatgtcataaaaaaaaactttgatatcatattagactagataagtgagctgtcaggagcaagatgttctctggttatgtatgtgtttgatgtcagggactccacgtccgcccatccgaagaggagcctggggaggaggcgtaggctggtggctgcggttgactggtatgcatattttagagcacatgaaggacacaaacatgacattggcgcagtttccataacctcaacttgtgatcaaagactgaaaaatggaatgaatggacaatgaagagtgtgttcccttggttttcatggatagaatcacacataatttgctaggaatttcatcgaacatttttgaacacgggaaaaacggcgctggggaaaaacggcagtgttccagcgccggatgtgggagtgcccaatctgacttctataaatttattcatgtagaaaggagagcgataagtttcatttgacgcaaccggcctcgactccaacacttcttcctcaatccaagtctcagccagattgatacccagatagactcccctcccaacagctccaagtctcagccagattgatacccagatagactcccctcccaatagctcccaacagcatgacatgtgttgtgatggcgctctctcacatagcgtaattcttctccaataacctcaacagctaggcgtgccggctcaagatccatatcgacccagtcactcatcctgggggcttttaactatttgccacttttagatttggtaaataactatttgtcactcctatctcaatgacacgtggttccacatgtgtctgacatgtgggtccagtgataaaaaattaattgctacatttaaatgtggcaaatggttaaatatctctttggtaggcccacccatatggccaagagtaggcattagcttattgttattacggctaaatatactcctcttcaaggtgcatgcacatattttatttttctgtttgaaatatacaaactaatatagtaccaaatgtattgatctatgttgatgtgcatcagcgatggatgtatttttctttaatttactctatcagtatatatcgacgtgccttgcaaggtaggcactatgtcaacaagttaaatagtttccttggtgtactactctttgaaaacgttattttggttcatctgtgtgattatatgaagccagggcctgaccgcctcacagattgttaatcgatcttgaaacaaaaaatgaaatctgaaaattatttagcactttaacaattatattatgtgttttatttattttattagcaacgtggattccacgtgcacatttactagtgaaggatgggtagatgtgtagtcctgcacaggaaacagattcatgttattttaacatttgtcgacatgttaggtagttagcactaattagaacacttgcactatatgtagttctgtccttaagagttgaatcaaagcttgctttttgattaatggttatataagatatgtcaccgtggtcgcatatcgatcttagggtgatttcgcgtttctcttcgtcgagctatgtctcggctttcgggcttggcctagcgtgagtcgcgttggtgtgaaattgcggaaaggagtacggcatgcatgcagtacttacaaaataatttttacaagggccataacagtttttttttaggctaccaaatactccgctagtatctaaaggcctgcgaaaattgactttcgcaagcggtcataggtctacttgcaaaaatcaattttagtaggtgggcccattaagaagaccgccggcgaaaagtatcttgtgccaaaaaaaagttttttcacaacatgcaaattcacatttaaatccgcatcattgcaaacacatagttcagagagttctttaaaatatactccctttatccataaaaaaaaccaacttctcactacgaatctggctgtaggctagacgactcctcttagaatgtgtgcctcgcgggagccaaggagggcagcaccggcacaatttttttttatttttgaacttttttattttttagtttaaaatatagacactttcaaaacttatttccataatctgaatctttggtgacactagcatgcctggtataataaaataataccgacacaccacacatagtgggtgtggtagttttatactatcactaccacgcgagtgagagtggtgtgaccaaataatgctgtcacaccagccagatcagtgtgataatgttattttgccacggctaatgtggctaaaagattcagatattggaaataagttttaaaagggtttattttaaaattaaaaatttaaaagttcaaaaaataaaaataaatccaccggcatagcgctgtctccatgcacaagagagaaagaggggaagttagtacaacaagaaggttaattagggactgacatgtgtggccaataagaatttcttaaagagaaaatttgtttcttttgcaccaggtttagcagatactttcattttacaccaggattcaataatttaaatttcacttaacaccaagatacgtcattaaatatacaagattttcatgacatttcatcaattttgaataaatcctcatcaaacatggtctaaattcaaaaaggttttataatttgtaaacatattttacaaggtttttctttaatatatgatacaacccccagtgcaaagtgaaacaggtacgctttacccagtgcaatgtgttatttattctttattaaatttagttgatatttggatggtataaaaccattttagcattttattttcagtttggcttcgtagagtgttgtgaaacctgtagcacgacacgagacatcgaagggtttgtcagcatatatctgttagaaaaccgccggcccataaaggcccgacccggttactcactaattggacccctcactaaacatggaaggtggaagagggaatgactataaatagagaagtagagaggaggattgtacaggtgaatgagaagatggccacaccctcatatctttgtgtaatccctcttggactaccttggtagcatgaggggttgcataatacgttatcagcacgacagtctaccggaggtaagaactcgtagatgaccgaggaagaagaagggtaataactcgtagatccgttttgcatctcgctgattcaatcgcgaaaacgacttcctctccctattcccgttccatttttgctgttcccgacgaaatccaccgcagcagacttggagtcgccggcatatgccgatcggtggaaaccgcggtcggcaaacacggcattagcgtgccggcgacgcgccatggccgcgaacccgagcgtcgcgacaccacggccgcaagatcacaccggcgacgcacactggaagcgctccgtgccggcgtgcaccgggcagcaacccgcgccacggccgcgacgagactgcatcaggacgaagtgctacgcactagcacggcgcctaagtcgcagccaatgctcgtgccgccgtgcgttgcactgagacgcactcgcactgtgctccttgccatgaaggcactggccggataggacagagaggaagaagaagaaaagaaacaagcagaaagcattagcgtagtattgacacacacaccagtgtctacgccgccgcacggccgctggcctggccgcagcatgtgcagccgcgcgctgccaccgaccacgtcggcgcccggtctgtcgcgccgcaccgccatcggctgccacgccgcaccgaccgtactcatggcaaccggtgccatcaggggagagaagaaaggaagaagaacgaaaaagaaaaaggggaaggcgcagccgccgcacggccgtccccccgccggccgtcggctttcgccgcgcaacgctgcacaccgtcttcgcgcggcagcacctcaccaccgcacgggcgcgccgccgccgcatggcatcgccgtagcccgcctgcgcctggtaccgctgcccggctgagccacgccaccgcaaggccaactggccaagctcctccgccgcaaggccaagcaccgccgccgcgcgccccgccgccgcatggccacctctcgccgccgcgccgtgccgcgcggctgtgcgccgctgcgccgtccttggtgccgtctcggccgcgcctcgccgcacgggtgcgccgccgccgctcaccgcgtcccacgccatccgtcagtaggcgtcaccgcgccgcgccgccttcgcatggccgccgcgcgcctcgccgtcccgccgcgccgccccgctgcgcgtcgcgccctggccgccgcgcgcccgcgccgctgcccggccacctcgccgtcgcatggccggccgctgccacatatggcaggagccccatccgggggaagaagagaaggaggaaaggcaagaaaaaggaaagaaaagaaagaaaaaaagaaaggaaagaaaaaagaaaaatggaaagattcccgtgattttgcaaaaagacccctgaagttttgcgaaactaagtgcattttcctttggataggaaatcttgccttttgaacccttaacttttcaggaaactcataaatagccctctgtacttgggatattcgttcgaacggcattcggaatttgcaaatatcaccaaaatcatattctcgcataaaaagggaccacgggacattggatttcgaccccgactttccatttcaggtacctttattgctgatatatatgattatgaaatttatttatcgcatttacaattattaattatttgtgatgttttattacttttaattaatatcgttgtggtaaaatgtatagaattgcatagaatatattggaattatttgcaggaatttttgtgtaccattatattgcaacaattgtgcatttttacctgaatctaattttacgcatatatgaaaaaatgacgtgcatcgcgaattagaaaatttgccgaatcttgaatatctttgacatatttattcgatgtcgaaattacaatagagcaagaagctctatgttaccgctaatccaatcgtgctataggcattgactcgatgagtttgatctagtatttcaaactctcgctagtgcctccaagctgctctcatgaatgagtacgctagacgaatgagcgcgctagcatttagaggattatggtacataccctacctcccgtagagcaagaactataagcaagaacgggtatttttcgactatgattcaccaagcagatgacccatagagagtatggtaatacgatgcattgcattggcattgaatgccgctgaaactcttaatgttctacccgaacgcgatgaaagtcgcacgcaagtatcactagtacacgtataagaagtatgcctaactagttgataatggaattacgtaacgttcgggatagtgttcactagaaaaacattgtcttccaaaaccaactagcatagttgatagcgagttcaacaggagtagctagcttggtgtacttacctcaacgaaagaaggggaaaagggggagtagaacacaagtcaagatgaacaatctagaattatgaacatgaaaagaaaaggacagatcctaatagcacaatcatcatgaattgagggggagaactccttagctatttgcatggctatggacgtagaatctcctatgctagattggatcggccctaaaatttatgtcgggatagtaaatcattgcgatagctgttgagtaagaagctcgctatgaagttaattgaatccgatgtagcggaatacttcgttgaatcaataaacttcgtcatcacatgttgcaattcttgaatagaacattgcattgaagaaatggtgtttgcccaagtagagcacatattttccctgcaatagagaattatttccagtataaaatagtatatttaaggcatttactatcttgttgctcttttctagcacatagttataatgctttgaattttgtgtagcacccaaacataaaagaaaaatgaattgtggtccgcataaccacaaataacactttaagagaaagaggtatttccatacccatagaactagaaaaaattatgatcgttactagtagcaacaactaaatttgtcggcctagaaagtgccacggtcatattacctatggaacaaatgatgcactttatagaagcatccattgtccgtcaaccccgttgaactttctaaaagtgtgatgatttgggctacaccttttagtaacgaattttcagccatttgggtcttagaattataagaataaatattacaactcgtatggtcatagcacttacatgcataattttcctaaatcatgaagacttgtgtgctagtatgcaccaacaggagattaatgcataaaccgcataatacaaaggtatagttcctgcatccctgaactggattaggaggaatatttgcggtcctatttggtactatatggataaatgcgcttccgaagcagcaaacatccagtgtctcttagacaccgtgtctttgccaagactgatccagcaatatcacgtgaactccaatataactcactaaatcatctttagaagtccgcgaggacaacgctagcattgtatttgatgattggtgaattggcagcacgaagtaccaaatatccgcataagcggactaagtataagctatgaattgcaatatttgctatatcattgttgtaatacacgcagtagaaaaggacatgtagtcctgaaaacagcagactctgatagaaaattcagaccatcgtcatgaactttcattctgcaactagtgctattgtatctgttttggtttatgtgcatatcccactaccataatgcgttgcaaaaggctctctccgaaagtcggaaaccttttacgaagatagttatgaagcctaaattccttaacaaataagaattatttccagtcatttagggggagagaatgaacccctagataggaaatgtcaggaaatatgatagtagaaagggactaatgcatgttacaccgcactagtaaatacagtttgcataaagaattaaaactgccaaaccactttgtaaatacttttgtgatttcgaagagtttgactaagttgcatgaatgcaccggaggagggttaaataccgaagaaagtaaatgtatccctcatcttgtctagaggcctcgaataaaaacaattggacaagaaacttcagctcctcatgaccctaaagtaaccggagacatctggtgaaaatagggcaagagggactatcatactcaaagtcacgaaaagtaccccaccaaatagaaggggagccagttgagatctggcaagtggtacggaacctcagaataggcgtgctgcaccttcccatcaaggaagaaaactagctattcgagtgcacactaacgctggtacatgcccacattaagaagtattaagcaattataggaagaagaagcatatgaaaatgcaactcctcgtatatccatggatactcgcatagagcctcatgcaaccaataggagttggcaatgagacctatcatgggcaatgtctttttttaagacaacaaaactcattggcagtcaaccaggagttgaatggaattaataaactagaagttgaaaagaagaactcaacccaaatgttgataagcattgaatatagaatcaataaatgcactttagaagcttggatcggacacttgcataatagtacatgaagaagtactaagtcctgaagcaacatagaacaaatagagtaatttgaaaaggattgaagaaacaaaatcgttcattttgaattagaatttggcttcatttggaatatttggctgaacccaaatcatgcttacgcttgcagctaaaggcatgcaacatatgaaagtctagtacatcagtccaactgcactttgaaatgttcatggtgcatggcttcggaatagtcaattatcgccaaatgggacggaattcccaaacacaagagttatagcagcacatgaatatttggctaattgaactaaatcgttgaactgttcagtgcctcggcatggttttgagagatggttacccgcgacagcaattgcgatttgaaaactatctcaacccccaccatttatgatattaaagcagcatatgtcgcacatatgcaaatgagttacgtgagaagcaaactcactaagcatatgaacccccaagctattctatgtacatgaattgcatagaagcaacgaactaagttatgtggaagtcttgcagattcatccgctcattattgacatcttctctcttgaataggtgtttccgagaaatcggaataatgagacttagataaatgcaaaattcagggggagaattttgctgactcattcaagaatcttgatatagaaaatcaagtacccaaaaatcaatctagaaagattgaacgaagaattgggtggattgtactccttttctcttggataagttttcccagcaatttcttatcaaggtttttaatgaggcaattcatgcaatattgcaagcgtatgctatgtactctttccctaaatttttcccactgggtttttgttgagttttgatgaggcataggcatcacgcagtgagagcccaaggggaagtgttaggaaaccgctggcccatgaaggcccagcccggttacccagtaattgggcccatcactaaacatggaaggtagaagagagaatggctataaatagaggagtagagaggaggattgtacaggtgaatgaatgaatgaatgagaagatggccacaccctcatatctttgtgtctccaacttttgttatgcaatccctcttggactacctcggtagcaggaggggttgcataataatatcattgtacgactcttctgaccaaatcacgcgcataaacatgaggatttttttaacgactcgcacgagatggtgagaagttctattcatagagcagaaaaaaattacaacattacaaccctggagggtcgtaaccaggaaaaaggaaaaaaatataccaccaccacataccgacagcatcaacacacaagtctaggagaaggctagcgccggaccgaccgccgctagaccaacaaaggaacacagacgagggggtgccaaaacgacgtcttcaagaagagaagcgacggaaaactgccgccgctgtccgttggggcttaaaggagccaagactgggctttcgcccggcaaccacccttgaggggtgagacagcatgacaacgccctcaggagggggaattaaccattgttgcgctccggcaaaggccgagcttggttttcacccgctgctcaccacctgcgaatccacggttgacgcaccaatgctccaccaccactcaacctttgctgatatgtgggacccctgcaccggcgccccccgctggcaagccttcgtgcaccgaagaccgcgccacacccaccggcagctcctcctcgcaccaaggtcgcctcctccaccgccggccgcgcctctcgcaccaaccggcctcctccaccggacgtgcctctcgcgccaatccggcctccctccatcggcagcgcctctcgcgccaagccggcctccatctccgccgcccgtgcctcttgcctagccggcctccgctgccatcggccgcgcctctctgcaccaagccggtctccgacccctcctccatacgctgccgtgccggccagatgcagccatctgccacgccctcagctagccgtccgaggtcgccatgcctcctcccacaccaccaccgcagccgttgctgccgacggccaccttgccgccgtccagccgctacagcgaccgtcgccacaagctccgtgccgctgcctccgccgtgagtgcgccccgttgccacagcagccggcagccgccactaccgtcgaccagccaccgtgatgacgccgccgtcaagctgctgctgccgctgtcgccatcgccctgtgctcccgcgccgttgccgtcgacgccgtcgacgtgagctttgtagtgccgtcaccgccgcaagctcgccccgcactagatccgccctgggggtaggggggacggatccgcctccggcgtgactgagtcctgcctgccgtcgccatcctccaccaccttccatccccgccgccatctccatccccgccgccgctggcctggactccgccgcctccaccaccactcaccgccgccgccgctcctcagccccgccgccatcacctcgtccgcctcttccgcctgcgccacggcctcctccaacggcaactcgatctcctccgccggcctttgaagtggcgcggccggcgccgctccctcccgacttggccacgagggggctagatttgcctccatcggcgtcggatccgtcgcctccggccgccggcggcaccgaagaccaccgtctccgtctctctttccgttccccgtcggagctccatccgccgggaagaggtgcgagggagaagaaggccccgccgccgctgtccttgccgccgcccggctttgtcggcggctgctcgggcggtggcgaggcagaggaggcgatggagcgaggtgacacgggcgctggctaaaaacatgaggattatctggttacgtaaagacgccaaattcttagtttgttttactctgctaggtagggtggccatagcggcgtcaaatatgttatcatggattactttatcttattagtttaagaagttgtttgaaggacatatataacacattgttgggtaggcaaatggacatggaggtgctttcttcgttcttcgtatcctcattgaccgcatgatccatgtgcttgcgtggaccaaatactactattgtaattggtgtggctagtttcctggaaagtccagcactgagaacaagttcagcagttggctgaccaagacagacacttgtgtttagggttggtttagttccccaaatattttttctcaaaaacatcacatcaaatctttgacatatacatggagcattaaatatagataaaaacaaaaactaattacatagtttgcatggaaatcgcgagacgaatcttttgagcctaattagtcaatgattagccataagtgctatagtaacccatgtgtgctattgatggcttaattaggctaaaaagattcgtcttacggtttccagatgagttataaaattagttttttcattcatgtccgaaaaccccttccggcatccggtcaaacatccgatatcacacctaaaatttttcttttcgcgaactaaacacaccattaatctgagacgatgcgcacagacatgtttgatcaattaatcctaattaacatcaattaaaatctggtaacatatatacacgcagatgtacaagaggcgtatgacatttagcatttattattcgcatctatatcgttctgtgttactcccttcgtcttaaaaatatggtaacttttgcttttcaaaatttatcacatattttctccacttattcaataatctcaatcaagcattatcatctctcatttaatttttctacataattttcatttcattccatcgtaacagtgcccatttaatttcacctaattacttataatcaccatataaaactaaaacaaatccactaaatcctatcttgttatgtcggagggtgaactcctctgccagggaaccgtgaggtccccttttttgttcggccgggggcggtgactgagattcgaggactctgtggtggagtgtgaacaagagagggtcgggcccctcgggggagatgagacaataggggtttatacaggttccggccgctgagaaacgtaataccctactcctgtgctatgctgattgaggaagagagattacaagatctctttgttggagtagaaggtgttgatgataagaggcaggagactgctctcgtgaaaaagcgctcatcccctccctaagtaagcttggacctccttttatatctcaaggggttaccacatgggcccatggagcctatcttggaagtctcttgcatgcccgctgcagcgtggggactgtcaaatcatgccgcctgacacgagggacgcccgtgtcattcgccatttaatgggtgaagacttttgggttctcttcacaccgggaaacgagaaccctgcttgaccaaaacggatgaaccagctccggctgggaggagaggctaaaagcctctcatcatgacgacgtgacggggcaaggcaattgcacgccgcctgacgcgcggcagtgcgtaggcgcactaccctagtcccgtcaatcattcgaccggtcacatacctgtcaggcgtgttgcacgctggcgcgcccgttcggtccgctttaaatgtggttaagtgggcactgtgcgcacccacccaactcgcacgtgtaggctgatgcgctgagggggttgggacgggtccgaccctcgagcgaggagggggcagccgccactccaccccgggcccgaccctcctcggggaagtgccacgtgggtctgggggcaacctcctccctccaaactcggtaccccaagctgggagggggcagccgccgctccaccccggaagccaccccctcaggggatgccacggggattcggggggcgaccttctccctctaaacatgatacccccggccccatatcaccgatatgctataaagcaacaacccactaaatcctaaaattgaacacacaaagatgtcacatcattatcctttaacaattgttaaatataaaatatcatgcaaacaagctatattatttataattctataatttattaaattttagggcttttaatgtaagtatgttaaatcactacccaaataattcacataatatcttaatatatctctccatcgtttttataatatcatatatacctatatagttaatcttattaattaatgttatttcactcttttcttattaagccatatcacatcaattgtgcttaacccttattagatgattaatgtgtggtctaaattatcttcctcattttctcattaaaatatatcacctcaattgttttagcctttagataattaatctacggtccaaattatgttcctccttttcttctctcataattccatgtcaccttatttttgcatttgaatcaatattccatatactgtttgaattatcattctatatactattgttacatttaaattatcataaaccgtcaacttatataagcttatatcgtttaactattttacgtattattttaaattattgttattatactaaattcctgcagaaacacgccgggttttacctaggagacgaaggggtatatatgtcaacttgtctcctcgctgttcctttctctccgcttatctcttatcttccatgtcagcaaaaataagtaccacaaaacaccattttaatcggggtcgtgcgtgctcaaatctgttagtgtaaacaaaggccacatatatacgatagatttgcattccaggtagcatatgagcatatgtatctatgcatcgcttttagcagttttagcggggattgatattaaggtaaaatattttaatgcctctaagatcctacttgactgaagaaagatcatatctagccatgcaacaaaaattacagagaaccatatgaagtagttggattgagaaaaacagtatttgttgacatattttatatgctagaaaagtttatatttatgaacagaggagtatgagcaattttttatgtgtagatgatcttgatccactactcaacatctcgttatcacgcttgctcctccaatccaatcatgctggtacctttcacgcgagagaggtttttcttgttctgcaacttgtagacctaggtcgtccataatctctgcacactgttcagctacattaattccaagatatagaaatcgcagtctttttttccaatgaccaatttgcaaaatttaagattcgctagctagctagctcttgtcatcatgcctccaatcagtctgacgtggacgattttttttcttttataaaattatttattttggcaaaaaagaaatggacaagaatcaaagatggtacccacccacgcacgaggctcgattgatcgaagacaaggaagatctggcttggaatctaataaagcagagagcagtgacacgatcccgtgagcatcaggctcactgttctctcactgttctacggagaggtctttgccgggtatcatggccaatttgagctcaagtgtgtgctcttcattgcagtcttgtctctgctggagacgacgacaatggcgataatgttggtagagagatcaatgtcggaagggaactgggatttgatgttttcttttatcttcttgttctctatgatgggggcaggtcgatagatttacatcagcacgatttttctcccattttgcgtggatggagatgaagggaatcctaatgagggtgtcgaaccaggagaagtcgaacgaaatttgcggttttattctttttatttttaatggttattatggatactaaatgaaaaaaaagagtaaatatacgaacttgtcattttggtgcaatttagtatattaacttataaaaatcttatttttatacacgaacttgtttggtaggtgcaaaccaagatcaaaatagcatgactaggctaattttgcccagttggatgctaattattaggacatgatatgcacgtgtgaggtgggcatgagacatgttaaacttggtttctatattatccttcttttttatccatccttgcatcttagttcttctatgtctttctttatacaatatttatgtcttattttacatttattgaacatacctatgtttatgtggcatcttctcgcatacgcgtttatgtcgtatcctcatcaacacttaaataagagaaattagccatatcgtattcttttagccttggttcgcactcaccgaacaaatttatgtattaagatgagcgttttacaagtttatatactaaattgtatccaccttattagttcatgtactaccaaaacaatttatagaaaatgattgttgtaacttaacgggataaatagtgtgtaatctattcggactctacgcaacttcaacacggggtaatctgatgagtttcaaaaataaatagagataatccgttcaatccaatgcaacaaaataattttaaagatggtttttgaaatggaggtggtgggaatgggagagggatgatgaggatggctatagagggctgggtcgacggtgaggtgctagagcagtgaggatgtagacatagttagcgggaggggaaaagatatcagagatgaggaagaaaggtgacgtggtggtgttggaagatcataaggaggagcaaggaagatggtggggagatcttggctgaagggctcatcgaagtcatcgaagccggcgcaggtgttggcataggaagaaggtggggttagggtcatgatggtatgctgagcagtgttgattttgggtaaatagggagagatgagagctcgtacgaatctttaagcaattaggctaaatgttggttcgacgatgggaaaggcattcatcaagaggtcaccataatatgagagatcaccttaggaaaaaaaggaaaacatcacactatgagatattccccgggacccaataatctccattgatcctctcacttgtgtctgtgtactaccttagaagttagaatatatacatatgttcagtactaaaatatgttatatttaattttagggtttttttatgggatgaaaggagtatatattacggtagccactggaggctccaggtgccgtggcgtgcgccttgtagcggcggcgcccttccacgtgcgcagaggccgccagccggcgaccactcgcacacccaccacaaccagtgatcagacaccacctaccgcgcgcgtcgcgtactcgcgtgcccaaccccttgcctccccgtcactgcactgcaccggcgccttctcctcctgatcttcccagataaatgttgataaactacggcaatattgagtcatcaatagcgatcaccggaagaaggaggacagagaagaaaccgagagctagcgagaaaaagtccaacaccaaatccggcaccccccgaccaaaatcccgggcgtatttaaaacgccctccctcctcccttccccgccgcgacccacgccacaaccccgtcgtcgctgcgctgcgcgccaaatcactcgttccaccgctcgctctccctccctctctctctctctctgtctctctccccctcgctttccccgctccgctccattccattccattctcttctcgccgcgtacagattactactactactgctacagtactactacagaaggctcgtcgaccccttttgatggcggcggcggcgtcgctcgccgccgcgcgattcgccggcgaggcgtccccggcgccagctgcggcgggggcggggacggggacgtggcgggcgcggtgcgccgggagggtggtggcgatgccgatgcggcggcagtgcgccaggggcgtcgtcgtgcggtgcgcaggggcgggggcggggcggtcgttcggtggggcctcctgcgggggcgggggcgggggcgggggcggggcggaggatcaggaggaggaggggacgaggttcgtggggtggtttcgggaggcctggccctacgtccgtggccaccgggggagcaccttcgtcgtcgtcgtctccggtgaggtcgtcgccgggccccacctcgacggcattctccaggtatcgcctcgccctgctctctcttgtgctattaaaaccaacgatttgaatttgtgtggatttgttctttggtcgaatccgattcagggggcaatggaaaaaccgtcttggagaaggggcgattcgtgaaattgattaggaaaccagattattagcagatgatttgtgtctaccgacttttagtaactttttcttgtgaagttttatttgttccatttaagtggatggaatgaatcgatccatttcatactctgtagcaggctgtgtcgctgcctgatttcattacatcacagataaattttagaccatttgggtggcgtgtcccattatgggttttcattgtcgcgttgcttcaccgggtatcacttccatcattgtactgtttttgtgcttccatgagatcaacatcgttggaggatcttaggcgcttattcgatctgttagggaaaggttgaggtaattaaagttaacaagttccgccctctctattgaactaggaagatagataagattattagttgcacgtgtgttactttcccttgtttttttcaccacctatttcagtccttttcatgtgaacgcctccgttgaacttgtggcaaaatcttggataggttgaccagctccacttgctttgctcactgagaagagcttattaaaaaaagtcatgttgttttcataaagattaaaataaaagaagacatttctgggctatatataactaacttactgaaatttttcatcttgttgatatcacctgcctttttttggattttatcattttttttccttgtaagtagaatttatcgttcttgagtttttcagtcttgttgttttgttaattcaactcaaagcaagttccatgcattcttcttcttgtttttttttttgggtaccaactggtgacatttcgtttaacttgtctggtcctactattttgcaagttggtgtgatcaaccttatacatgctctatgtgcgtggtaggtaagtactgagttccatttttcaggtcaaactttctagtgtgcagttgttaaatgcctatttctaccggctacaggtttagataaagacagtgctaataagtatggtacatctaattgttgcttgcattggacaaataatttgttttgtcccgtctttgtggccattatgatggcaaattcccatgttcagttgtttgcccttcgtttccacttcccagtcaatattgtcctgttaagattgttataccagggttatatgtaaggtcgtttcgctaggtagaagagtttgctactttattttatgagttatggagatctgaactgttattttttcccctactacctgctaaattacagttgttttaatttacaggatatttcacttcttcatggtcttgggatcaaatttgttcttgttcctggaacacatgttcagattgataagctcctatctgagagaggttagctgaggctttggctgtttacacatgtatgcttaaatggatcaaacaactgacattgttgtgttttacaactcactagcactaaaacttttttagcataccctagttttcttttttgctttctacattcattttttgaatactagctgaatgctcgtgctttgctatggataaaagaaaatatattaccatattgttttaaatacaaaatatatattttccatgattatttttctctctatagggaatattcaccttaatttgaatttatatgttgttacccatttaggtttgattgttttttaatattaagaagttcaagggggtgtttgcaatgggagtaggtggggtggcagattcactaccaccaccactacattcttttcaaggaatatagatatagatgttatttttgcatgttgaaggaaaacatggtatggctagattatggttttttgcatgtgcaaagcaaaaacatatagcgagtctgacttaattattttatacattcattagattatgttgcatatgcatgtacgaatcaaaagcatttaccaagtaggcaactagatatttgaatacagtaatttggaataataaaagtaccagtagggaattccactcgttattactatagcactgattcttaattttatagtagtttttgtcattttgtgtcaatatacataaaatccaggactccaacagcttctgcttgtattagatttgcagttgatgcctgcatctgcaacctcacataaacatgcgactgttaattgaagttaaattttaggataatgtatgattttcccagtctgatattctgccattcacatgctagtgattactgaatgcccctcttttgttttctcagggaagaaggccaagtatgctggtcgttaccgtattactgattctgattcattagaggctgcaatggaggcagcaggcagaatacgcttaactatagaagcaaaactatcccctggtcccccaatgttgaatcttcgtcggcatggtgttaatggtcgttggcatgaaatatgtgataatgttgcaagtggaaactttcttggcgctaaggtgaatatacatactgaaccttccatcacttctaggatagtagaacgaattgagttgatttattttctcagccgtgtgcaatgaggacaatgatgactgtcagataatagacgcatagttcaataatacatgaggtcttatacaaattaatagctattgaatccaaaagtggaattaatgtttgcacttccattcccaactgtgtaatgtgaacatacttaagtgagaaagtgagactcaaaattggcaattagtaagcctctctagctagcaagtcatataaatccctttgtttcaattgtttcaaaagataatttttagtcatgaaatggtgaattgatttacctctctactcttttggcagagacggggggttgttggtggcattgattatggattcactggtgaagttaagaaaatagatgtttcacggataaaagaaagacttgatagagatagcatagttgttgtgagcaatatgggatattccagctctggcgaggtgttgaattgcaagtatgtttactgtattatttgaaattttgctgtgattaatgtgaatctgtgttcataattcttaagatatctaaaaatcagtatcatccatgtcatataccttatggagaatttcataagaaatagaagataattgcaccattttcctatagtaagtactgacataactattcttttgttactttcagcacatatgaagtcgctacagcttgtgctttagctatcgaggcagacaagcttatctgcattgttgatggtcaaatatttgatgaacatggtcgagtcaatcgtttcatgtctattgaagaagcggacatgttgatcagaacacgtgctaagcagagtgagattgctgcaaattatgtcgaagttgtaggtgaggaggatattagttatgctcgcaatcttcctatcaaagaggagaaagaattaggattgattggaagggacttcgttgatgggtatactgcatctttccggaatggtgtgggtttcaataacggaaatggtctgtctggtgagcaagggtttgcaattggtggggaagagcggttgagtaggtcaaatggttacctttcagagttagcagcagcagcatatgtatgcaatgtaagttttgagcttcttacagaatcccattccttaaaatttgcaattctttgctattgattgaaaaagtgtgaggttctttcagcaattagggaaaagttaaaccctgcacttcgccacattctgatgctcatattttctaaactgcttatgaatatgtttctagtggacttttttactcagtggtatgtgccattatgtttctattcatatattagaatattagaccaccattctgctggattatcttctattacagagtgatgtgccatttccttgtctaatattacttggatgcccattaacgtgttggaagtgatatttgccgtgatccttgggttattatgtttccatgaggcaacactatgtgatgtatatgtgtgccttagttgcatcagtaatgtgttcattttcttttgttactctgacatcctattttctaaatgtcagggaggcgttcaaagggttcacattatagatggcactgttggcggatcattgttgttggaattattcacaagagatggtgttggaacgatgatagctaggtcagaagtttggaactttctctatcctagatgccagttttaatgtacaaaccggcaaactttataactgcattatacctaatatatttcctgaacaagtgatttaatatattttcacaaaacatttgtttccctggtttttgctaaaagaaagacggccttctatccattttgtacatggcaatgtacaatattcgattatataataagtttatcttcttgccgctttctccattttatagttcatgtttcttggagacaaaatgttttggttcttatttgatattttgattaggaaaacaggatcttttgtccattgaatattttcttgtgactagtaatttcattttgtatatttcacaagcaacatgcaaggaaatgatgtttgtgtgcttcttctcacagagacatgtatgaaggaacaaggatggctagagaagaagatctttctggtattagaaagatcatccgacccttagaagaatctggtgtcctagtgcggcgaacagataaagaggtacatttactatctcgttttgtaaacatttagcaatggatataaatacattactgttcagtccagacattccctttatgcaactgaacatattttatgttttgttattagcttctagaagcattgaagtcatttatcgtcgtggaaagagatggttcaatcattgcatgtgctgctctctttccattcttgaggataaatctggggaagttgccgctattgctgtatctgaagaatgtcgaggacagggtcaaggggataagttacttggtacgatttctgcattttcatttctttagtagataccagtttggctatcaagtgtttgtacaacatcggtttggaaaaccagtgataactgactggttgcaacatgatttccctatcttgtcctgcatcattcgccctctgttttgtgttgtttaatccactttttttaaaaagaaatatgttgaaattccaaaaccgctgctttcttagaaggccagaaccaagcaggtttcagggtttgccacagtacaaaaaaaaaaaaggagaccctacgtacattagtacaacttgaatactttcataataaaatgagaaaaagaacaccttggcatgtctgctaccttgagtattgacaactttttcttcattttacatagatcatatagcatccatgagcaattaacatctgttgtggttggcatatatccttttggattttctaatgaacatggtgtcagtttttcaacaagtctcagtattaaagttaatgtttcccgaaatatttttgtttgctctacagtcaatcactatgcattatacttaccctggtgatctgtcctttagattacgtcgagaagaaggcattatcgctggtcttgagaaaatattcttgctcaccacacgaacagcagactggtatgtacttatgctgtagcacggcgcaaattctatttatgttcaaagtccttttaacgaatcctgtcacatggtaatatgcattgggattggggtgctttccactgctgtttcgacatgaattaaacttactcaacctagtacctgctgtatttgttaacaattttgtggtgcaatttttctttttcttaacaaaattctggatgtacttccagtcattgtttatacttttgatgacgcaaaatgttcctcatttataactacatttccacaggtttgttcagcgtggcttcaagga

SEQ ID NO: 47298 - DNA, 3089 bp, Oryza sativa
cacgcaatcccggtgttgctcatgaggtttctaactttctatgataacctcaaaagcgattgtacattgtataaattgtgtatggtatatatgtgagtaatcgatcaccaatgtggttttgtttctttagtagaagccgcatcaatgggtgcagtgcgagcaacatggcagcttcgcggcatctgggttcttgagcagtcatgttgaaatgccatgtgtaggacaaacataaaacgatcgataagtaatttaaaatggagggaatatactttgagatgaaatcatagagtttaaagtctgaaaaaaaagatgtctcgacgtgaggctcgatttgtagtcactaacacggggagagtgagatattacagtaaactagataaactaatccatcaaatacaatgatttcgttaagggggtatacacttatctggtgaacaggcaatacacacataattgtacgctgtgatggtagaaaaattctactaatcttatcaaagaaagtaaccaacacgacatgccaatcccaacaattccatatatttcttttcaaaggaacaataattccacatcaatcccagggtttgtgtccgatcgagactgcttggtcacacggacagacttgatcagaagcaagcctccaacaggcagcagcagcaaagtgcagccaagctgtgcaaaatcagagaaaaaaaaagcagattcggttagggcgccgaaaaggcgaaaaaggacaaaatacagctattacccgtgcaaatcccatactaattaacaaaacccagagggaccaacaagttgtgtgttcgctactcttggcagtatcaccaaccactaccgatcatatcccttccagctgcgctttacagagcgagagttgccggttagctagctagtggtggtggcgcattgctgtcaacgttcccaaatcgtgtgatttgttgttggtccactcgaactgctcaatcgtcgtgtgaaccaaccgtggaattaaaattaaccagtgaaaacatatcgcaagttgaaataaaaagacaaaaagagaacttattcactacaacttggtgaatatggtaaaatatcaaaaaaaaaaagaaagaaaaaaaaacacaatctgtgtgtcgctgtcagacgatgatccctcgaaattttacggttcgtatttgtgtggacctcgaaattttagtcgtcggttagaaggtcacattgggagcgagtgggcgcaaggacggataagaaaagagacgaaaaagaaaggtagaagttggcacagaagaggcgtggggcccgcgtgccagtgagccagacacagtcaggtcacgagccacatccaccacacccaactcgcctgcctaacccgtcgtcgtcgagccccccaccacccacccaacactccaccgccggcgagcatcgccgacgaggaggaaatctccaccagaaacccgaagcccgaactgtctgggataatagctagtagtaggtgagagaggaggaggaggaggacgtaccatccctccatgaaggaaggcccgctgctgtggtgctgctgctgctgcggcggcggtggctgcgcgtacggcggcgggtagccctgctgcggcgggtacccctgctgcggagggtatccctggggagggtacccctgcgccggcggtgggtagccggccggcgggtaccccggcggcgggtacgcgtccttccccgggtaccctgcaaaattcagatcgatcaaccaaccactacagttacaagaagatggggaggaggagtggaagggacggatctggataggaaaccttgcggcggcggcgcgcccaccggcggctgctgaccgtagtagctcatctctttctagtttagctggaggattacttttccccttctcttggcgttcgtcagtgagaggattggcggttatataggcacccaggtaggcagttggccacttggcctggacaagggagattggagtatcggagaggaggctgttgaattggaaaaaaaccaacaaaccgggtgggtcatgcactcatgctgctgcacatgcaggtggatggatggatggatatatagccgtttggtcatttggacgacctgcacaagtgcaaaatttagactaattaactatttgccactcttacaagtggcaaattaaatttgaaaatatacccccttttttctataattcgcgtttatatacatgcatggcaactatttgcgaaaatatacctaatccgcagccccacgctgcgggagcgaagcgcaaccgcggattggggacgcaggaccggtgcccagagcggtggcgcacgctggagaagcggaaccgcaacggtcccgcacattggccgtgcggaaccgcggtggtctgcgggaccaatcgggccaaattcggtcccgcatattgggcatgcggcaccgatacggtcccgcatatccaacctgcgagacgggcaacggtcccgggccacccctcccctcccccgaaagttccttaaattaatcctaaaatttagttgcagtcacttctaaaattttgtgtacatttaaacaagcaaaccactcctcaactttaggtccaatcactcctaaaattcagggaacagttaaaacaaaaaaaatgattggaacttgtaggtggtagtgctaaaattctgggaacagttaaaacaaataaatggattggaggtggcagtggcagggcggtcgcacgctctggctctgcgggaccgtggcggtcgcgcacgccgggagtgtgggaccgacagcccggccccaccctttgccctctcccgcgcatgcttcttttatcatctggtccacgtgaaattatctcccacaacccgtgctgctgctaaaagtagacaaaataggaatgtgcgccgtcaatacagtgaaaacgtcaatcatgtcttctttttttttttacttagctgacactataaaataagtgggcgagagacgcgatgcccctcacacaagagctgcgcaaaagagaggagacactcatgctgtagaagagagagtagcattgtgagagaggagagctagagaaaagatcttggtgagcttccagcagcaattgaagaaat

SEQ ID NO: 47299 - DNA, 1277 bp, Oryza sativa
cctgcagcccttacgttagaagttgataaatatatagtatgaatgtagtttaaatatagaatgggtttagtattatatttgttgtatataagacgtgcataaatttttattagtgtgtgaggccgtgggagaaatgtatatattttgaaatttctttagttgtgtgtacgatatctgaacaagatagacaaatgggtaaaaaatatattaatttactatgtacgtagaatggttgtagtattatgttttcgggtacataataaggggaaagttttaactagtatttagagccgtgctgcacgaataattgaatgtggtaagaagttttttagttgagtgtaccatttgagagtgaataagacaaatggaagaacaaaatttagaggtaacttgcatgacggttgggattgatataaatagtatggattttgcaagatttattattgacatatattcattattttgaaggttataagtgtgaacgtggtgcatttaatttagaaattataagttcggagaaggacaagaaataaataggagacatacaggtaagcatatatacattttatatgtgtttaggtattcattaaatgtgcaaatcatgtaaactaatgaaatgaagaagggaataaaattttcttaagaaatcatggtgcgagttaattttctggaaatctcgatgaactaaaatactatatggaattatcgtgaaattttcgaagctatattggtaattttaaaagtgtcataataatttcagcaaaataaaaaagtttaataacggccatcaaaacgcttcacatacaaaatgaaaatgacataatccatatcttcatttgtgacataatccatatttcacagatgttcattttttgtaatgcttatatgtactgattaatttggaaaatttcaggtatggcggacgattggccctacccgttactcagtagagacatcgatgcacggcaccgtgcacgacagatgtcttccagctgtccaaggggtctgtcggtcttcataacgcggacttgcccaatgtggggggtcgacgaacgttgggtaccaaggtaactaatttttatacaggcttacatgtaatattggtaatattttttttacttcaattagtgttagttttgtctgacccaacgattgtcgttttgcaaggttgtccaccgcaggccttcttccttttgttagttgcaggctcgagggcattaggattacatggtagcaagacaacaaagtgcacgccgacggagagcaaatccagggga

SEQ ID NO: 47300 - DNA, 22877 bp, Oryza sativa
ttactggttgtccattgttggtcatgctatggtcgtatgaacgctttccattgggatgaccgtacatgcctgaacctatggctgattcgaccttatttggtaacactacagatgataggcctacttatggcatgcattggtgctagggaccggtacgtatattttttttaacatttgcatttatttcgtacatatataatcttaatatttatttcataacatacagccacagtgggcgaatgttcaggttcgaagtgcgtacgaatacttcactgaagtgttcgatctacttaaggaggataacgttcagtggtgtccgtacaccaacgaggagacacaacgccgtgcccctactggcctcaatacactctgcctgtgtgactcgtcttactggctgacgaaaaagatgcttctgtacgatatagcagttgaggcgtacagtccgcagcatgtaatgaggcaatttggcctttaccaagaagtgccagtcccacttggtgaaacggtcccccccaagatacacttgtaagttatatttaaatgcattcccattaatttgcgtgtgtccgaattatattacttacctcaacacttaatgatgagtttttgcaggcaaaataggaaggcagatgctagcgtgcggcgaaatatttttgctaagatgacaccttgggtcgaacaatggtcgagggcaacactcgacattgttaacgaatccagaccgtacgaccgttgtcctatgcataatgccctctacaatagctgtcaaaggtagaggccttagttttcgtagaacagcgttgtaagcttctgcaagattagttgtcatgatcccatgtctggccccatcggtgtcgtgcagcaatgcccattgctcctctggctctgcttcaatccaatgtgtgaaacacttgatgtttcttgccaacctccgtcgtttactgttggaagtaataagactgtccattggttctaaggcctccagggctggttggtcatctttcttgcaatccttttttgacttaacatgtgttgctgttgcatcatccagctgcctccaaagatcttctaacttctgttgctggttttgcatacacagccgcttgaacatttgcattagccttttgctatggaactgtttgaaaaagtttgcacccatgtgacgcatgcaccatcggctatgcaaatccgaccagtagtatgctccgttttgatcctctttgagctccttgattgccttaagcaacccagcatttctgtcatgaataatgcatacattcgatatgctttgcaccacaccccatttgacatgctgcaagaaccacaatcaactgtcgtagttctcgctctcaacaaaagcgaatgcaaccggtattatctggttgttcgcatcggcaccaacaaccgtcagaatagaccaactatactttccggtaagaaaagtaccgtccacatatagaacgggtctagaccattgaaatgcgtgaatacatgctccgaatgaatagaatgccctttccattacacggaaattcggaggtcacacggaatccctgtcttggacaacaacataggtaccaggatttctgtcttgaacaacaacataggtaccaggatttctctgtttcaggatatctaggatctgcggtagtgtgtcatatgccacctcgaatgatccataccttttctccatcgccttttgcttcgccctccacgctttgtggtagctaatagtgtaccgttcactagtctctactgcctttattatatgcctcacgagcaggtcgtccgcttcaataatgttgctgtagtacttgttagcaacatacgccgcggtgaggttgcggtgggacgaccttgtgttccttagcatacagttgttgtgctcctccactctcgacacgagccagtacgactcgtactttggcacatgcccatgaaccctaaaattgcacccttccgtctcacacaccgcagtgtagacggtcaggcttgatttgagaactttgaactgcctctgcatcttaaacgaccacgacttaactgcatcctgaaatgcagacttcgtcgaaaacattgtgcccttgtttattgggccatcaccatagaaccataccgagtcatgcaactcgttctttccgatatatccaagatcttcacggttccatgatgctataacaggttggacttcgtactcttcatcatctgcctcctcatcctcctcctgagccaagttagcttcatcctcacgagcattcctatcaaccctctcaatctcgtccactataccatttatctcttccccttcatcggcttcactcgaaccatcttgttgcaccgtgctcggcatcgcaaccaccgtttgttcagcttgttcaatatgaaggctctgcatgtcaatgccaatattgtcttcattatgctgggagacttccacatgaaatgcaatcggttgagcacatgcctctccctgcatatcggactgaccgaatgaactgtttggtcgagccctccttggacaagcttgcaccaacatggccatctcgtatcctcgacgtctgcaaccttgcaaccaatccttccatgattgacttcgggttacttctttcagttgccattggatgtccgtggccgaacgactccataacagactgacattaacactatagacttgtgggtccaatgagaatgagcatgtcaaccagtaccacacttcgggcattctaagattgtccggatttgggtgatacagtgtgcactaactaaagttgctcaagtcaacacccatttcgttcgacataatttccccgttgccataatatactctaaagtttgccattcctaaacaaataaacaattgcattacgtacgactaaaaaaactaaaaaaaactttcagatatcatacacacaactaaaaaaactttcgaaatatatacatttctccccacggtctaacacactaaaaaaaaaattcatgcacgtcttatgtacaacaaatataatactaaacccattctatattcaaactaatttcaaactacatatttatcaacttctagcttaagcggtacctaaaatttctaaacataactgaactatttacatgtaatatatgaacactatctaaactattacttatctaatacactaataattatgtctagtacataagcattcgctaaacctgttcttaataatatatacattactattttagctgtatttcttctcttgctgcaagatcatcaaaatgtttcctcttctgtgcaatctcctgacttctgtacgagcagcatctctcctctcgtttgcgcagatcttctatcttctgcagacgcatctggtctctcactctccatctactcttatggtgggagctctaaacgaaaagaaacgacacgaactaacgttttactgtattgacggcgcggattctttatcttgtctagctttaaagcaacatttattgtggagagagggcactcatatggctatcttcgcatgccctgctttcgaacccatcttctccacacaaaaaatggagcggtccattagaacgtgattaattaatattaacaattttttttaaaaaaatagattaatttgttttttaagcaacttttgtatatcaatttttttttccaaaaaacgtaacgtttagcagtttaaaaagtgtgcgcgtggaatactagggagaggggttggaaacatggagcaaagaccatagtggacagagagaagcaacagttatcgtggagagagtgcactcatagtggacagagagaggacagagattactcgtactagcagagaggacaaaggtgcatcattgaggacagaaaggtcagaggtgcaggcacggtcccgcgcgcccagtgtgcggcagcgccacggtcccgctcaaccgttccgcgcgaccgcgcaccatgcagggtcccgcccaaaccacgcgaatctcagtgcttcatttgttttaagtgtgcctaaaatttaggagtgattggacataaaatttactactattcgcaaaagttgactagtgattggatttgtgtggagagcgatcacgcagattagaaggaccgtcccgcacagccactctgcgggaccgggccggtgccgctcgcccgttctgcgtgaccgagccggcgccggccggtcccacaatccaccgcgctgcagctttatggacctgcgggatcgtgccgatgccgcctgctcaatatgcgggaccgcttcgatcccgcatattcattctgcgcgaccgggacgtctagcgatcccgctcttctgatccgcggttacgcgtcgctcccgcatccccaacacgcggattaggtatattttcacaaatctccgccatgcatgtatataaacgcaacttatgaaaaaaaagtatattttcaaatttttttctacaagtggcgacaaaggatttactactaaacccacgtgtcacagatacatgagggcctagatatgatagacaatgcgtggcaaatttttaattgtcatatcttaaaagtggcaaaaatttaaatgtcccacaaaatttggacaacaaatttggttagaattcacttttttcctccaatggagactgtcaaacacctttattgtcgtccaaatttggttagaaaatttttttgttgcaagaaaaaaggatcagatttagatggataataaccatataatatatcctaaataatatattctgagactttctatgtggtgatttttgataaaaaaaactccaaatctagcaaattgtggaccattggatttcatgcaacataccttaaccctatcttttcgccttccctcctcggtccacccgccgccgctttcacgcgcctacgcctcctgcatcatcgctgccacccgacctcatcggctggctggaaggggtcaacgtcgccggcgaggccatcttggccaacctccttcccttttcctcaccgaccttctcttcctcaaggtaacaacaccgagtgcccctgccctgctgactttcctatctccggcatctccccaccaccggatcagccaccgccacccatcgcctcctgaccagagtcaccttgttgcacccgttgcaaaccccgcaactctggcgccgccaaaggcacctcgtcactcacctgtgtccaccacccaccactagatctgccaccaccggtcgccgcttcctaaccaatctcgccattttgcctgccgccaatgctagcccattgcccattgccatcctcgtgacttcggtgccgccgcaagcacctcgttgcccgcccgtgtccaccacccacttccggtcctccattgcccatggtcatccctctaaaccccggggaacccccctccctaccaggctaccaccaaccccaacccaaaaccctaattcgcttgtctcctgctggagttgggggtatcaacggcgctagagaagagggggagcttgccggagtcagaggagaagaagcccatgacgaatcttgctgcagaaaattcacgtcccaatggcgtattctgaaagtagtgcgaattaggtggcatatcctgaaaaccgtgcgtactccaccacacgcatatcaccccaccactcccctcgcgcaaaaatcacgctgctcgccgctccctcacgcgctctcctttcccccatcctctcctcccgcccagatcgatccccctccccttgccaccgccacctcctccatcccttgccaccgcaagcaccgccccactccccgccgcggcacccgtgatgctgtctcgttcctcactccaatcgctgaagtcgaagactgccgagcaacactaatgtcccagcacatacaacacaccgaaccagatgaaaggtattgcacttcaagctcaatgggtttaacaactgcagcatactacaggttgataaaatgtcatggcatcctatggcacccagcaacattcatctggattaaggcaataccaaacacttgcaaaattttcctctggctggcctttcatggcagactaaatacgaatgataacagggtcaggaaatgctcggcatctgatccgcattgagctgtttgcccagctattgaatcagcagatcacattgttccatgctgcaagttggcatctgaggtttggaagaaaatcaacctatttgatcaggccacccagagtgcagattgtggagattatggataccccatacctacacggcatgtatagtccgactgggtatggggtgccatgtatagataagatatctttaaagggacttgggttaaattccaaacttgtatgtcaaggaaatacccgggatcccaatcggttatgattgtatattatctgtaactacctattccgttagggatatggactgtactttgtaatacggactccttcccctatataaggaggggtccgggtgcctttgggggcacgattttctcctagatcatacgatcaataatacactcggcggatcaatccccggacaggagtagggtattacttcttgattaagaaggcctgaacctgtataaaattccttgtctctcaacccatccaattttccagcttgatagccaccccctttcagtattgccgaaatcttgtttcgacaattggcgcgccaggtaagggtagcgtcaagttcttcgccgactagtgcgatgggtttcgtctccggcatcgacgacttcgtcttccctcccgggcaggcgttccggttcggcagcctcgacttcatcaccaacaacttcggcaagatttctctcctcgactcggattcgaaccagtcgggaagaggtcaggtcaccgccccgttcggtatcccgaactcggccgagatctaccccaagatcatctcaaccgagttggccacaaaccactcgaacgagatccaatatactccaacacgacccgatcaagacgatggagcctatccgccaatcctgatgaaactccccgatgacttggctgccgtgttcaccacaagggcgtcctctccccgtaggcctaggcgggatccggccccggccccgatccagtctagctccagggaagtcggcgtcataatccagcctctcggcacggtttcgacggaacaattggacggctacctcagctcccctggtgtcgactcacgaccaaccgagatcgtagagtacgacgacttcggctaccgctacgactaccacaacctcgatgacttcgatgaaggctttgaagataactacacgcgcctctactttggcattttcatggccgacaacgagacggaagaacagcgtcaagcccgagaagcagaagagcagcgcgtgcgacaggaagccgaacgtcgccgactggaggaggagcgccaagcacaagagcgagaacggctgcagcgtgagcaacaggagcgcgagcgagctgcaaaggaggctgaggaccggcgacagcgtgccttggaggccgagcgacgagcacgagaactcatagggcagcaagacgtcgaggggagggcggtttttcgcacccccaagcagaacgcggttgcaacgatcaccctcgtcgacaccctcctcaaggaagacgcactcaatcaggccaatcacgtcatcaacatcttgaaccagaccaagaccatgatcgctgcttcggtcccagtcaactccgcaagcgtccgcacgccgactggcagccgagttccgcctcttcgatctcaagactatcaccaaccaagcttcagcgtcgtcggcgcgggatccagtcgcaggagcagggatcatggcgagcggttcgttcagtcgcctcctgaccggcgcagggagtgtcgagctgaacgtccccgctccccacatcatgggcgtcccatcgatcttcgtgaaactatcaaccagcgccgtgcggcaagaggctacatccccaccattcaccagatcgttaagacaacgacgtggatggagttgctgccttcacaagcgacctgcgtcgagtggattggccggccggcttcaagccgactggaatcgagaagtatgacagcaccactaaccctgagtcttggctcaccgtctacagtctcgcaattcatgcagcaggaggagacaacaaagctatggcaaactatctgcccgtagccctagcggattctgcccggtcctggcttcacgggttaccccgcggcacaatcggatcttgggcggaacttcgcgaccacttcattgccaatttcaagggtacctttgaacgccctggcactcagttcgatctttacaacgttgtccagaagtccggagaatcccttcgagatttcatctgatgtttttccgagcaacgcaacaagatttccgacatcaccgacgatgtcatcatcgccgccttcaccaagggcattcgccacgatctcttagtcggcaagtttggacgcaagcctcccaggactgtcaagcagatgttcaaaaaagccaatgagtatgcaaaggtctaaaatgccgtcaccgcatccaagcagtcgggcaccacttggaagccgaagaaagatacgccgactacaggaggcagtggaagtaccaatcacaaggatcgcaagcgtaagcccgaggaacttgtggcaaccactacaccatcctcccgacaacgttcgcgcatcaacagcttcgacaagatcatgaactcccaatgtccgcatcatccaaattccaatcacgcggccaaagattgcttcgtctacaaatagttcgcagagcgatacgccaagaacgcacgcaagacgactaacggagatcaaagcacgtcaaagaagaaggacgatgaagatgctgccccgactggttttcaagaccatcgcaaggaactcaaccatatctttggcggacccttggcttatgaatccaagcgaaagcaaaagctgaccgaacaggagatcaatgctgttcagcccgacacgcctcaatatcttcggtggtcagagacaacaatcaagtttgacatgtcaaggaagatgctaaacctattaagcaacgactccgccgtttcgcacaggataggaaggatgcaatcaaggaggaattaactaagctgttagcagcaggcttcatcaaggaagccctacatcccgactggctggctaacccagtactggtttggaagaagacggggcaatggcgcatatgtgtcgattacaccggcctcaacaagtctcgtcccaaagaccccttcggtttacctcgcattgaccaggtagtttactcgacggccggctgcgagctactcagttttttggactgctactcaagatatcatcagatccgactaaaggagtccgactgcttgaagacttcattcatcacgcccttcggggcctactgctacatcaccatgccttttggattaaagaacgcaggagcaacttatcaacgcatgatccagagatgtttttcgactcagattggccgcaacgttgaagcttatgtggatgacatagttgtcaaaaccaagcagaaggatgatttgattacggatctagaagagacctttgcaagcatccgcacttttaggatgaaattaaaccctaaaaagtgcatcttcggagtaccgtcagggaagctgcttggttttatggtgtcccatagaggcatacaagccaacccggagaaaatcaacgccatcctcaacatgaaaccaccgagctcccagaaagatgttcaaaagttaactggctgcatggcggcactcagccggttcgtttcacgactcagcgagcgggggatgccttttttcaagctgctaaagaaaactgataatttccagtggggtcccgaagcacaaaaagcctttgaagacttcaagaaacttcttactactccaccagtcttagcttcgccacatctgcaagagccgctattgttatacgtgtcggcaactttccaggttgtaagcacagtcctggttgttgagcgtgaagaagaaggccatgttcaaaaagtccaacgaccaatctacttcgttagcgaggttttggccgactccaagacaagatatcctcaggttcagaagctgttatatggtgttttaattaccgttaggaaattatcccactactttcaaggtcactcggtcacggtggtcacattgtttccacccggggatatacttcataatcacgaagcaaatgggcggatcgcaaagtgggccttagagttgatgtctttggatatatccttcaagccgcgaacttctatcaagtcccaagctttagctgacttcgtcgccgagtggaccgagttccaagaggacacgcctgctgagaagatggagtattggactatgcattttgacgggtcaaagaggctttcaggcaccggagcaggggttgttctaatttccccgactggagagaggctgagctacgtattgtggatacatttttctgcgtcccataacgtggcggaatatgaggcgcttcttcgtggattaaagattgcgatttctttgggaattcggcgtctgattgttcgtggagattctcagttggtggttaatcaagtcatgaaagagtggtcctgtcttgatgataatatgactgcttatcggcatgaggtacgcaagttagaagataaatttgacggccttgagctaacccatgttcttcgacataacaatgaggcagccgacagactggccaattttggttcaaaacgagaagcagctccttccgatgtgtttgtcgaacatctctacgaaccaactgtaccgaggaaagaaatagtcgaggctacggacactcaagaagtaagcatgatcgaagccgactagagagagcccctcatcaaatttttaaccaagcaagaactccctcaagataaagacgaagccgagcggatctctaggcgcagcaaactttgtcatacatgagactgagctgtacaagaaaagtcaatcagggattctgcaatgctgtgtctttggaggaaggatgacaattgctaagagatatacattcaggcatctgtggcaatcatgctgccgcacgaactgttgttggcaaggcctatcggcagggttttttctggcccacagctgtgtccgatgctgacaaaatcatgcgaacatgtgagggttgtcagttcttggcccgacagactcatctaccggctcaggagttgcaaaccatcccgctatcttggccgtttgcggtatgggggctcgacatgatcggcccgtttaaaaaggctatcagtggttatactcatctctttgtagctattgacaaattctccaagtggatcgaagccaaaccggtcgccacaatcacggcagacaaggctagagattttttcatcaacattgtgctttggtttggggtacccaatcggatcatcactaataacggtactcaattcactggcggagtatttaaagatttttgtgaagacttcggcatcaaaatttgttatgcctccgtagcccatcctatgagtaatggacaagttgaacgcgccaatggtatggtacttcaaggaataaaagcacgagtttttgaccgactgcatccctatgctgccaaatgggtagaacagctaccgtccgtacttggtccctgcgcaccacacctagtcgggccacgggccagtcatcatttttcctagtctatggtgcggaagcaatgttgccgagcgaggtagaattcgaatctttgcgattttgtaacttcagcgaggagcactatgggtaagaccgagtagatgatctcaaccgactagaggaagcccgtgaagcaaccctaattcagtcggctcggtatttgcaagggatgcgccattgtcacaatcgcaatgttcgatcacgagctttctttgtcggagacctggttctgaggaaaattcaaactacacaagatcggcacaagttatctcccttatgggaaggaccgttcataatttctgaagttactcggctaggctcttaccgactcaaacgtgaagacggtactcaagtcgacaactcttggaatatcgaacatcttcgtcgtttttatgcttaggcattacattttgtatcttcctctttgactgttaacatcaagttcctccttgagttatcagtcgggagctactataataacaatggagtgtgatttttatcaattcaatttgcttacttgatttatcattgccttgtttgattttttggcttagtcaatgaggactgaaagttttttaacaacttttgcgggttctaggctcaataaggtttgacaaaaacttttaagaaatcaggacctaagtttaaatcatcaggcacagcataaattcatcagtattgtacaaattgtgcctccatcatcattatcaaaatacaaattcaatcagtttcagttttttcatcatcagagttaccaaacccggtcggcctaaggtagttgtcctggaacctctcaactacatcaacggctatcttgtcagcagctttttgcgcatcattgatgaggtcaagggcagcttcttcacttgtcccgtctgcaaagccatcaacagcatcaatgtcgatcttcgggtacaaggacttggtcatcgccaacgccaaacttgctcccatacttccagcttccttgatgttcttaaaatatgtatccggagcaattctcaacttgtcgaagatttcggaagcgtcaaatgaactcggaccattgttattaaaaaacatggcttggacaagtggtgtagcagcattggtgacttcatctctagcttcctcaagcctcttgattttgttaaccaagacgtcgaattgtgcctaggatttgattttgcaatcttcataggagtgggcacgaagataagagtggttttttgaagttcccgctacaagtaccttcgacatctttcaaagccgagtccctctgcttcgtcagttcgcccttatgtttttctagagctttgattcgcttttccagctcggatatcttggtagcttgcactgtattgcctctcattggttagttgcatatggatagcagcacgaaacaagtcagacagggatgagagttaccttttgatgaaccgctcagctcaaagttggagtcttgaaactcggcgattcgatctctgaggtcatgctcggtcttcctggcaagttctttggcttcacgcagttggtctctggttgcttcaagggttccaaggtggggaactaatttttcgagggttgcggtcttcgcttcattcctaagatggattctctgcaccacaaatttgtctttgtttaagcaaagtggtcgacaggatgattgaagctgtgtgtagggagacttacatttacaagacgagtggcttgactaagtgtctttttcagcagacacacttcctcgtctttcttctgtttatttatcatgattccctgtggttgcatttcatcatcccaccacttgacttatatgggtgggcgagaatcttcagccgattgtatccggaggacctcttcttcgtcgccgatcattgggccttatacattcatgaataatggtgaaacaattgaagaaagtctgtcggatcaaaactgatttggaggttttgattacctgttatgatttccggtcgaggacgagcaggtccttgcaccctaacaggagagttagttccagagtcagcgccagcgtccgtcttgggagggctattggtttgagcctccacttctgggatatctttattttgctctgtacccgactggtttccagtcgggggctcctgatcagcactgactccagtgtcggccgactggtttccagtcgggggcttattgctggtcgctacattgtcggttgctggttggtcatcactcgggcgatcttcggcagtcggcccggtttcttttgaaggaccagtctccgtgccagtcggctcagggtctttatcagaaagatctatgtcagatggcttcctacaaatttaagatatgctattagtgctacttcgatagtaagtgaccagtgaaacatggaaaatgaccaaatgatttgtacctggaggacttcctgatttttggtatgggacgactggctgttttattcttcgggttggcttgttttggctgtttcccagtcatccctttgctgccagtcttttcagcattatcatcttcgtcgtggctcagaaccaatttcctcttacgagagtcaggctggttagtcggctgtgaggtgtgaggttgagcgtcggaccggatttttggccctccactagcctggccagtctgccgacggggtgagcggcgttgggcaatcggaggatctgatgtcatcaaggcaaactcctgtgcatgatgttccaagttttcaatcaaccttgcagatgataaaagcatgcttttgagagaggctgagatgtttaatacatgctagtggaggagggttgaaagcattgtacggcaccactggcagcaagtgcgaatagctgactacgattgcatttgagaagattttatacattctctccttcataattttgaattcaagagattatggatcttcacggttagggtcatgcttgccatcaaattcaaaggccgtacgagatctttccttgattggggccagccggctcttgataaaatgccgggtgatctgttccccttgcagaccctgttcctttagcttcaacatacggtcaaccagggcgagtgcttgagcagcctcatctcccattggaagcgagttccaagtatcttgatacactggaggaaggcaggagtactcgggaagagctgattcaggattttgcacataaaaccaattcgcatgccaacccttgtttgaggttttgaagggcatggaaaagtacttttggctcaaggttccccttagttggaaaccggctcccccaacaacacatggtttgctcttgtttggctggggcttgaggaagaagatgcgacagaacagggcaaaatgcggtcttacacccaggaaagcctcgcaagcgtggataaaattggtgatgtggactatggaattggggtttaggtgatgcaaactgatcccatagaaatccaaaatcccccggaagaaacttgaggttggaagagaaaatccgccataaaagaaatgggaaaacaccaccacctcgtgtgtgtcgggggtcggaaatgtttcaccgcacgctagacgccacccgatgatctcctttgccagaagaacgccgtgcgccaccatctccttcaggttttcctccgttacatcggagggcgcccactgaccctcaaagctttctctctcttccgccatggatgcgaactggatgatgtgatttggttcgaagtgtggctgggaatggatgggagattgatgtggtggttgcgtgggagattttcgtggggctttggaggctggatttgtgtgaatctgtgaaccctagcttcgccggtgtggttttgcactatagcagagaatggggaaagtggcgagagtttcggcggggaagacgaaccgacgctttgcttctagtgttattttattagggtatcgggagtactaatgggcctgggcctaaacagtacttcagcccaattttgctatcagcgtggctaagttgtgattcttagggacttaggcattttgcttcggtgacacttgctcacaacagtatagtccaatgctgttaaaatcctttttgacgcagttagataattctttggaattactacgacgcaaataaaatggtgcccaatagaaaagtgttatactaattttgtaggcctttttaggctagctgttcgggttttgttgagatgactggtttttgaatagtcattctctcggcatgttatatgcttattttgatatggtgtgagtcatagcttaggcaatttagactcacttattgtcatgatttataccacatttgatggatcttttttgagagtttttactcggattcttatcatatgtgttggtttatagaccttcagtgtgtttctccctcggagttttttatatcttcttttctggtatctcaaagctaaagcagtcggctggatgttttattaaacgtagcatatgcttagctgtgtgataccatggatgatccggttgtaaaaccactcggttggatttttgcgccttgactatatgtttagtttttaactaatcacatagtcgggggctacacctaattaggtgcatctaatcgatgcacctgattttttttctattttgagcccttcacagtctttgatcttactactcaggaggccaaggcagaagaagttggagcactcggattatcgttttgggttacgagagaaaactattttgtcgactgtaaaggtctcaggggctactatggagattatgaataccccatacctacatggtatgtatagtccgactaggtatggggtgccatgtatagataagatatctttaaagggacttgggttaaattccaaacttatatgtaaaggaaatacccgggatcctagtcggttatgattgtatattatctgtaactacctattccgttagggatatggactataatttgtaatacggactccttcccctatataaggaggggtccgggtgcctttgggggcacgattttctcccagatcatatgatcaataatacactcagcgaatcaatctccggacaggagtagggtattacttcttgattaagaaggcctgaacctgtataaaattccttgtctctcaacccattcacttttccagcttgatagccacccccttttagtattgccgaaatcttgtttcgacacagatatactccagttcgttgaggagggactgttggttacaccggtgcatctaaaacctggatggtctatttgcttcgctgcttgttcacacagtttatggaaagcacgcaattaaatcagagaatgtctgcacttgtggtagaaccgcgtcaagcgacaatgccggactctaatgcgcagttgggcttgcgcagttgggctgccttgctagcatagcagctatatctccctactctttttatgttcttcatgttgttttctgttttcttttttcttttttctctttctctctcccttctttcttcttccttcctctgtctactgttgtttcttttcagtttctttccgatctttgtacttctgctataacaccttggctaccattaataaaatggttataaggtagagcctctctacctttttcagtcaaaaaaaaaaaaagacccccgagccagcgacgatctcctccgcggccgtcactgactggctctgcccgccagctgaaacgaacgtcatgtgtgtggtgtggctaaatgtgtttgattcaatcaggtgcgacagctcgtgaagacgacgacggcggcagtggttcttcgacggtctgggctggcgttgtggcggctgacacaggcggcgccggcagcgggggcgagaaagcggctcaaagactatctttggttttagtgcccacaacaaaagcagccgcagcagcagctattgcccggactattttgctgttattttgtgagagggtgtgagattagatgagatggcgtgcagatgcaatacagggcttgtgggaaattggaaaaacttggcaggattgatgggttaggtctttgtatggttctgaacatagtgctgtctacaatcagatttgggaatcaaactgcatgtaggcagatagtcttcctgagtggtacaatgaattaagggaataaaacactcactagagttctgtttccagttaatcagaagcaataaattgagggaaatagagactcacaagagttacatttccagtcaatcaaaaggttagtttttttttggttcacactgacaatttccaactcaaattatgttgatgcatgtaaacaatctgtgagtttagagcacttgaaactaggcaataaaacatttgggaataaattactttgctcaaaccgggacccaacatcaccagcagtaaatttctgaagtaacattcatatgtgagatgttaagttcatcatttttttttgttcagtacgagttttcattgcagatggttaattgtttcaaatttttgggggtattttacaggtgtttgacggttatggtcgtacagacgaagcatcttttgttcggaagaacttagcaaggtccatagttgatgcttggttgacttccccagcagcatccccaatgcagttaggagtgcatttctacatgttttacctgccatgtctaattatgtatatctatgtattcctatattcaagtatatatttctgtgctgaaatggaaatagaaaaatggcattgttgtttttaatatacattgggctgtctgaaattcagaacactgaaatatacattgttattgtcccttgactttgcttcttatatgagtgattaagtgaatttattactaaatagttaatagtttttgaattgtacaatggaaactgggagttttctatgttttataaaaatttgaattgtataatggtaagcatttaaagtaacctgaatttgttaatatggagcatgctggcagcttgctttcaaaattcctttgagaaattcagaatatataaatgtaacaggtttgctatggcacttccaaatttgctatcggactttcaaggaaagcagcgaacctctcctgtttgctatgggacttcctgattagggctaaatttttgtacaaaatctgtgagtaatggaattgttctgatttgaaacagagacctttggtttagagcatgatcactaagttagtaccggtattgtcggagggtgaactcctccatcggggaaccatgaggccctcttttttggttcggccgggggcagcgggtgagatttgagggcttggtgagcaaagttgtgtgacattaaggggtcagccccctcaaagacgatgagacaaaaggagtttatataggttcgggccaataagaagcgtaataccctactcctgtgcttagctgatcttatgagaaattacaagatctccttgttggagtagatcgagttgatcctcaggggcagaagctcccctcccttttactaggcttggttctccttttatacctcaaggggttaccacatgggcaaaaaaatctagctccggtggagaagtattttgcattaaatgcctgtcatgtctcttgatttgggaagcaagcgcacgtcatcttgatgatggggcctgtcaaatcctgctgcctgacacggggggcgcccatgtcagctgctattaatgggtgaaaacttctgggctcctgtttgcaccagcaaatgggaaccccaattgaccagggcggatggaccgactctggccaggatgagaggctcatcatgaccgatgggacaggacgggatgtacgccccctgacacatgcgatagtgcacctaacaccctgatgtacgccccctgacacatgcgatagtgcacctaacaccccgggtcccgtcggtcattcgaccggtcacaggccaatttaggcgcgctgcatgccacattaaatacggcgtggcgcgcctgctcaggtcaccattaatacgggtaggtgagcgctcgaaggtggccacctaacccaccgcacgtggcgacccgcggaggcggtctggggagcccgacccctagtcacatgagggagtggctgccgccttgcctccggcccggcccccctcgggggagggctacgtgatattggggggcagcctcctccgtctagtcgctgggaaggagtggccgccgccccacctcgggcctgactcccctcgggggagggccacgtggcattggagggcagcctcctccgtctagtcgctgggacggagtgaccaccgccccacctcaggcctgactcccctcgggggagggccacgtggcattggggggcagcctcctccgtctggtcgctgggacggagtggccgccgtcccacctcgggcctgactcccctcggaggagggccacgtggcattggggggcagcctcctccgtctggtcgctgggaaggagtggccgccgccccacctcgggcctgactcccctcgggggagggccacgtgacattggggggcagcctcctccctctagtcttgagaccccaggcccatatcaccgatagatattgttttaaattcaagcacactcctctggttggaaactttgatcagtcaggtttgaattatgtctcctctttatgcaaataatttcttttttttaggtaatgatcatttgatttagagtttaatttggcacaattggagtattaactctaagtcagggctaaattttgtacaaaatctgtaagtagtataattgttttttgacctgagacagagtcctaacatgatatcagagatagttgcaaaattttgtaatgtctgtgagtaccagaatcattctaatttggaacaaaactcatctgattaacaactttactcagtcagtgtgaattgtgcctcctcttaagtgcagatagtttctttcatttcaggtaatgatcatttcatcagtccgccgtgctctcttaggcctacatcatgggcaatcaagtgtggacctcgggtcatattggcaacatctacatccagtcagataataccacgacaagcatgcagtccttcaaatttccagtgtaagcatccatactcatccaaacataagattttgggaagacacgtggttgggatcgcgtgctttcaaagatcaataccctacattatataatctggctcgaaagaagcagtccactgtggcaaaggtcatgagcacaacgccgctaaatatctcttttagaagagctattgttggccaaaagctaatcaagtggaacgatttgatcctcaggctaactaatatagctctgttaaatgaaaaggacttctttgtatggtcgctccataagaatggtcaattttccgtcaaatctatgtatgccacgatcatgaactgtaatgttcggataaaaagagaattctgtgggacttgaaaattccactaaagatcaaggtctttatttggtttcttcacaagaaagtaattctaatgaaagataacctggctaaatgaaaatggggggggagacaaacattgttctttctgctatacacaagagacaatccaacatcttttctttgagtgtcctgtcgctcagtttgtttggagatgtgtgttttttgcttttaatatctcccaccctgtaacgccaaaaacattttcggtaaatggcttagaggggtatctaggtccatcaataagatgattctaattggagctagtgttgtatgttggtcaatttggtgttgtcgcaatgataaagtttttaatggtaaacaattatctaaccctatgcaggttatctttatgtcttcctactggctccacttttggtctacaatgctaccacaggaggagcaggatactatgcgtaatggtgctacactcttgaaatcggtagccaagcgtctcttattccactatgggtggcgtagttccataagaattgctagctaaaaaattttatgtggtttaacgctagtcaataataaaggggagttggggatttgtcccatcaccttatttctcattttgatttatttttatcttacctttttattagtattaaacttatggctgtgtgtcttatgacagaagccgagatgtaatccatttccattatctaaaaaaatactcatccacttactttatatgcatgaataacattattttcaaaactgaaagatcaaaggtatgttctgctgtggtggatgaacaaatagcctggtgaggatagtgaaagtggagtgaagacgaagcagagtatgatgcacgtcgtggctaaaacaagaccctcctattatggaaattatgagcaatgttgtctcttgaatcctttttttcctgctgaatctataactccgccgtctcatttcttcaccatataagtatgattgctgaaagagaagtgaagagatgaatttttttaatgactcgcacgagacggtgcgaagttctattgatagagcaggaaaaaattacaagattacaaccctggaggatcgtaaccaggaaaaagaaaaaaggataccaccacccacacaccgacattgccaacgaacaagcccaggagaaggctagcaccagagcggctgccgctaagcgtgaccgaccgccactacaccaacaaagggacacaaacaagatcgccccctaggggatgccaaaacgacgtctccaagaagagaagcaacggaaaaactgccgccgccgtccgtcgggactcagccaagactgggctttcacccagcaatcacccttgaggggtgagacagcacgacaacgcccataggaggatcgttgtcggtccggccaaggccggactgggttttcacccgccgctcaccggctgcgaatccacggctgacgcaccgatgctccaccaccacacaaactctgccaacatgtgggacccctgcaccggcgtcccccgccggccagccttcgtgcgccgaagaccacgccacatccaccggcaactcctcctcacacctaggtcgcctcctccactgccggccgcgcctctcgcgtcaagccggcttcctccaccggacgcgcctctcgcgccaatccggcctccctccatcggccgcgcctctcgtgccaagccggcctccatctccgccgcccgcgcctctcacgccgaaccggcctccgctgccatcggctgcgcctctctgcgccaagccggtctccgacccctccaccgaacgatgccgcgccggctagaagcagccgtctcccacgccctcggctagccgtccgaggccgtcatgcctccggtgaccgcagtcgcggtcaccaccaccacagccgctgctgtcgaacgcccagccactcacacccgact

SEQ ID NO: 47301 - DNA, 10296 bp, Oryza sativa
aaacccggccacccctcgaccgccgtcgtagccaccgcacctccgtctccagcgtctccgcgccgtcacgcccgtcgacgccggatccggccgcctcctcagcagtcgtcgtctggctccaccgccgccagttccggccgctgtggcatcggcaccgccgtcgccgtcgccctgaggacgccgacctcctccgccggcgccagacccccaccgggcaccgtcggaaacctccccgccagattcgcgtcagatctggcggcctcttccaccgccgccagcgcctccaaacctccgccgccatccccgccaaaggccgctcccgagcacactgccccgccgccggcttaactcaacgagaactctggctggccggcgtggatctgggcggtttctgcctcccgacgccggcagacctccccctgcccttgtgcggcgagacgaagcgaagcccagccgccgccgtccttgccgccacgcggctttgccggcggccactcgggcggcggcgaggcggaggaggagggagggagggcgggcgacggcggcctgggcgcctcccgtgccgcccgagaggagacgacacgagaggaaaaggtccgctatacgccccctcaagaggtgaatagataacttatagcctagcaggcgatggatcattagattgcattctatgtttctctttatctttctggtttgagcttgagaatgtatttttcggttggtcttgaactcttgaagtcacacctggatggatgggtgtttggtattctcgtttccttttacccaactcattttatttatgaatgataatgtaattttgataatttagttatccaaaaattgtgggataaaatccttatttgactcctaaagttgacctccattctctcattggcatgtggatccatgactaacatgtcagtaaattatcatggaaaaaatttcaattagagttgcttgtagttattttgcgcatcatgagcaaatagtatttatgtacataaaagaatttcttagtgcatcaacaatcagatggttttgagtgaagatataaaagttacgatgcaattttgcgcacatggttgtctttaaaatataacaattctatcgttcaatctttacgtgaattttaaatttatctaattatattttttattgtgctaacatatgacagtctttggtttaattttaccgtagcgttagcacggacaagttactagtattaaaggttcaacaatatatttgaacatacaaaattacaagaaataaacataatattcataaaaaattacaaaaattacatgcaaaaaatatttatatacttagataaaaataaattaaaaccatatataacaataaaattgcaattaaaaatatgttaactataatattacaatcataccatctaaatgctaggctttgttatatataattttaggtggctaaaattttaggaatcactaaaaaaatatcttaaattttttttaaagaactttcaaatataatagttgtagagttacactaaagttacattatagttacatttacattgtaatatctatataacttaggtataatacatatttctttacatacatacaagttaatataactagcatggtggcccgcgcagattgcgtggctagcatcattatattttctctcatataatagcatatatgttttctcattatattattcaaatatattaaaatgaaaacataattttaaattttgcaataactttacaaaactactaatgtgtaatattcatattatattttatatacgtgttagttattaattatttttaatatcaaattttagttatttgtaaattatatatattcctatatgtactctagacttgtcttttaattttttttaattccgaattttctgtaaattgtatttctatatagactctatgctcttcttctaatattatttatttttatttctgaattttcatattatattttatatacgtgttagttattaattatttttaatgtcaaattttagttatttgtaaattatatatattcctatatgtactctagactcgtcttttaatacttcttttttttaattctgaattttctgtaaattgtatttctatatagactgtttgctcttctttcaatattatttatttttatttctgaattgttattattactaattgcatttatatgtggactctaaacttatctttcaatattctttaattttaatttcgaatttcagttacttctaaattgtatttctatatttgtattcctatattgaccttaaactcttcttcccatgttattcttaatctcgaatttcgaattttagttatttgtaaattgtatttttatacatactctaaactctacttttaattttattatatttattccaaattttagttagttttgaattcctatatggactctatactctacttctaatattccttatttttttaattctgaatttctacttttttcttaattgtatttctatatggattctatactctacttctaatattccttattttaaattgggtgaatagctaatatgctccctgaagtttcacttcgggctcagtttagtccttgatgttttaaatcgtccaaacaagtcctctaaattaatcatttgggttaatatagtccttggacccaaaaaagtgccacaaattaattatttgggttaatatagtccttggacccacaaaaagtgccacgtgagcatgtcaagtcatcctcgcatgtagcggtatgaatgaaatgaacattctacccttatataccatataaaaaagaaaacaaatatttcacacatgtatggacattttagaattgtcacttacgattgctgcagcctaatcgtataaattcctttgtcggccaccctccgcaacaatgttgggcctaggttagcttgttttttttgtcttttatttcttttctatatagtatataggggtagaatagtcatttcattcatatcgctgcatgcgaggatgacttggcatactcatgtaccattttttttggtataaggactatattaacctaaataattaatttggaggacatgtctagacgatttgaaacctgactaaactgagcctgaagcgaaactttagggaccatattagctattcaccctttttaattccaaatttctattatttcctaattgtatttctatatggactctatactctacttctaatattccttatttttaattccgaatttcagttatttcctaattgtatttctatatggactctatactctacttctattattccttatttttaattccgaatttaagttatttcctaattgtatttctatatggactctagtctcctcttctaatattccttattttttaattctgaatttcagttatttcctaattgtatttctatatggactctagtctcctcttctaatattccttatttttaattccgaatttcagttatttcctaattgtatttctatatggactctagtctcctcttctaatattccttattttttaattctaaatttcagctatttcctaattgtatttctatatggactctagtctcctcttctaatattccttatttttaatttagaatttcagctatttctaaattgtatttctatatggactctgttttttctttttctccgattaatgtgagaatttctaggccatgagagcgaacgtggaggctcatttttctattcctttaataatataatagatagatagttatataataattatagtagaggtagtatattataaccgtacaataaagtttcactcagttttttagttgtctcgaagttttctcaggtgtcttaaatttagcaataccttgcaatttgataaaagattttctacggctcgaattccttttcctgttttatcgaccacgatttttaggatcttatatgttagatttccttccatagtcaagaactttttttctgtaccattaattggagggttttgtccaaattaattgtattgtatggcagatactgaacattattaatggttaaaacacctggaggtgacttaaaacaagagaatcatgtcattaacgaccgctagcttcctaacttcaggtacggttggggaacggcgacaatcggactgcgcatgacatgtttcccagacacccaactcaagcttccctccaccacctcgccgccgccgccgccgccactcaccgtcacgctgaagcccttcttctcgccgacaccggagaacaccagcttctccggcgacacacgcatcgtcagcgacctgggtatctccagcttcatcgtgtaggtcgacctggccggcccgacgttcgtcaccgtccggttcaccgtgaacggcggcggcgccgccgacgacgacgaccgcggcagcggcaccgtgatggtcgggtagttgagctgcgcctccggtatcttgttcttgtccagcttcccgcagctcaagctctcgttgcgcacgatcgtccccagcccggcgtctccgagcagcgcgcagatgtagccggcgtagtcagcgacggcgatgtcgtacactaggcctgggtcggcggccctcgccgggttgatgtggccggcgccggtgaggaacgcggtcgccctctcgtggtgttcgtccaggatcgggttgccggcgccgtcgacggcgtcggacgtcgtcaggatggctgacttgatggcggccggcaaccagtccgggtggcggctcttgacgagcgccgccacgccgctcgcgtgcggggtcgccatggacgtcccggatatgaccttgaagagcccgccgcctccgccgccgccgccgtgctggaggtgcggcggccatgcggcgaggatgttgagccccggcgccaggacgtccggcttgagcacgcccggggcgaccttgctcggtccccgggacgagaaggaggcgacggtgggcgccgggtggacgctgagcaacgtgttgtcgaacaccacggtggcgttgggtttgcagccgccggctgatgatgacgacgacctagcgtactccgtgatgttgtggccaccggcgacggtcacctgcaccatgcccgggccgtagtcctcgaggacggtcgtgtagccttcgctctcggtgttgatcagcaccacgccgccggcgccggtggccatcatggcgctcacgacggactcgtcctcgaccggatcggactggcagaccacgaggtggccggcgacgccatctccgacgattccggcgagctcgttacatttcggttgcttctccgagaagtggagtgggtagtacgaggtcgaggagttgggctgctgggcgagcgcctggccgtcgacgagctcgccgttgccgagcagcacggtggtggagaagctccggccgaccgagcctgcggcgaccgtgagcagccacggcgcgtcgttcgagaccgtcgacggctcggggccgccattgccggccgcgcacaccacggtgatgcctcgcgccactgcgctgaaggcggcgatggcgatggggtcctcatcgaaggggggactcgaccacctcccgagcgacaccgagaggacgtcgactccgtccttcatggcctcgtcgaacccggctagcacggcgtcgtcatcgcagcctgagccgttgcacaccttgtacatggcgacgtgcgcgccgggcgcgatcccggccgccgttcccgcgcccaggccgcggtccgacgcgccgccggcgacgaagttcccggcggccgtggacgcggtgtgtgtcccgtggccgacgtcgtcgtcgccgccgccgccgccgtcaacgaaggacttgacgccgacgagcttgttgttgcaccgccgcgtggcggcgacggcgcaggagcccctccacctcgccggcggcggcgggacgccgcggtcgtcgaaggaagggtgcgcggcgtggacgccggtgtcgagcagcccgacgacgacgcccttcccgtagccggcgacgtccctccagaacccggcgcctctcgtcagcccgaggaactccggcgtgtgcgtcgtcatgaggcgcagcgtccggcgccccgggaacgcgcgcacgaacccgggcttcttggacaccacgccggcgagctcggcggcggtgagcctcgcggcgaagccctcgaacacctcggtgtaggagcggatgatccgtgcctgatcggcgccgtcgtccatgcgccggcctcccggcaagaaagactcgtgccaccggcggtgcccgtcgtcgtccgtggccgcgccgtgcggcggcgggtcgacgagcacgatgtaagtccggtaggcgtcggctggcggcggcggcgtgccattcggagtacggacgacgctgcctgcttcacctgcatggatatagcagagtgcaggtgcaggagagagcaaggaggctagagccagtaacacaagaagattgatcatgagatttgtaaaggatgacattgatgggaatgcaattaagctagcaagccaagcttcatctttatatatacatatagatatcaatcatgaaggcaaaatgaagcacactacatatctcagcaggattaattgcattctcgtttctctgaatcgttgtagatggggcttgcatttattttcgtgtgatcaaataatcaattgagcataggatggtttatgtattaaaggcttggattaattttctccctccacctttccaagacaaaaaaatatttaatatgcagggagggatgcatatctatatcagtatacaatttggtataaatgtagatttgaaaatcaaaccaaaacaaagggtatgtattgttaaagatatgaaagttatatgtcagaaaatctttgccattaagacataagtctctgtattaaatgcccaacttgatgcatatactccctccatactcataaagaaagttatttaggacagcgacacggtctccaaaacacaactttgatttcttgtttttataaaaatatttattgaaaagtgatatatgtatacttttgtgaaagtatttttcaagacaaatcgattcatataatttttacattttcaaactcaacaacttgagagttatttatgatttatattcctaagatttgacttaaacattgtcctagaccacttcctttatgagtatggagggagtaccttatgacctggctatacttatgacgtcatattatataaaaaaagttcaaatctttcaacagtatttacactataaattccatatattacattgtaaattttatatatgtatagcgtagttttcttacacagtaaaatttgctgtaattttttcttatattcaggatactgttattatctgcttaaatcatataagcaaaaggacaacgacaaaactttagtttgcatcacatgatgaaaaaattgattgaaatcaaccgaaaaggtggtgccataattttaccaaaactgtttagtttattagcattttggctctttattgatttgagaatttgttttattattaatgtgagaaattttagctttcccgattaatatgtgaattcctggcctttggcctcctgaaatttccgtggaagtgcttctatgagggccttcttcagttagtatgaatatattttatgattttctcaaattgagtagtttagcatagttcctgttagaaatatggtcatatatcggcatattttaattcaaaatattatgacaataatcatggcatgaacaatgtggggtgatctaatgataaaatgtaacataaccagagcatgcttaaagtataataagcatcatgaacataccaagaacgcaattctaacagaggtataaagaatgagttaacagtagcagaaagatataccccgagaatgtctctccgctggattgtgaggcagaactgcctccgttgacgttgacgttcgcagcggctccggctcccggcgcgccatctccagggacggcggtagctgcgccggctccaggtgcagacatggtggagacgacgacgaacagagcagaagtcgagagcagtcgtgcggaagcactccccaaaaacttgatcacccgcctacctggtacagatctcaggcgaaggtatggttccggaggccctgctcgttccgatctctcgtgcacgcaagcgatcagaagcggggaggcagaacagaggcagcacaagcgcgcggaggaggaagaacaccagcaagagaaagcaagcgagagagttctgatcggattagcggcctccttatatagcacgagtgattccgccagttgccgcacacgccattatggaggcaatcgtgggatcgtgggatcgtgcacgcgccgttacggaggcaatcgtgggatcgtgggatcgtggttgcaaaaagggtagaggcaggcgcaacgcacgcccgccacgccattcccacgccctcgccccggcccggccggctcggcgcgcgcgcgtgtggctttccgattcccacctcaaccggtcaacagggagcctccaataactccctatttaagttgagatactcctcgtttaattcctgaggtggtattattatccttaacatttattatgggcctttgagatttaatagaataaatcgggcctagtccaattattctaacaatccccaccaaatttcaaggctcataagaaatattctcaaggttgtgcctgtttgatataccagtgttttggtggagactgttaagttgaacttccacataggaaatgagctacatcagaccacaactgaacaatggactatgccttgaattgtcagtcttgtgtgatcaggtttcactcaaacccttgactggtactgggctcccgttcgcatcccctatgtttggagcatataagtcaaactccaggccttttcatgagtatctagagatcacccaaatctcatagactttgactagcagtcaaactcatataggtgtgttccttctgagatgttctgcaggtcaacatctctgcttagaaaagccactcggatcacattaaggcatgagccatcctaccatgcagaaaagaagagaagtacatcatgaaaatgagcccttttcaagggtctcttctctcagtcacacaatagtttgtttcgccatccaaattcacgggatctccgatcacaatagacaggtttccactattgtgcaaccttaggtgggtatcaagcccatttccctcgatgcactgtctatcacattacgtggtagccccttggtaaactgatctgccagatttctagctgtttggacatagtcgaatgctatcactccggagtttttatgctttctaacagatttcagtcttctcttgatatgcctagatgacttcatgttgtcctttgaactgttcactttaataatcattgtttgattatcatagttcattaggatagctggcactggtttttcaaccatcggcaaatccatcaggagttcacgaaggcactcggcctcaactgtcgcagtatctagtgctgtaagttctgcttccattgttgacctcgttaagatggtctgcttgcaagacttccaggaaacaacgccacctccaagtgtgaacacatattcacttgcggcttttatctcatcagcatcagatatccagtttgagtcactatacccttctagtaattttggatacctggtatagtgaattccatagctcatagtgccctttagatagcgcataactctttccagagcctgccaatgatcatctcccggatttgagacaaaccggctcagcttgcttacagcaaatgagatgtcaggcctcgttgcactagccaagtacatcaatgaaccaatgatttgagagtatctcagttgatcccttgctattcttcggtttttccttaatagcacgctgggatcataaggagtaggagctggcatgcagtcactatatccaaagcgactcaaaaccttgtccacatagtgggattgcacaagtgtaatcccaccctcatctcctcttagtagcttaatgttaataataacatcagccactcccaaatccttcatttcaaaactcttggacagaaagtccttgacctcctcaatcacattgaggctggtcccaaagatcaatatgtcatcgacatataagcacaagatcactccttctcccccaccatagcgatagtacacacatttgtcagcttcgttcacaacaaagccaacagatatagtgtggtgtcaaacttctcatgccattgcttaggtgcttgcttaaggccatacaaggatttcaacagttta

SEQ ID NO: 47302 - DNA, 3588 bp, Oryza sativa
cctcagctttataggtcttaaagtaatgcaatgctttcctttgttttcaatagatatacataacaaaatctagtgcaatcatctatcaatgtcatgaaatatttctttccccctttagtcaacacgccgttcatttcacacaaatcgaaatgaacaagttctagaggtgccaaattcctcgcctcagatgccttatgaggcttgcgagattgtttcgattgaacacaagtatggcacttagaacctttgaccaaagtgaattttggaattaaactcatattagctaagcgcgtcatacaaccgaaattcacatgacagagtcgcgaatgccacacattagactcaccattctcgctaatatggttcacaacattatgattattacacatgtcatccaaagaaaagcggaacaagcctcctctgtcataaccttttccaacaaaagttccatatttagatacgacacatttattggattcaaacacaagtctaaaaccttctctacacaatagagagccgctaacaagattcttctttattgaaaggacatgctgcacgttcttcagctgcacggtctttcccgaagttaacttcaaatcgaccataccaacaccatgaacagccgcaagcgacccgtttcccatcgacaaggaggaacctctcccgacctgataagaagaaaatagagaaatgtcagcacatacatgaatattagcaccagtatcaacccaccaatcagatgaatgaaaaacagagagaactgtaggtaataatttaccgtaccccgatgtttctccgcccttgctaatgaccatattggcagacttcctgtctttgcgcttaagacagtccttgggccaatgcccatacttgccacacacaaagcagtctccatttgcctttcccttgcctttcttcttaaaattggttgtagccttgggtttgccatcatgcttgactttcttgttgttgtgggatgcatgagggttcttcttctgtaccatattggcactagaacctccctcaacctttttgtgccggttgtcctttgccctcgccttctcctcaacacccaaagagccaatgagatcagaaacactgaactcttgtctcttgtgctttagagaagtggcaaagtccgaccaagaaggtggcaacttggcaataatgccacccgccacaaacttgtccgacaactcacagttgttgttctcaagttccttagccagcatctgaatctcatgagcttgttctactacagaacggtcatcgaccatcttgtagtcatagaactgctccatgacatacagctcactgccggcgtcggaaactccgaacttggcctcaagtgcatcccacatgtccttcccggaaggcatgtgcatgtacacgtccactatgttgtcagcgagtatactgatcaatgctccacggaacaggcaatccgaagcctcgaacttaacctcttcttcaggagagagaggtggttcacttcgtttaccccgtgaaacatagaagcattgcatcgctgtcaaccacaatagtgcacgtgctttccacctcttatagttagaaccatcaaatgcatgtggtttcagagcaaagccaactaccgaaaatgacctatcaggtttttggattgttggaaatatggtcatatatcggcatattttaatccaaaatattaagacaataatcatgacatgaacaatgtggggtgatctaatgataaaatgtaacataaccaggagcatgcttaaagtataataagcatcatgaacataccaagaacgcaatagaattgtgactaacaggacaaacagaggtattaaagaatgagttaacagtaggagaaagatataccccgagaatgtccctccactggattgtgaggcagaactgcctccgttgacgttgtcgttcacagcggctccggctcccggcatgccatctccagggacggtggcagcggcgccggctctaggtgaggcggcagcggctacaagtgcagacatggtggagacgacaatgaacagagcagaagtcgaaagcagtcatacagaagcactccccaaaaacctgatcacccgcctacccggtgcagatctcaggcaaaggtgtggttccggtgcgcgcaagcgatcagaagcggggaggcagaacagaggcagcacaggcgcgcggaggaggaagaacaccagcgagagaaagcaagcgagagagttctgatcggattagcggcctccttatatagcaggagtgatatccgccagttgccgcacgcgccgttacggaggcaatcgtgggatcgtgcacgcgccattacagaggcaatcgtgggatcgtggttaagtgccgttacggaggcaatcgtgggatcgtgcacgcgccattacggaggcaatcgtgggatcgtggttaagcggggaggcagcacaggcgcgcggaggaggaagaacaccagcgagagaaagcaagcgagagttctaatcggattagcggcctccttatatagcaggagtgatatccgccagttgcgcggaggaggaagaacaccagcgagagaaagcaagcgagagttctaatcggattagcggcctccttatatagcaggagtgatatccgccagttgccgcacgcgccgttacggaggcaatcgtgagttgccgcacgcgctgttacggaggcaatcgtgggatcatgggatcgtggttgcaaaaagggtagacgcgacacacgcctcgccggctcggcacgcgcgtgtggctttccgattcccacctcaaccggtcaacagggagcctccaataactctctatttaagttgagatacttctcgtttaattcatgaggtggtattattatccttaacatttattatgagcctttgacatttaatagaataaatcgggcctagcccaattaatctaacagttcctactactaagacacaacttgtgtttaaatgtaggaatatcgtgattcaaactctggtagatggatgagcatttatagatacatgaatagaagtgatgacaacattacagagtttgccttttcgtttttaaagtgaccgctctctccggtttaccggaaaccaataaaaccaatgactcatgccaatgtcatacggaaattggctgatatcgactggaaccgatacctagcggtttcacgaaaaccaatcgttttatgaatcctgcaaagacaaattgaatcgaataataatttgttttgaccaaagaacagcaggggaggcccatattgtaataattttcagtaataaatcgaagaaaaatacaaaggaatcagggatcgtgtaacaaaagccactgtgttaattctttcgtgcagcctccatttacccagtatagatgcagaggagtatcttctttggaggtcttcccacattgctaatgagacctcatttggataatgtgaactggaaataatttcccactcaccgaggggtaacttttaatcctacaacctatccatccattcttccagattcatttcatcctacccttatgttccaatcccaatccctcatatcccattatctaaataggccccgagggatgaaca

SEQ ID NO: 47303 - DNA, 3021 bp, Oryza sativa
taactatcaataactttcaaaaatatttagtttgtagacattagaaaacgattatagattagtcttaaaaaatattttaaataaaattaaatatttatttttatatatatttgaagaccatatcattgtacaaataatcaagaacaatggaaacaaagggaatatagtataggttattagttgtcaacaatcggagacattaatgttgaaaaaagaaatgcctaccaacgggtggaatagagatcgctagtttttgaatacgcgtcgccggcacacatttctattgggattaggtagttaaactaatatattagtcttagctaacgtcagtttaagataatgacggtagtagataaggttttctttttctgcgagatttattttaactaacaaattgaaaagaaaatctatatctgaagtcaaattttcaaaattttaaaccagatttgaaaactttcaactcgaaattttaaatttttaagtcaaattttgaaaactttcaacttttcatcttaaatttgaaaactttcaactcaattttgaaaactttcaactcaaatttgaaaactttcatctcaaatttcaaaaactttcaactcaactttgaaaactttcaacccagatttaaaaacttttaactcgaggtttgaaaactttcaattccaaatttaaattttttttaaattaagatttaaaaattttcaagtcatgatttaaaaacttataacacaaaaaatttgaaagcacttgtgctgaaaatttttaaaagaataatcagaaaaaagagcaaaaagaaaagaaaaaaatcgtgaaaacaaggaaaaacgcatggaaaatattcgctaaaaggcggcgtgtggagggtgcgcgcgccagatacggatccggcgcgcgcgccaattagcaaaagccggtggaatgggtcaatttacattaacggaagaagccttcagtggctgtgtcaaaataaatgcaaatggaggttttctaacaggagaagagagatggtgttggtgcggtgatgagaaatgacagaggtgtgttcatggcaattctctcagcattattcttatatttggcaatgctacgatggaaggtcatggttgaaatagattttatagaggtggtaaaggtggtgggtgttaaaaggaattagccggccatggaaatccaagatttgaaatctagcttgagtttttttttttttggcaggctatgaagttagtataggttcgtcgttcgactcacatggttgcacaaaggctagcgaagtaaggtgaatttgacattaagattttaacataggtgtaatacaattgaaagtatgtgtatgattttttctagattttttggtgacatttcttagttggtgtgcacgtgggtacacgtgagggcctatgtacatagaatatgttacaccttgtgcgccaccgcgtcatcggccgcccgggccctgggtgtaccccccgtgcacaccaactaaaaattatcacaaaaaattataggaaaactcatacatgtcgtattacatctacgtgcaaagtcgtatcttcaaattcattctacatagagaataacaaaaaagataaaattttgacaaaattgcaaccttaaaactgtcagattttttgtttttttgttacggctaaaatataatgaatttgacgttaacattttaaccctaggtgtaatacaattgaaagtatgtgtatgattttttctagattttttggtgacattttttaattggtgtgcacgtgtgtacacgtgagggcctatgtgcataggatatgttgcccagttgtttcacaacctaggtctcggttcgtccagattttattttacctatgttggccggttaatttaggtgaataaagtgtcagcatagtttaacagttactcgtgttatttatcttgctacgcctatactcgtattagatgttgagacaaacggaccaaaatatacagttgagtgatgtaaaagtacacagaaatacaatttcgagcaacttttgagttatagcgcgtcgattaaaccgacaaaatatgacttcggtttgagctatggcacgctgatctagtgaatacattcatgccacggtacaacagaccgaccaagaaggtataactatttcaaaatcactggcagttcaaaattaacaagcatcagaatgagccataacttcatcaaagctattccaagtcaattgccactatcagcaacaaacaatcacatcattttagtgaaggcaatcaccccacatatgaacaaaatcgacaccatggtgatgtctgaggtgattcttgaactgtcgaaacttaagtctatcccagagcgatatcagcccaatcatttgggcctctgaataatcaaaagagcattaattgttttttaggcttctcatctagtcatctactggttcattgttggacaggatcttcaatcttcagatcaccgtttagatctccctcgctttttaggcttcctttcttctatggattcatcaatgggttggtcttccccactcttcaggtcacctcttcggttaccgtatttcctttttggtttggtcacttctaccacttcatccctgttctttgacctgatcaatcacacaaaacagtagcccaaatactttagctaatgctaaatccacaaacttcaaaaaaacaagatcatctgttagtctttcttacccttttggtaaaggatctaagaaatttacgacttctttaagagcattgagagcaatcttcttaatctacaatttgttaaaaaaacacaatcagcataagggtagttatcacagaacattacaccgcatgagcaaaccagatagctgaatacatgcgctctaacctctagtttatcttctttagccctgtgatcagatggaagacgtctaaactctccggtcagcttaacacactcaccaacattttcaggggaaacaaagtctagagcaaccttgatgcaagactgcacaaatcagaatgggtcttagttttctggttctgacc

SEQ ID NO: 47304 - DNA, 9390 bp, Oryza sativa
ccacaggatgggggagacagagggaagtattcagctgcacctttaaatttctcacttggtgtggacatccagcaggaatgaaaactgcatcgcctagcttctgctcgaatgtccatggttcaacacctaaaattatgcatgccaacagacaagaaaaacaacattatatcagtgttataaacagctttggaagagagatgacagcttcaaaatagaatgttatctaaccgtgttcttccttgagctttctcttatgctccacagttaaatagaaagtctggtcatgaattgggtgagaaacctgcacattgtacagagctattgctcagaataagaaaataaaacatataggattcctatataatgtgattggacaaaaaaaagggtacatttttcactggattgcagtgtatgtgccgaaattctgaggcatgcttccgaagataatcttgtaacttctcagaatcttctcttcggaaaatatcccacaaagcgccaccagttttctgttggtctgaacagtctgaatctttgcgtttgaatccactcctgtcaatgtatccttggttgtctgaagtacaatgagctccagcatgcatcttgacagaactattaacctcgtgattgtgttttgaacattgtgttaattcactttctacctcagattgacaaaatgatggtttatccccaatatcacttccagaatcatcaggtggtaaagcattaatgtccaaacctgcatgactcagaaaagaaattagtaaaccataaccagacaaacaattcaatttcttgccagctcttgattttaacaagtaaagttttattatttacccttagtactttggttagaggtgtgtttgttttccatgttacatgagattttcgatgcttcatcatcagctttacccttggcgcctgattctgaaaccccaaacagttcatgaagatcttgttctctcattttcattttaatttttgctatcttgtcaagctgttcagtgtcataggacacttcagctgtgtgcatcaagatatttacctggtcaaaccaaacaccttttgtaattaacctttataccatgagaagccagtgaaacccaatcaatatataatggggaagaacaaataatttatggtaagcaggcctggcaatgcaatttttattctggacaggatgtaaaagctataacaatctggggaaaaaaatatcatcatgccaattatagaataacataccgcatcagacatgtcgcaatgaagcttggtcacagagtcacccctgcctaactcttcataacatccataagcaatataagtttttggcccaagatcaggcttcagtacaccagcaggaagcctgacagcaagatttagcgggccatatcgtggatcagtatactcgggaaatggcaatgcagttataaactcagcaccatggcgaggtaacctctggtcaaacatactagatggtggccaatcttttagcttaagcatctcaggccaaaaggtcatcggatgtcttctacctctcatataccccataaagaacatgtgtatgttaatttccacctgcagtatcaaacaaaggtctgtctaaataaaaacaggcacggatatcatatttttaaaattgaagtttcaagttatccatagataaattaacaaagtttccataaacagaaaccagatatcagggcaggagctgccaaatcttatttgtctaaaccaactgtaaacaataaggctcgcaagaatagaacagaggggataagaagacacagtgctgccaactcacataaaacacaggaagaaccaaccacttctatgcctaagaaaaatagtacaagtaaggaaggaccgtccacttctatgcctaagaaaaatatagtaatgttctatattagggataatgttattctaaaaggatagtcaaagttgtacggcctataaaatcaagacggaacactcagcaacaaggaaattaagagttccaaacctcattccaatcaaggcaatccactgccttaacagcaaagtgctcatcttcaacatcaccattggttttcttctctcgcaatgcccgccacataaccaatggctcccagctcagaccagatgttaaccgaagagcatcagaaacaataaccggttcaccttttgaccaatgcatctgaaagtgcgacaggtcatcctcctggatattattggcatctggacagtacaagtagttatcacttgagccctttctgtttgctgcctctcgagtagcatttgttcttatcttgcttgtgtgataaaagcaagggcactgatcacttgtttcgtttattgctttatcaaatgcttctctcttaataactttgttagccctgtgttctaactcagaaagcataatttctggtaataagcatctgagtaccaaagatgaagcaccgcagccccctatttcctttggtggacaaggtatactgccatcactattagctttccacagtaacaaagggttatttgggtccccagcaacagccatgtcattgcaagtttcagtactgggggtctccatgtgcctcttcgaagatacccttttcttctcatccttggaaatattaccaaaaacatacttctgacctctctcttcccactgcacactctttgcctcttctcctcctggaatctcacctttgcgaagctcccagcagcatgcaaggcacaagtcatacgaacaagccttgcagcttctatgaaaatcaactatcgaagttttgcacctatcactacaataaaagaataaaaaggctgatcaaatgctcagtgccacaatatttatggcaaaatgtaaacagggaaaatgtttaaccaataaacacgctcatccatatcacaatcagcttgttccaactttacttcatccatagaaacacctgcaaataaaaatgtaaataggcagttagaaaatcctccaatacctgaatgcatgaaggaacaccagaacagcataccttgtaatctaccctctaattccttctccttcatctgctcctgttgaagttctttcaaccaaggaagcaacaagtctacaatacgaaaagcataacgtcgttgattttcctcagaaatcttcttttcagggggctgattcaatatgacagggcaagttattaatgccagactgtaaagcaatcttttgagcacaaacaaatctgtagaaaatatggaaacactagggagggataccaagtacataccttttcaactcctatcattcttaggcatgccttgcaattacagttctttctacaatatgggcattttgcagcaaaatcaacttctgacaaacctgggtacctatttatcaaaaaagttttagtgtagtgcaatgcacaagatcaatgtattacagccatagatcaatggccaacaaaaaaggtattaaaaggaacatcaaaattggagtagcacagtcatcaaaagaaaataattgaagtataaaactataataacatttctgaacagtggcatgatacaatggatatgggtagtccaattagtagatgacaagattgagacaacttggcataccatcgtttcatgcatggctcacagaagcgcttattgttgcatgatttacaccaaatcaccctccctttgtcatttctttgacactggtggcacatcaaagcattttccccagtgagcatcttcttccccttctatatgatcaaaaccacacaataattttcaatgcactcataaaaaaactgtggagtttccatacagaacatataatgaaatctgagcattaccttattgttcgcatcacacatttcatcctcaatggatatggtattattctcttcttcctcttgtttctttcctgcacctcttttcttcgattcttttgaaggcttcatcattatcgcttcatcattctgtcaaggaaagaaattgtaagtactgaaaaatatggttaagacttaggaggcagatttttattagcaatacctagcgaccaacactcaccagaagttcattaaattttcgatttctctgagctaaagtatacacctcccagaggttacaaagcatcctattaaaggttttacacataccaatgatgtaaggtttacagcacaggactcagaatagaagcacagttacaattccggggaaaaaaatattggagctaaaactactgcttatcaaagccagacaagacatcagagcaccaacgagccaactaatattcaagatctaaaaaattgggaaatgctcacttggtcagcagaccaactcattggcagagtattcttcctggcaaggaaagcaggattcaaagtactttgccctttctcaggtgcaggaattaattcagattaatcaaagactgaatgtgttctgccatgctacaacaataaaggagaaatggcctgcccagccaactaggcccatttctccaatctactttctttcaaaccataaaccctagaaacctccttcccctctctaaaatagtagtgacagcagtggatgtcacaacaagcaacagtggtagggagtagtgacaacagtggatgtgacaatgatagcaacaagcaacagctgtgcccaatagggacatcctgcagtactgtgtctccaattttttagtgttagttgagttgaactattgctagttgaatctatagatgttcacctctatccatgcacgccatcgaagacataatatctgttgtagtagtggcaagtgcttggagttttaactttgcactagaccgagatacagctgcctactgcttggacttcgatgcaagagaagagtggaataaccaggctgagttctaaacagctacttggatcgacaacatccttgttttctatgagcacactttccaaactactaaataatgtggactaaatttctatttacaagttcttgaaaaatcaaataaatccattttccaaatttataacagttaatacctaattaatcacacactgattacccatctcgttttgtgtgcggcatattggcccaactaaaatgctctccctaacagagcataaggatgtcagcacacgaaacaaatgaccagaatggacaaagtagtagtactcataaactgaccaaaaatatgaacagcattagcaatatcaggtctagtgacagtgagataaacaagactacccacaatgtggtgatatcaagagggatcctcaataggtgtaccatcagtagaatgcagctacaagaagggatgaaaacggttcagaaagtatccagttttcggatgtgttttcagaaacaaaaagtcggttggatttttttcaaaatgtttcagattcggaaacaaattaggaattttttttctcagagacggaaacgaattcggtaaggccactatccgtcggaaacaggaatcagtcggagaatgttttcggacttctttctcagcatcggaaacaaattacttttcccatacagcagattagctttagccttctctactctagatgtttagaattgtaccgagtattgaggtaattagttgaatggagattttttttctagtctgctgctttatatcaatttttccatactacttacatatagatgaatatagttcttaaatattataattctcatgaaaagtgaagtgtgcaattaattgtattattattaattgataaaaaatagaaatgtcaatttactgttttcaaaaatattgaactacatctcttcattaatatgagaagctcatttggagttgttttcatattcctacaaatatttgttaccgtaatcgctctggttggtattcgctttgttttcatattcaataatgttctatcccgattttgtatttggggtttcgatttcaattccaatactgaaaaaaatatgaaagtggaaaaggtatagctagtttccgtccattcccaagttgttttcatccctagctagaagtgaagatccataagggtcgtagctacaagtgaagatccataggggtggttgtagagaatgcaaaacctcaattcctaagaaagaactaaggcctaaaatcagtcttctgaaattgctcaaggtgcttttccacatggaaatgtggccaacgccatcccccctaatcaacatatcatccacatataggtgaagcaaagtacatcgagcatggcttgcgcaatggggcctccaagcgacatgcgcacgacacaaactgcaagcgccgcaggtgggcaaggtctttgaatgagattttggggcgattttctggtgaggaccagtttctcttctcaccatggtacaaaaaaccgaaccatgtcaaaccaaaaaaaatagaaaccagcactcactagtaggggtgggcattcggtctgaccgaaaaattcggtctcggtcttcagtctttcggtcattttggtctttgaaaactcaggaccgaatttcaccccaaaaaaactcggggccagcaaattcggtctcggtcttggtctgactgaatttggacagtttcaggagataagtttggaatgaaaaaatttgacagcacttcccctcttttcaggcattttttcatagttatatatcacaaaaatacaagataataggcaacatcatacaccaaataatatatcacaagataggaagattaaatagcataggtctcaagtctaaacttcacagtcacagtacaactcacaagtcacaaataaaagttcaaggttgatgagtacattacttgcaaataaaagtcattattatgcactggattcaaatcaaaggagtagatcaaaaaataatcataatacttacatcgcaagaatcaacagatgtagccatcgtaacggattcacagccgttggcttgctgcctccccgatgcagacggatgcggccggcaggatggaggcaccgagctggaggcggggtagcttgagagtggagtggagtggagacgaggaggcggcgcgatggatgcccgcggcgcgatggaggtgaagggcggaggtggcgggatggtcgatggaggcggaggcggaggcgtgaccgcgcgatggcgctcgacggatagggtagagatggattggaggcagcgctggtgaggctgagtgggagtggctgacttactccctgctggtgctgccctctagggttttgtgtttcactaggcttattgggcctcctaggcctattgagccacaaatcggttttctcggttaactgaagccaatgaccgaattgcctgaaaaaaaatcggtctttcgacagttgagaccgaactactaacagaatttctcggtatcggtgttttcggtttggtcctattctgcctacccctattcaccgtgttagtttgcttcgaggaccaccaatgcaatttgactagcatgatccaggtgaactaggtagattttgaggaaaatggctgaactggggtattatgaaccagcggttcagccaacagatgggcccacctaggaaggaccaccctgcatcttaaggcccaatttgatttattaaagaaaatgaggaaaaaagatggagcggtagggagtcaaacataggttggtagggtggccacattgtttaaaatcatgttgtatgctaaatagctttggccagttcagcaatcaacccagtctatccaaccggtgagccgatgaaccggaccacgagcggttcaatggctagtcctattcttttaccatgcttctcgcagacaatgcaagttgtttggggtggcgccatctacacgaggagataagatctcttttccctcagctaggtcatccaaatgggccaatttggtatatttgttttcgataagcttcaagaccaggatctacttccgtgggtttggcatactacagcaagcaacaacatgtaaagctctggatattgggtacaacttacctttctttaagggcttcaggatggggtccaccaacacccgtccctggtaccgccacccccattagatcataatcgcttaatcccattagggccttattcggtttggaggggattgaagaggattagaggggattgaagaggattagaggggattgagaaggaataattccacaccacagtaggtgtggaataaatcccctccaatccctccctcatggggattaaccgaacaaggcctaaggaaggggattggaggggatttattgtacacctattgtggtgtggaattatccatcctcaattccgtcgaatcccctttaatccccaccaaaccaaacatggccttaatgtggtgacattgtccgcaataatcttaggtttctttaaaaataatctatataacaagtcgagatgtaaaaagagtctgtcgtttgagtctagaagggtgtgctacagctcgaggacgagctactaaaaaagaagggagcaatgtgatggacattgggatgggagtcttgggcccaaacccctgcacgacatacgtaggtcaatggataaagtctgttaagatagagcaagttagaagagaaactaacctgagttagaaagacattatattaagatttatcttagtgcccccaccaacctgccttctcagcatgacatgatcttgctccgtcgcatcgttgaggtccagagccattcctgttacttcctcctcctgtaatctaatctatctccttttgccccgaaatattcttgcacgtgaccttgtgacccatcaatattgttggaatcatcaaaaataggagcattaggactaggcaggtgttgtgggaggtgttgcataatgagtgtataattgtactaaaaggtgtatgagatggtggtggtggagcggaagtgggtagagggtgctcagaagaagtgggtgtgatggaaatagaagtaccaggattaagggttgtagagacatcatcactagatgaaataggaggaaggtacaaactctgttagggtctatgaggtttgagtggagggattataaaagaatggatgaataagcaagtatgcaacgagaggacgatacccaaggaaacatattcaactaattggaaggccaacttagtccgctcatatggtgcaaggagaacaaacatgtgcatccaaaaacccaaagatacaccaaaattggacagacaatttggaggatgattgtctactaataagataaactgtaataggaacaacttcacctagaaatgagaaggaacaaaagaggaaatccgaagtgttcgagcaatctccatgagatgacgatgatggcgttccgcagcatgagcaccaagagtacctttagtggccaaaaactgacagaagacaagaaataaataatgaccactagaataggaccaaaaaagtattacggtgtagtaaactctattaaaatatagcgagaattttcattgatag

SEQ ID NO: 47305 - DNA, 12357 bp, Oryza sativa
  unsure (1)..(12357): unsure at all n locations
atgtggtggtctagtcaacaaacaaaaaaatacaaaaaaaaaatacaggttcacatgtcagagcctattaacctattcttctacctccatctcttatcccctttctctccttttctctctccatccttcttccatcctccacacctgagctcgatccgcgaggagagcggcggtggcggccttcccgagctccccaaggagagagacattaacacgggcctcagctcaaccgcaacaccagtggcctccccgagctccccgaggtcaacaggtgaggtcgaactcaagctcccttctcgccgcctaagtcaagctctgtcgcccctcgactggcggcgtcggcggcggagcacggggctttcggcattgtcattggcggagatgccgacgggccatgagaaaaagggaggagggccgaccggcgaccgtagcccccagatattgcgcggccgctcgacccgtcaaatccaacgccgtcactcgcctcagcttctccaccgcgcttccgcatgcgcctcgcacgtcggtatggacatcgatgccgatgcaagcaccctcaatgccaacgccgctcgggcctagcctacgccgtcagcttgtcgaccgcaacacctacaatggttatgccagttctgtgccaccaaatgccgtggaggatggccgatctatagtgggagagaacttggcaggagtggagggaggaaggcctaggacgaagagagggagcttgccggttgctttcgcctctcagcgagattatccaaagaggaagggagaagaagaagaatatatggactgactggtgggactccatgctgatgtagtgttcaactgtatcaaaactagtgtaataccgcttaggggggtaaaatatctggtattgatagttaaagggtgtattatacccggttttgtagttatggggtgtattttggacaaacataagagttcgagggtgcaaattggactttcccttcctaaaatatagctacctttctaattcaataatatattgagtaacaaaggtagctatactttgggatggagggcataacaatatatactaagtagacccttatcagcaaagggctaaatgggcctcgattatgatggttgatatgcttaaacaacaattattaatcacaacaagcagaataatataacaagagcttatagtttcctctatccatgccattgtgcaaccaccaattgtcaacatggccactctttgggtccaaggccatataatatatgcatttcacatatccatattatgagactcaaaaatagaatgggtgtcttttaaaaaagttcctttcaaaacaaccaaagcgaatacacatggcaataaaatttcaacatagcaaaacatactccctccaatcccaaatagcaagatatcgaaagcttaactcaataaaatatactcacttcattctcgaatagataagacgctttagaatgtgtggtcaaacatcaaaatctgaagtcaccagtatatcaaaagatatattcttattgaaaaaatattggcaattcatgtgttaaaatcacattagtagatccatatttcatatagttatatttttcaaaaatatatggtataaaagcagctgtagaacttgtgcgtcgaagaatgtcaatgcccaaaagggcaaagaaaagaacaaagagggctttgtaaggccaaatttctcctttccaccaagaaaaaaggcccatagtatccaaataaatgtaaaaaaattgtacaaatatcgagaatcgatccttggttgctgggttcaaatttcaaagctacatctagattagtgggaaattgtgcatagtaggaacgttaggcatacatgtgcattgtgtagtttcccctcactatgctgctccctacgaatacatcaatctacattctacaatactatttttcggtgtttccgacatgaattgttcgtttcctatcaataccgtcatgtttcctctcctatagttcctcttctgatattctgatagttccgataacgttttaatttctgctctacagattctggttccctgacggttttcacccctaatgttgactaatcactgaagtgaaaaacattgctaacactgcaccttcactagtcaccgatgaaaattagatttacaaaaaactgaatcataattactaaatgttgtgtagttttgactctgctagcatcatgactttaactggtgacaaggtatctcatatttattgtcaatagctaatacaggactaaaaatttgtatcaggcatgatccagtacatgctcaaaaccactcaaagaacacactgaaggctgagtaattaccccattgttttcgccaaggtgtttcccgttggagagttggttactgtcctcctgctctgctttcactttctttggtcttccccgcttcttccctgtattacttctgttgggttcattaagagaatccacaacttgattatccgatttttcagcaccatcatcattctgctcgtcgtgctattagcaaaatagcaatcagtcaattgaagcttcaagtcaacccaaaaaaaagacgcaccagacatcggtacaacgtaaaagaaacactgatacagcgatggtaacgacgacgaattcgggatgaaattagaagatttcagatctcgcaactattggagtgcaacaaaaatacgtggagaaattgcacgaatttagctcgccaagccattaattaattagtcaagcaatgctcaatttgtcacaaaaaccgcaactttccttattatcttggtacataaattgcctaataattttatcgcgcaccggtaggatagatagtcccatcctcaaatcaacagaaaatcttatgagtatatacccgatttttttactccaaaccaacccagtctcgcgccgaagagcgtacccgactttacgggctcctgctgctttcccccaaattttttttaaaaagaaaaaagaaaaaaaaagcggaggatgccaaaaggaaaaaaaaacgacagcgggaataacaaacagtagaggagcatacaaagatctaacttattatgcgtgcaaattcacaagatacagttcaatcgcagaaaaaaaacagaatgcagagaacggagagagaaacagattaaaagaaaggaacaaacggagagaggaatgaaagagccaaagaacaaaaaaggggatgattcccccacctcatcgtcgccgccgccatcatcgtcattatcagctccgctctcgcggtaggcaccaggcgccggcctcctctccctcagcgcccttccccccgccgccgccgccgccgccgggacgaccccgcgccgccgccgcggcccttggtctccgggccccgccgccggcgacgcgagggagcggccgcccctccccctgcccctgcccctgccccgtcgtcccctcggcctgcccctcccacgcttcgggtgcttgccgtctaccgcctcctccatctccatgcgagtcgagagcccgtgcacgcaggcagcaaggctagggcggaagctggtgttgagtcgtgcgtgcgaggggagaggggaggggattttttttttttgtttggtttggattttgaataggggacctcaggcggatcgaatggaaaggcgcccaatttaatgaggcgtcggcgctgggtccagtgagcgcggaagtcgaaccggtcgtcggaacaggaggtaggggcaaaatcgggcgggttatggtaatttgtatatctaacatagggcatgtttactttgttacaaaaaaaaattaccagattttggcattggttaccaaaattttggcaacttgccaaaattttggaattttggcatgatttcttatatagttaccaaaatttagcagcaaactaaatgtagccacttttttggcaactttaccaaaatttggtaaggttgaaaatggtatcaaagtgaacaggcccatagttcccaaattgatcatcatataatagaatttaaaatttcttaaattgatcatcatataaccgcatggatatggaattcatcataatacatgtaatgcgtaatgcagtatgggagaatatgtgcatgctaagatgtaattggtatgatgttttaatcgatgcatgcactatgggagaatatgtgcatggtatgttgattgatgtgatttaaattattcttggtcttggtgcataaacttatatgatcaatttaggaagaagggagtatatattttcccatcaaattcaaaaccgatataaataatccctgatataatcaaaaccgataaaaataatccccgataacatatcactgatcccactttttttcttactagaatcgaacgaatatctatttatgccatactaaatctaaggagtaaattagtgttaaaaacagagaaaaaaatttgtgtaatattacctatgagcttgcactaataagatagttgctgactgatggtggattcataatacatttttatatatatttgataatactagcaaaatgtccatgcgttgtaatgtcgtgttggataaagtttaactgaacgattttctaagcagtctagtatgacaaaaaataatcacaaaggttttctttttatttgaacaattattccacgtgtccgtgtatggtatgaactatattcctaacgcgtatcataatgattgtatcataggagcaacaaacggtgaaggccttcgatcactttcatgcaagagtagatggacgaaaatgtgtgattaacaaacaaaaatatgtatttaaaataaggtaagtttaataatcaggacggataaaaatacttttacatatttactcaatatttactcatagtcttataggggtgatgtgtgctttctcaatctatcaactctcatattgcaagcgtgcgatctcgttttcaaaatcataagtggacttgtgtggagactaatcgtgacacgtggatgatatatatagcgcgtagaccctaatatgtcatgtctcgtgaaaatttttatctaaaacaaatattagagtgaaagtttcggtgattacgatgtcaacaattgaaaaaaactaaaaaaaaatatcactcgtctatgaagtatgtacgtgtaccttaacaattattttttagcagaaatcaattcgatggattagcaaaatctagaaaattaactgcaattaacaagtctactataattgtagttttttttaaaaaaaatatgggttgcctagtcagatagggttatatctctcgctatacattacgattgaaaaaggttaatgaaaattctaacattgggatcactgtacaccataattaaaaagttaattaaaattttttattggttttagaccaaaagcccattcattctttcttttttagccctaggctagtctgctacctccttacactcggtctgcctccattcggcccattccacaagtggagcgacagcccaagctcatagccgactccgtcttcaacctccgaagataggatcgtgcccatacgatgccagagcagatcttccccatcaaatccggacgaattttcttgatatctcaaaattgatcgagagcttttgatccacttgttcccttctttatgttttttttctaaaatcagagcgtaaaactcgagataaaaaggaacgggaaaatcaccgatcggttatcaacggagattaaatctggcgaattaaagccaaatcaaaaggaaaatcatgaagaaaatgataacggaggaggaaatgcacgatcgatatggctgcggcactgagctaggattcaacccgagcggcggcgggaggcgcacagtgcaaaaaatagttcggatttgaaaatgaaaacaacaacaaaataaaccggatggaaaaaaaacaatggaccaaaataaacaggaagcttttttattaggtatatatatagatatagattttctgagtgatcaagtaatcgatcataattttccaacaattttaaattgctcaaaataatgccaaagaaaattctacaaatgactaaatgaattaaatcggcggaattaaataaaatcttattttggcccattacttccctaaccggcccaaaaaatcggcctggcccgtttaccgcgagtgcgcgggctgattgcacagcgaacagcccatttaccggcaacggccagacgcgggcgcactgagcgtggcgaagggtgcatggcccagttatcttctgcggcccaaagaccgcgtggcccaacagcggtggcgacctgacgcgggaccaatccgagtcgtccgatctgtttcgtccgatttgatggacggctcggattggttacacgccgatgaaattgccggccggaggggggaggggtctgaaaaccataaacctaatcccctttctcccctactctccccgatccaatctccggcgacacgagagagaggacagcggtgatccaatctttcatctctctcccttctccaccccagttgtcgatgaccagatcgaccaccggctccaagccgtcgttgctgctcacgtggatccaccgccggcgactggatcccgtcggatctccgcctccctctcgtgggccgcgtatccatccatcgacagcgacgggaggggcagatccggtgacctcttcccctcttgcatggattccgtcgtctctcgggagaagatttcagacaattcagaccatccgagaaaaatatgcataaacctctatacttagaaaagtttatacatataaattttcgtgtgtaaattttggtgtataatttttcgtttgtataaacttacttgaaaaaaaaaagatattgtagcagaacgtgcacacacttacccaaactgggttatcaaggcgtaatcacgcggcggacaggagtgcagtgcagtccatcttccatctgcatccaacagacgcaattattccttcttcaggtccactgtcgccggttgcctggctcaatgtttccaagaagaatatgtcttttggtccgctgtattatgttttttttttgaaactaggcatattatattaaattaaagggaaattaaaattatgattacaaccaacaatgctaacaaactctgccaaacataaaagtatatgaacgagcatcgaccatcatcttcattcttctggcaaatcctcaaagtggtgtcatcatataaattggtgatcggtgatccagaccctaaaactcatgttgtccactgaaccatcggaacccaacagagaagactttctttgttgatacctctgtgatcgaattaacagtagacaaagtgaaacgaaagataaaatacaaccaaatccaacttcaaaaacactatagacagcataccctagactttctaatataaatactgaaaacttgaagtgaaagaagccctaaaatttactatgtaattggtttgattgactcactgtataattctcaaattgctcataaatcttgaaagggaagagtataaattgttgcaaagttcaaatgttcacagttcttgcaaagtttaaatgtgcacaagccaaattgaagattccgaatgactaagtaccaaagacgccttacataggaataacccttatattgaggaattaagtacaaatggcaacattttaaagaggaaaagaacactacaatacttaaaccaaaatgtgtacccggagtttcgaaaaacaaaatgcacacccgcatcaagtccaccttatctttgatctctgaaatatcgatgcttttcaccaaatggacttcttccttcactaggaccataagcatgtagtgtatacatgcagggtagggtgtacacttctccgaggtaaccacggaaggaacggaattactaaatggcattcgatagattattaaggctaaaatcttacaaattaccactgagggatttgcttcacaattcatgctctttttctccagtgacaccttcttctccagctccgacacccccgatgaagacagtggagttaaggtttaaggtcctgggttgggtttggggatgggatggtggaggaagggggagagggaggagatcgtcgggcttaagggaatggctatgggaggcggtggacatgggcgagcggtaaggcgtcggcggtgccaaagccatagtgatagaggagggcggtagggtgggccggcattggtggcaagggggaaaccgaagcttgtggttaggaggaggtgattggtggtggcggatccattggcgggagccataggagatggggaagacaacagggcaggggaacctcacatctttagcttgagggatgtagatcctatgcagtgctgctgctgctgctacagtagcagtggctgacatgtggtgccagacacacaatgacatgtggggccggacacacacataagtgtctgttactactaacaatcctcactatagctagagcaggggaaggggagaatggaggaggaggaggaggaggcgggctaggagggacctcgccagtgccgatcgtgctttccggctagctgatgaggctgggcaacattggagcagaaggcgagggaatatattttttttttgggggggagaaggcgagggaatgttcgtggtggcaaggaaggagaaggataagagggaggggctagggttaggggagtccacacaaatcttaaaagcaatccaaaggtccaaatttataagatttggaggggggttttctcaaatagataaaccctaaaatgaaattctgcttttaaaagaaaagcccatagctaccctaagtaatgtaaaaccagtcatgagctcataatttggcagccccagaatgagacccttttttttttgtccaaaactctcacctcttgttttcagcgctcacgcttttcaaactgctaaacggtgcgtttttttacaaaaagtttctatacaaaagttgcttaaaaaaatcacattgatcctttttttaaaaaaatcagctaatacttaattaatcacgcgctaataaaccgctccgttttccatacatgggagatgggttcccaacacccaccatcaaacacagcctaaggataatcataaatttatcacatctcacattgctagaagtgtggcataccacagaccacacaattgttttttttttgatagaaccacacaattgttggtgtagacccaagaactatgtaagtgtggcaagacataaatatggggatgtttggttgcttactaactttgccaaatcacatattaggtaaggtgtggctgccacaaaatgtgtggctagcatgctagccacaatttagccaaagttagccaaacatacagacatgtggggccatatagagaaaaggtgtggctagccataattgagtcatcaactaaacaaatgactaaaaaactgtggcatgactcactttaggcatagcaagttgtggcatgcaaccaaacaaccccatagtaaccaaccaaaggttagactaaaaattgtacaccatatctaaggtttgacgtggcaaaacataacagccctgaacttcacaaaagaatgtatcatagaagctccacaactacaactgtatcgggcagctggcatcctccggtttacataagcagcctcagcgatgaagtgcggttgtacaatataatcagcttgagactcaccgtagcacctagaagttagtactatactccagatgtttcaacccaacaagaaacctaacagggtatcctacaaaatttgcttccacaaaagtaaatacgccatcgttacagctactacagattcgcttccacaagcaaatacaccattgttacagctgctagctaccactcaattcatatacattgaatacctaccgctgcaagcacactgaagataccactaccaggaagaaaaactgatatacagctcaaatctattgattggcaattgaaaccagattactagatggaagatatcacacacagcttaaaacagtccgaacaaacgtttccgctgctggctcatgctattttggggtgttctttgtggaggagtcacagatatcctgtccacgtttgctagtgcccacctgttgaaatcaggcgatgagaccagttgtttcatagctttatgtgtctcttctctagtgaatgctgcatattcctcctctgaaaactttttccgctcagggttagtgtggaaggtagaatagtagctatccgtagcaaggtcttgagacaatgtcttccttgatcctgtaaaagcaaaagattttaggtcattcaccaaacaataataccgaactatgacatcatacaggtaaaagaaatgacaaacccgtacgaagtgaatttctttttggtgtactcctcatgtattcaccatgaagcttgctaaatccatcttggtgagatccattcatgctggagtactcctcaccaaaaccttcatagccagtgggaacaatgttcgaaaatgccctgccaagagatacaatcaggtcattgatgtgttaaccatgttatcaaaagatttggtggtaacaaaatgaaatgcattcttaaggcaaagggacccattcatttggagaaactattatccacaaagacattattcagcgtcatctctacgaaacatagtgttataaatgtaaccaaaaggtttttgacaaagttgcatacattcaccatcacatctacaagataatacatttagaaagatacaaggactaagacatgaattatttcccagcatacccaattcctgtcagtgttccactttctattcacatctaaagtaattactctgatgttgcacaacatactacacacataggagaaaacatctattggacttagctgtgtgtgcactggccaagaataatcagcagatacaaataacaaagtgcactggctaaatctataaaagttaggaacccaaccataaacaatagaatatgaggaaccctgctcttacatagttacaatcaagtcaaattctccttgatgacaattgacaagggttatgatcaatgcgaaagtatgaggtgacttccctgataataagatatacgaatatattgcatcttaccttgataggcaccgtagaactcttgactttccctcaatcctagaaactgctttgatggctgtgcaaaataataatgctgaaaatgcaaagagatagtccaaagaactctacacggaaaaaaagaacaagcaaaagcttgtatgtcagttaacagataagcaaattattaggattgtcagtaaataacaggtcactataacaacttacctgcaggatcataactgcagaaataatcaagatagcccactcaacaaaataagccacaccagcatcaacagatccttcttctgttagcacaagcttacggacaccccagtaaccaaaccaggctccagctaagatcacacttacgagaaggaatacacctagctgcaataacatatattggatgttggtatgtcacagggaaaagagaaaatggaccttgaacgaatgatgcttttgaaagcattagcaatatatttatgggataatttgacagcagcatataaacttgaagggaatactaatgataaatcatggactatctctttatgggactattataaccagactatttatcaacaagaactggcagagacaagcataagtaaatatttgaagagaatatgagatattatcaaatttatacatcacagtaatctatgaaaacgaacttacaaaacacaagcagcaaactgcaaagttgaaaatattatacacttgtacctccataaaaggtaaagctctttcttccatatggcacatgtaattgaaggtggaaacagaagtagcaaatgaaccataagtaacctacaaggagaacttacatacaggattatgcatgtcttcggcaatcccaatttccacaagcacagaacgtaaaagtcccgacaaatagtgcaaaaaatatgtggtcatgccaacctgttttgagaaaacgtcatgaatcagtgttccaaggatatggcattgcaatcaaagcagaaacaagtcaaattgtatgaatactcacaagtgaagagtacacaaaaattgcaagagaactctttctaccagtgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47306 - DNA, 4293 bp, Oryza sativa
  unsure (1)..(4293): unsure at all n locations
nnnnnnnnnnnnnnnnnnnnnnnnnnnnnnnnnnnnnnnnnnnnnnnnnnnnnnnnnnnnnnnnnnnnnnncaatctagactggaacaaggagaagaagctaaagctgctttgcttgagaggatagaacatctaacagaactaattctggtttccgcaaaggcaagtcggactactaaatcgtctcactgcccaaggcgaagacattcttttggtgaagaggaggtctgattactcaaataattttactaaatgttataattcgaatgaacttgtattgatattttgaatacagtgccatatttattatatttagtacctcaagttctttaaagtttgtgagctgcttataactgcagcttgcatatctcccatatgaaaggcaagacatcatactggataatgaaagcaatatgttgtttgttcctatcgaaggattcggtgaaaaatttaaaagctcccccaaggaggagacggaaaatcagaaaggacaccttaactggctgaatctacgggtatgcacatgaatgatgtttaatccactgcattttaaacactttctatcatagtgaagagttgtaccattttttttcatgtatcacttatattaagctatgaaggtttcagaggaatggttacctttaaggaatacaggggactgcgaatcacatattcacatccttactaatgttgctaacttccattatgacaatcctatactatgatagtgtaaccttgcatgtaatactcatattccgtggccatatgacatcatttgtttctaaatgattatgcaagttgaattcttcaaatgttctttgcagatttgtacttagattatggaaccaaaatataatgattgagtttgcttttgtttgttaggattcttcctcttactgacctttttgtgatttgactgcatgcagaagtgtgatagtggttctactaatctgacaagttcggatggtgaaaaccctagttcgaccaaatcattacctgccctttccacacctctggggatcggattttttaatgtcacatcagaacaaaggatgtcagattatatgcttgctgagaatgtaccggctaatctgttatgtgttggccatagagaatttccttctgacagccttcctgtccaggaaacacctttggtacaaaatttgtgctcaatgatttttcaatttgttgcttgacacctaatgttaatttctcattagctggacagaatttctatgccaaaaatatttataatctggtactgatgttcctctctagaacattttattttcaactaaacactgattattttttctcaaaaatttgccttttatctcacactagggaaggaataagtgaaccaacattgtgtaccgcctatttccaatcagagtaggactaaactgaaaattgtaaaggttgctatcaaacattcatagaagacattccacaattttgttagatttttttagaacattcattttttttttttgttaacaacaagcgtagatgtgttttctgtatatacaaatcagaaagaatggttaaagtttgagttcaagggagattgggagaaagagaaggctgagtaggagtaatggaacagcatggcagcaatagtctgggactcggattaattatttgatagatgtacattctattataaatgtctgagcagatatctgtaaaaaatagtgatggcatgatcttttatgtcaaataataacaggttagtagaaagacttcagatcatgtggacatattgagagagcaattcaatattttatcaggggaggttgcactccatcaaagtgttctaaagcgcctatcagaggaagctggaaaaaatgcaatgaatgaacagattgaggtaatctttctactgtccactggtgtgctctatgatatattattataagcgctcttgttttctaaaatgtgtttctgtctatgttaagatggaaatgaaggtggtcaatgatgaggttaagctcaataagcagaaaatagcatctttagaaaggcggatttctaattcaatgtcaaatagtcgaggcatgcatgataatttagaactctcactggtaatgtttacctgcacccaagtgtgatttccaactttgtgttcttctaactatatacatatcatattgttacattggttttggcgttgtgcagccttacattgaaatacctgagcaactcaatgagaaagcgtttcaacatgaggtgaaccaattgctctattatgcgtctgttctttggcagtgagcttcatgctcctggctggtaacattaaagcattgtgttctcctcttaatggaaagatacatcattctaaaaaaaagtattagatggaatgggaactgaagataaggttcttgtgggacaaaatggtaatacaattatacaagtactccaaggatctgcattgatgaaaataatagcatttcaaatttccatagtaacatcatgctagggcctttccatttaaagtggtacaatgttgtcgtactcctacaccatgcagtatctacaggaggatatggtattattggcatgaaagcacaaaaggtagaattttcagtgttccaaacagtgattgtagtgatgtactgatgttttcgcaaacagaatcttattttccttcaacaagatgatagcagtcacaaatctggctgttaatgctgtgaacattggttggttgtgggtttgaggactgagggtagggtagttgccttatggcgctttcgcaaccaaggctgcaaactctggtagatactctctttaaaatatatatctgcttgacctgtaagagatgcggttgaacgttttgactactaagaaacctatctctgttatcaagtagatatcctaatactcttatttcgagttggttaaaggcctaagaaaattgtaactaacagcataatttttgccggctgtttcttatttcttgccacccagcccacctttggaggctgcagtttccagtgcttacatctgctgcagtgcaccgcttgcgacaagccaaaaggcaaaagcctgtagcagctaaagattgaaaatttcattttctcatgtagatctttgatagcctgcaaatttgtgcaaagaagttttgctatagattacttcctccgttctaaagtataagcattttttgtatgtatctggacatcccttcatccaggtacatagccagaaatgcttatattttggaacgcaaggagtatttgtttccgtgttgttgactgtgttgcagagtcattttatgtctccattttgaacatcacttttttctttaattactgctggtaaaaacagcagacggcagattaatgaaagacgagcaaaagatgattagtaaaattcgtggagcaagacaaaagcttgtagtattacttatagttttccctgtttgctatcaggcaagtgagtgccaagagtttttgttgtcagaaagaaccacatttcagcacaacacaggcattgtccaagaaacaggatctcaagctcacaaaggaaagccattgcccagtgatgtatctgatgaatttctgaaaaaggcgtcacaggtttgccttttctctgcactctaggcctgctgtcctgcttccttccattctaacttcaagccagtgatatgtactccctccgtttcataatgtaatactttctagcattgcccacattcatatatatactaatgaatctagacacatatatatctagattcattagcatctatatgaatatgggcaatgctagaaagtcttacattatgaaatggaggaagtatattgtgattctcagggataaaatcgaaattaaactgttcctccagccatttattggctcatattagtcatatatcttgtttcttttctactgctttgcttcataagattgagtgattgaccaatgagaagcttgtagccaggtgattggtgctctgtacttaaaccatgctgtcctgtcatgatgatgtacacttgtgctgataattagtagtgttagtattcctatgggatgacatgggaattagtgcttcaaaacaaaggcaccggaagttgacatttgtgggaaggttttatcatgaaatgtgttagcatctaatactacctcccttttttaatagatggtgccgttgacttttaacatactgtttgatcatttgtcctattcaaaaattaaatgtaaatatgcaaaaaaaaaaaagtcaagcttaaagtttcttgttggataatgctacttgtattacctagaatggtgctcttatgttacacatttt

SEQ ID NO: 47307 - DNA, 11215 bp, Oryza sativa
  unsure (1)..(11215): unsure at all n locations
cagctccgcgtcctcctcatcctctccccgctgctgctcatcgtgcccgagcaggtatggccncagagacgaccacgcgccgccgccgaccgccgtggcgccggcggaggcctcatgtacctcctcgcgcagctgatgggcatgggcgacggcggcggctcgccgtacggccgttggcacggcggcggcggcggcgcgtcgtcgtcgccgtggggcgtggcgctggtgctggtgctggtgctgttcttggtgtcgtaccagtcgtcgttccagagctggtggttcccgctgctcagccgccgatgagaattgcaaaagctcgtgcatgtaaaaccatggtgaaaatatagcagaggcttcttggttaatcagagctaagctcggtgacgatcgagctatatataattgagcacaagggcggagctagagcgagatggagggatgccacttgtttaatttactctgttttatattaagtttaagctaatacgggtatttaaatttgtattgagagatgtgcacacatgatgaaaataggttaggtataactatattttttcttgaccgggttcctgggtacccccctcaatactctagctcgagcagatggcatttgggtgccgtgtaattatgcttgtccgatctccaatcatagtaactaaatccaatttacctgtgactttcgagcgaatttccggtattgatatatatactcttacatatttacctgaaggggtttctcctatttttggagaggtatcaaaactaattgtataagttagaatagaattgggaatccatctttatgactttattatgttctagatatttttcttccttttttgagaggtatatgcattttgtaccttatagtgcatagtgttaggagatgtatacctccaggatctatgcactatgagttatgtatactttctacgcctcccgaaaatcagaaaagtgttggccaactataagcttgtcttttattaagtttgattgttcttttttaacctctcaatcagttaggaggtatatacctctataaggatgggagaaaacattttcactaaattatgatggcaggtgaagaaacgaccggttttgatagtgaaagtattagttcaacttgttttcgactcattttcttctttgatttcaacatgttttgcaaactgcataaaaatgtaactatatatgttaacaatagttgatgcaaagctactacttctatgataatggtatttgtagtataatttttttgctgttattgttaagcatatacagtaacaagacaagatatggttatgtttgttaatgacatactatttgttgtttgatgctaatttatatatgtcaaactccatataatagtataaaagatgtcttgttactttataaatatgtggatagggttgggattgggattgagaatgaaatagtcccaattatccatctcttccatatccctataacaattccacctttttattacctagctacatccagacacacgataaggatctgcgaaagtatatatgaatatggtgagtgaactgaaagatataagtaaatgtgtaccacgatgaataaggtgagtgaattgaaagatataagtgagtgtgtaccgcgatgaataaggtgagtgaattgaaagatataagtgagtgtgtactgcgaggaacagtcaaaagcgttgtggtataagctatctgttcttctttttctaccagcttaatttagtttttaggtgaattaactagtacatacagctcaatatgatattataatcatgatgttttgagttcaaatatcatggttgacacaatatttcaagcttttagatgaacaatggtaaggtacataaaaaaggacccaagaatgttctaggtcaaaagttctttgttctgcgttatctagaatcttcttttgttggcaacagcacacaattcttgcctcatctttttcacttctgtttatacttataaatcaaaatttaaattttcaacttaaatctagagttaattttgaggttttttcatcgtagtttatttttcagcattcgcttttagatcgttaagaacacttacataaaaagttcatttacaatttttttttcgtttgcaaatataccatttgacttattttaagccgtacatcccaagcgatacaaagaagctcctgtctccatcttttctggtgctctttttcttttctctgctgaaatctagtaaaagctctggtattccggttgcgactagatatgatatgatatatgattacctcagccaaagcagaaaatgcaattttgattctcaaacacactctttcattacctggctttaagcagcattaccgtgcgatgatgttctagattttggagccttggaatattaatacgtacgatcaggtctaactgagcttgataccacaattatacagagtagttaaaattttgccttggagcttttggcatttctttattatgagatagttgcaagttgattaatcaaattagcatcgaagattacacaagcatgcgagggatagatatagatatagctagactaaataaaggaaggaagaatcttctaacttttgtcaacaatggtgccgtctcctctctttcggctctccttgataggtgaccaaagtgactttctgcgctaatcatacgtgtggggctctctccacacgtgccaccctgatcccagatattctgtgtgatcatgaggatataatcacttctctggacgataagactgtttttttatacgtgatgctgttactattcatcatattgaatatatatatatatatatatatatatatatatatatatatatatatatatatatatatatatatataagttatatttaaagtaacttcaataataaaacgaatcacgaaaataaataaattaattcattggatcttctccaatagacggctcacattcactcatatgtatatctaaataaaaaaaatagggattgtatctcgtttaaatgtggtgatatctaatcgatattatgtgatacttgtgatacttacgataccggttaggtattaggatataatatttcagatgtaccatttcgttcgaatggaataccgcacatagcattcctcgtaattaaagcaagtccagaggtagttcttaaaaagaatggtccaaaggggataaacatcaattaaaattcccttgggtagtactcgaccatgatcattctatacacacagaaattcataaatttaaaatggtccatcatcatgtggggatcgtcgtaccgcaaaatcattttaattcgatctctccactctccagattcgtagcgatcggcgattcattccgacggtgtacttaacgcctgcacgtgctctcgcgtgcatatcaccggaggattcgttgccgccgtgcgctacgacgttgagatcgatccgcttcatcgtcgtggtcgtcacgtcgtctcacggcgcgcgtcgttaaatttgtctcgcctcgttttggaccgaatctgcatgttggttacggcgccactgggctgggctcggtgttgcgcgcgcggcggaactgggcttttctcgtcctcgtttcggcccgaaactgcaaaatgtacagactgatatgccgccctccggcccaagcactaaggcctgagcattaaggttttcgtttttcaaacggtcaaacgatatattttatgaaaaaaaaactttctacgtagaaagatacaaatttatttttaagtttgtagcgagtaaaattcgattaagcatgcactagtggttttcttgttttccgtgtcctaactttatcttcatcttcattagaaatgaacaccactttaaaatataaaaccgttagaatttactgaaaaggccgtacggtccctgaaatcacgtctggttcctcgaggtaagtttgtacgctaacaatttgaagtatatttttatgtctcgactcaaatttatatttcgatttaaaatcgggtgtttttatgtttctacgttaaaaattaaagcttgaaaacaagtagtaaacaacatcttacgatggcccagacgcatgtggattaaatcgccaaaagtcaaccaagtttggcgaagttttaattgttcgtggatgacttgcatcatcattgtatgcgggcacatgatgattttcctgttggttcaagcttccgcaatctcactggtcactactgtccccagctgccatccctgatccctgtgtccgctaaccagaccgcacagcgaccgtccgtccctttcattcccccgcatgcgtgatcccccattctttccgagaaaaaaacccgcgtgatcgcgtgatcgcgtgatccgatccgatctccaattctccatcatgggctacgactctgacgccgcgcgttgcctctccgatctcggtgagtccgccccttctctattctcccctccatgctccattttttttttattttttagacctttttaatttttagttttgcaacgggtaaaggtaattttaatcatgtatactggtgggaaaaaaatataaaataataataataataataatgaaataaaattacagtgacctttggtaaaaagataaaaatatataatcaattttccattaattccattagctaaaaataatataatacgaagtaggaaagttattctcaaattttagcaattttcaaaaagcttaaatagagcaaactaattatataaatgaaaacaaatttaattacctaaataaaacaattagacctgtaattgaaaatctgttgccggtttagttaaaataagcctgtgggtgtgtgtggtatatatctctcactcgtatgtcgtggtctttttttttacatagaaaaaatgcccgtgcgttgcgacgggtaattaaaattataacaaatataaaaatattatatgattaaggtttagtttcacatgatatgagctctttaagaaaatatatttataatgaaataaaaaagttcagctgaagtgacctaaagtgaacttgttccatacggagcatacacatggtccatgaggcggccaaatagtgtggacggcctagaaatagaatcggggaggaacaacttaagcgacctaaagtgaacttatttcgtgtgggcggtctgggaatggcgttcggcctgacgcgggagaagccagagccgtccaatctgatagacggtcatcccgacctatataaaagttcaacagcccaaaccctaaccctaaaatcatttccccttccccctctctctcaaaacaatgtggcggcggcccgacataccgatatccctgcgacggcggtggcggttcagcagcgacggcgacatcctcccctttcggcgtcggcgttttcttagtgttcttgaatctgatcttgtattcttgtagtagtgttttctttagaatttaggtctaaacttgatgcggtctctcatttttttttcattcttttcttttttttttattatttttcatcggagagggattaaagcgggatcaatcgcacgtgcaatggaattttttttatggacgaaaactataacccataagccatacaaatttttttaattaggtatatatagatattgaatcagattttccttttttttttcatttttttcgtccttttttcgttactacagatgtcagaaacgtctttaatttttttttaccgcgtcagatataatcagattcgattttttttgtcgatttctttttcacgctttttttcacgggtggacgacggaaacactttttaatttttaagtagtagagattgagatagagatacagatagagatagagatagagaaacggaaaactttttttgaaactttttttttggaaccggacagaaaaaattttacgtttgttttttaccgcatagatggaatcggattcaatttgtttttttaccacgccgtgtcacatataataggattcgattttctttggaatcggacaaatacttttttctttttggcccctttctttaccgcgtcgacagagtcggattcgtttaaattttttttccttttttcgcccttttttaccgtgtagaccgagtcagattcgtttctttttttttcctttttatcgcccctacttttggatcggacttacttttttcttttttttccggttttttttccttctttcgccctttttgatcggacatgtttgtttttttttcacacggttttttttcgcccgcagatttttctgtttgtttcgtccgtttttttatcggacatagttttttttcgcccgatttttttctcccatggttttttttgacggacgatggaagcacctcttatttttttaactactagtagagattaataaatattatcggaaactgaatttttttagccacgccaacactaccatgtcagctgcacgtggcgtgatagagttatttggccgcgccagacaggctggcgtgaccaaaagatttagatttagaaatactttttagagtgttctattaataaggctaaaaaataaaaactctcaaaattaaaagaaataaaaaaattttctccatgctctctctataggtatacatgcatgtatatactccctccgtttcagaatataagtttttttttgttggatatgatatttcttagtactataaatttggactctttgtctagattcgtaaaactaagacgtgtcatatccaataaaaagacttaaattctgggcagagagggtatgttatatacatggtatatgtgcatacaaagttatatacactatatataatttatgtatacgcatacaatgtgaatgtataaaaaatatatatacatgtattaaaaaaccaaaaaattagaaagaactgaaaaaaatggggaaaaaactagactgctctctccgcacatgccatgtggttgcgccgcacggagagagggcgtgcgatagcagtgaaatagctttttcgcgatctatttcgattatgggcctgttaagtttccaaacaaatatttttcatcatatcacattgaatgtttggacacatacgtagagtattaaatatagaaaaaaactaattacacaaattacatgtaaaaatagagacaaatcttttaagcctaattgctcaatgctttgacaatgtagtgttatagtaaacatttgctaatgacggattaattaggcttaataaattaatctcgttgtttttagacggaatctataatttattttattataagtatatgtataatacttcaaatatatatccgtatatccgatatgacacaaagaaaatttcattcgcgacctaaacaggccctatgtcacggtaccaaactatcacgccggttatgagctgcagttaattgattcgctggttgcttgctcacgcgccaacgtacaaacaaaacctgcgttttcgccgtgcactcaaaacggaaccgagcgatggagcgagcaggggttgttaatactctctcgttagcagcaggggaagttgccgagttgggcgttgctgctgaatcggcaaaggaaaatggtcagttatggcaactgactgactgtgacttgttcaaaaaaaaaaaaaaaactgactgactgtgaccgtctccgaccgagtgctgcctcatggctgtcagcttcaggtttgctcatcccatactgaacagagtgtatgttcgtactaatttcgttgtcaaacaccatcattcgtaatgacatggtggcccttgttattattgatgtggaaaaacttgacaatgtttgcagtttgttttgtcctgcgtgcaacatttgcagtttagtggtagtaccgcatcaactttggataagcaccgagaaaataaggggaccggaagtgtactcgttgcatgttacaattactccatccgtactataacgtagcaatcgaagatggataagcaccgaaaaaataaggggaccagaagtgtacttgtttaggatggacattatttattttaaattgttatattctgagatgaatgtgatatgttactaagaaaaacctgccgagtataatgatggagctctcgttttttttctctacacagaaatacgaacgctcgtttacgtaagcgatgacttatgaagcagccatggtgactccacatggataaagattagcaaaatcatttttgactagcatctgacttccgattcatgggtacacgaaaatttctgctaagttggattcgttttttctctctctctcgattttttgtggtcgcggagagttgtaatagtagcacgagtacgcgtgcgtaacgtaattacgtaaacgtgcctagaaaagacgacgagcaggaaattttccagcacggttccgttgtttggtattttacattacagaccttttataagatctatttcacaaatatgtcctataaacctaactgctaatgtggatcctggatcgatgccaagtgccattgaggttacatgttcttatgttggaaatgttggcaatatgcgtggcagccggggcacatcacgctgatgtacccaggagctaggtcaacaccgtacttcttggtggtgatgtctagctgacaagtcaagctcggaaatcacgtgaatggcagaaatacctatgaacccatatgtcagctctctcatatctcttctctctctatccactcatttcacactagttggtcagtgccatattgcatcaccgcctcgagccatggctagcgctgttgccaccatcgcagcccctgccgaagaggatgccgctgtgtgggagcgcgccattgcagcgaccgtcaagaacgccccaagaccctaaccctcgatggtatagtcaagtccaccatgggccgcctcccccccggaatgctagttcgcgcgcgcgttaccggcgcgcacttccggcccacaaggcccaccgcatacgcgcacgtctctttttttctttttctttttttcgcagtttttttctaccgctgtttcttctcttttttttcttttttccacagtttgctactgcatggataggagaaaaaatcataattagtttactagtgattagtttcctatttttactagtgattagtttactagtaatatttttaaatcttaacttaaaagttttcaaatttggacttgaaagtttttaaatctcgagttgaaagttttcaaatctcgagttgaaaattttcaaatctcaaattgaaagttttcaaaattttcaaatctgaatttgcgaatctcgagttgaaagctttcaaatctcaaattgaaaattttcaaatctcaagttggaagttttcaaattttcgaatctagagttgaaagttttcgaatctgagttgaaagttttttttaaaatttgactttaaaatttaaatcttaaatcgaaagtttttaaatctagcttaaaaattttcaatctattaataaaaaaatctccaacaaaaattttttaaaatctttcctaatactataactaatagaggaacttaaggggagtgcgcgctagcggcgcgtacacgccagctagccgcccccgcctccccctcggcgttgttccttggtcgctacctgttccttgaggagctcttcgtcgtcggggtatgcctttcctcattcgtaagcctcctgcacctctcggtgctccgccgtctctccctcccagacaatcgcctcacaaggcccaccttcctcgcagatgtcgtcgagccctacgacgccacactccgccaccttgatctcgggaagcgctcctacacggcggagatgcgatgcagcgccaaccaatcagtgtggaaggaggggacagagagaagagagatggaataactgacatgcaggtatagggatatttatgacatttcacgcgatttctctcttctctttaaccaaaaattattattttaataggtgtggtgtccagcagcaaatatctaacttctaagagtttattctccaaaagtcactccgtgcggtgtcttacaactaaaacagtgaagtcacgatattctttagcaaaatttgcatatcctcaattaattttttgagggtttatttacaaaataagtttatattaagatgcccaaatgtaagaaatccagctccatttcggccagactctcaagctggatttttcatattttgatccttttaaaaaacttatttcgcaaatagacccctgaaaaaatttatctcagaaatgatcctttttggggcgccagagtggctggcgccgtcatccaacgggacggcgccagcctctctggcgccgtcctcctgccaccgtggcgcacgcgaaccgacgtggcaggaggagggcgccagccatgctggcgccgtcccagggaggagggcgccagcatggcaaaaaaaatttaaactcgaactaccacttagctaagtccgaaaatatctagcataccacttagtttactttgcaccttcactaaaattagaccataactcctttagtaaaactttttgatcagcatgttaaacataatacactctaccactatatgaaattacttaatctaattaaaaatataaccacatgaaatgacatatgtaagttaaatagtacatagagatgcaattttttttatttttatttcatttttttgatatttttttcatacttaggagaacataggaaccaaccgtgtaaaaaataaactcaaacggacaaaatatgtgacatgtagaattttccaaaactctaccgaaacggacaaaatatgccatctattaaaataggcgtaactttctcatacggactcggaatcaggcaaataatatatgcacggacatctacagaaaaagttacatccgattctccctagctttgccgggttcggcgatattaaaacctccaaattccgcttgcaagattgtgttttcgaggagagaagtttttcggtggagctttggaaaattccacatgccacatatttcgtccgtttgagtttattttttacgtggttggtttctgtgagttcctaagtgtgaaaaaaatatcaaaaaaataaaataaaaataaaaaagttgcacatctctctcctctgcactagttcggagagaggagaggagaggaaaaattctacatgtcacatattacgtctatttgagtttaatttttctatggttggttcttgtgtatctctaagcgtgaaaaaaatatcaaacaaataaaacaaaaataaaaaatttcgggggggggggg

SEQ ID NO: 47308 - DNA, 12629 bp, Oryza sativa
ctccccctagccacctcagcatcgccccgccacgtcggcggtgggacggcgccaaagaggctggcgccatcctgttgaacgacggcgccagccactctggcgcccccaaaaggaccatttttgggataagtttttctagggatctacttgcaaaataagttttttaaaaggacaaaaatgtgaaaaatccaggactctcaagagtccaagagaaggccggcacgccgggctccgacccggccaaaaattcccaaatccaacctgtacgcgcctctctctattctgatccacaccaccccaccacgccgccaccacctacccaccaaataattccaactccaactacttctccttccttctcctcctcctgggcctccgctgccagcgatcaagccagcacgatccccccgcgcgcgcccccagtcaaccccggcggccgccgaggcaaatgccggctgcgggatcccggcggtgaaggagcggacgccgacatgggtgggcttcgtgtcgacctctccggcgcggagatccgcgtggaccccgcgtgcggcgccgccgccgacgatggcgggagcccgcccgtgttcctcccccgccagcccgccgcgcccccgctcctcgcgctcgacatcggaggtacgcgcgttttcctcgctctctcacgcgcgaagtagacgatcgtggtggatgaactcgctccggggtggtgtttttttttttttccgcagggactctgataaagctggtgtacacggcgagctgcggtggcggaggcgcggagctgcggttcgccaagttcgagaggcggaggatgcaggagtgcttcgacttcgtcagggcgcagggtctcgtccaccgcaatggtagtgcgtttttttgcgctgaattttggttgattctctagcgttctagctccatagtttttgagactgcaaaaactatggatggtaactgcctaactggcgtgggacttcaatacttgatgaggaattgttagttgctctcaatttaggactgtagcctgtaggagctcatcacatttgggaatttctgtggctattcatgctggcatctttgtctgttcgtgatcaacaaagcaagctcactgtggctgttggacatggccggtgacatttgcaagcgtttcactccatcatgccggcgtgaagaaggctatatatatgacgcgatttttactgcaaccaaaattacaatttctgttgttggagcttcctgtgttcgtgggaagaaaaatgttggaactatctgttgtgagcttaattatatttttttaattacaggatcaactatgggttcaagcaaagaaaatatagcattgaaggtatgatttttcttgtgctatgtattagtggtccggaaaatcaagatatcaatgcaagtggagaccattccagcaatctgctgtttcctctacatttatttgcatgttcatatgaatgttttacctattatcatacccaaagaaaaatcaagagctttgaatggcttcattattgctcactagtgatagcggatgtatgatgggctttgtatggcattcaatagtttactatcatatgattggatgttgctgctacaatccattgaaatcatatttattcggtggaattcaaaaaatacaaacatagaaattagttgcttacattttgtatatcatattagttgcatttaattgacacaactaattctcgaatttaattcatggagttgcattgccaaccgatgcagagttacagaaacaatgttgcagtatccccaagcagcggagtataactttttatcattattatttgaatattattttatttagcaaatcagggctttctcctccttggtatggtatcactacatcattatagatgttggcaagtatgcttttcgagcatttaatgcacagctttgtgtgaagacgtgaaacattgttgaatatatgatttagcagccttagttattgatctaacatatatgatattatcatcatctttttctttgttgacctgaatagaatttaatgtgatcaacactgtctgcaggcctcaggtggtggagcatataaatatactgaagattttcgtgagaaattaggagtttgtcttgacaaggttgatgaaatggatagtgttgtttctggagcaaactttttgttacaggtcagtcatatgcatctatattcattgtggccgttaaataaatcactgcacatcttgaccactctgtagattttcaatttgtattttggatgggaccaccaaattcttgagaaaattgcaggcaacttatcgtctgtatcgtctggatatttatttcttatttggagattgttttggttaaactgatactttcttgcagagtgttcctggagcagccttcacacacatgaatggaaagaaaagttctgttgatatttccccaaataacttgtttccttaccttcttgtcaacattggctctggagttagcatattaaaggttgcacttcttcctcatgatacctgtatggaaatgccttacaatgcagctcatataaacatgttttatcaagtttaatgtaggtcactggaaataggaaatttgaaagggtaactgggacacatattggtggcggaacaatgtttggtttagcaaaacttttaacaggctgtaagaggtaatccctatacttttatgtcatatattgtcttggctactgtttcctcactgatatggtataattctctagttatgacgagttcttacaattaagccagaaaggggacaattttgttcttgatctaattgtgaaggatatatgtggggaacttgtttgccagaaggtttgcctttacccttttcttgttttatttgattgaccaagacctcttgtcttgcaaatttaattttcactttgtccttgtttcttttgttttagttttggtaggccagtcgtgcttttgcatgcgggctaactctaccatacttgattgtatttatttatatgcaacagatttattcttttagcatcattaacaaagcagtatgacttctaggattattataattattaatgacatgcacctatttatttatcttcagctatcttttaagttttgaagtgttgatcctttcatttcatcattgaatatttgttcttacatcttatgggtcccttcttatatgctccagcaaggactttcaacttcaactcttgcttctagttttgggaaagttatcacttctaagaagaagttaacagattacagacctgaagatctagcatccacattgttgagcgcttttacctataacattgcacaagtgagtttttgttcgatctttacctataacattgcacaagtgagtttttgttcgatctttcttctagctattaagtcactacagattatgttggaagtggataacgtaagacagaggagcttagttaaattctcttggttccttcctcagctgtgtgcatctatggtacaaccacactagttaacagcactttcttgaaagaaattacctgggaatatgcagttataatttggaataagaaaagcacagtaaccaacggtttcttctgaacctaggtagggataaaagaaacatgtttaaacttaagaatgtttcagcagaaagcagtctaggcaaatgacctcaaacatgctggtaaaactttatcagaaagaactcttgttttacctttcaacttatgcggttctgttgttactatgttttcagttactggttgtggtaaaataatcatggtatttgtcattcagatttctttccttgttgcatcaatcttgcatctcagaagagtgttctttggtggatcttatatacgtggacataagagcacgatgcaaaatatttcttatgcaattgacttctggtaaatacttaaaacttcctaaaattttaagtgtatcaatgtggatgtcatttttcttcaaaaagttatataaaactgtatattcataattgcaatattccatttgttgggactttaatatgcgaggtctgttattcaggtcgcagagtaaaatgcaagctgtcttcttgcaacatgaagggtatttaggagctcttggtgccttaatgagttatggtgattctggagataaaaacatgaaccttgaggaaatgaaagaggaggtgagttagtgagttactaagaaaatactgttgactgtttatcattgtcctactactccaaaaagaaagaaaacaaatttggctctcattctttatgtttttttatctaagaaaaagtttatgtgctactagatacaaattacacaaaatctagagtaattcacaagtggaggtgttatctgcatcagtctatttgcaacacatgtccttttgtaaactgtttgatattttccaataggtgtttatgtcattaggattatttctaattccaagctcaaacgtgggagtttcttgtgctctattttatgttgctgtaggagaacatccatgaatcagcaacacctattgatgagacatcaacagatgaacataatgatggaaacatatttccttatctccttgttaatattggatcaggtgtcagcatgatagaggtttgccaatacacagcttctcattgcatttagtattttatttacaggacagttgttaatagagcattgttttgtgaggcaggtaactggaaatgggaagtttgagcggattataggatctcacctaggtgggggcactatccttggtctggcgaggcttttgactggttgttcaaggtaatattcagtattcattatgatttgtttattttatattaatattgggattttatttcatactgattaattgctttttttttgttattagttatgatgaattcttggagttgagccagagaggcaataatttagctgttgatttgactgttggtgacattatggggagcatggttacccaaaggtacatatacccatactctgacaaaaggatttttttttttggtgaaacgcctgtgggatgttaatcattactatgccgaccgacttactaagagtacaatacatatattagctatttgccaccctgagatctttggtggaagaagccatagcttggttagcaaatgcaagcatatgtcacttatgtccaccattttatttgcatatgcatatgtcatcgactctggtgcttggttacattactctaatgatcgaaaatcacaatgaccacttgttatcctatggatgttaaatggggcttccttgcgtcactactgcagctagctttggaaaagtgagttcaagtagactttcggaatacaaagtagaggatcttgcggcagctctattgaattctttcacctacaacattgggcaggtatttccagatatctgagttactaggtgtcattcaccaataatgtgctgacctcattttgtttctcttttagatagcctactttgtagctaatctttctggtctgaagagaattttcttccgaggtgcttatatctgtggccatgagaagactatggacaagatttcccattccctcaagtattggtaagaaattcctgttaagtttgctatccaggaacactttaatgctcagttcaatgcgattgacttgttactagttcattacaatttttcttgctctcaggtccaaaggccaagttcaaacaacatttctgtgccatgaggggttcttgggaacactaggtgcattttggagctatgagaacatgggtattgacggcttggcagcacatgaagtcataagggaggtcttgcttggcgctccttacactgggcagcttccatctctgcctctgactcaccaacaggacaatgtaaatatttgacactgacacgtttagctgcgtagtttaattaccctatgttatttttccttcaagagtgcaaaaccttaatactctctctctctctctctctctctctctctctctctctctctctgctgtttttagggagaagatacgaccattgaaggagaagtagaacggcttcgacatgacaatgctgtgctgaaggctgagcttgaacggttacaaagggagaacacagagctcaaagcgaagctggtaaaatctggcaaaccaaataccttttatcattaaacataggatgcagtagtgaagcatgattccatggcaacaagagaaggtgtttgagggcaaaagttcaatggccttgttatggagatcggagaggcagaggctgttcaaccaacccaccacctggttcaagtcttatcaactactccggtacggccccaatttgttaaaagactgaggtgtgtgatccacatggaaacagatgcaactaacagcctaatactgaggtgtagaaagttgttgtaaacttgttacactttagcaataacttttattccaacatgatttttacagaggaagtgtgcacacaggtagttacccagttaacattgctcatacatattgagctgatgttgtatatttatttatttttctttacttatttttgttggtgtaaccttttctctgttgttctgtatcttgtaaatatggaagcagccgtgataataaacatatatggtgtctttgtatattttgcgaagatgtctatattgtcatcaagaatagtacaatacagaaatgttcatgatacttgtcgagcagttgtcttccctattataaaccaaatcttaactattgaaaggtgaaactcaaaatgaaataaggatgagccacatcattcgataaatattagccgttggattcactacaagataaaagaggataaatgaatcttaatcgttggattagctggatagtaaaaataataatttaagaagtttccggggatgaaactactagaaggaaagaaagaaaggaggggaaaagctaaaagaataaacatatgaaggtataatgttatacatataatttacgatctgtaaccagtggcggatctagaaaaaaaattaagcctggacaaacctcataaagtaacaagtaaacacaaatactatagtattttataatgaatagaagcaaaattgggttgctggctaataactaaatatgataattagtgctaatctaatggcgcatgtgcagctagactaatggctaagcattttatttagctataatgtatggatgcatgtggcagggcctgttcactttgatgaaaaaaaaaaccttaccaaaatttggcaatgccaaaatttgccaaattttggcatagttgctaaaattttggtagaatttcttatataattaccaaaaattgacagcaaactaaatatagccacttttttttgacaattttactaaaatttggtaaggttgaaaatggcatcaaagtgaacaagcccgtagagcctgggcgcctgcccatgctggccgggcctcggctccaccactgtttgcatctattgtaaaaactattttacaaataaaccctcatcataactaaagattcatgggtcaagattgagctatttcgacttttcgagtatatacaaaatgtatgttcatttgattaattttgtttctaacaattatttttaatatatttgagaaaaattactataaagacatgcacagttatggtcaccgaatataagttaaatgattttcacacgaatttaaacgaaatcaaactcattccttaaaaacctacaaatatttgtgcatagcctataaaaagcatgtgccaataaaaagtaaggggtcatgcaaccacgaagaactgtaggacaataacttataaaatttgtaacaaatattaagttatttagtgtattatcataatattagtcagcctaacctatgtctaaactcagcctaacctatgtctaaactatgttttttatgagcaacgataaacctataaaaaaattaccactcccacgtaccacataataaaatgtctagagtcgtgcgaatgggcaatataggctagttcaaagtgaaacaagactgaaaacttggaaggactttgtatctatcctccatcacctgtacataaaacatgaatttcgtttttttagaaagaccaaaattctaattccatgatggcttcatttactgcgtattattctctgtataaagtggttcttttttctttaacaatttcacgatttactgcaaagtattctctgtataaagtagttcttttgtccgtaacgaacaaaattctttttttcccttaacaatttcaaaaaaaatattggcataaaggagtttatttttacttaacgattgtacgacaaaattattttattcttaacaatctcacaaaaaaaaaatattgccataaaggtggtacactgtaactgtgaaaacaaaaatttaaaaaaatgaaacataaccattgtcataaaggaggtaaaacaaaaattaaaaaaatgaaacataaccattgtcaaaaaggaggtacactggaactcccaacaaaaacaaacaaaaattcacgacgcctgagagattcgaactctcgcggggaaaccccatgtacttagcaggcacacgccttaaccactcggccaaagcgtcgtctgtgctaaaggtacaaagcgcttttatatgtcataaagcaattgcttttcacaaagcgagactctgaagacatgaagatatctgaatctgatcggatatccatctctcctgctatctgcactagaagaaatgagacgctagcaaaggacttgggatttgagaagcaagcatgacactgacgttataagccactgagcacttgcttggcttgcaagagctaacttgccttggaatactgcgtccagattaacctcctggccgccacgtgaactcacgctgtcctgccgttgggtttttgttcattctaaagctccagcagtccagcctccagcgcacaagaaaaaagctcaaaaaatggatcacctcatttcctttgccaattccagcttccttctgagaaaggtctaacgattagacgcaagagaacacttgcccgcacggaaaacggagcagcgattagcaggtgattaattaagtatttgcttttttttaaaaaaatagattaatttaatttttttaagcaactttcatatagaaattttttgcagaaacacgtacgcgtggaaaacgagagagatgagttgagaagatggtctggctctgctctatcaatgcatggcgaatagcatatcacctgacgttaacttcctgaaccaagcaaagtagtacaatagtacatgtcttcacacaatcaaacacattgacacatgtagtccctctgtggactagctttagtttagagcactcgcaataataaagtaagatgctctctataaaacatgtacatctcagcaatagactagattaatagtaaaccacctcaatagtatatctacatcggtatctatagctctctaatgcattgcctcgtttttctctatagactatctccaagttagcagatagctttgctctctctctttatttaatatcttccaagtagaaaaatatgctgacatggatctcttgtagagagcctatagataaccattacgggtgcccttagaaaaaccgaaatcttgaaccgccccactccatgtagtaaggggttgtttggtttacaactaaatttgctacatctaatcttaaggcaagccacactttttgatagacagcgtttggtttctgccacaattttactttacctaactcctagctacttggcatacatgtcatatactctatggtactcttttttttttttgcctaactttgcctaagcttagtttgtcattttgtttgccataaaagtttggcaagattaaacttagccaccttagcaaaaaaaaaatatgtgacaaatttagttgccagccaaacaagccctaaggctctattctttccttattaggggcaattgtaaatttaccatagctttaaatcgttattgcaagattgtcattagaaaattgcaaaaacaccactagaattgtcatttgagtggcatccttgtaaaattgaaaaaacttgtggaaaatttgcaaatgcccctttttattgagatgagaattttatctcgatttttattagcacatattttaaacagctaaacggtatattttgtgttaaaatttcttatatataattgttttaaaataatagataaattctttttttcaactttgaaacgattaaaacctaattaatcatcctctaatggttttttcattttacacgctcgtacttaatcttcattttcattaaactcaaacgaattattctaactaatcttaaaaattaaatatcctagttataagctgtcccctccatagttagtactataagttatgagttatatgagttatgagttataggattgagattctctacagtcgaatgcacggtgcttttgtcactgacatatggactcagggattattgggtccacatgagttataggattgagattctctacagtcgaatgcacggtgcttttgtcactgacatatggactcagggattattgggtccacatgttaacaaagtcacgtgattttaactgcagaggatcctgaattcctgatcctgagttttgagcagttgagcactcatgttcagacagagaatttaaccgaattcagacagagaatgaatgatgattgatgggtcatggcacaaggacgctaaaccgaagttcaggtgtgggaacgaaacgtgcaggcttgttgcacctcatttcccttccttcacaaacctcagcacaaaaccgatcgaagccaaaggcaccgcgtatatctgctggactctggaatccagcacacttcaccggttgcgtgcaagcctcactccaatccaaatatccaatgacaccaacaccatcaatcctcaaatgctcattctctatataaaaaccaaacccaagaactcctccaaatcgactagctagcagtgcctctctagtctctatacaagaagaataagaaaatctcattctctcttggattgcaagctacagtgtctgctcggtgcagtcacagagctagtagcaatggtcgacatggcggaggcggcggcgtccatgtcgccggagctcgccgcggcgctggcgaaggtggccgtgttcgcggtcgtgcaggcgctggtgtacctcatcctgcgcaagtcgtcgggcgtcttctccccggacaggacggcggcggcggggtcgaggtccctcagcttccggccgatgcggagcatgagcgtccgccgcttcctggcggcgctctccgacgtccccgtcggcgtcacggaggacggtggctcgccggcgccggcgccggcgccgccgcatcgcgggcctgcagaccttgccgagtagttcattgttcagtggtttcagctaattaatgacagtagtatactcgtaatgcatttgttcatggctattgtgaagaaggaatcatttaacattagatatacttagtaagttagtatgtgctgtttgtgaattattatgatatagtttggctttgtacacattaataaatcttttattttactgtccatccaacagttacacgtatggtatactcgtgttttacagatcaatcaattaaactggatcattcagagactgattaaaatacgtagtagtactacctgactatatcaactgagcatattcagtacaaagttttcaagtctacatgtataaagcatctgaacccgaatacccccgtatgcaaatctggaaacagaaaatcacacaatagtgaagcattttgttcaatttggacgctactatccactaatattgtcttcttttatgcgccatcgtaaaaagataaatcgcatgtaaatagtaatgtaaaatgtttgaatgtacactgtttggaccatgaatttgtcttctttttctccacatgcaaatcaaattttgagttgattttttatggtactatatatgttacagtattctcggaatcttttcatattttattgtgattttttatgcacttttaaaacaggtagcacggtagctcatgagattatctcgtatgtgtgaggcccaaactaagtaaactttaattttctctactttccttgctatagttgttgggaataagttcactttggatccctcacgttgagagcgagtttgaaaaacagttgaaccgtaatactaaatataataagtccctaatattataaaactgaattaaatgaggtccgacattatagcacccagttttgtctgacatgacgctttgactatagtcagcgactcaggcactcagcgttgacgacttagcctaacttggtgtggggctatgctgagtctttacttctctccttccctcttccctctccctcccttgtttgtacatctccctgtgatggagcaagggcggttgcccaaagtagtgtagcggtgaggagagtggtgttgaggtgggggagagcgaaaccgctgatgccgttcacgaggaggcggaacatatgttgtggttgtgaagaaagtgcatgaggatggcgcaagtgagctcactggaggcgacgtcgaagtcgtgggaagctgatgtgggtgcggtggtagatgtagaggtcatgcggagcaatatcccaagggcagcacgactcgctagg

SEQ ID NO: 47309 - DNA, 4177 bp, Oryza sativa
attggcctcctggtggcagcgaacacccttctccttgccagctcctctcctgtcgatcgcgatccttctcctgccttctagccaacttctctcccatcggccatagcccttcccccgccacttgccgcacaccacccttcttctcgccagttcctctcccatcggccgtggtccttctccctgccgcccacagtgcatcacccttcttctcgctggttgatctccccaccgcttgctgtgcgccatcccttctgcctaccaattcctctcccgtcggccgccgcctcatccttctccccatcggccattgccctggagaggataggggagggagagagagagagagagaaatgaggaagaaaatgctgaccactaacatgtagggtccgcgtgggtcttgctgttgactcagccatgttgaccatagtcaactcgtcacgttagttataactaggcacaatactgtcctagaaggctagaacctcggataatccagttttgtatgttgagagacacgacgtgatccaaactcgacgtcaatattgggaccacctatacatttggcgacaaattttctcctaaaaatttgacagatgtaattgtaatacaatcgtagtgtaattacactgtaacttatatgtaattacactgtaacttgcatgtaactacagtgtaacttgtacgtaagtttcatgtaattttgaatcattatatctattacaagatttgttttgctgaggaagaaaaaaaatcacggcacacacatatgtataaggatttgttcccacaacctccattttaccgaaataacatattacagagagatttttgaaagttacatacaagttacactatagttacagtgtaattacatgcaagttacagtgtaattacactacgattgtactgtaattacatctgtcaaatttttgggagaaaatttgtcgacaaatatatagcaaaatcgtcaatattagggaacataagtgaacttattcctggtaggtagctcctaatgggccgtgaagcccctattcaagcccgatctggcttaacggatacacacacacaccccttacgtaaacctgcaacagcaaaggattggaaccggaaaagaaagatgccatttgcgtacatgtatacgcataacgaacacatgccacacacacacacactggcacactccatacccctcccgtaacgatcgaaaagcagttggagatggcgagagtaattgcgcaattgcgcaatgcgtatatatggtcccccggcgccggcatcacccgaacgtgccgtccatccatatataccaccaccgctgccaaaaggtcaacaccccactaaagtaaacaccactgccaccaggacgcgagagtgacacggacacttccacagacacggccgtctcccggtctcgtctctcgcccacgtttctcgtccatcccgacaacgagagccgatcgatcgatcgcgcgcgcgcagcggaaaccggcagtatcgctcgaacgacgtacggctcgcacaccgcgccctgcaccgacgcgccgcgagacgcgagaagccaaacccggtggagtccagcgcgcgggcggcaccggtggcgagcgggcaaatgcgctgcagatgccgcgttcgggcttggggtcccccgtgccgtgtgcctcaccatttttttcggtgatctgagcccgagggaggggtggggtccgtacgtccgggtactagctcgcctattggcctcaaaagctgtaagttggcgagctctgtttactcacctgtggccccctcggctgatggcacatagtgggcacgctacggcgactgcgaaaattcggtgatctctcggtaggctcctcgcaactggcatctggaattaactccaagtactacttattactacctctgtccaatagttgtatttttaggatttgaatttgtttcaaaataattatcacaataacatactaatggtttcattaatcacttctcattcaaatttctttctattttactgtcatttacccttccactcttacatacatatcatttaataagggtatcataatcttttttcttaaatcttaatatatgctaaacaacctgagtaatagtacttatttagtggacaagtatttattcagattaatagttagaaatagcttttttgcgaaacgagaggcaatcaatcattagtttggaaaaaataattaatccctccgttttaggttataagatgtttttgactttggttaaagtcaaactactttaaatttgattaagtttattgaaaaatataataatatatacattaccaaattaggtttattaaattaataattaaatatatttttatagtaaatttatcttgggtcaaaaataatactattttttctataaacttaaatttgtgtctgcattgtgcgttccaagtaactagcttgtcttttgtctcgcaagattcttccatcttttgctcatcgtcggtgggagatcgatcgaccgatcgatcaccagcatttctcgctttaaagccatggatatggatcgatcacagatcaggccatggtgcagtgcagcacagctccatgatcgatcacatgagcccattatatagagctcccacacatatgcctccttttatgcctacgctcatgtcgtcgcatggcattaagcaattagttggggagctttgctcgttttgctttaaccttttttacaatgctagtagtaccatacttgcaaagccaccattaaagcgccacgcccttgccttgcttcaaacgtactccatggatctgcatctttagtgtagtagtgataatagtacaaaaaactcttttcccttgggatgctaaattcatcatgattatgtccttttctttcgtcggatgaatcatgcttaaccttgtgaaatttataggatcgaatcacaagaactaagccaaccagagaggggggtgaatggttggtatacccaaaaaccgaaaacttttagcagaaataaaagttacccttaatttcgatgaagatcggtcttatcggagtagattagccggtctgaccgaagcgtagccaccggtctgaccggtgttgatcttccggttggactgccctggaatccttgccgcgcctgatgtcgccgccggtctgaccgcctcgctcccgccggtctgaccgccgatgagttaccggttagactgccgaaacccggtaaacacaaatcgaagaactcttaaagtagatgacaactttattgattctctctatgtttacaaagtgcaccaacagcactccttacaaaaatttctactaaactcgaaaccctaactcaaaactcaactcaattgctctcaaaagcgataccgggaagcctcacgctccccctctatttatacatgaggtaggcagcctaaagccacgaaccaaactcatattaagagtcctaaacaccttaggaaaccctcgaatacaagaaagaaactttacatagccaatcgtaccaaatttggactccttccaaattcgactccgtatcccatacgcacacaatacctccatcgtatgccatatggaatctccatcaaccacgtgcatcaactctagcctaagtatcccgcatgatctctgaccaccacggacgtcgtcttatccccaagccgactcccggtccatcaccgcaaatactctcccgaggcatcgagtcacctacacatgaaataaacaaaaaaaccatattccgagaccaagctatctccaacttgactgattagtaacaaacaacagtattacacacgtatagcatccatctagaagccataatcatgaaataatcacggatatccaaacaaacaacccaaaaccgaaaccgacacagcgtcggccggtcagaccgcgggctggccggtccgaccgctcgatcaccgccggtctgaccggcacacactgcccggtctgatcggtcacataaaataacgaacctgcgattcacctgtaaatccaatcatctccaaaaccacttcgtgaacaaaaccaataatctctaatacccaattattcatcacagaataataataaaaaacacctttgattttataatctcccccttgatgaacacattggcaaaccaataaaaaatgttttggtgtttggaaaaataaaaacaaaagtgataaaaagc

SEQ ID NO: 47310 - DNA, 1280 bp, Oryza sativa
ctgtttccagggattcggtacccattattttgctcacatcgaatacgtccttgttgtcaagactgtttccaaggattcggtattcatttttttttcatattttttattctctttttcacaatgagcaattaaagatatttgaggagtaacaattcaataaagcatatatagagagcatttataaatcaaaccatatgctagcatcaacattgcatatttgctcaattcaagtagaatttaagtgtcatgcatcatctcccttaaaagcaaaatctaaatctcatgaaaagactagaatacatacaagctatgctagagacaaataaaccttcaaagtattgctagcatgtacaagaaaataccatatgtataaataaagctctcttttctcaattttttcattgtcatattattgcttgataaaaccatgaggtacaaactccccctcaaattatgccaaaaggatgaattattcccaattcaccacgaagaaaagcaaaacgattaaaatccaaaggtttagtgaaaatatcagcaagttgcaactttgtgtccaaaaactgcaattcaacatctcccttctcaacatgatccctcaaaaaacgaaaacgaatatcaatgtgctttgtgcgtgagtgttgaacaggattcttagcaatgttaatagcactagtattatcacaaaagagaggtactttctcaaaagtaagaccataatctttcaaagtagataaaagccaaagaatctgtgaacagcaactacagcagcaacatattcagattcagcagttgattgagcaacactagattgtttcctagaagaccatgcaatcaatgatgtaccaagaaaatgacatgttccactagtacttttcctatcaattctacaaccaccaaaatcagcatcggaatatccacttaagcatatagaagatgaagtagaataccaaattctaaactcaagtgtatgattcaaatacctcattattcgcttgaccgcttgacaatgtgaagcacaagaagaagcttgaaagcgtgcacacaaacacacagcaaattgtatgtctggcctagaagcagttagatacaacaaagatccaatcatacttctatattccttttgatcaacagcttcaccatcttcattaggatccaacacagctgtagaaccaattggtgttaaaattggcttgcaattctccatcttaaaccgtctcaaaagatccttcgtgtacttcgtttgatgcacaaaagtaccttgaggtgtttgcttaatttgc

SEQ ID NO: 47311 - DNA, 1843 bp, Oryza sativa
cgcgttacatttttaaccagtagtatccagctgtatatggaaaggaggaaaggttccaacctccttcctaaatatctactcccttttttacccaaagcaatgggccactgttgtacttctggtccagctttttatcttttatatgcctttactgaccttactatcttttttattttcttcaattatctgatgcagcaaattagtacattagctggcaatttgatcccaagttactttgtatgggaagtaatattcactatggctattattggactggggttgttgcttttcgcattactcatagggtccatgcagaattttctccaagctcttggaaaaaggtgtgcagttgtaccacaagtttatcctatatgaagtgtactgatgagatgccaatgggtttagtatatatacatgtaaatgatgttacacatatgcacagaattgaagagaacacaaatagcaacaacaatcagtttgaataatagaaactgtgcggcactctggtagtgccttttcctaatgaagtctgataactaatgttccaaagggtatatgttttttttttgttttttttgcaggagactagagatgcaattaagaaggcgtgatgttgaacagtggatgagccataggcggctgccagaagatctgagaaggtcttatatcttccaaatcaaataactgagatatgaggaaactgacctttttttttaattttctttcctttcacattattaaagaagtaaacatcatattacctgaaaaggatataaatgttctcctagatctgtttacctagtgaaatgtccggtttcaggccttcagtggggtaaatgaacttcaatccaatttaaaatgtgactaagaatcgaaatggagaaaactgctaccatcatgttgttttagtaacaatttcgaacaagggggaatggatgagtattagagataaatgctggaattatatgcatacatatcttgataatgtaaaatggctaatatttcaagcagaagatataaatggttaataaatctgacttttattcatgagtgaagatagtaccattttttcttcgtgttagtactagtaaaatgttttgttatcaacaagctgtagtaagtagtaacacatcagtaacaaaccccaaatttctatgctgcaaggtgagaatgcctaaagctttgtgggtgtgcaggagggttagatctgccgagaggttcagctgggtagctactagaggagtgaatgaagaagagcttttgagcaatttgccagaagatattcaaaggggcatacgccgccatttctttgggttccttaagaaggtttgttgattgtgtctttgcaactgttttttcctctccatcttcaattagttgacacttgacactgggtaggtgcatattttaattattaatgcaagttttcctgatagcctggacatatccccgttcgcaattgcttcttgtctttcagataattattcatgtagtaacaactttactaggtaccggtatgagttcctgttactggtactggtttttttttttgaatgaatactggtagtggttttactcagtagatccttacacaggaaaggactgaaaacaaacttcctgtagaccaagttaatccaggtggtacaggtgtaaaatttcggttctgtgcggatgtcttcttttgaattttgctttatgaaaggaaacagcaagttttgcgatgtgtatatgcttaatgatttcctctgttttgccttcctttttcttgcgagaactctgtttttcttttaagaataatgatatgcgactctgtttttcttttaagaataatgatacgccacca

SEQ ID NO: 47312 - DNA, 13551 bp, Oryza sativa
agtattaggtatttaggttgaggaaaacccaaattaatctaagcaataaatcaaatcgaagatttagggcctatttggcacagctccacctccacctccacccctcctggagttggagctcagccaaacagtttcagctccaccaaaactgggagtggagttgggtggagttatctcacaaaatgtactagagttgtagagctgggtttaggcagctccacaactccactctagcctcaactcctagagcaatatttaggagttggagctgtaccaaacagacccttactcctacataatttcaagttctattatcgatgtgtgacaggaaatgtgcgaaaagtgtatttatttctcccaagtatatttgtctgttttccagcaaataacctttcaaaatatttatccattgaggagactaagacgtaccacctctgtagaattttatagggtgtattttaattgataaaactcttaaggtcacactttgacagtatattcctgatatctataaaactaacattttgtgaaagtatttgaaatataatatacttgtactactacttccatcacaaaatgagttcatttttcacccactttatcaaatcccatgtaattgtttttcactttatctactttcaatgcatttgtcccctacttttacaaattccaatgcaatgattgcttaaaaatgaacttattttgggacaaacgggagggggcaaaaaatatcttattttgggatagaggaagtataattttatacagtaaatatacttataatttgaataatcattagtcaaagttcacaaagtgacttctttttcaaatcaaaacacgtggagtgtgtagttattttagacttttttattttttgccctaactagttattttagacttttttattttttgccctaactagattctttgaaagacataattaggttatattatggcggtgtcgtcatgtttccttgttaactttttcttaattttttttttacttcatagatataggcacatggtgggatataaacatataaggtgaaacagatgaagtagtttattaatgaaaatgttttgagagctgcttatttgtgcatgatttatgtgatggatgagcattgctctctccatttaaaaatatagggcatataagctttgacacggtcttcaacatagaactttgactattagttcttttgcaaatattaccaacgactatgaaatgaatatcatacaaaggtattttcaaatatgaatttaatgatatcacatacgtaacacacaaatacacagcataaagacactcctcagatgcgcagtctattgtatcacataggaattttgaatttttcaattagtgtagctggagcctggaggatatcatattcccatggccctaacttactctgttcactgatgctttcgtgaacatgaaaaacaggtatgaatcaccttactggaagaaccttgcagcaaatcgcatccaagtcgcatggaggtatcggaaaaggcgactgaagagagctgagatgcaaaggttgcaatagaaatcaagtcggcaattttcggttgtacaatcacgatctacggggtatgcatagtcggacgtcatatagcgccatgtgcacaatcggcgtatgcatagtttgatacttggatgtgcatagcggactttagccattccactatttcttgtgtgggggaagtaggctgttagttttggtcttgtcggttttgtgcaggttcactaatttgtgtttcctcccgtataaaatgagatgtagaagacagccgatgtacataaaaaggaaaagaagttccctaaaaactgtagatgaaaaagaaaagtcaattgactaggaaagaggcttttcagatagttctctgttatgaaattgttactggtggtttaatcctttcctccccgaattttgtaaaacgtattgaagattgcaagtttgcaattggaaaggacgacccaactctaaacaatactttgctatgctatctatctacggtgcaagcgggcaggcccgcaatggttcgtgagtctacccacttgcacccttgtatctatctatctttttaagttggcaattttgccggcttatccttggaccacgtggcacccttaaaatttaagatagatctaggaattactgatggtaagaaaaaagagagacatttacaatgcaccagaaaaagtgaaaaagttaagaagggaggaatgaagaactttctcaaatgtgaactaaaatagtgatatctataaccttctaaaaactgatgaaaagaatcatagatcaggattcagggaaataatcgcagaaatctctacatctagactctccaaaagtaaaggggtagacaaatccgagctctaacaaaaggaaaaaaaaaaggcaagaacattgaggcgatgatcttttcccggcgcttctgcacagagaacgagatcctaatcctcggataaagctccacaaacgttggtgcatagcggacgtggtgcgtctatccccgccacacaccgcagcatagcgaaatggacgtggttgctatcgccctgagcaaagcggctgaagtaccactgacaagtaggtcccataatattttttactgttttatatgactaatatgtgggcctcatatattattttatttttttttagaactgctactgacatgtgggtcccattaagtttgtaatgccacgtaaatgccatgtagatgtaactgttatgtaggacaaatagacgctatgccagtaaaaacagccatcaatgattcaatactattccctattagattagagctatatttgagggacccacattagacattttcgaaaaatcatgtgaacgagggaactaataggctattcccaatcagattcgagctatttgacggactcacattagacatttctcaaagatcatgtggacggggaaactaataggtgatgatctggcccaaacagcccaattctcccctagcctacaacacacagcccatcgctcgccccaccgcagcacggcctactccacccaagaaagaggtagcctagcctgcccgcccatcacctcgcggagaggtagtagtacactagtagtctagtactacacgggccgccacgtttgggtgcggtgtcgtgatacacgctacacggccgcgttggagattccgcgacggcggaatgcccccactaccccgccgtcaccggtggtgtggtgcagttttgtcttttgcgtcactgcgcacccacctcggttttctcgcaccgtctacgtagcgtgcgttcggtgcagccatacacggaatatattttttttggggggagggggggcacaaaattactctggatttgttaaccatctcaccggattttacgaccagaagggagaaggcccccctccaaagatccgtactgttttttttcttttaccccatctgaattgcaccaaccacggcaacaattatttatgcaggcttgggtgggtggtggtggatacccattctcttttctctctcaggtgcaatcgtacgtgcaagtgacaatctttttctgcatggccgatggctcctgccactatttactcggaaaatcacggtgaaaatccaggtcctgctgctcgtgctaccaccgaccgacagttgaaaaggccaccgcaaaaatgcggcaagaattcacatcgccggcggccaaaatgtgcacccccaaataggaaggaattcgttgcgtcgcattaatggtgcgcgatatgattcgggcatggctcgtcggccttggaaggcggagcctccacgacggcggggttcctaaccgtcgccgacggcaggtgctcggtgcggccgagctggctggagccaccgcgtcccccgccgccgcaggtgacgctccgcatccttcccttgccgaggtggtgctcgcagagcgcgtagccgacgagcgtcggctggctgcaccgccaccctcgcccgttcacgcggctgcaccgtgacccctccatcagcaccgccggcgcgccaccacctcgccgcttcttggctccaccgccgccgccgccattgccgacgctcttctcctcctccttcacatccacgatcaccgccggtgcaaccgccgccgccggctccgacttgctgcccacctcgccgccggtgcatggcaatggcacgctgccattaagaacacaaaacgcatcatttgcacacacaaacaaacaaacaaaacatgaccaaaactgatcaaaaatgtgatcaaaatacaagtggcaatctagtgcattgcccctggaacttgttgtgccgaactcgctaggtgccaagcaagattacgcgagggtacaaccaaaccaaacaggctgtggcctgtgatgcgagcctgattgatcagcagagctagagccaaacaaaatccatccacccccaacaagaagtggcctaaatataattgaattattatgggtggatcgatgcgtccatcaatccatcatgcatgggtggtggacatgcctacagcccgttctgtctgacaggaagtgtactactaaatgtctaaaaccaatttataattgcacatttgcatcgtcacccactatgaaacagtagtagtagtagaaccaaagaaactaagaaaaacaacactaataaatgggagtagtaacctgattgaatgtgcatctactatcattctattgtagtgttgttcagtcaactcaaatttcaaacagactttgttctgtctgcattttttgcagttcttcagcactcttacctcctgtgagcatctccagctcctccatgttcttcaccaggtcccttgctgtcgctgcaatccactccattttcctgggatatcaatcgatcgagttgaggccaaaacacacaagttctttcgattcagctagatctaagccatctgatccaagagtgcaagaaccaaacaaaatctgcaagcagcacgcgtacctgctgcaacaatgccaggcgccgccttgccaccccggacgatttcttgccaagatccacattcccatggtggtgcagctggtgcagcctcctcccaacaccatcgccaccaccaccctcccggcttcttgctgccgcattctgggttgcagcggtggatgtggatggatctgagctctgcaacgaaacacactgtggcctcctcctaatcctcatcgatgagtgagaaagaaacaaagaaacaaagaaagagagaaagaaagagaatgagagagatggcaatggaggaggagaaggtcggagatttggggatggtgcaaattaaaggaggagagcttttggttttattatcttttggtgatttggttgatggtgcctttggtttttatggctcatcatgcttttgcctgcacttatttatggaggagagaaaccagtaaatagaatactagcagatggtgcagttttcagcactgccttgctgctgtctgtctggctttggctcggcttgcacatgcctcccgccgggacatcgccgcggccgtccgatcgagggaacggacggctcggatcgaccggatgcgtacgtcccccgtgatgggtggcaccggttttgtatccgcatgcgcaacgccatgtgcgctgggctagctagggagatgcattatattgccgtcgttcgcagaatttgcaatctggcacagtgtacatgttggttggtcaattagcaggatatgtgtccagtgaagatgacacgcaatcaaaatgttaggagatgaaaatgttcatgttcatgctcattatttttgcgtgtaattttttcaagctgttaaacggtatgtttttttaaaaattctatataaaagttactttaaaaaatcaattaatattttttaaaaaatagctaatacttaactaattatacgctaatcctcgctacccgaactcagcctaagacctcattcggaagtgtgcatattatgtgtgaggattttaaaggaatttcgtatgaccgtgttaaaattatggtaagcctacacgtgaaatcacgggttttgaaatgcaaatggttgttgtcgtaggaattattgggggctgttcgattcagctaggctgaggttgaatgatgcagtagactagcagaaattttgcttgctaggtctttgttgccccgtggctgcagcgtcagccgcagctagcgattctgaacacagcaattatatgtcaataggattgtaggattttgattatggttcaactgaataattggctataatctcttgagctaaaggctactaggatttatttccattacccaatgaaatgttagggagatggctacggtcatctttgaaatgtaggaattgtattttttttatggggttttcacataaactagttcagtttcagtagcattaacgtgaaatctaagacaaagctacaccaagttgatcatagaatagttcacctgatcctgccacttagaaacgcaagtggcttatgctaatgactaatatttttatgggttaacacacgatgggtatcttctttttttttttgcggggcacgatgggtatcttcttgttttttgtttgatactaaatggatcgtgcatggaacgaacgaacagtcagatcaagtgggggcagtgagaggggggcggtgattagtcagatttagaagtgggaggctgggaacaaaggctgtgtgttcagcgcaaagtttaaattttagttaaaattggacatgatgtgactgaaaaattgtgtgtgtataacaggttgatgtgatgaaaaatgactgaagtttggatccaaactttagatctaaacacagccaaacagggacgtaaagcaagcaaaatttgggtttgtgtcaggtcatggtcagggacatggtgtgtctatgcatccagcttttggccagcatggggggctcaaagaagccaatctcctgcagactctgggctatcggctgtccattgcacaggtgatggcctgatgtttccacacttgggtagtcatatcccttagctaatgcatgcttaattagcctggccgttttaatcaggttcatttcggtttagattttattcagttaatccctattaaaaaaagattgaggacgatttattttataccgtggaattattctccattaattcctttcaatcaccttgaagccgaataaggccttaggagattttttgttttaaataaaacgcagtatccaacaagttacacgtgagatctttattttaagatgtggcgtctactggaagacatgcattgacaggttaggttgttcctaattgtagcaaaacttgcatgtctttaatcattaaaagaaacagaatttggtatcaaaattcacaccataatggtgtggaaggaccttgatgtatgttttttttttttgaatgaaaagaccttgatgaatgaaaggaccttagacatatgagaaaaatatggtagtattatttttcacctaaccacaagaactgtgagctggtctattttttctgtcgtttcatacaacctctcgaatattaatcactctcccaaaacataactatttctagctgtttaacaggaaaacaaaagtagctatattatggaacacagagagtagatagttataaaataatcttttttttgtgtgtgggggattaaaaaagatacaacagtcatttataataaaaaaaatctcaattccaaatctgatctatgattggagaatatagatcaaatttaagcttacatattcatggaatgatatattatatacttctttcgtttcacaatgtaagtcattctagcatttcccatattcatattgatattaatgaatctatagatatatatgtctagattcattaacattaatataaatgtgggaaatactagaatgacttacattatgaaacggagggagtaatatgttagtttataaaaaaatgtgagtattgtaatggcatgcaaagatgaatgaacattcttaagggaggacgggttcaagttctaaacttgacacaagtactcgcatttactttacagctaattatttttttttagtgataggcgacgtaccagtcgatagcaaagcgcccgtggtgacttcgtcaatctcaaaatatactaatacaacctttcgaaaatgcttataggagtagggtgtgcttgtgtgtgttcgtagcgttgagtatgcgtgagttatgagcacctacatttgtactttgtttctaaaaaaatgattttcctggtttccccacgccacacaggctaggacatcaaatctttttggtccatgcgtcataggcacaactattcattgaccaagttttagaaattgagtgaaatgcaccgttaataccttgacttgcgaggtgggtgcaatttagtcgcacattttgtaaaatgctctaacaagtcacacatcttattttggggtgcaaattacataaaacatgtgtcgtatggagtgttcgcaatgaagatatatgctatgttaatttgttttgcaaacatggtcacacgatccataataatacaacgtgcaatactaccggtactagctaaaatccaattaaagatgaattttgttatggattgccaagtacaatatagtcgtgttcattgaaagcatgggaagtagcatatacatgaaaatataaatgttaatatgtaattttaatgcttatcctgcccacattggtaagaaatgcattatgttatgtcaatatgcactccaatttgaaaacaaacaatccgtgtgaaaatgtatttagtaacatttacaccatcgaagcaagttgagtgacttgtttaagcattttgcaagatgagtgactaaatgcacccacctcgcaagttgtgataccaccggtgcattttactcttagaaattcctttagagatgagtaaattacaaccctaacgaaattggctattcattgataagcattagagtaatgatggatttgtgggtgaatgaccgtacccccacggattttaaatcttggtgctgacaattacttacacgcagtggtggcttcatggggtgttccatgtaggccttagaccaccctacaatttagcatatttttatattcttattatattttgaggaaatgttgctatttctgtatcatattttgagcaacttttgctatatcagtatcatgttttgaacaaattatatatgtgatattgagttcgtgatgttatgatatgtagtaccgtgagcctgcgagtgttcatgtaatgaaaaagaaagtgtcactgttaaagaataaaaaggaaatggaaattaccaacaggactgagaacaaggctttgatgggcactaccaaaaggcactctcgtggactctccggcccaacaatttggtgctccccgtagcttcctgattgaatcgcagctactacttagcaagtcaacctcgatcaacctaccacgttaacagaaactgtttctcaaattactgaaggagtcagtttgtatcgattttcgaagatgggggagggattatactactcattttacgatgattttatggtgagggatgcacgatagacttattcctcctcacaccaaaaggcgctctcgtcatctcgtggactcttcggcccagcaattttgcgctcccgtagcttccgctaaacctgtcgactatactatttgctgttgcacaagctgacaggttggctcaggatatgtctgagttgatgaagcgtcgctgcctctttgggcgcaccgcgcaacagaaccaacagcatagccaccatcctcatctactccaatccgcgatatggcactcaatatatagcgtagagaaatgcagaactacacctgagctatacctgctgctgctgctgcatacacaaatacaacttagcagttccagaatgcaacgaggggaaatgagaaagtcacctgcatatttgctataaaaaaactggttgatgcaaacagggcagtaagactaacaaacagttgtaagaacatcttttacaatcttcaatcctcaaaagctgcaaagctggaccaaatcctttggatcccacatggacagcttaactatagagaaatgtcggcaaactcaagaggtcgctaagggcctaattgtctccagcaccaacagattggttgacagttgacacaccattgcaggcttatgagatactcaaagattcattttcacttggacaaaagtactggcatatgaggtcatcctatgtttcagatttgacaaaaataaaattccatcataagatgtcaatgctagggcatcaccatgtttttacaatccaataagcagtttcacctcatttccacatttaacattcgaaaatcgaaatacatcgaatggatattgtccaactcatgctatttaccacacaaatgaaaaaccatccacaaagtagtcaagtggcagtgtggtacctcgcatgttagggctgttcgttgtcacgcagcatgaggttcatgataaagtcacagatgagattatattgtatatccttaaatacaaaataaatgccaggaactgccaaaaaaggaataatttttatatcatagcatctatactattgtctattactcattagaactacacatgaactttacaatatgaagtcctagaagcctctaacacaagaatttgtgtgcgtattgagagatctcatcaactggcaactttactctctatagggatttcaaaatccctaggtctctatcgaccttacttttggtaatcgtgttgattattatcatggcgaacagttcatatacaactacaagcaccctcatccagaaaaccccatacttgcctttattgttggagcatttgatgctgtttgatcaaaagttgggcataaagcagctcgttccaggaatccggtactccaggaaggcaccagtggctgcagtcctggtatctctctggtgatcttctctcgtcctcagtcaggttccgtttgcgatagattgaaggatgtgcatcctttctatagtcagtcatccttgttatattcaagtaaacaactggagttttcatcttgtggatcacatcctctaaaatgctcatctttggtgggtaggttgacaggtactgttcatttcttattggttctgtctctttgtcacagctaccacctgaattccattgcccaccactgcatatttgagagcacaacaaaattcagtcaagacccgagattcgtcaaattttcgcaaaacaaaaaggcgatatatacctgaaatgggatgctgaatagcctctgaacaacacagtggttttcttgggatttacattcgcatcaatccacctggaccaggtgacaagagctttgtgaaaggcatccacaacattgagctcactatacacgtgattaccttcctgatagtaatccttcctgtgtcacatagaacatatctttaatgttcaacaagaagaatgaaatagagatgattgtccagcccaaatagcagtgaagataccaagataagttaccctagagaagtcttctcatgtgtccaccagtgtccagtattgaaaattagaaaatctgcatccttatactttggtgatgattgctcgactatatcaagcctaagagtttcttttttctttccattgctcactttcatctcccattcttggactaggaaaggggagcgaaaaaactccacactgcagttatagtcctaaatgacaagaatttgcattaaacaacacttccaatttctgaaatggatgcagtgtatagtaaaacagaatcaatccaagctaggaaatacataccgtgaacaggaaagagtatgagccctcagtcttaaactcatgcctaccagatgcctcaaaaaccttcctcttatccttaacggagttccttaagatgcagaccagggattcccacatgttcctattaagtgaatcaccaacgaaaaccagtcttttccccctcagcctctccaacatatcagttggattcaatctaatataacaagaatataattaggcatgttatgcactaagatggaataaaaattcaccaaaattgattgcctgctctagtaacttttcctcacctcgggatgttgcagctactaggttgccaccggagcttctggtaggctcgatctggccggccattgagataacagtcgaagggctcatcaatgtgagggcatgatccctcagggtagagagggtacgactcatcccgaacccaattcccatggaacatatcacagctggccatctccttgatccagtcaacctttttatcaggctgtttttgtgatgcctgttttgttgatgatccattccccttcaccagcacttcgctgtagttgctagtttttgagttgattgcttgggcaggatgatccttagatgaaccaacactaccctgcgaagttgtttcctcctgcttacttgttgtaccactacttccaccagaagcaactccagcactagtctggttctgattcttcgaatttgtcgatgctacagatgtctgattcttgcttggggatccacccgctttctttgcgaccattgcagtactagcagtctgattactagttgaagccacattcccactcgctttatttgtatcagctccgccatctttagcatttcccttcgccggactaacagtcacatctgatgtatggttggaatgtccacttccactcgctggcggagtatctgatctgttactcaaatcggccttcacatctgagacacttccggcagaatcagtactcgtagcaacgactacgtcttttgcatctgtctttaccgcagtgctattcacagcagcagaagaaacactacttgcaacaccatttccacttcctgcactgctattagatccaacattagattcaccctttgctgaacttccagttccagtagaattatcactggatgctttaacagcaacttcggtatcggccttcgccgtgctgttcttcttgtcagaaacggcatcgccattgctgggagcttcacctccacttcctgactgcttattggacttatctacactctcctcgccggtgttcgcggaggatgattttccggcagaactactggctgtggatggggatccacccccatctccggccgggctactctgctccaccgcgctgttcgccggggcgccgccacttgtggaattattcgccggagcgccgccgccgtcgccgccgcttccctttgcaggtggagtgccacttcctgccaaattgccgggcggaggcgcactcccaccaccgccattgttgcttgccgcaccacctccacctccacttcccgaatgcttggtagacgcagctggatcgacagggacgctgtgcgctgcgccgctccgcacccgcgcgtgctcatcgatcccatggctactcacctggccgcctccctcgccgcggcgcggcggcggcggctgctgctccggcgagggggtggaggagccggtggggaagatggacgagaagaaccccgagacctgcgcgcggtacggcgccgtggacgcgtacaccccgccgaaccacgacgcgccctccc

SEQ ID NO: 47313 - DNA, 6113 bp, Oryza sativa
gtgtgggtttagaaatttaagagagggggggaatttaactaatcagccgctaaatttgtttagattttgcatgggggttcagccagtaacttgcagttgcatctgaatctttttattcaacgagtcaaggatgttcaaaggagtatttaacactttgataaggaataaaataggagaccacagcaccaaaaatattttttcttgtttgactacttttttgctgttagttgatgggaattttattgtctggtttgaccttaaacataggcattttctgacttagatatttttgaacaataagataatcatgccaaatgtcaatcatatactccctctgtatcatattataagtcgtttaactttttttcttaatcaagcttcttagaatttgatcatatttgtagcaaaatatagtaacattttcaatacaaaataaactttatatcaaaaatatatttgatgttaaatttaatgacactaatttagtgtcgtaggtattgctatttttttctataaatttggtcaaacctatagaactttgactaagaaaaatgtcaaatgacttataatataaaatggatggagtagcttttttttaatagaagttataattctacctgcctataaactgcaaggttaaaagtatactttcttaagaaggtataattcaacacatataacctacgtgtacacgtctgagttgtgcacgatatgtacacgcgaagtttgcatgcacaaaatacgttctccaaattacatcaccttcctcgattccaaaatataatatattcatagttttagaaaaaatctaacatccaaaactttgaactagcaataattaatcaaacaatagattacaaaagaaaaataataattataatcaagttataatgttattgaccgtgaaaaaggagctaataatacatcattacattggggatggaaggggtaacaaatagggacctatggtttggtccttggaaaaaaaaatgtaatgcaaaccatttgcgtagtggaaacctaaaaactattactggattcacgaatagacatctgaaatttgtcacgttatttactcccagaaaattgttcactcctagttaaatctaactgaaagtaaaacttttactcttaataagataaacaatgtttagatccaacgaaatgaatttcatatttctgctagatattgttcatctacccagtgactttgctcataattatagccagggtttacaaaaccgcacggttatcgtgcggtaaccttttaaaattttgaaaccacggtctggcgataaccgccgaatcatgaggtgacggtaacccccaccctaaacgattcggtaaagtctaggcatagcccagccccggatgctgcggcaaaccagtggcggatccaggatttgagcaaagggtattcaaagctgaaaaaaaaatcatacagaactcaaaaaattggactgggaaaatcatacaggagtggtaatgacatgtttaaagccttaaaggtacaaacagtagcacaatagtcaagatgtctatctccaactgcacacttggggacatatcactatcataggcattgggtgcttcaagtagtagctgaataggactagaaggggcattttctgggatctgaacttcactctcaatggttaatggttttggatcagaggtggaagctactttctgagacttggttgacctttcccacaaagacttcaaatctattgtcttcttcttcttcatttttcaaatttcaagacctacagttcaaatttctgactaatttaacttctaagcaatagcaattaagcaatggccaatcgcttggggaatttgacaagaggatttattttaccagtgccagtccactgtccagctgtctagggaccaaggggacgcgccgacgcgggggtgcgtcgccgcaaccggctgccgccgtgcgccgcagcgccgctgccgtccgtgcgaacctcagctgctcagcgtcgcccgtccccgaggaggcggcggcgtcgtcgcaggccacgccgcctccgcagcagcaggcccagggaccagggtccagggagatgaggctggtggcgattctggcgacgcgccgagccggcggccggcgccgccgagcgtcgagctctcgatgccccgtcgcccgtcggtggggatgagtggaggcgcggcggattggggctgggacgacagaaggcgtggggactggctgaccgggggatagggactagggttttgttcgtttttgggccagtgggcctattcgttgggccaagatggggaggaatgtatggtctgctgcgaataaatgggcttcttttcatttgggctatacatgctgtacttccttctaatttctcatgtatatatgcataacatacctatatatagttatttttttttaaattccatgggtattcaggtgaatacccatgaatcacatgggatccgcccctgcggcaaacattggaaccggcccctgagaaagctggccagccgtcacgctatttttgccgggccggtccgcaccgacggcggacgtgctatccctcgtgttttgtggtgcctgtgccacagccgcatcaaattgcgggaggcgccactgaatcgctgacatgtggagccgcaaccgggggggattgtcacggggccacgggactcgagaccgcgtgccggcgtgccgcgaggcgcgagctgtaggccggccgacgataacctaactgatgaattgaatgtggctgtgtgtcatacgccaaacatatcgttagcacgtacgtcttcctcgcggtttgcagcagactatcaggagatcgaccacatttagcttcatttattttaacgatagtgcgaaattcataacgatatagaaaaaaaataattacaagattataacatgggaggacgtaactagaaaaaaaagagaaagaagttttataggtgcatcgaacatgatgaataacaaaagaagaagcacacatgccgacatgcgtgatgccatgatgtacatacatgatacgtatgcatggacatatataggagtaatcatattgctgacaagttaggttttttttcactatcttattggtatcaaatgtggtaacatcgagatttttcacgaatgattttttttcccgattatactaaagacacctaagctcacatataccacacttgtacacacacagatattttctcttacacatgctttaaagatggagactactgataaatctctaatctcaacaaaacctatagatagtgcaatcgctcatgcgtagaaaagcttaggcatcagattttaaatcatagtggatggaacatggacccacgactatggcaccatgctaccagcactgaattaattttgcaacaaacacaaacgtttgtgttaaaaaattaaagtggctacataaatcgtaccaaacctggttttatgaaaagcttaaaatatttttgtttatcactttcaactctaaagcacctggataaatttaggtgtggatttcgactactcggtgttatgcaacatgtactaccaagggaagaattgtcccaacgaaaaataaaagaaccttgcaaactatggaaacaaattaaaacaattttacaaggtacaaatccaatcaccaacctaagcaggccagaatccgtttgtatttgcactttgcaaactatgtttgctgctaattgtggtcttaggctgcgttcgtttgggtgatagggagtgagaatgcacatcgttttccgcgtgcacgcttcccaaactactaaatggtgtgttttttgcaaaaaaaaattctatatgaaagttgctttaaaaaaaatcatattaatccatttttgaaatttaaaatagttaatactcaattaatcatgagttaatggctcacctcgttttacgtatcttcccaatctcctcaatccccttttcctcaaacacacccttacacgccatgtcatgtgaaatgtacgcaattctcagcgagagagccagagaggtttgggttgttattagtttcacatcaaaattgaaagtttgaagaaatcgaaacgatgtgacagaaaaattaaaagtttgtgtgtgtagaaaagttcgatgtgatggaaaagttagaagtttgttaaaaaaaattggaatctacaccgggccgtgtacaagcgagtctgcgacattgctttgccaagtcctctgccgaagaaggctgaagtcggtgtaggctggactttgggagacctggtccacaagcgtacggagtaatttaatactctatccgtctatttttgatagtcatatttccaaatctgaaaattttatttttgataggcatatttcaatctaacaacctatcctcttaatgattttctcgaatttaatgcgtgactctccattcttccacacatgattggctacatggatattgagaaatgtaaatattaattaatcgcttgtttacgaggaatgattagtagcatgtttaaatagatgataagtagaattacttatccttggtctacgtgtcaagatgaaatatgactatcaaaagttgatggagggagtatttagaaagcgatattagtattaaggttaaattgtgttatatattacactttcccaatttataatctctcgtttttcgcgtacacacttagtaatctgctaaatgacgtgtttcttttaaacacaacataaaaattgctatagaaaatcatattaattattttcaagtttttaatacataattaaccatgtattaatccgttgctccattatacgtaaaatgttataaatctcaaaatgaacacactaccggcacacagcccaagttttctcggagacaaatttggctactcttcttctgttcataaatatttatcggttttgattaaacatatataaaatataattattattttaagcgaccattagctctgaaagtaggatatatatatatacttagtaaaaaaaatcgattttagacctaatgctataagttcgatgctgcataatttgattttttaaaaagaaaaatattggcaaaatattgcttgatgacctaaaattaaaattacaagtatctgtgaacatagataatattaaataattaaatagttacaccgaaataacacatattataaaggtagcttcctccattcgtgtttactcggtcacttttggaccattatccacccacaaatacttgtccccaatatatattttacccagtttaccctatcaattttctccttactgttttatccgtcacatatttggtgggtttgggatgttctggttagttttgaagggtatagcatggccattcatatatccaagcaaattattgcctaaatatgcatgctataggttaaaagcgacgagtaaatgtgaatggagagagtaattctgagacaaatccatacataaaaaaaagggaattagctagattgctgtctagaagcgcagagatgaaaagaacgtgcacggaataaagatagtattgcaaaggagaaaattgacgcaattaggtacgaactcactcagatttaaagtgggcgcacggttgaatccactgtataattgctatatacagaaactccactctttcaattcggtggagcaattcggcagatttctactactcgcatgcatgcttgccactacagtacgtaccaaaattaacacccttgctaatgtacggcctgataattaacatgacccatggatgtaaccaagagccaagactaaagttgtactcctactgttactcctactattcagtactccctccattttaaattaatctacatatagttttttaattattcctaaatgatctatatatttatatttatttattaagtatattcgttatttgtgtattggagtaaataaacattgatgcatgcatccatgcacacaagtatttataactcacatgcaatatcttgatttgctattggctagaaaatagtggggatagagcatgtatcgagtttgttgctagagtaaatatggtatgagagagttattagcttttttttttgtctttgtgtacctatgaaatatgtatatcaatttagaatgaaggaagtagtaattatga

SEQ ID NO: 47314 - DNA, 730 bp, Oryza sativa
agatcaaacgtttctcaaaaaattaacagcggcatacattaaaatacggagggagtatttaataacctactgtctagaacattctttgctaatcacatgcaccgcaactgcaccatccaaagctcagctcatgattcagctagcgcttaattaattataataggagtaattagattgtcttcttagacagatcccatgcaggcactcttatcacaaaaaccgctggtccgatccgttactgtttgtgtggcccggtacagtgttttggtgagtggttccttttcaaagattggatctttttcaggtgtctcaatcttaattatgtcttgaaataaagacccgatcttaattgtgtcttgactcttttttttttcttttgaggaattgtcttgactcttgagataactaattaaaggaacatgtcccttcacgttttgcaattactcaactaataatacagtttcagggagaaatcgctgatgaatcacatttcgtagttagttagtatttctgaaaattttgtaaaatcaaagatgtttttcccagtactgaggcttcgacttctgcttgtgtgtaggctttggtggcaaggaaggagaacgtgtgcatcgtggattccggttgttcgcggcacatgaccggtgataaaaattggttctcctcactcaagaaggcatctaagactgaatcgattatctttggtgatgcttctacaagtgccgttctcgct

SEQ ID NO: 47315 - DNA, 25913 bp, Oryza sativa
  unsure (1)..(25913): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgtgttgtaaaattttcagccaggaactccaccagctcggccatatgaagcacccacacctggatcagggtgggcaaatacgccaggagttagctataatgacgctccaactcccagggagagcaactacggtagtgaaacatattctgtttttatttaccatatactgatacatatcatgctataatgcatcaacgtttctgttctaatactgtttttctactgtctcttaggaaatgctccaagcccatatgtgccttccactcctgtaggtcaaccaatgacaccgaattctgcctcgtaccttcctggtacacctggtggtcaaccgatgactccaggcaatgttggaatggacataatgtcgcctataataggtgtggtgtcatttctactgttgcatccataaagctcctatgtattgtgctgctatctgcgtaacacagaagcaggcacgagtacatctaattacatgtcaaaatgtctgcaggtggtgaaggtgaaggtaactggctgttgccagatgttttggttaatgtgttgagggcaggcgatgatggtcctggtgtggtgagggaagttcttgcggtatgtatttgggctcttcacaatttctctgcaattcttgctgtctcctgagctgatgattgatgccactgggcaatctaaacttgcaggatggatcttgtcgcgtcgcccttgggtcatcaggtaatggtgagatcgtgacggttcttccaaccgagctcgaggttattcggccaaagaagagcgacaagatcaagataatgaacggcaatttccgtggatactctggaaagctcataggtatagatggttccgacggcattgtgaagcttgatgacacatacgaagtcaagatcttagatatggtgattttggccaaactggcgagttgagatggatgtatattttgtacgagtccatcgtatagccaaatgtttgtaacagataccctttgtagtcaataaaacgttttgttatttattccattatttagttgtatccagattttgacatcgaaagaaaacttgccttaagaaaaccgtctgtctgctatcccagttatctcgttactcttctcatcatcacagcaaaaatgccaaaaaagtataaccaactactcactccattgacttttttaaatatgtttgatcattcgtcttatttgaaatatttaagtaattaattcttttctatcatttgattcattgttaaatatacttatatgtatacatataatattacatattttacaaaagattttttaataagacgaacggttaaacatgtgctaaaaaatcaagtactccataatctaagaaatagcgaaggatataactacaaatgaatctgaaatgaatctgtctttttcttgatatcattacagatgaatctgaatttgtcatggcgtaatttagttgtatctcatgatctttacacaagcataaagcttcctatcgactatgccaccaactgtaaactatcaccgaactgaatcgattgatccatagtacatgccaagaactaatcgagcattattttcatcatcacgtaatcaagtgagaaaaaaaaagtaaaaattaagccgagatgtcgcggcctgtactgtgctcttgtcctcctcctcgttgtcttcttcctccgatcaggtgacgtcctgcttgcactgctggaaaacctgcagaatgttgcggtacgggctcctcgacgacgacgacgacgacgacgagggctgctgctgctgctgcggcgaggcggtggcggcgcgctggcgcttgctgctcgacggccgggactccgggctccgcgccgcctccaccgcctccgcgtcccgcagcgcttgctccgccgcgtccttccgcagcgcctccatgaacgactccttcaccaacccgtcgatctgatcaaaagcaccaccaccccccgcttgagacgagatccaatcgcacaagaaaacgcaggtgaagaatccagcgatggatggggactcaccgtgagcgggcagaactccggcatgggccacgcgacggggccggcgtcgtcgggcggctccggcagcgcctccacctcctccccgccgacatcaccctcctcctccgccgccgccgccgccgcctcaaccttgtcctgcacgcgccaacaccaccacacacacacagatcaggaacaccgaaaaactccagatggaaagagcggagatgatctggggggggcttccccgatctatctcaagtagtagtaccatgaatctcgcggcgatctccaccatctttcccccccttttgatctcctcgtctcctcctgctttcctttttggctcgaaaacgctcgatcgacgcggtttggaacttttcggccgctttcgtgcgcgacggatttgaaatcgggtgagggcgtgaaaagcggaggttccgttcgttttttatggatctcggcgaagataattcgggaaaaaggcaacggctactttttggttgtacgagtactggttccggtaggtctttggttaacctgcctgcgagcttttcgaggtagatccgatttgggggtacagacgaatttgaggcaggctccgtagccatctgaatttgaggcctcctgagaataagaaaaagttgaggaattcagcttctgttttattaaaaaaatattttctgaattatatatacaactatatattcgtataatccgaatgaaaatctgaactattttgaaggagtttgtcatagctagagattataataaaagctgcagctatcagaaactcctttaaacatacctgagttacggttggtacaattttgaagaccctcttggcattggaacaaggctaaaacaacttatattaaaatagatttatttcctttacatattttaaaatatgttttctaaaataatattctaacgcattgctaaaacatttgttttgaaactacttccccattttaaaatatagggagcaaataattttttatatgttttgtaatacaagacgtgcaagcacgtattcaattaactagcatatctcctttccttttttttaaaaaaatacgtcaccctcaagatttatatggattctatttattagggtgatcgaaacaagaagttaataattttttttgtgtttgtgcgtcttatattttggaatggagggagtatttgctaagtttatttcttaaaaaataatttattcctataattaaatcaataatccgctcaaaaatataaatcaaatagagccttatattttggatcatagaatagataatggttggtttgagaaaaaaaatcagttttggaagtatggtgatgttatttttcttgttattcattgcagatatctcaaaatgtaaggtaaagaagttgaggacatatccggtgaaaatgagctaagtatgagaaactcgtgaaaatcatacctaaaagtttcataaattcatgaaaaaaatagtagataggtgtagatatgaaatacattctcaccaaatctcaacttcaaattcaacttaatttaagaggaaaaaaaacaaatttatgatgaatagtgtcatgttactatttacctaaaatttgtcttttttgttactcctaaatgaagttgagtttgaacttgagatttggtgagaatgcatttcatatctacacatatctctagtattttttttcatgaatttataaaacttttatgtatgattttcacgagtttccaacacttagctcgttttcatcggatatgtccaaaaaagttacctgtatgtatactatgaggaattggacgagccaagtctgtgcttggaagctttaccggctgaggtaaccctgctacttgattgagctctagttccaccttcacctttgtgtactaaattgacgctgccccatgaagaccacctcaccatcaccatccctagtatcatcacattgtcgagctccaccttcacctccctcagtatcattatatcaacgagctccaccttcgcactctcctccgcaagctcccctggtcgttagaagtggaggttcgggaagatcgaggaggggtcgctggtttgaggagcgttgctcctagttcaagctacatgggagagggagctgctcatggaaggggctcgagctcggcggtggatgtgtggtagaaatggactcattgatagccccacgagagagttaagctaaactagtttgatgcttcttaggaaaaatttatgcagttgtgcagtagccagtagagatggattagtgttaattaaagaagtgttttcaaaagtagggattgactattatcaaagaagtgcgcaatagagatggaattgtgttaaagaagtgttttcaaaagtagagatagactaatgtcaaagaaatgttttcaaagagttttgaccaaaaatatatttaacttaatagttaaaaaagatgaactagtattaaagaaatgttttcaaaagtagagatggactattatcaaagaagtgcgcaatagagatggaattgtgttaaagaagtgttttcaaaagtagagatagactaatgtcaaataaatgttttcaaagagttttgaccgaaaaatatatttaacttaatagttaaaaaaatgaactagtattaaagaaatattttcaaaagtagagatagactagtgtcgaagtcaaaatgttttgaccaaaaaatatttataactttgtagttttttatttttttaaaggaataagttcactttgactcccttaaatagtgactgaatctaatttgtatccctaaactacaccagatatctcgacccccaactcttaaaaccgaagcaacttgactccctcagtggttttggaggacggttttgttgacgtggcgcctacgtggcggtattgacttggtctgtattccacgtggcgcttaggtgtcattacaattaaaaaatagtgtaggacccatttgtcattcacataaaataaaattatggggcccaccgtggggccttctctctcccttatctctctttctctcccctccctcaagttccttctcggtcctcaccgctcccttctccctcttccatctctttcccgtggcgggcggcgagggccagagcggcggcgggcaagcggagacgcaggcgtggtggtgatgatcgcgtgcgcgccggcgggcgggacgtggtggacgacctcccgccgcgggggaaggcaaggtgctcgtcaaggtgtccgccgccggcgtcaaccgcgccgacacggtgcagcaccagggccggtaccccgctccgcccagcgcgttcccttactcgctcggccccatcctcgcgctcggccccaacgtcccctcccgctgagccgtcggcgactaggtgacttggtgattgccgttgctgccgtttggattaggttaattgattgggagatttgttgttccttttcaggtttgtgcgctgctcagcggtggcaagtatgcagagaaggtggtggtgctagcggggcagctgctcttggtgccggagggggtgtctctgacggacgccgccggcttgcttgaggtggcctgcaccatttggtcgactgcttggcgaattgttctcgtaagataacttctctttttcttctatactcaaggactttatgattcattcctgagcacggtgtatcctcgatgtttgcagatccattgtggatcgagtggaattggtacattttactatacagattgcaaagcaacttggaattaaggtttttgttactgcaggtttgttcagtaggacaaaaacagtacgagtatataataggatgttgcagagattgctcaagtaatgatgttaaactatgtgttaaacaccacagccacgcccgagtctttgcttgcccgtcgccgctccgacccacgccgcccgccgcgggagagagggaggaaggagaagggagcggcgaggagggagaaggaacaggagggaggggagagaaagagagatgatggggagggagaaagccccatggtgggtcccacaatttttgtttaatgtgaatgacaaatgggtcccacacattttctaattctaatgtcatctaagtgtcacgtcaacgccacatggaacgaagaccaggtcaataccaccacgtaggtgccatgtcagcgaaaccgcccttcaaaaccaccgagggagttaaattgctccggttttaatagttgaggggtcgagatatccggtattgtggtttagggatatgaatcagattcagtcactagttaagggagtgaaaataaacttattcctttttttaaaaaaagagttggcttagtcgtcagtcgaggagaatccatgctccacccaccggtggaaccccacaaacttcgggctacgagttgggcttttaccccaaacccacccagccggtaggctgggccgtgagggccaaatctaacttccgtgttctcttcaaactttagcagcagaaatgctaatttcttcctccccttctcttctcttttatttagctgagagtagaggggaagctacttggggtcgtgagtacccccgttttggcatggactcctgactcctctgcccggctaagcaacagccgtataccaaccctttaccctcccaaagctggagttacaggcgcacgcaactgagcccggcgagctgctaggcacggaagcacgtatttgtgctgctgcgcgccaagttcgattagcggtacggtactaatggccttagcacgtaagtttttttttttttggttccgtttctcagttgcctcgcacctatggcagtcaacttgtggccttagcacgcaagtttttctttttcttgttgctgacttgcatgcacaggtcgcggtacaaacattgctttttttttctctttcgcattggttcatctctcgtacttttctgaaaattcgttcatgttcggtaatttcactttcgatcaaaacaaccctccccgcactcccctcctccacccccccccaaaaaaaaaaagaaagaaagaaaagaaaaaaaaatctgttcattatagcgacaaggactcaactagttgtagcctcccctatatgcaaatagtaaaacataagaagggtatatgtgcagtaattaatcaaaacaagaataacttaatgccgaagtgaaactaacttaattggtcaggttccttgtggcggaatcaactaacccgggtttaagtcctggacgatatgtgggctcgcatttacgactaattgtttttttcgtgataggcgaggcgaccagggttcaagtcctggacgacatgtatgctcatatttacggataattattttttcagtggtaggcgagacgcccatagtgacttcgtcaatcttttttcagtggtaggcgaggagcccaggattcaagtcctagacgacatgtgtgctcacatttacggataattgtttttttcaatagtaggcgagacgcccacagtgacttcgtcaatctcaaatctttcggagatgtttataggggtagggtgtgtgtgctacatatactttaatcaaactaaaataaaactacatatacaaaactacagatactttaatcaaactatcgcaaaactacatatatattatgttgtatcacaaaattatagatttaacgtcaaatttatgtgtgcgccttcataaggatgagtgtattcctgcgtttgtaccgtgtataaattttacaaaactacagatactttaatcaaactatcgtaaaattacatatatcaaactacagatactttagtaaaactatcgcaaaactacatatgtagtgttttgtatcacaaaactatagttttggcgtcaaatttatcacaaaaattatagttttgagatagagtatcacaaaactaaagatatggttgttatgtgggttccacggactaaagctatatttcattgccacgtaagctcatttttttttgggagggggttgtaaatctgtcggtttgaagagtcgaggggggagaaatgtttggtactgtagtctaggagatgaatcaaactcacacgatagttcatggaggtaatttaaatttttccttaccttatttacatggtgtgcttttgaattaaaagtgaggttatgggtgaaagggcctgtagcctagtggttacaagagcctcagagcaagttcaatagtatagcccaatactagctccaattcatctatagccaattcatataatagttgcttactatgctattagtatatggtcccacctgtcatacacacactgtgtcttggagtccgtgctcgctgctcttctctctcatcttttatcttattaaaatatgtttatagctagctaatagcctactattgtacctgctctcagtagtaccttaggtcctgggttctactccccatgggagcgatggattgccggcctagtcttcgaagatgctcataggggtaggctagattgcgactaatttgtgagacaaattttttaaggctaattgctccatgatttgactatgtggtgctacagtaaacatttgctaatgacggattaatcaggcttaataaatttgtctcgtggtttaatggaggattttgtaattagtttttttagtacccaaacacctcatacaacactctatacaacacccgatgtgacactctaaaactttacccatcttatatctaaacacccccatagttggcaggggagcgcgttctgcgggggcacgatcctggtgattgggatggcatcatggcagtcgccgttgaggaatcgtgtccgcgtcaactaggccaacgtgcccatgaaggataaagggaagaagataaaagaaaatgctgctcagtcgttgttcgcaacgccaaacacttgtgttttatctgcgattgctgtccaaactcgcgtgtgtgttgcaggttccgctgctgggtttcactaacagacgtgtgttaaggagtactcctatacatccatagtgtgtgtgatgtgatgtacatgagtagtgctatgcacgtgcgtttccacgagaaatattcatggtttttgtaattagattaacttataatgaacgtaaaaaggcaaaaagtagttgtgcacgtgtgttttcacgtattcgaaaaatattctttggttttacaagtaaattgcattggtggtacacaaacttgttagatgggtgcaatttagtatataaacttgtaaaatattcgtttcagtacacgaacttgtctagtttgtgcgaacgaggaccaaaataacttgacaatgttaattttatgaagcgatgttgattaggatgtggcgtgcattgagtatgcatagaacatccaatatttgtaaatttggtctctattttatttttcaccatggaaatgatgaatttcatatatttctaacatttatactattgctcgttttttaaatctttttctactatcactatattctattctatttttattaaagaggtgtatgtctaatagcaaccttctcatatatatgccctaaatcaacaatattagcaatatagtgtcattttcgccttcctccgcacgcaccagataagtttatacaccaaaacaagcattttacaagtttgtgcactagattgtacccacctgacaagttcgtgtaccggcgatgcaatgtattcattagattaacttattattattaacgcaaaaaaaacttacttagtgtgggtatgtggttggcagcaaggcaacgacgaactatttaccggttgccgtagctgactcggctcggaattggcttgctgtgttaccacgagggacattcggttcctgggctaagcttcgcgaccacttcatcatcaactttcaaggtaccttttagtatttcaccaattaacttattattaacgcaaaaggcaaaaaaaattacaattagattaacaaaaaaaacttgttttaagagttgtacttggtggttttaagaggcaaagcgggaaacacaaacaccacaacacgaccttggcaacaaacatcatatgaaacgggctcggcttgggttgccccatatgccttattaaccccacaccgtagatttcttcaggtcgagaaatattgtttgtttttacaagtaaattgtattggtggtacacaaacttgttagatgggtgcaatttagtatataaacttgtaaaatattcgtttcagtacatgaacttgtctagtttgtgcgaacgaggaccaaaataacttgacaatgttaattttatgaagtgatgttgattaggatatggcgtgcatacgtttagtgagtatgcatagaacatccaatatttataaatttggtctctactttattcttcaccatggaaatgatgaatttcatatatttctaacatttatactattgctcgttttttaaatctttttctactatcactatattatattctatttttattgaagaggtgtatgtctaatagcaaccttctcatatatatgccctaaatcaataagattagcaatgtagtgtcattttcgccttccttcgcacgcaccagacaagtttatacaccaaaacaagcattttacaagttcgtgcactagattgtacccacctgacaagttcgtgtaccggcgatgcaatgtactcattagattaacttattattattaacgcaaaaaaaaacttgttttttttacttagtgtgggtatgtggttggcagcaaggcaacgacgaactatttaccggttgccgtagctgactcggctcggaattggcttgctgggttaccacgagggacattcggttcctgggccaagctttgcgaccacttcatcatcaacttgcaaggtacctttattatttcaccaattaacttattattaacgcaaaaggcaaaaaaaaacaattagattaacacgaaaaaacttgttttaagagttgtacttggtggttttaagaggcaaagcgggaaacacaaacaccacaacacgaccttggcaacaaacatcgtatgaaacgggctcggcttgggttgccccatatgccttattaaccccacgccgtagatttcttcaggtcaattgtggccgagactgcgtgtgtgtgttgtgggcccttttgaccggcccaaacaccagcaacgtaccaactcctagccctccacaggccagagttaaaggcccacgccaccgacccagtccacttatactgactagatgcttacgtacaaaacaaaaatatgggccccacatatcatcctcaccattgtctaaaaaaacatgtcatcctcactctcctctactcttctctctccatctcccccctcattccactagaacctagagctcgacgcgttggcatagaagatggagcagcaattaatggtgggagaggaggaggttgcggctgtgcacggaggtgggagggaggcaactggcggcatagtggtgttgtgcagtgatggcggtgtagtctcggtagagctgccggatccttcctatctcctgatcgagcttgtgtaggtagatattgcctagtagggccgatagtagtacaatgtttgggacggagttagggcccttctcacctcctacgagtcgtccggcggaaaactgtttctgagtggggtaaaagaactgtttcggacgaagtcggccttggagacgaactgcatccatgactccttggcagcgcactcgcgactagactcctcgaacgacggcgacaacctcttctccatctcactataggaggcgaggaagcggccctatctctaaatccatcggaggaacggaaatggcgtcgtgcgggaggcaggagcagcggtcggcgacacaaggccatagatgcgcgccgctaacgtggtagatggaagcgtcacaggatgattatgacgtcctcgccctaggcggtgacgacgtggagatgacagtgccgcccaaaagtggatctgaatgtggaggagtctcggcacggtcgatgttggcctggtagagaccgtggtggacccgtcccctcctctagtgatggcgatgctacggtgaggccaccggtctgcgcatccactcgccacccagattgagaccgtcacccctgccctgccctgcgctctgtgctgcttcttgctcggaacatgaccgcatggttgccggcacctgacagagtgagatggggataagaaagaagattgctatttcacttatatgtgggtctcacgtgtttgtttttaatttttgcatcttgtgccacgtcactccaaaccaccttcaatattgtattaggactatatttgcacgggttttaaaatatgagggatgtgttgtatccgattttacggtttagggatttgattcaaactctacatccagatgaggggaccaacagtaaacttattcctttgcaaaatgtgcaggccacttgcggtctatctcttctctgaagggccgtaaggcccaaggcccagttcttcgttgcggaatacgcatagctgaataagctgataggagattgaagagaaagatgaagatgaaatgcagattaagtatttcacgcaaaacgaggtgataataacgtgtgattaattaagttttaattattataaatttaaaaaatagattaatatgatattttagaataattttatatagaaagttttcgcatgaaacacactctttagcagtttaaaaagcgtatcacgaaaaccagaacttcatccaatcttttagtaggaaacgaacggttactcagctctcgctccaggatgcatggcgcggttgatgggatacagtcatccagaactctctcttgagatcccgacgcggagtagacagtagagtcgctggcgctgcgcgcacagctagctagcctagcgaagaggaggggaggaggatctcgacgcgtagagcgtacgtacggccgctggggcccgcttacttgaatcctagtcgggccccacagcgatctgacgagcggtgggccccacggctacctagctactccagctagctgcatgctcggctggctgctgtccccgccgcagccgcctccaggtggcacgcattgccacgtggagagctcgagatcgtcgtcaaactcccgctcctgattcatcaggtttttttgcaccaattttttttttactctgctcgttgccattgaatcctgtgatgaatcatccaacgcctttagcttggtcaggagcggatgcaacgtgagtgcagggggacttgagtcccccctacattcacataatccatggataccttaggagcaccttcttcgattttttcactatgaataataaattaaagctctgtaaatggctgcagattaaataaactgcgtaactgagtcccctaaatttttttttgttcttggatccgcctctgagcttgagcttggtgagtgcaatgctgggctaactgccaaatgcttcgtttgtaattctgggcaaacagcatgacactcggcgaggcagatttaactcggggccgcacatatacatctttcagcaagcacgtacatacatatacacatgcttttctatcttggcagtgtggacaagggccatttttgcggtgtccgtgcccattttgccgaagcggagaaggatcagggggatgggcgcgcgcgctgctgccgatcgatcgaatcgccgctggaaacggcaagaatattgatcccctttgcctcctgctgcagcgcggacggagaagccctctcgcttaaatccgctttcccgaaacgcccaacccggtggtgccagcgtttgcctccgcccgaatggcggctagctaactgtaaccggcactaatcgggagatcgagggatctgtacggtgatccatccatcgatccatcgaaaggctggagatctagctcaactgttgatgggtcagtgtctctgatggagtaggattgctgtaggctttgtagtagggatggtgtagcgaggtcgatcgatcgagcaaggaggttacgttgttccgtactgttatcaactgcatctctgcgctgcatgcatgtagtgatggttgaattagaccattcacagcgctcctacatgatgagtggtagagtgactttagcttgctggttgccacataggagccatgctgctgcgaagagcgggggtgtgggtgagtggcctcggtaataaggtgttcgtgctttgcagcagacatggtttcttcagtaagtagacatctaagttgggcgaacacgtcacgctgccacacggtgtgtggtacttttctgccgctagatttagagggttgagctagagcggttactggagaacaacgtccgataaaataaatggagttggtggatggagatagcggacgacggtggccaaatatggagagtggaggagcggtggttgggagggacataccagctgggggacctcgtcaccgttgaccaggaagatgatgacgacgagtccgagcccgtctacccaccacctacgagctcgtggccagcatggtgagctcataacaagctccgacgaggctttggcatgattgattgtccgtggcagaaaattgacctagtgtcagcttgggttacttcggcatcgagacgagaaggactgtgtcatgcgctcgacgatgcaatgatgtttggcaatggctgactagattaaaaagtttaggggtgacaagagaaggactcgggagaagaaacacgacaaagaatagtggagagggggtggtagagaatggtagaggggaagacgtgaggagagattttatattagtttatgtattttggtatgtatagtataaaattttggacttccatatgaattaataaaatatcaggactgaaatagaaaaatatcaagacggacatgaaaagtggaagttattacttgaagccgcttgcactatggtaaaataactttttagaggtgtggtcttagtcctgtatggcatcttaaggacactcatataagttgcttctattgtgaatgcatttagctactcgattgttgcttgttatgttggggtgcagaagctcatcttgttttaaccattttttttcttatggatatttattgttgatgccttttctagccaacacggacttacctaatgatttttggtgttaatggagtcacgaatcaccttgatttagaaaactctaaaccaagatgggttttgaagattaaaccgactagcagagccgatttaaatatcaaaactagcctctaaaccgacttagatcgatatggatataactatcatctcgtgggtgaatcagaagatttatgggacaaacctacaaaggatattgcactcgagcagcgaaggaggacaatttacgacacaaatcgataaagatagacaaaacatgggtaaagtagaaaccatgcctaaaaagtaaagacaaaagaatgattcgatagattgtagggattatggtcagggtgttaaaaattgaactagccatagctcttataaacaagtttgtcttgtctccacaggatcttttctatgtcctactaagtttagagatcaataagaacttaaaaaaaaaacccagggtcaatgaaaaaaacccaagaaccgacaaattgggcttgaagtcggtatgactgactccatgcggcggtcaaacctacctcatacggtaaaccgggtcttttccaaatttgaccgtgttttcctgtttttccatcttaggtgccaaatttagatgttaccatttacatatatcacactttattcactctcatttcgtactttttcgtatcttgcatacataaatatgtatcttcatatacatcaagcatgttgttcattggcatacatcgtttttttcagctctgcaacaccaactgttagctgatcttcttttacagatttcctcacggcattaatcgagcatatgcaacattaacaactaggatatcaaatatcacatgataacaatccggcccaggtggggttggccgaggcccaataacttaagattgcccggaccccaacagttcataggcacacccactcggggaaaggcccaatctccctaaaagactagtccgataggggaagggtggctctcccttttaaagtggcttcctcctcccaagctaagcaaggtgggattattcagaggctcacacggtcgccgcccgacttttgcatctttgctagtgggtaatagtggaggatgtcctcatcatcacatcttccctctaccaaaatcgacatttcacaactttaacgagataacttcatgattacaaatttacaatagcacaagggagatattagaggactactgacaagctgcaaaagcacaagatcacaaagtatatgtttcatttttggagtaccaaaagtgcttggtgaactaccaaattataacctattattccctctggtcatgaaaaaatgccatctctcgtactttgaacactagtatcttataagatatttaaattagatgcataaaagttgtatgtaattaagatttatgcgagatacttttataatattatagttttatctagttatttagatattatgaaataaaaattagtggtcaaacttatattttgaagaccatgccaatgtccaaaatgatatgtttccataaccaaaagaaaattatgttataacttaaaagaaagaaaaagtgaagcacaacactttaataaatggaaatattaaaaggaaaggcacatcagcacatcacaacacacacatatatattaagtacatatgaaacgattcatcacaacgccacttttagaaaaaaaaattcaaccgcggtgattttatttattttaaaggtgaataatttaatgtttcaaattcattgatagctagttgttaacatttaacggctcaaaattaagatcattttatatggatctatattctaccaaaaggttgattctacaatcactgtgtataatgttgattgtctcctaactaatattgctaacgactagcatactatcatataattaattacatgtctatgctatagaaattatccatcttgaaggtatggaagtagattctattaataaattgtgctccatctacttgtcctaatatctgaatgttggtcttagtcattcttagtaaatcacatcaaatgaccaacacaatattgttagactaaataaagttaaaattgaatcaagtggtaataagtagagttaattcatcaacattatatattatcaagtatagaagatattcttttgccactagttcgctaataccgcatattcaggaattatacaccattcaaaattgcaaacaagcacaaccaatatatttcctctagaacatgatatgtcgaagacattcttaacaatcgtttcattaaaaattaataactacaaattaaatgactatagttttccatgataatgtcatccatgcataagaacatttatgaaaagcaaaaccaaatcgtgtaagacatttttaatatcccatatgtagacaaacatatacatatttttcaattgatttttaacatgtacataaattaacttgaaactagtcatcaagcataaatgcataatatgccaccatatctagaccgatcttccatttaaggcacaaataatatatacaatgacagttactcatgcaagtttgctaactttagaataaaaataagatgaagtagtggctaagctttccattatgtcagactttgctaagtttagaacaaaaataagatgatgaagtacctgatgttctagatgattgaacttctaagtttagaataaaaataagatggcatagtggctaatgtccaagatcaatgaacttttctaagtttagaaggaaaaataatatgatgtattgtctaacgctccaccctggcacgactccaatatcattccagatagtccgggctcacctccactatcattccagatagtcttcctctccgggtgttaacacccatacttggttccatatcaatacataagtagcaacaaattaatgcatattaaatgtattccaaagattacaaaattggctagtatatgccaatatctcaaacaaatcataatggaaataatatctttagagtcatttatgaacatagaggaaaaatgatctaaaagtaatagcactttttaacctaaatgggtttgcttggttgcatccaaacccaatagtagtagggagggagatgaatgacctgcaagtctgctacatggtgaaaaataatccaagaatttaaattaaaacaaaatattccaaaaactgtactcaatatattctatttaatataggtcaatagatatttttctaaaacaatttagtatctatgtaaacacataattataaaaccataaatatataaattttagcgtacaaacaaaaagtttagaataatattacctaggagtacgcttatattatttcagaaccaacttacaaaactaaaataaaacaaagctcgttagtttatatggtcattggttatgcttttgctaaattcatttgatggttatttctttaagatcgtcggttccacttttacccgcgaataaactgatcaaatcgaacaaattgatcaagtaacgctctagctaaaacgcccagagaatgcgcatgccgagcaaccgagggttatctcctctcttgatcctctactatatatttcttattaagacgctatcatgtatccacaccctagttcgaccaaccaaatcccatcgctgccaagtacgccgtctacctttgccatgtggggagaggtaccacggagtgactgctatgcgaggtgctgatcaaggcgtgcatgagttctattgttccatgaggtggcaagatatatagtgctacatgaggtccgcgactcactatcttccatgttcgatattgttggtattccttgtgagttcatacttgtcaatacattcatacttttctctatgttggtcacttgcctaattgctcggttccttgctcgatttgtttacttaatccggtgcactgcttgattcggtggattattttcccggcacacattcaaagtaagtaaacaataatagcaaaataccaaatcaaactatttcagttttcctagccgtaatttttgtggccatatttggaaaaccaaatttttaagcaaagaaactgaccaaaacaatcaaattcccaacttgaattatcattactagttctaaggaataattgaaaatgactaggagaaaaatacataatgttttagtttgcataacaaatttgtccgaaagctaccatagctacatttctaattatcggtagaattgtgttaaattttctctgtttaatataatatgttacaaggtctgtacttgcagagaaaactgaaaaacattttgattgcaacactgcaatcatttgaaatgatgtttgaaaataaatcccaagtggattatccatatttaattatcacaacgtataatcgttccacacattttcaaaggctacacatttctagcatagtaacataatttccctattttaatatttagagataactcatggcccaatacattatgatgttgcattagtctagaaaaaatataaaatatggattagtcaaacttttctgaaacattatgaagctgacataactgatatcctttgtttatttggtctttgggttttacttttgtattcaatgttgagttgtccatcagattcctacccatcataaaccattctaaccaaacaaacggtaacaattattccatacttgagtaaaaaaaacaattattccatacaatattaaagggtagacaaacaataacaattattccatacaattttaaaggctagaatttctaataaaccaacaattgtattttgccaacataattttgtctaactttagccatatttatggtacaagagccgtcaaaacatatccaccaaacttatagatgcaagacacaagatgtgtagatcgtagagaaaacataagaagattagtaacgccacaaggcccacaactttaagcatgctttcatccaactgcatatttacatgacttgcatcgtcctccaagcttgtagaaacatataaataaataggttgaatgaagggatataaagattacatatatttaaaacatcatgacttttaacatcctttctcttatacatatttacagtgctagaatcatccataaaacttatagatgcacgtaactagttatttataaacataaatgcatgaagaatcctctattggatttataaatgggtggaactagatatgctcatgttgaacaaaaacaaagaaaaagagtagtaaagtaccagcataacaacgctcactccatcttttttatataattttgagaaaccctcatggttcaattattgcatattttaagttatagtttttaaaaaccctcatggatctatacgtatgtactttacgtaacaattttgaaaaacccacataaatatattaatacatcttttatgtttcaattttataaaactcccgtggccatacgttttttacgttgtagttttgagaaatcctctttgctctatttgtacgctttttacgttatagctttgaaaaaccctcttatctctatttgtacatcttttatgttacaaattttaaaaacccctatgaatatattaatacatcttgtatgttgcagttttataaaaccttattgcatcttttacattatagttttgaaaaacccttgtagttctatctatgtgccttttgaattgcgattttgaaaaaaaaatgtaggcctatgagtatgtgtttggtatcacgatttgggaaaaccttcataaatttattttttgaaaggaaccttcatgaatttattattatatcttttgtgttatggttttgagaaactctcatggctttatgtcttttgtgttacaatttttgacaaacccctaatacctttattaattcgtatttgttacaatttttgtaaaaaaaaaactaatggctatattagtttgtcttttacttttaggttatagttgtgacagaaaccctcatggctgtattaatacgtcatgtcaattgacgtacgtaacattaatcaaactagctacaagtccaatcatcgcaatcgctccttcagcattataaactatccatcaccaaaatacttcacacgtaaaccgcctctaattgtcatcaacttaggcaaaaaaaaaaaaacaccaccaccaccactgcatcagctactagcacacaaccaaatcatcacattgtctcttctttcttatatccaccacatttttcttttcctttatttatgtgcatcacatttttcctttctccatactcaccacattttctctctctctctcttggccccatcgtttgtcttttcttttaataagccaaaacggcttattagagaataaaaataaatttataggtaaaacttttatatatgtattctcggtgacttaaaaaccaatgctgaaaaagaaactacgttgaaaatatctcaaaattaatatcaaaattaagtttgaaaatttaaaatttagctttttctttagctgaatagaccatccgatgggagcctctatctctatctctctctaaacccaatgtacggcattttcttttgacacacatgcacacacattgtacaggcaacccctcctcccagaaatagaagtacaggagcatggagaggagagggaggggtttccggcccctttgcatttgtgccttggcgggcgcaggggcggaggaggcgcggacagagagagaggggggaaaaaacccgacccgtttggccttaaatggctccagctgttcccatccaaacccaccagagatgcactgtagagagagaaagagagagtggtcgacggggcgccgtgtttaaaaacctcggcccttatttcgcaccggttactactctactgctgctgcttctgctactgcactactactacactcatactctcttctctctcctgttcttgattttctctctcctcctctacgcgaggagaggagctagctagcgcacaccagcggcagcagcaggagaaagattggcacgaacagtccagaaaactagtagtagcagaagaggatacagggagagagatcagataagcgagcgtttctgatgatggagaggagatagagggataagcgcgagcaagattggaatcagcgtggtggtggtaggggaggggatggatgatatggcgtgacggaagggggggtttggattggatgagttgaggtgcctgcaaattccttcctgttttggatcgctgtgagttgggaattcctgtataaatacggccccgagaggggacgcagagatcaagaacagtgcaaagatcaatcgatccatccatctctccccctcctcctgctgctgctgttgttgcgagagagagagagagagagagagagagagagagagagaggaagaggcagaggtagtagcagcggcggcggccatggatttcggcgacgaacccgagggctccgacagccagcgccgccgcaagcgctaccaccgccacacgcctcgccagattcagcagctcgaggcgtacgcgttttctctatttttttttctgctgttgttcttctatgtgttgttggctttcgtccgccatggcggcggcgccatggatggagggatgaaatggtgcgtgtgtttgtttcccgtgttgtgcaggatgttcaaggagtgcccccacccggacgagaaccagcgggcgcagcttagccgggagctcgggttggagccgaggcagatcaagttctggttccagaatcgccggacccagatgaaggtaaattacaaggagaattccgattggttttcttgattgatcgatcgatcgccatggattccggcgtgcgtgcttgcttccttccgttcgtttcttgcggggaggatgatgatatccatggtgtggggtttgctgtttgcaggcgcagcacgagcgggcggacaactgcttcctccgcgccgagaacgacaagatccggtgcgagaacatcgccatccgcgaggccctcaagaacgtcatctgccccacctgcggcggccctcccgtcggcgaggactacttcgacgagcagaagcttcgcatggagaacgcccgcctcaaggaagaggtaatgccccgcctccgccgccgccgccgccgccgtcgacgacgcggtttgctttgctttgttgatgtttctgatgatgtgttttgttgcggtgttcgtccggcgaacgtgcgagcagctggaccgcgtgtcgaacctgacgtcgaagtatctcggccggccgttcacgcagctgccgccggcgacgccgccgatgacggtgtcgtcgctggacctgtccgtgggcgggatgggcgggccgtcgctggacctggacctcctcagcggtggctcgtcggggatcccgttccagctgccggcgcccgtgtccgacatggagcggcccatgatggccgagatggccacgcgcgccatggacgagctgatccgcctcgcgcaggccggcgaccacatctggtccaagagccccggcggcggcgtgtccggcggcgacgcccgcgagaccctcaacgtcgacacctacgacagcatcttctccaagcccggcggctcgtaccgcgcccccagcatcaacgtcgaggggtcccgcgagtccggcctcgtgctcatgagcgccgtcgccctcgccgacgtgttcatggacacggtaatcaagctgttcgacgccacaaccattctccattttgctcatttgattgattggttcatcgccatcgcagaacaagtggatggagttcttcccaagcatcgtgtccaaagctcacaccattgatgtgctcgtgaatggcatgggagggagaagcgagtccttgattctggtaaacccacattgccattgccattgccattgcatcaatcgagcaaattcttttgtgagttttttccattttgatcttgtgatgtttgtgttgtgggtgtagatgtacgaggagctgcacatcatgacgccggccgtcccgacccgggaggtgaacttcgtccgctactgccggcagatcgagcaggggctatgggccatcgccgacgtctccgtcgacctgcagcgcgacgcccacttcggcgcgccgccgccgcgctcccgccggctcccttcggggtgcctcatcgctgacatggccaatggctactccaaggtatacgcgatggacaatgtgccgcacgcaatggtgttttggtttcggctcgctgacgacgtcgcgcacgctcgcgtacgcgcaggtgacctgggtcgaacacatggaggtggaggagaagagcccgatcaacgtgctgtaccgtgacctcgtgctgagcggcgccgcgttcggggcgcaccgctggctcgccgcgctccagcgcgcgtgcgagcgctacgcctccctcgtcgcgctcggcgtcccgcaccacatcgccggtggtatgcacccgtcgagcgctcgacatcacagtcgtcgttgcgtttttctctcgccatgacactgacattgtccgggctcgccatggttgggcacgcagtgacgccggaggggaagaggagcatgatgaagctgtcgcagcggatggtgaacagcttctgctcgagcctgggggcgtcgcagatgcaccagtggacgacgctgtcgggctccaacgaggtgagcgtccgcgtcaccatgcaccggagcacggaccccggccagcccaacggcgtcgtcctcagcgccgccacctccatctggctccccgtcccctgcgaccacgtcttcgccttcgtccgcgacgagaacacccgctcccaggtcagccatccactctctccgccattgatatcgctcactcactcactgtgcccgccattgctgctgctgcagtgggacgtcctgtcgcacggcaatcaagtccaggaagtgtcgcgcatccccaacggctcaaacccggggaactgcatctcgctgctaagagtaattagccctaattaaccctctccatgatcgcatctccaaaccttaaacctcgaaatgccatgctgcggcgagtttaatgcgattacgtcgttaatggcgtcgtctcgatctgcagggcttgaatgcgagccagaacagcatgctgatactgcaggagagctgcacggacgcgtcggggtcgctggtggtgtactcgccgatcgacatcccggcggcgaacgtcgtgatgagcggtgaggacccgtcgagcatcccgctgctgccgtcggggttcaccatcctccccgatggccgcccgggctcggcggcgggggcgtcgaccagcagcgcggggccgctcgccgccgcgcgcggcgggggcggcgggggcgctggcggcgggtccgtcgtcaccgtcgcgttccagatcctcgtcagcagcctgccgtcgtcgaagctcaacgccgagtctgtcgccaccgtcaacgggctgatcaccaccaccgtcgagcagatcaaggccgcgctcaactgctccgcccatggccaccacccctgatcgccgccgccgccgccaccgagctcgccattgcattgcacccgcttcgccatcatcggaggagagagagttggttggcgcgttgaatgctcgcattcatggactccacctgctgctgctgctgctgctgcatctgaagctgatgcaactctctctctatctatctctctctttcgcccatccattatccagctagccatgatccatccatcaaaccatgcatcgttaaaaaaaaataactcttgtttaggttttcgt

SEQ ID NO: 47316 - DNA, 15967 bp, Oryza sativa
agaacgcaccatgcttgtcacttttcctcttgttgtaaccaccaaatcacacaccaccaccatcacaaaccacaaattttcttttcctctttctttttcacccattggatttgttccgttttgatcatatcatcatccatgcatcatcatccatccatccatatgcatccttgtcacctcgcgcgttgtcgctggtgttgtagcagcagaggatgaatggttcgggtattgacttctgtccattaatgtaaagccttcaatgaacattcatttcggttataaatggaaagagaaaaaaacaaacagagagtgctggtaaagctggatgatgcgttcatgccccctgcttccctttttctggcccctgtttattactctactcctcctcctccctcctcttattacccatctaaccatacatttttcttcttaaaattatcacattatcactgcaaaccattttaaattttctctttttttctgaacggtgatatgtgtgattggatcattggagaaatgtgtgatatgaacggtggagatgagagggtatgtagggttttttttttcttgggcaggttcagtataagtgcggcattgaagcacggtagctgcggctgctggcgaaatgtttccagcgttttgatgaggggagccagggcgaggggcaggggcggctggctggctggctgggttggctgtggctggacgatcgatagaccgatcgatcgcctccggccccggcccgggaccaaataagtctcgacctactctagatcgcggcttaactaagtacaccagctcgagcttagcttgcacacgcgcacgcacacacacactacactacactctactctcactcactggccagccagctactgcctccgtcccggtttagttgtcgctttgactttttctttacaacgtttgattattcgttttatttgaaaaatgagtaaaaatataaaaaagaataagttatacttaaagtactattgataacaaagcaaatcacaaacaaaataaataataatttcataaatttttgaataagacgaatgatcaagagttacaaataaaaactcaaagcgatgagtattttgggacggggatagtacctagctagcttgtagctagtgtatctctgcaacatctccctgtctctgtctcttgctatagctaatgctaataataactgcaccacatcaagatcaaatcagaattgatcagaagaaggatgaagtgttttgttggagtggtagagacgatgtctggtcaaagattattggaggaaggagaggggggaagagatactagcttcatgtgtatatatggatagatatagtttggctaaatttgtgggttggagatatgggtttttgggagcgtttccggggaggtatcttttttgggggtttttgggttggtttttgcttggagaatatgtgtacgacagtattgaatgaggccttaaatttgccatactgttgcggcagcgtagagctcgtagttgtcattatccctgcccatcttttcagtgctttctggcccaaatttttgtccgtgttcttaaatgccccgcgaattgcacaacttgtatataggagtatgtatgtgtatgtagctagaacgttagtatatatacggaatgccataaaattaaaaggtgttctagctatctattagctgaaatttaaagtgtaccagtagtgtgtgctcgctcggctgctgctgctctatttccggtctaaatgcaatcctctcatcatttatttgccggtgttactatcaaaattaatcatgttttgttctcttgcccctgtcttttttatttatatatcttgaccattccttccttcctccttggaacgacgacgccataataattaactaattgattactagcttgtcatcatcgatgatcataaaagaaaatctaaggtagttacagcttcgttttttctaattaagatacaagtattaccgtggttttttgttagcacgtttccaaattactaaacgatgtatttcgtacgaaatatttctatatataatttgttttataatatcagataaatatatttttttaattttaaaataattaaaacttaattaatcatgtgctgatggttttctcattttacatgtctgcacttaatatttatctttagtgaactcaaactgggcttatagttgcattatgtcattgtgcgcgttgaacaagagagatcatcgagagagtagttaatggcgatgcgaaggcaagcatcggtcattcgaagctctccaactagaacactattcggcgacggcacggataacctaagcataaatgccgacgagcgaggcgctggcacgcgtggttgcatatacaaggacatgttggcctcgcgagaaatcgtcacgaaacggtggtggcgccaccggcacccgggcccacgggtcagcgaccgatcgatcgatcgcgacggtccggtgaggagtcggcccgtacactagaagctactccctccgtaaaaaaaaaagacaaaccgtatctaacattttaccatccgttttatttaaaaaaatatgaagaaaattaaaaaacaagtcataaagtattaatcatgttttatcatctaacaacaatgaagatactaattataaaaaaaattcatataagacgaacagtcaaatattggacacggaaacctaggatttatcgtttttttaaggacggtgggagtacaccgtgaccgccacctggggcccactcccagagaggaaatatatgcattggcctctcttcttttcttgcaaattgcaatgcccacacacacagctggttggtggcggcaggtacttgattacgcgaaaggaacgtacttggcccttaataagcacctagctagctggtcagcttacatctaagcatgtgaaattaaattagtccaactagtcaaatgtctcgtgcaatttgtgccgtttgaaatagtatattgtattttctatgcaaactatatgtatatgtctattaacatctctcattgtttgttcattagtttatcagccttcgctaaaatttgaattttaaaactttatttttagagttaattttgagttttttcaacatgttttttttacattgacttttaaaaccgctaataacacatatgtatattgtatacaacatcactaactcaccgtcattatctgaatctataaggctataataactattaaattgtgcaattcttactttctttttctccgattaacttagaacctcaaatgtagctttttttagcacccacttttttttagaattacacagtataacgcagacactcacaacgcacgcgcactcaccctacgcacgcaaaccctaccctatgagcatcttcgaagactgggccggcaaatcctggagagattgacgaagtcaccacaggtgcctcgctgtcgacgggtacgtcgcctactactgaaagcacaacgccgttaattcctggaaaattcgctcctatggggagtcgaacccaggacctcaggtgctactgagactcttgtaaccactaggctacaggccctttcgcgcatgcatgacattaattaaacatatatactgtcagttacaaatgttgattttttctaaaaaaaattgtggacgccttaatagtttaggacaccggggcatttcaaaagaaaatataaattgcacagtatgttttggtgctattggtttgggaatttcactgaatgttagatgatattgttctatacgtacattaactttcagaaaagttcattccctgttaatttgcacttggttggggcattatattctccgtttcctaaaaaagtattatttatttatggatccttgtattactaaagtgaaaacaggtaatacatgattccatattggccgggtaagagttcgtccattagtggttacaaatttacacaaaaaagataaaaatcattctctccatttgcataaagccattatttacgatcatatatagatctaacagttttaaattactcctttgatataaatacttatatgttttgacttaatcatatacaaatttgaccactgttttttagtataaaaatgattagctccaagtgtagaatattagtgcaccattattgactacaataatctaactataccacatttatattacaatataattacatagttttaaagttattgttgggtcaaacctttattggccaaagtcaaactaaaaaaaccaacaagttataattcctccgggtcatgaatactctacatgcagtgtccatgtgagtatttgtaaacaaagatagtatatacttcctcagtttcacaatgtaagactttctagcattgtccatattcatataggtgttaatgaatataggcatatatgtgcgtctagattcattaacttctatataaatataggcaatgctagaaagacttacaatatgaaacggagaaagtagttgacacgaagaaaaaaaaataccgacgacatattttcctgaagatataggtcaatggcattgccccattcatgcatgcaggactccaaagcagtaggaagggggattattaaagagttcactaccttctgagggggcttgaaatgttgggccatctagatgcatgcagtggaatggcatattaaacagtaaaggttgctcctgatcaagccggctagctaccagcttatttggacccatccaatcttggactaatgatactagttggcgatggatggatgcatggacgcacacatataatgtgtgtacatataaatgtacgaatatggtccctggtgatgaacaatttcgctggaaatgggcgagctgtgatccggtggcacgcccttaactcctcccagctcaatctgcgcaggctaatgagttgcccttgctcagccctgccccctagcctgcacgaatcgcagcgcgccaagtgtcacgtgtccctatttcttgctgtttttgcagattagcatatactgtgattcatttcttaacaattattttaaaatagaaaaatgcatttgcatttaccatatattgttgtatcagttctgttatttaaccggtcggttttattacaatctagatccacatatatgatcaattctctcacacggtcaatatgtatataggctaacgagttttactcttatcgtcccctatctctagcctgcacgaatcgctacgcacaatttctcaatataattcttgcctagggatgatatttgccaatgctacacagaatattgacgaattttacgtacgttgcacctcacacatgcaagtgacattcccaagatgtccttgcaagaaattaattatcttctcaacttctcatagttgtacactttgaaaatcttaatttcatcaatcctttttttttgtcataggttaatcagcatatattgccagggtccttgtactcttcctcttcctatttctggtcaacgtatagtactcaagttagtcaagttgaaaatggcatatatgtgtgtagatactatggtcccaacccatttgcaccaacagcatgaagagaagactctcctcctggtgttcttgggtggtatattttgttttagagtgtgtgttcagttcacaccaaaaataaaagtttgtttgaaattggaacgatgtaacggaaaagttagaaatttatgtgtgtaggaaagttttgatgtgataaaaggttagaagtttgaagaaatattttggaactaaacacggccgtagtagcattttcccaacgaaaagacagggaagcgaaagtacatgctgctacttttatcaacaatccaaacgaaagccatcggcgatcgacgtcattgtcatttgcaaaaaaaacgcacacatgccatgctgtctcagcaatagcatgcaaccaccatctacacacaatttaaatagcaatgcaacaatatcttccataaacgtttagccgtaaggttctgagtccagtttcacttataaactggatcaactctattttttattaaacgaaagcaggaaatccatgctctttttggatgttattttctaagaaaaaaattcttccaaagctaagaactgaataaaaaaacagagatagagagagagaggtgtggaattgcatgaccagctgctactaattggtaggagtagtatgtttggttggttcataataatggcatgcaaaataataaagccagcaaatttaattaattagacaggggaaaaagacagtacgagatgagtggacacatggcattggcaagctagccggccggaccggacagggtgcacgaggacagtggccatttagagagggagagagatgggagaagagaagaggaggaagggctatgctagtagtaatagcttttgcaatatttcgagctcatctatcgatcccagtaggttgttgtgcgatgatgagctagaaataactccctcgcaaataaatgtgcatttgatcctagtaaatggagggcatttatgccatccatatgagggcttcaatgttgttaatttaagtcatccaccagattccctgcagggtttcagtgatgaattgcaatgcgaagaaagagagaaggaaggaagaagagatctttttctttttgatcttttgctattcttgaatggctggctaaatgtgtgaatgaatattgcacggccttgcaaatcattgttgagccaatgtgagttgatagtttcagaaatgtttgaatcgtagcagtagtggtggtagtaatagtagatctcatcagcctttttgtgtactggccatacgtttttgtgcaaatcagtgaagtaatcactggatgacttttgcattatggccacttgactgatcaggccagcctgcaggtaatagctagctagggtacggagcttagcctttcccactcatggagagacatgccgtagaccataaggaaattaatcgatcgagaatccatcaaacatacaataaagaagaaagggtatttcttttaaggaactctcataatgatacaatgataatgccttttaccattaatacattcatgatatatatagttttattgttcttggcgatcgacgacgatgttgaattgtggtggtagtagtatatatatttattataattgttgatgagtagtagcattgtgttgttgtctgaagctttcatatgtcctgcactgacaataacttcattgattctagttgctgtcttgagccctagttgggtgctgaatgcaagataatcaagagctggccgactagtgaccaactctgaagacaatgacctcgcttttaagccataagctcaacatcaatgaactatagatgcatttttaaggtgctatattgatggcgaaaaattgaccctcctcgatcttggtcctgtcttatatattgcgcaatcatttgattttactcggagtaatcagttcttccttcttgtccatttcacatttgaattgaaggtgagatcaccagagtttttagtgtcggcatgtgaactaactagctagtcaatgcattaacaagccattgatactctgaaaaattcggttgtcgaaatgaaacctgcagctaattaaaccagcgagtggtcggtagtcattatagagtatagaccacaattaagctcactcttatttgcctgctaagtaactacacggtcagtgtaaccttcaagtgtgatcagcacatttctccatgattgtgatcatattatctttgatgattcacctccataggaaaagtatacatataatttctagtagagagtctcaaaaaaaaacatgatcatttttgctggccagttcacaaaccggcccagattagcaaatttatataggctttgggcccagatattagtaaagttcacatggcatctacaccacctgatctagacaggcccatatacggcccatataccaatattttgccttggtgttctgattttccgaatatgtttgtacgaccggtctgaggtctcagggatatattcactaccgtcgcatgtcgatgttgctgaatcttgcttattgggatgcaaaaatgggtagatcttctaggtgctttagctgctgcaaagtgatgaaattatttttccaccttggtgcaaagttaaactgttcatttgaaacgacaaattaacacttcagtcttcagctaggtgcacagtgcaatttgtgttgtagaaatattttactgtatactgtatatttgataagagcctctataatattatatattcgatatattgcaacgatggaattgaatggccatcaagacaaacgaaagaatagatatatattattcatataccgaccggttacattacatggggctactttcttggaagggaaaacaacaccaagttacatcattacaaggacagcttgtctatccagttactatatactgtctccgttgatttctataggacatatattttaatttctatctagaaagtccaaggtcagattttgaccactttcttttcataagttttattatcactaaaattacaaagaaaaaacaatattgtgtgaaaccattttaaaatcctattggtataacttctactatacactatatttacttgtacatttttaattgaatttacttttagttttaaaaatcacttgtaaaaaactacagagtttattttgtaaaaaatcaaaatatgtcctattaaaatcaacggagggatatatatatatatatatatatatatatatatatataaggaacgaacaaatttaactaattaataacaaatgaaagaacaataattaacgttgacccgcacaggtccacccgatatgatgatcactgatcaatcccaagtcccaaccaccggttgcttgactccaccgtagaccttaactttggtctctacgctagtgtaaaagggatcctctgatttaactgctgcgcagttgagtcactgacatgtaggccatagtaaagtgggacccatatgccagtgactcaactgcatgtgcagttaaattagaggatctgcttccgttctatctacttgatcatttctgggctgggttaatttacttgatgacctgcagtttaatcagcacggagaaagagaattaaaagttcaggttaaaaaatagttaacctttcttgttcaagctagcgagctggaccaagaaaactacaggaaaacacaacccggaaaactcactcacttaaattaagcagcagtaatattgcatgtacatgcagctggtcggagtagtggtgggcgcgcgttagcccgcggcgttcggctgatctggtggtgcgggctcgacgacgccgccgccgccgccgtggcgccgcgggcggcggcggtggcgacggtgatggcggcggcgacggaggagccacgagaggaggacggcgaacacggccctgagtaccatccccctcctcggcacgtaccgcggcgcgacgacccggcgtgccggcggctgcggcggagccatggcaagcagtggcggcgcagcgcgcggtgcagctggacgtcgacggcgagtgtaggtgagatcgagtggatcgatcggtgtgggtgacccggccaccgcccagtagctagctagctagaacgcagtggctcatgggatcgaggaggagaggtgatcgctgagtgctttgcaatctatttataggcggcgccgccggcccgaccggccggacgaacggtttggctatttttccatcgaacatcgatcggccggtccggtgttagatagctatagctaaagctagcccggctagttcatgagcaattgagcatggacacgtacgctaggtgcttgggttatacttacatatatattccctctctgttaataggtttatttttggctcctacttttgttgtaaaataagtttatttttaaataatcattgcattggagttcttttaaaatagggaataattgtattgggagtagataaagtgagtaattaattgtattattgataaattaggagtattctagtttattttttattttgtattgatatgtataggataagtgaagagtaaactttgtacaactattcttataaacctatagctgtaacatatacaacaacttatgtaaacctagctatagcaaattagctagctgatgcgtcgtacgtcatgcatgcatgcgcgcattcacgatcgatgcctagctagtctgatacatatgcgccatgaaaacctgagatagagccgggaggagataagcactgaggatatagctagtttggtattatgcagggccaaaccgcgtatgatatcgtgctcatcatctcgttcgtcgtccttaatttcgttggtgtttctatccgtcgcgtacgtcgaaactcgaaacgcggtaaggattgaaaatctctggacacattgttaattcttttaacttttttcttctcgcggagatctggactgactattttaatttgcagtgtgtttagaggagattatcttatctgagtgtaaatcaatttattaatttatatgaattcatgcatatgcgtcccgatcgcgacatgcaggtgtatccatcagctcgcaggatatggcgtgtaggacctgtgtttatggtccacttactcattccgacgctgacagtgagatcgagtgacactgctgcgtgccacgcttttttctttctttctttctttctttttttttttgagtttacgcgtagacgcgtagtgatgaatcagtttgattcggcagccaaaaacattacatcaccaccacggagatacgcttatcataagtcgtcttttaattttctgagacatagggaaaatagatggattatttgccttcctctaacgtaacgacttgacttgccacacttgttcagtcatggaagaaaactatactatagctagtactaaacaagtagggaaaccagagaataagaggacatgacgactcatggttttgcaagacgtaccatgtgtgtatgtgtgtgtgtgtgtgtgtatatatatatatatatatatttatttatttatttatttatttcctggttttcctgattacgagcttgtgatgactgacgacgaatgaccaaattcgcgccaaaatttcaccggaatttcccaaaatgacgagtatgacgtacgaacaccctcatatagtatgagctcgtttaccaactgatgatgagcaatctcagttttctgccaggttctgggaatgttcctgcattggaattatagcctgagcgcagcccctcacttttatctctgcagcgtgaccgtttctgcgttgacgaaaatacggtgacggccgggttccctgtcaccgactcactcacggctcacccgccgcccaaaactccaatagtcaagagtcaagatggaacttcgtggtagttctctcttattagcagcaacacgtgtttcacgcttcacatgcacatcaagataaatttataattttctttgcgttgggctatgtacaccttctaaggtgtagaagccgggtcaatataatccattatctaaaaaatagaatgaattttatatatggtatggtttttggaggcaattcttgtcatatatgtattgagtttgataccctgaacagaccgccgatgttaaactagcagaggagcggactaaaatcacacagaagaacttttcttgtttttgtttttatttagttaaaaagtatgttctttaaaaaatatagtcgtatgtaaatggttcgaagagacggctcagtaaggatgggatgatcgatcatcaaatcaagggtgacttcttggttggtgaaacaaaaagaagggggacaaaacacaccaatgattctctcagccgatcttcatttctaacttctggagaaacctgttgagatatattgatgacaacccccaccttttcatcctctcccttaccgggagagtgcacttctcttcttcttgtggccttcacctcctgcatggcccggaaacgctccccacccaagcgatttagatttgtcacaggttacgcgaccaagctctccattattctccccaatgtttatctttgttccactttgttttattttagtgttttactatattcaaccagatgttgcacttacacattatgcacattactttatcaaaggcgtgcaccgcaccctccactgtctcgaagttgcttgctggcaacaattatttttgttgatgttgtatttggttttctttgatgtatcatgtattggctttttaatattgcaatcattattttataacttcgcgtctagttgaaatatttttcaccaagtaataaaacatctaaaacaattctgacaagtggtgaaacaccgtttgacgctttgactaggatgggacctccaaccgctactcgtgtccacggtgtaaaaatgtttttagaccttcagaatgtacgcgataaatttgttgtgtaaaaatgttacggtcaaagtcacatccttaagaccgaaaaaagtctaaaattcacagtatactgatgatcagacagagtaccacaaattataaggtgcgtaccacatagtagtataagtttgtaagggtctgtttagttggtgaaataaaaatttttgggtatcacatcggtcgtttgaccggatatcggaaggggttttcgaacatgtcacgccccgaactataccgaccggaactagcccgggacgctccaaattaatctgttaatcgataccagtcccaggaaacagtgctggtatcacagggagacagaatatcacagcaacagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaaaaacccctcatcagcaggatccacttcatcttcttcagcaactgggggggattatttatatagagcaagggtgagtacaggagtactcagcaagccataggaaataagtgtttaatgcaggcttcaaggaaaggctgttgtttttgcaattgattttatttgaactcttttctaaaaacaactaagtgagtgcttctcaaacgacccggatgagacagtgcgcctcgtccggtcggagtatgtgcaatgcatcagtctttagaattgaaacaaggttggcacccggccaacagcttttcaaacggccacccgggccaacaactttcaaacggccacccgggcctagctgatcccatcagctgcagatttttcaaacatcgaacccctttcaacaacagtaatttcacaagcagtagtcaaacaaaactacgctaggaatcacctcacatccgcccttgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgctgacgagaggggtcccagaccaacaacaggttaggtcccagaccatactgtgccaggaagcccaggggtcctccccgacaccaccccggcgaatccacatgtctctcggcatcaagactcccctgataagctagttactcagccagggggtgtcccattccacccatgtggtcgtacttgtcttatgtttggatgaaattccaaggaatcggtccttaagtgcgagtgcgggaaaccgtacacccggtacgttccccggtccgcggttttggaaattcatttagttcgcaagcaccgacccaggtgtcgggttttccaagtcttttgtaaacccaagttttacccaagttgttattcaaattttaagtttgaaggcgtccgtcgatactcgcacagggtgcacgaatatcgagacgcaactagatcgatacaaggggacatgatataacaattaacaaaggaaggattaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgagacgggacaactccacaaacggcgaaaataaagccctattaatgacctctaagcgtgccattagatagatctcgagatttgaggaattttggaagttgaacggagtcaaacggatttacggttgggaagatattgaatttctaagattattagattttcggtctaaaggaaaaggatttaattaaatcctttttggaaaagaaaagaaaagaaatgaaaagagggagggaatatagacttttctcaggcggcttgggcgcggcccaagagaaatagagcggtccggccgactaaatgggccggccggcccaagacgcgcgctcgcacgggagggaggagagagagagccggtggaccgggctcaccgcgcgtggtcccgggtgggacccgcttgccgattactcggttcaccgtgcggagcgagcacgcggcgcgcgcgcgcgggcggggctaggacgcggtgcacgcgcgcggttcgcggtggacgcgggtgcggcgggcccacgcgcagcctcgcggctcgcggtggaacgcgcgcacgggaggggctgaccgggatcggcccgacccgatctcggccgagctggcgccgacgtggctgccacgcgggctggcgggaggaagacgaaggcgccggccgcgaatggacggcgggcggcggcggtttctccggggcgccttgcgacgatgaggggcgacggggcgtacaccgggatgacgaggaagaaagagagggagcgagccaacggcttggattcgccggagggagtccgtcggcggcggatttcggcggcggcaaccggcggagagcaaagggggaaacggcgacgaggtcacgaggggccaattcccggcggtgagagcatctacgcggctacgagaatccgttgctagcgtcggattgggcggagctacgccgagcgaggccggcgacgagcgggtgctacggagcacgggcggcgacggcggcgagcacacggcgagcgatggcaacggtcggggcagcgccggctagctacggggaggctactcgtgctactgccgaaaactaagggggagagatggagcgaggaggaagaacggagggaggcactaccgagatgaggaggggcgctgtgacgagaggccgatggcgcgggagtaatctctccggcctcgggccggggaagaggaggaagacgagcgcccggagtccccttccgcgtccacgaacgcaccggctctcccggcgcttggcgatgaacggcggaggcgagacagagctcggaaggcggcggcaacaatggcgatgggaggagaagagagggagggcgcctgggctttaagggcggcaatgtcggtttggaaccgacttgggtggtcaaggcgcgagctggcgctcggcgctcgcgtccaatcggcgacagggcggagggaggatgacgccggcgggaggaaaaggggaaaaggagggagagaaaggggggcttgcccctttcttctttgggaaaaaggaggaggggagcgggggcgtcgcggcagagggaggagggctctgcctccgtcccttggcggcttgcgcgcggagtggcggggccgatgcgatgacgacggcgatgaccgcggggcggtgtggagcggatcggctacacgggcgacaggcgcgggcaggcactgacgacggcggcgaccaggcggtcggccactcggcacgcgcgcgcggcttgcaacgggaggcgtgg

SEQ ID NO: 47317 - DNA, 9536 bp, Oryza sativa
ccccgggggagatgggccgagagaaattcggcccatcgaccccgggggaggcaaaatagacttttgcggaggaatttgattggaatgattggattcggaattgaactcgacgatagatcggggatttgagatcttgagatggcacggacactagacgacaagcaaagaaacaaatttcgcaattagggtttctaagagataattttcccgctaggcgccacgacggaacgggcgctacagaacacgaatgaaaaaactaatttcataactcgcctggaaaaagcaagacgaatcttttaagcctaactaatccgtcattagcacatgtgggttactctagcacttatggctaatcatggcctaattaggctcaaaagattcatctcgtgatttacatgcaaactgtacgattagtttttctttttatctattatatactaaaagtccattaaacttcctacaaacgctctcaagctgccatgtggtgctctaataaattagagaaaatcttataaattctaagaaaaaagcaaaacatctaccccttgattttcacttattttggtcggtctaatattatacaccgttagataaaattgatcttaaaacaaaccaaatactatgggtcccacctttcctccttctcccgtgcatgtgtacgtgggtatatatatatacacgtacgtaccgtgtacgtacacccttcttttctttttttcttctttttccatttatataatatggatatatacttttttaaataaccataaatttacaacataaagaatctaccatcatataactcactggtaactaaattagctctacaatttttgaaaataaaatttaaaccattatatgtgaccattaaattaataatgtaatatagtttccacttaaacatgtgtactcattatttttactattattttcaaataatgcactattttaaaataaagtttacacaattatattgtgtacctatcaaataaacagtttaagatgtatattaaaccgatggacccattatttaaattatcggaactattttttattacatcggactattattctcaaataatgcatggtttcaaaataaagtctacaccattatattatgtacccattaaattaacaatttaaaatctatattaactaatgtacacttacactagaaccggtggacccattatttaaatcatctgatatattatttgctaataaataaaacgtccgaagttcttttttttgcccgctgcacaatgcacgtctgcacctttactttttgcacgcgtgacaaagcatcgtgtctgaggcatctaaggtgatcacgactaccgcagcactaccattttgctacatatcaaatcatatatagagatgatgcagcgagagaagaattaagcactgtgggttgtgtttttttccaacacttggctttgtttaagctgaaaccgagagttgattacaaaataattataatgtattgtgttatgtcgtatttggattttgtactatttgtttgtatagatgaaagaaatcattatgttataaatgtgagcacaatattaacgaatatcaatagcactcttacaaagactagggtgttataagggagtttaagatcctctttttttttccgattccatagtttgtaaatggtgtcttttttaaacaacattttaactttttagaagtcaatttattcgtttataccctcaaatagctatcacataaatcagataattcatcaattttagctgtcctaaaccctaagtagtacatattttttttatgcaagtcatggtgatcagtaaattggggatcaatggataatcaaagtcgtaagatgaatatgtaagtgctactatgaacaactgtaaataggtgtcaaaattaattgctactaattagacatctaatggcttgctagccacataattaatttctctcaacatgtatataaacatgcacgaagctggaacaaatattaccatatgccctatacatatatattaagcggttaatattctaattacacgtgttaagtcctttaaaatttcttaaaacgctctcaagctgtcacgtattagaaattctaaggggaaaagagtatcaattacttgatttttcacttaatcgctacgtccaatattataaaccgttagattaaattgatcttagaaaaaacaaaatactgtaaggtctcacctctcgtcccatggcataggtatgcacctacatacatgggtacgtacgcttcccctcccttttttcatttttccctttcttctttttttccatgcatacacttccctccctttcttactatatcatacaccttcttgagatgatttaatcataagaattttgagtatcttgctcttgtatttttcatttgtggccatactacacggtatgcatatagatggactgtatgatacttaactagcaatagtttcttatttactcgagaaaaaaaatgatttaaaagtcataccttaagaaaaagtttgtaaatggttttttaagataccttaagaaaaagaactttagtttgcccttcatctataagataaaatttttgaataaacaataattttacctttcaataatataagtgcccgcgcatgtgcgcgggccaccttcctagtttatatttaatgctctatatatgtgtctaaaaattcgatgtgatattttttaggaaaagtttttggcaactaaacaggacctaagtactccatggccacaatatacatgtgaaaacgtccggcggagaaatgaccctgcagttccctcccgacatcgtcgacgtgatatgtctactttcagcttcttgtcaggccacaagcccacaacaagctacaaatagatcactttcagaatcctacttcatgcggcagcaggagaatcttgcctgctttcttgcaaatttacgagtgcagtggacgtcatgcatgacccatatatacatggcggctcatcgtgtcatcgtaattaagtgtgactacgcgttgcgcccgagccgtgtttagttggagaaatttgataattttgacagtggggaccctagcggatgcacgtgtcatgggctcatggcgataacgaactctcaagacaaggaccttgatgtgttagacaatagtagcatatatagttaattacttactttttcgtcgaaacatgactaggttaattaaactttactgctacattttgactggtgtacagatatacagtacaatccatgatcccaaagtctccattttaggtaattgaatttaaagtttacgtggattttatacggtttaccacggtaaccataataacaatgaaatgagacgtagataactcttactcaaacggtataaaaaccgaaaaccctgattcaaactaacatggcccgacccagactatccgataatatatcaggccaagatcaggcttatctaggtcgggctcgggctcgggcctagcgtttatgtcaccatcgagtcgaaggtggtgccatcgatgcaccaccatcgccattaattagggcatcctgattgccgttggataacttggatgttgcgacggcagtaggttactaggctgctcatggtggaggagtccaacaccggaagggtggcaatatggaggcggccagcgaagatgagaccaccacgtaggcccctcggtcacccctctcgccagctgggtagagaggaggtgatggctacgagtggcttgggagagaggagttggcggcggtgggaagagaggcggcgggggcaacgaagctttcttgtgctcattggggagaagcgagagaggagcagtgtgtcttgggagatagatgtggaggagaagagataagatcgacaaaggacttagaggagtagataagatctgttggaacgtggcttggtttggcttgatttttatggagaccgattttgtaaaaaaaaaaacagcacctatatataatatagatgttggttttttaattaacaaacacatataatatattaaaggtgtctttttttgaaaaaaaacatgatgcttatagctgctcaaaggtgtcggttctatatttttccattccatgggggtaaaaaaatgtctataaataccaattttagcattaatttccagacctaaagtgccacccttttgtgatgctttttttatagtgtgattatgtcctgcaacctgtacgggcttggacaattcatgtccagtcttggttcctaggacaaaagcccaagagttggcccaacaagactatatatgatggagtaagtccacttgccatcccacatatttacgtagagtttaattggcatccataaattgcaatactagaaatcttcatccctcatcttggcaaaaccgtttaagtcagatcccataccggtatgatggatggtttcaatgacactgcaagttgatccggtctaatcgtgttgactaggcatttatgtggcaaaagaaagtgggctccatatgtcattctcactcgacctcgacatgcatgctagacgacatgggtgacacactggccacgatctcccgaggagaggttggccttgcattgtgccatggcatacacctgctagtagctggtgccatagaacccaccgttgctcccgccgatgttggcctccatatgtgcgaaggcggtgtcgcagtgcatctcaaagtcagtcccactattaccgccctttccacagttcttgaacaaaatttgggtgtcagacacctacgggaactaggatatcttgtatagtgcaaggcagtggtgagctggattcgcgcgaagacaaaggcaccgtagatgtcagactagaaggacatggggcaggagatgcaggcatgcagtcaaagacgaagaggtccccacgacactcgaatagagatggaggcggaggaatttgacgatgacaacaaagtcttgtagatcttggtggaggcggactaggacaggagcatggaggatagcaccacgatagttgggagagggggttaccatgccgggggggggggggaagctcttgttggagcgccctcatcagcctgggcgactcatggtaggcacccgttgcggagatgcgtgtagtggtggcggcatgccccgcatttgcacctccacgtcctcattgagcctggagagggtggaggcggcgctaccgtggtaggagggggtgcctccgccgttgtcagagctcaatgcccaccttaccgcagtagcttgcctcgcgcaggcctcgagggcaaggagctcgtcaatgtatgctgcggcgttcggcaaggagggaggccttgtccatgccggacatgctagcccgggttttcctccctcaccgcttcattggccttgttgctgacctccaaccgccgttgccgcctcccgcaaacaggttcgtctgctgtcgcccctctccccattggtgagctcctggggaagagaggatgggtcccacatgtttttatttattttttctaactaagatgccacgttaggcaaaactaccattcatattaccatggaacctcacttggacggttttgtcaagatgagggatgacaagtggacttattcattctttgtgacttaccatcctataatagccaccttttttttcccctgatatgagcccaattagctccttttataaaggtacctgcaggctgcagattctccaggcagaaaaaaggcggcaatacgaaattccatcatccctgccacaattttttttttgactggatgccgcaaaatgcattgatgccgaaagtgcttattgcctaattagagctggaaatggaacaaaccctttagggcaatccttcatctgagcatcaaacaagagtgtcctcatatagttaggcagaatgtagcaagagacaacacgcatattcagattacattattattatagcttcccaaaaacaaagaccacccactacagcagcaaaaaggggaaaaataaagtgccaaaaaaaggtgtgatcgatcaggtgatgttcttgtgcagatactataatcccattgccacaccatgctggacacaacaacttacagatacgaatgacaccatatcatgcaatctctacttagtactagtaaatataaatacttcctccgttttatattataagtctatttacttttttctaaatcaaacttcttaaccttaatcaagtttatagaaaaacataataacattttcgacacaaaacaaacatatcatcaaaatatattcaatgaaactagtttggtgtcacaaatgttgctatattttgttaaacttgatgataagtttgacttagaaaaaaaatgaaacgaggagtagtaatttatgaccagaaatgaaaatagtactatctgaatatatgttggatgattgactcttcctatggctgcccgatgctcgatcactcgctacctgaacagcagccgcagcagcagagcgcacaaaggaaacgcttcagaatgtgattccgcatttcgccacggcggcagaagcggacccgtcgacggcgacgttcctcgccgtcgttgtggccaccggcgacggcgacggcgacggtagcctgtgcctccatgtagatcgatgagattgcgagtagtgtgctcagtatatcgaagtattctacgctgtagttagttacctgatacaaaatgtgtgtgatcaaggagatgatcttatatagggttcagagttgagagttcagagtgactgaaacagcgtaactgaagtctgaagaccgaataaaggcaataggacacagaaaggtaacaccctttcggcagttatatatatatatatatatatatatatatatatatatatatatatatatatatatatatatatatatatatatatatcatgcatgatactactgagggaggttagttagttagttactactagttaactaatcaataattgccgcactgaaaattcctaataaactgtacttcaaggtaacaacagtagacacgttaaggcttaagatactgcgcgcaaggaatttcttgtggatacaaaggacagagcaaagcatcttgttacggcttgaaaaagtgatcttttttttttctggattgggattacttcaagcaaatatgtgccttgtaaaggtcatataattattcaaaacagaagagatgatatggtcaagattaagattgtttcaggtccgtatatggtaggataccaataccattgagctcatctaaaagctgaaacttttgtggaacagctactctttcagtgtataccatggaggcatttataccgaacatgggtcctacagtccaactgagtcacatagtcatcaatagcatctaatcttttcataagaccatcactagcatctaatctacgctttagtcgctgtattggcaaagttacaacattaacaattcctatggttgcggtatagtatctgaagaagagcatcatcaacttaatgtcggccagcttgtgattaacgagaaccccactcccactaaccacagagaaagagttaattaattatcttgctctttccaatgttccagttgaactttgaatgctaatctgaattgcctagtgctcatacaatgttcagaaaggcagcagttgattcaaacgaccagaaaggaaagactcaaagatgcagtacattcataatttcatatgcctttgtacaaagaatatttgtaagacccatgctatgattataatctgactaaatcaagctgttccaggtttgaacgtgtagttagcaactacgggccacagaagagaacctctctttcagtcacaagtcagtctcacagactgagtcagtgatcagaatatatgcttttgctggcccaaaatcagttgaagaactagaatctttctcagtgcattttaggcactgaactggataactactctcatttgtcttctggtttatgcagagaacatagagcatttgctagagtatgcagggaagaaaacctttttcagtcagaagtcacaaggcacagaatgagtcagagatcagaatatgagaatagatgccttgcaaacccaaaatcagttaaagaacaagaatctgtgtgggttttgagcacatatcataggtattttaagcaccgagttggataagtatgtgccagtcttctggtttcactggaagaatttggggaaaaaaataagtatgatactcctatttatgcctcttttaaaacatggaatgttttcaattcttatgagactaaacttactcctctgaatatctttgggtttcacaagaagtcttatctattattcttcccttttttttctctccgttagaaatagtttcacgggatttagagcaagtccagtttatgtattaaaatgagcatttcatgaattaatttacttacctacgtaacaatgtgacttggtactactccttgaatgcataaggtgcttgtttatcattgcataacaaaagtttgttaaagccaattaacaaaccgaaatggtactccatctatcccataatataagtgattttcttcataaatttatccaaaatataaggggtttaggatcctattacagtactataatcttcacctacaaacttttatactagtttactccactaccatatacttttatactaatttattctcccacctactaacttttatattactttattctttcacccatcaccctttgtcacatcacatgtcctttactacttccttaattcttgccaaaaagggtataatcgcttatattcacggactgagggagtgcttactaggctatgttcttcccctccttctccaactccactctcatttttcatgcgcacataaacagtgtgttttttcaaataaattatacaaaagttattttagaaaaaaaatcatattaatccatttttcatattcttttagctaatacttaattagtcatacattaatagttcatcacgttttccatgcggggagaaactcttaccttcccaaagcagccttagagcaggtacaatagcaagctataaacatattttaaagagataaaggaagagagagaagagcaacgggatacagatctatagccagctgtagcacgggctccaagacataatgtttgtatgacaggtaggatcaattattaatagtataataagcatctattgtatgattagctattacattgactatagatgatttgaagttagtacttggatatactattaaacttgctcttagagcaagtacaatagcaggctataagccagctataaacatattttaaagagataaagaaatagagagaagagcagcgggctacagatttgtagccacctgcagcatgaactgtcgaactccaagacataatgtgtgtatgataggtaggactaggtattaatagtatagtaagcaattattatataaatcggctattacgttagttatagatgatttggagctagtagtgtgctatactattaatattaaacggcccattaggccgtgcacctagggacgcccgggggtgcggggg

SEQ ID NO: 47318 - DNA, 5354 bp, Oryza sativa
ccgcgaaacggatcgtcatccattttagggttccaccatatatatacctcttgtaagccgccgtgcggcgttgtaacctcaccccagatatggtgaagatattttactgctagcgcctgtggttttttctctcctgttttgggagggttttccacgttaaatctcgtgtcttctgtgattgatctattgttctttgtcgtttgttcgcttatcgtttcctaacactgcgggctaatagcccatggctaaagccaactattagtacaatagattgtctattgactgactgaatctcataatcaaataattaattatgacatgcacatatcaatgtatatgatcaagagtgaattgtatcattgtagctatttgtgttgtgagatgaactttgttcaccaaacaccaggatcatatcacagatcataccaaccaatttctctgtagtactaaaattacaaagcactagtgtttgttggcaagaagagctcgtgagaaaggagtggatttctttggctgattttcgtcaaacgatgtggcatcagagtttttcacggcacagttttcgctcacgatcgcatggatggaagacgaagcacgcggaaggtgatgagatcgcgcacgaacggcggagatggatttgcacaccgctgggggaaggggatcgcgcgcggtgggcgaaaggggatcgcgcgccgcggggtaggcagttctcacgggatcgtctgaggacgtgagggccccacaaacagcgtttttagcactagggtcggctgcacacgaccaatactgcgtggagaaaagtgctaacgccgggcgacaatttagtcgtccgctttattctctctcatccacataggaaattgatgatgtggcattattttagagcccgctgagtcaaattattgtacctgctcttacaatgcatcccctgttccaacttccaagtggatcgcatacttctgtgaatgacggtgcgacgaacacaatggcacaggcgagcgccagcaaggatgggttacactgacatgtgggcccggacaactccgtgacaatgggacgtcgcgttggacgactcgccgctcggggtcacccgcgagccgcaactagtccaccgccctctctctcgctttcttctcaagtcccaactcgcgcgaagcggagagcgagaggcgagagcgaagtgaagcttcttcgtggcgcgcgcgcctcgagttcgtctcttccctcccgcggcccaggcagcgccggccggcggcgctctcaccctcctcgtttcgtggcgccgcggcggatcaacgcggtgatgcattttttattttttcctgattttttggggaaagtttcgcgccgaacgagttgagggttcttctaactaggggagccgagaggaggagagagcttttattttttctactatatttgttggggtttgattctgatgttttttttttgtatggatgttctagccagttagtgtacggtgactccgtgagtggagagtggagaagggtttagcactcaaacttttttttttcgaacttttttgtgcatttatccagggagatgagacgcgatgcatttggcttgttttttttccggatgaattagttgcttgttcctcgctcccgaatgagttctcgaccattttttattttttattttttttgccttgtactagattcgctgttcggagcttcagaaaatgcaaccatggtgatagtgggtggttggttagcgtatgaacatcgtggagcattttttctctaataatatatttttttcaggaggtgatgtttaatcagcctcttctgatggatttcctagcgcctacagtttctagccatttgtagattttttatatcgattctaatgcgcagtcaaacgcatgggcgaattttcactcgcttccctatgcggtgctctgaattttcagtttccagttgctgcttgctgcgctatcaaactaacaccttgtgttctgcgcagcttctcagcacttgctgtcaagtttgccggcaattggttgtggtaaatattagtcaagtctgaagtctccatctctcggagataattatcttttaataaatagccctgtatccattcatttttgtggttctaattgcagccgtcgcccttgtccttctgaattggttatgtgagctggggatgtgagtgacaaggcttcgtcctggattggtggttcgctagttgctgcagttcttgttttttttggggaatactggttgctgcagttcttgcatatcctgataggtgtttgtgcctctttttgcctgtttcgcatgaatatttgtttgattagtgattagtgtcgttggtatggtttgagttaccgcgtgtgtgcttttagctacggattcagaaagtatttttgatataagtactgtttgagatggagtgccttttggcttttaacagatttacctgctgaagtatgaccgattttttcatgtgtatgtcgttattatgctttatgtagacagttttcagtctctcctaacgttctttttaagataaaatgacatgtgtactctgtgtttacaccttttctacattttgctttagtttattatggttatccctttcttgggtcttaatgtagattcaagcaaattggataaccaatcttacatattactctattttaccaagaatgctagagcatgaatggtgtcccttgtatttaacaacttttcctgaagaagctttataaaaatctgatttgctgttgttgagtgcgactgaaatagagcaagaatttgcttgtaggaatgcttatcagagtaatcttttaaatttaagcgcataccttctgtatacaagaatattatactttatatgcaagtaacagagatcattttacttatctacttcagcacttaatgcaatgtcatctaatgcagtggatgttgggttccgtgtaaggaaatgtctggccaagagagagatgatgttccaatgctagagctacaaagatttcctactagaagtgtatcgatgtgtatacctgtcagggatgatatatatgaagactcaatcatatcccacagtggtcctattttcaccccagcaccaactcagtatacatccgtggctattccatcaggaaacagagacatgctcgataagctgcctcgtccaaaggttaagagcaaaccacatgttgttacgccggaagaagttggaataagtaactggccttatgaccagcatgttccgaagaacaaacacctgatgatgtactctgagcctctgggactgtgtgataatcctgattgtgtcgactgtcctcgtgcttgtaaaaacaaaaggcatttccagagaagtttagctccgtttgataacaaggtgatattctcagtcatgaacaccactgacttgccacctccctttaaacacatttccttttgagaaaagcataagcatattgattcatgtggtggcttggattggagctctatattaagaggtcttcaaaactatttggttgccttgttatagttgtcaaattttagatgtttatagatcaactgactgactcttgattcattctgtgcaacctttaaggaaacaactgtttcacacatattgtattttcatgctttagctgtggattatttgagttatctaagatctgtttggtttgacaaattaaaccatcctatgattagtcaattatagggtcatcccatggttttggaggcatgatcccgttcctcattttcctaccaaggatatgttttaagggatgaagtggttacgtaccactttactctattcattgaaccaagcaagtagctagccaggtttgagctagaatccaatggttgattgaccaacatattcctcaaactaaaagtcccattaaacattctcaactcgcccctttcataaatgttaaagcacaaaactgaagcaatgtaaagaaatttacattgtacaaatcccctagaatttattaaattcaagtggtgtttttatttttgaactttgcaaagctgcaaattttacaaatgactttaaatcatcataattgtcgttgttgttgttattgtcactgtctgttgttgactttttgcaatttcttggagtatttgttactggaatttattcatgtctccgtggctctgtgcatctctctactgatgaatgtgctattgatatatctcgtttattattgtagtttcacaacattctttatggctacggtgatcgatggaagaagaaagctgggcattacctttcatacattccaattatgaagccacatgataaggctgttcatcggtggaaccagttttttgtgatatcatgcttgctagccatattcaatgaccctctgtttttcttcctattgtcagtagataaggtaaggctacaagtttgacaactgttatatgaaagaatggactgaggccatctctttacatgttcatttctttcctcaatatcaaatgttgcagatttacatccacaatggctctaacacaaatgagcccactactattagtctgtgtgaagtgtcattgtcaagccactagtacagtttgaacatgtaggctaacgctataaaaaaatcaaccataacagttcatctcaattgtttctattcttgcaactatttatatataaaattatattacagagaatggatccaatttaaccacagtacatatatgtatttctgtatatttgtttttttgtggtgcaggattataagtgtatagtgttcaactggaatttcgcgatagcattagctgttggaagaagtgtgactgacgccatatattttttacacatgcttcttcaggtgatatattaacatgtaatttattgtatttatacttttccttctccattaaatgaatatgcagatccaatgtattcttaagtgagatgattggtttattcttttaatttcctatgatgggccaaatacaccttttggatttgcacaggttttgggtgcatgtacattatggcatggcttgttggacaaaaaactgcacatgcccttagttttaaagaaatctcttaaaagttagcatgcaaggctattatattttttccatatgttgtttaccatgaagtagtaatttttgcagcagaggttttccttctgttaaatatggaaatctacttccatgttagtttcttctttttcatgatagtacttctctattttatgaactatgtggcattttggttatattaagattccaagatgtatttatattacaaatccaagaaaaagcaccatgctcatactgtcatacattaagtgttccccgccaaaaaaaaatgctcatacatttgaataacttttgcagttcagg

SEQ ID NO: 47319 - DNA, 738 bp, Oryza sativa
actaatgaagtagcttagtgagattaaatcaacagaacaggtgcgcctaaatcaataaacatgaaaagcatccggaggaaagcacatacccatgccgagtgccgagagctccacttcgttatgcagctgcatgtacctctgcaacaaagcaaacatcaagcaccaaattagctatctccgtttcaaatccagccaaatccgcagccatgagccctaccgcaagcggggtttatctagggtttagataaaccccacggagagcagagcaaaaacccattccaaatatacaccctcataagccaagaaacgcaacaaatcaaaatccccacgaaacaaggcgcttttcttctcgcctctcgattaatctttctcccccacttaccttggcgaggttgacgtagaagaagagcggcttcttggtgttggagacctggatgcggttcttcttgtgcgcctccgccgcgccgccgcccgccccggcggcttctcccgcggctatggtgaggttgccgaccgcctccgtcacctcctccatggccgccgcccgacgagtccccgcggagcaccgtgcgcgagtgaaacggagagcgcgaggcggcgaagaagatgtggaggatttcggcggcgacggaggtaagagggaggggggagagccctatcgcccgcgtgtgtgggattttatacggggtagggttacggtttggaggctttcggtttttccccatttctgttttcgga

SEQ ID NO: 47320 - DNA, 2025 bp, Oryza sativa
  unsure (1)..(2025): unsure at all n locations
tgggaagcaatatgtccaatgggttggcactgctgctgcaacggagagacattgaaagcaaccaagtgaggtctcacactgcttttctggtgatgaaattagcctgcactggaggggaaccatatgtccataggttcttagaggctaacattgttcatgagctaattgacatgatgcagtgcaacatcaacgatctccaggattcagcatactatgcccttcaccagattatctttgcgaaggggggatcacttgtattacagagatttttacaagcaggaaccattgaaaaattggttaacttgcttgaccgcaagtcttcaaagacaaaggaactaacaatgcagcttctggtagacattgcggtggtcggaaccaaaccttgcatcgaaagaatgctctcgtcccaaatcatcgagaaatttgtggcactcgagaaagcaggtgggtctttcagtggagcggtatcaagatacgtgcaggggttgaacatgtgcaagaacgtccagtctgctgagagatcagtcatgaagcaacagattctttgaggaaaagtgnnaaggnaaaacagagataagaggtcatgatctggaagcaagtctagttgcctctgtggaagcttgcatttctgaaaaaggagccagcagcaggaggaaaaagtagaaaaaatttctgccaaatgcagcaactttaaaagtatagacctgatggcgcctgctgcacacttagataatttactcaaaactaattcaatagtgagatttcttcacaggttcaactttatagtgtgtgatcgttgggtcttggacgtaggtacatccttggtcaggattttagcaatgaccatccaaggaatcgtaaacatcatcaaaccaaatgacacctgaagaagatcccatttatatgtattgcttttcagaaatccaatctgatgtatatgatactgaaatatccttgactggttataccatctatgcaggttgacaaccatttttttttagtgcaccgtggcaatcgtttcgctacgttcgcaaatcatttcatgggtccaaatgcattttcatgagttgcaaaaacactttggataatgtttggaatgcatagaattttctggatcagctagagttaagcttaatgtttactaaatgttaaacttccgttaaatttccacggttttcctatatgactatcgggtgaaattcttttcatcagtcatctgtattagttgtagctattattgcagagatggatcacatcacaaccactcatcttgcagttgcattcctttcagatatagatcctctatagcactgtggtgtagtagaggtggctgacatatgggtctggatctatacgtcagtgtcagttattgccccactagtactacgtacaatccccgctgattcctttttttttttgccctcgtcattaggtttgcttatgcggaagtgctaatgggcgatcgatcgcccggcgacaagggtagcgatcgatcgcccggcgacaagggtagcgatcgatcccccttccccctccctccctccacctggtttccttttttggcaccgcattatttttctattttagtaaatttatgcacctaaagtttatacacctcaagtttacacatctaaagtttatacacctcaaatttacacatctaaagtttagagaccaaaagtttataagtcaaaagtttatatatccgtttcaaattcgaatttgaattcaaatatttttttatatatagtatttctatacatctaaagtttataggcccaaagtttataagtcaaaagtttacatacccgattcaaatttgaatttgaattatatcgggattcaaatttgaatttgcattcaaatattttctatatatagtatttttatgcatctaaagtttatatactaaaatttatagacccaaagtttataagtcaaaagtttacatacccgattcaaatttgaatttgaattatatccgtttaaatttgaatttgaattcaaatattttctatatataat

SEQ ID NO: 47321 - DNA, 3125 bp, Oryza sativa
aagacgaacaatcaaacatgtttaaaaaagtcaacggcgtcaaatatttagagacggaagaagcatatagcacaagtcaagatttatggttttgcttatacatgtgcttataagataaaatttaaattttaagatgtaatttcatggtcgattttttttttcattgtaagtatattcataaatatttgcttttgaatcgttaaaagggacgtatacctataaattatactattattaataagcagtacaggtaggcataaccaaagcgaaacacattgaaagcgacaattggctgagacacacaaaaatccaaaccaaaataaagatcatcacgatccaactctatgtgaacggtcaaaaacaaacaagatattttttgtggaagactacaagaaatacaaacaagtgtagattgtcctcacgagactgacagctagggcgttcacagtgcaatgggttggcattcagcccaaacgatccacgtcggtgaagcgaggagaatctactggtatcatcttttcgcttaggttgctaatcagctaatttgaatttttaaccggtcttatcttttcgcttatactgcttatcatccaaaaattgaatttttaacggtttttttcaatgaagtttatttttcagcatttacttttagatcactatgaaaacgtatatacaagttttattcacaaattcttttcatttgcaaatatgtcattatccgtgaataagccaaacaatagggctcaccaacctgaagacctcgcgttcaaaaaaggtcacgagttctttggcaaaatcaaggacgcgtaggatgaggagagagcgtcgccgctgtgccatggagcaagtggtttctccattgttccttagcgcgcgcttgcccccgatcccatattcaccgcgagatggaggcatgccggcgacgaggatgggagcgaggttggtcgattgtggagcgacatcccaagtgtatctcgaggacaacaacgatgatgcggaggttgcgtcgccttgaactgctcgttgcttgccggtattgtcccgatctcctcgtcccactccacatccggcgtcgccgccccgctccacgtccaacgccgtcaccccgtgcctaggccgtgccgcccctcggtctactccggtcgaagctcgtcggtcacgccaccccctcgatccgtgtcggccagagctcgccggccacgtcgctcctcaaggagcagccagatccgctcagcagcggaccatgccggcccgacctcatcgtcggagagggtaggggagtggagaggcgaggaagacgaggtggttctgttgcccgtgtttatatttagcagcagcatttctcaggggcaagcgccagcgccggcgactagtacgacgaggaggaggttgggctcgcgatggcgcacgtcgtgacgacggtgtgcgacaccaaggcgcggcggcttcaggactttgcatgggcgtgatggcaaagcttcgaggcatcgacggtgatcgcggccgtgcggcttcgatgcgatcgatggaagagatgggggaacatgaggtctcactgacatgtgggtctcatgctgactcagctgccacgtcggacaaaacagggtcaaccagagtcaatattgcctaaggatcttgggtgatgtcatatatccgattttttgatttagggacgattttgtaattcggtgaaaagataagggatctcggatatacttttccctatcccagtaattttgacccggctaaatttcacccatagtgaatccccatagtgaatttcaccctagctaaaccgtataacaataataagattacaatatccttcacccattgcaatgcacgggcatttttctagtataaaaaaacagaagagataaaagaggaaaagagatatctatcttctaactattcacctgtgttcgagagaagaggaaaaagataggattaagaagatacgtaaaacgaagtgagctattagcatatgattagctgattattaactattataaattaaaaatgaattaatacgatttttaagcaactttcttatataaaaaaattataaaaagtaccatttagtagtttagtaagcgtgcgtgtgaaaaacgaggtacttttctactctatccatccatctcaaacccacatacgtctcttctcgtcttctcctcgtgttacacatgaaaatatgtagtttaaattagtgaaacttagatacaattgttggatcgaaaaatagacgtctgagattcgtctacgctaccatgagtacttatgagtaaatctgtgagtaaaatttttactcgtgatgacgtgaacattccactttttcaccacttattttcccgaacaatcttgctctattgctgctgttgttccacccatgctgttacgcctatataagccagagaaggggagagagacaaccaggggaaggtgaaggaagagggcaacatcaaaatcttctcagatttgtatttgctatgaggatcatcgcctccctcaaggataacccttataaatgacactccagcctgagctgttttgacgctttgacactccagtagacctgacatcacgcctgacgagagctgaattggactatctacgcaacatttgtaattcggtccaagaaagccttcaaattatgatcccacgctactaaaaaatcattttcgcctatggccgaaaattgatttttgcaggcgaccaaccgctctgcctacgattaaaggtcagtgaaaatcaaaattttagaaccgttctgtaagtcacccacctaaaaaacctaaattttcaggccgacaaacttcttttggcataaaaataagaacagcatatcatcacagctcaatggacaacagcatcacagatcaacagctcaagaagtgaggggaatcaagccgaggccgtcgtctccattgctgcaccgcctttgccggcattgttgctctgccgaggtggccggatctgaagagccgaagacgacgagccccattagatctagatgtcgctgccctccccccactactgccgacgtgccaccccttgaatctggacagggcagccaccctctccccgcaccgttgccgtcggcgagccctcctagccccactgctgca

SEQ ID NO: 47322 - DNA, 5941 bp, Oryza sativa
acgccctgggtgcgccgccgctaggaaaggagggaagagggagcaagggaagagaggctgaggataaggataagacatacggttgagaggaggaatgtgtttttttagcgcctgagatttattttttatagcgactggctacgagaaccgctcttaggctcttagccatccgccagtaaaaatcgtgttatttttacaagtggcccttttaagatgatcgcttgtaaaagtaaattttcacaagcggtttctaatcagggacctctgattgccctttttacaagagtttcttattttgtccgccaaaagaaaataaggtggagccaggaataatcattttttagtagtgccacaagccaccctcgaccacggagcttcatcttccacactgccgagctccggcgaacgacggtggccggccgcctctgtctccaccatgaccgtctccacgcacctcgcgagcttgcccgtctcgagcaccctgtcggcgccggtgacggcacacacgctgacgccccaccatgcgttcctttcggatggggaactataaaggcgttactatatatttgtattcctttcggatgcagaccctctttagtgctcatgatatagtagcagtagttcaggtgtacgtcttatggtctcagtgtctgttattatactaatggtactgtagataattctcattgattcctttatagtgcccacaacattcatatcactttttaagtgcccacagcattcatctcactgataaactaaataccttcatatcatccagagatctatcaacctccattacgtactcggagccagaaagctaacaagggttcaactgcagccaagttcctgaggcattagctgcgtacttgcatagatagatgtcactgtaggttcccaattatgtgtgagcgtggctatcatggattaatgacatgtctacgccctgaaatgagcaccccaagtctacaagagcaagtttaatactcctacgagggaattaatgggatcccacaccataacaagaaatccatgtccttgtgcatgcaactgcaaattaaaccaatactacaatgaacaacggtgttgctgctaacaaacaacactcaatgccaaattgccaatagtgatgtgatcatgtgaaatacaaaacttgtccatgcaattgcaaaccaatactacattaatgaacaacactgttgcctgtatagcaagcaacactcaatgccaaattgccaatggtgatgtgatcatgtgaaagacaaagtgacaaacccgggatcccattgattccctcataggagtattaaacttgctctttgagacttggagtgttcacttcagagtgtagacctgtcactaaggatatggattttttttttcacctaggtgcaatcccacctaatcatttacatgtgacttgaatagatatggaaaaatatgaaagaaaaaaatgatagtattgttcacaatggcacaagtctatacacaatcgagcaagcctaaaatcaatatataatcagaaaaacaaaaataataaaattagactgtaaacagtacctatctagcacaaatagaacttgttattttctcgatgtgcatgtttgcatagtggtttatatcatctttatctaccttgtcaaattttatgaaatatttatttaattacataggtgacatagatacactatgttggattgcatctacatgtaaaaaaaatacttttcccgcatgcacaacgacaaccctcctgtgtgcacgttacgcggaggttgtaaattatttccattttcacgtcaaaggattaattttttaggttaatttgatcgatgccattgtgacttaatcaatttaaaaaaatattattattattcacgatattaataggatatgctactaacattttacaaaattaaaaccatatatcgtcgtcacgtacttttacctttttttaattcacttgaaatgacacgccaaccttagccattttgacacttagccagacatcatcatcatccctgacgaacggtgaattggattatctacgcaacatttgcaattcggtccaagaaagccttcaaattacgatccgacgagccgccctcggcgacggcctcccgcaccttcgccttccacgccaccgagctccggcgcacggcggcagccgcctccgtgtccgccatgaccgtctccacgcacctcgcgagctcgcccgcctcgaccaccctgtcggcgccggtggcggcgcgcacgccgacgccccacccggcgacgagccgcgcgttcgtgtcctggtccgaccactgcggcaccgccaccatcggcgcgccgcacgccacggcctccagcgtcgagttccacccgcagtgcgtcacgaagcacccgacggcgccgtgcgacagcacgcgcacctggtcgcaccactccaccaccatgccgccgccgtcgccgtcgccgtcgccgtcgtccctgtcgtcgctgcgcaccacccacaggtacggccgcgcggtggcggcgaggcctcgccggagctcctccttctgccgcctgctcaccaccgacatgctcccgaacgacacgtacaccaccgaccccgccggcttcgcgtcgagccactccatgtagcccttctcgtcgtgcctgtacaggtcgtgcgacgctctggcggcggcggctgcgccgccgccgtcgagcgaggtggcggccgggccgatgggtaggatgtcaaggtcagggaaggaggcggcgaggacgtcgagctctagttcctcgacggtgttgacgagcaccatcggcggcttgctgctgctccggcgatcgatgtccagctgctcgatcgtcgtccggacgccgtggaacgcggcggcgagcctggtgtcggcgaggtcggtgaagaagctggggaggtcgcggatcgccatcggcgggaggctcggcatgtccaccgtgaactccggctcgccggcgtgctccgtcacgagctcctcgagcccgtggaggtagtggtagtacacggcgagcatggtcgccggctggatccagtagagcacccgcgggatgccgcgctcgcgcgcgacgtcggccgcccaccacatcaggaacgcgtacacgacgcacgtcgcggggcggccgcgcgcggcgaggcggtccaccacgccggcgaacgcctcgcggccgacgcgcccgaacgtctccgagtgccgccacgccgcctcgccgtcgctggcgaacagccggaacccttcgtcgtagccgtcggagtacgggacgtaggagatcccgccgccgccggcgtcggcgtcgtggacctcctcgtcgggggcggcgagggacgggaacatgcgccggtgcgccgacacggcgacggacagggtgacgtgcgcgccggtggcgcgggcgaggcgcgcggcgagggctcgggccgggttgatgtggccctggccagggtacgcgacgacgaggaagtgctggcgcgccatggccggagttggggtagcttgtgttcgcgacaaagacaagctttgggtgttgagagatgtagcctgcattgcctgccagtatatatggctgttcttttacacctaagtggccaagtgtatgcgtgtaaatgtgtgataagtagttgtgaaaaaattgataagatttaacaagatatatcatgatgattaaatcactctgtaaacatataaatctaaattcgatctatctcttctctgctattataaaaattgaagatgtttttgccgatactttggtacatcatccatccgtgtatgagtcagtttttaagtttattcgcttttgaaaatatagaaggaatcgtataagaaatctctttaagaaaaactcacatgctaatcggactcctaattgcagctcatgactttctaacgaaaaatatatccaagcgaatttaacaaagtgaatttcaccttaattaaccaatataacaataataagattaaaataatattctccaattgcaacgcacgagcatttttttctagtagataaataaaataaaaatagcaatcctatttacggtccgagtttattaattttatctatataattatcgaatgaatttacataaaaatagcaaatcctatttacggtccgagtttattattttggtctatataattatagattgaatttactctcatatatttttatcgacttatatcatcctaataattattaccaatttattttcattttttctataggtatttaagttatgcaaatgactggtgcgaatgcactagacactagtgtagtaaaaaaccttgtccatgtggctgcatggtgcatgttactagtactagccagtagtataaaaagtcacacctcgtgatcataaaacacgtggttttagatatttagatggttttcgaactacaactttatcgttaatttctattgcaaattacttttagaaactcggctagtattatatatgaaagtagtattattttgaaataaatttaaatgcacgattttccacactccaatcagatttatgtttcttcttcttgtttgaaaggaaggacatctaaaccaatatgtttttaaccagacaccataacattcaagatctttatgtaacaacagtaggtttgatgatctatgagtggggtaaccaattcttgaaataaatttaaatgtacgaattttcatacatccaatccaatttatgtctcatgtaaaagaaatgacgtataaaccaagatattgatgtaattgtaacttaaaattcaagttttttaatataatggaattacattacattttttggaaatattcaacatattggtgcaataataatacaaggtttgatgatctgtgagtgggcctcgttaatttaagagcactcttagtttgttgtgtgcttgcatgtcatacttttaaagttacgtcggtattatgaatttgtgatgcatccaatgtgttgcatttaattttattcttccagtgaggctagtatttatcaagctggcacctgtaccttaaacatctgtctgagcaaccacccataccccacgttgtctctggaggcaacacgagcaaaacccacaaacgccaccccccatctcttctccttctttctgaccacttcccgcttcaccattatccaagcgagccaatgaaaatccgtgcagccatagtgaagacaacggcaaggcttctctaagccgagttgggtggccaccacaacccttaagctggaagagggtgcgggtcgtatgtggctagatctgacatcgacgcacccgattcatcgcactcatggtcgaatccatcaccccggcatcggggttgagagcggcaatgatgaggcagcaggatgtagagtgggtagccttggaggcgaggcagtggaatatggacatggaaatgaggcgaacatcttggaggctcaaaggcaatgtgcgaccagtggcaaggcgaggaggcgatggggtgatgctgcaccctctagacccttggtgagatgttggatggtgcactctcttccgtagctagcgtgacagaagggttggtggaggaggcggggctgacgacgccgtgcactagatcaatgttgaggaagggtgggtgtgcctatccccttggaagatctagctaaaatgatttcttttggtggtaggcctaagatgctgtcagtgtgatgcatttgcaacactagcatgtggaggcaggaggggggttgttggtacaatggtgtttacgtgctaatggtgggaggctggttgtggagcttggagcagcagaacatcagggtggccgacatgtgaaaatctagaacggtcttgttggggcgacaatgatgatgcctttgggagtcattttccgtcttgggagcattgtcaagacacctctcccttcctaacaggacatcatgatgaaatacttggagtctcctagagaccaggaggga

SEQ ID NO: 47323 - DNA, 30719 bp, Oryza sativa
agagggatctttttttgctcccaccctctcggtgttgggtggtatggttgtagctccttatgctagcggcggctggtcacgtacgcttagctattaccggtctagcgctagtcctttcctcagctgtgtgtgcaggcgacgtcggtgtgtggtggtggtggtgtatctatttttgtttttccaaatacaactttttagggttttagagttgtcatttttttcgctctattgaatgaaacatctgttgcctgttaaaaaagacaaaatttgctatatgacaccgcgatttcgcgattttacctgttggacatagaaaaatcaatctttggggaaatacattatcaaaatatggtaatttactgctagacatcatacctattaaaatattaatttctagttaataaaatagaagagagaaacaacgtgaaagtaaaaaaatacaactagacccacttgtcatattgtttctcttccactctagtgccagcagtggtaccttttttttacctttaaccatttcttcgtttcggaatttttctaatcatatataggatgtagtcttgctcgatcaggaccctagctttattgcgagccaaaacggctgcgctattctgtctttattaaccacttggctcagcaatatcacaagccacccagccatttacaaactctgggagggggtccaaccatatagcagattgacccaggtcccagctccttcccacttgggctaaattatgagcacacaaattacaaagatctagaaataaaagagatatcaaccctgaaaactctaactggggccgtgtttagttgcaaagtttttctttaaactttcaacttttccaccacatcaaaacttttctacacacataaacttcaaacttttccgtcacatcgttctaatttcttccaaacttccaattttagcatgaactaaacatacctagatgagaagcttttatttctcggaaaatagggttgcccgttgcttgatcatagtcctgactcctgctttttcagcgccgtgaccagcaatgccgaatcggattcaattccaatatcaactataagggctggtagtactggcacagcgaggcatgcatggttcagcttcggcacacaatgcatcatgtactggttccattcgtcctgtcccagcaaagcatacagcatccactatgatcacgtcccacaaaaccccatcctccaactttcgttgcttccaacttcctggtaggaatcatcaaagtttaagcttcaggttcccctccgaaggttgtgacgagcttacagtctcatctttttcgcttatatttatacttatcagccaaaatttaaatttttaaccttgaatttgaagttgattttgggattttttttcatcgaagtttattttaatttcagtttttgcttttaaatcattattaagaacatgtatataaaaattttattcataaattatttctcgtttgcaaatatgatatttgtcttatttccaaataaacaaaacgatgggaccttaatctccctcaccattgatttagttcgatgtaccatgtgctcagatttgtaattacaacactgcatgtgttaatataaaagaaacaattcggagtcggttaggtgaaaactggtacaggttaattcaaatgcgaggccacgtcggcatcatgggtgggcgggcgtcctcgccagtcgccactgaagaccgaacgcgtgcagcgggcggagagatgagatattagagactaggatttggatcaggtgcagtttcatcgtcggatacatatcgaacggcctggatcgagcagctactgtagcgcaggatactgttcacatagctactgtagctttagatttggaccgttgattataaaaatggacgctccacgttgtgtgcagttgctaacgttgtgactgcacctgatcccaattctagagactattcagttcacaggattttcaaatcacagaaatagaaaaaacgtaggaataatgtaggaatgcacgtacaaaacaaaggattggaacacatgaatttttcctacatttagctaaacaaaagaggatggagtgaatgtttttattcctatggaattagtacatttggaggatttgtggaggattggcatagtgttcctatgaaaaattttcctttgaatcctagaaaccgaatgaatgaatagtgcttattccaaaggaattgagtttcctttaggaatccttcaaaacgaatatgccaagtgggtttagggatttttttttggtctttcatgtcatttttctctcctatttaactagtaggaattaatattttaatatatgttgtgtccactgtcaattgtattccccagggatcactttttccatgcccgttggaatgttggatcatcaatatccaatgtccagttgatatactactccggccctgtttgaattgaggaatattttttaaccctccctcaaatagcctaaacagcctaaaaagatctaaaagggtgagctattttagggctatttggaaataacccacccaaaaaaactatcccacccaagatgtgctaattggggttatttcagatgaggcccactgaaaaaagtgtttttttctctctatctctctccatgtgaaggtacattaaaggttaaaaagctcttaaaataacccttggatccaaacaacttagaactatatctatgtacttaaaaaatagctttcaaaataactcttggttagttctccaaacagaacctccgtcccatagaaagataactctagctataaatctggacacatttcataaaaactaatcatagctacgatttataggacggaggggtggatgatatgtgcattcaataggtagaggacaaaaaattgatatagatggaacaaaagttggcctgagatatgatatgctcattttggcatggctctggcctgtagatttttgtttaaaaaagactttataaaattaaagttgcttgattctcttattttaatctatggataaaatgtctcacgtaacaaccttaatctaacggtagctctaacttcaagattttttttagtagactatgtacatctgatgattaatatggatattttttattaagaaacagtctattttactccatgaaatatttcatcggatctaaatgatctatggactcattttaaaccctaaattattaaaaatgattcactttacccgagccacattgaaatagcgaggaggaagataaggcctagtcgcggacatcaactcgtggagacgtaatcggtggatcttagtcggcgtgttagctgttagaacatctaacctgcttcccattataattaatgtgatacttttcaaatatacacatataaactggagtaagttattactcgaacctaaaccagtataagaatctttctctttgtctccttacaacaattttgcgtatatcttggtgccgatgattccatactctacaaatatcgttgtcggatataacccgtcgccttaaacaataggaaaaaataagaaaaatattaaaaggtactcatgcaggtgtcgatgctacaaactttcaatgcaaaataccacttatatatagagaaacaaaaatgagaaagtgttaggaagtaaagtgaaccctttttaatgcttttggatggagggttaatgtttcccgataaatagatcagagaagtaaaatggaccatttttttcattaagacataagtatacgaattgaagtagcctagcgttttcagtccggcacttatggtccatgtgaaaaaataaatataccccgcgtggagggggctggttatgatttgttaaaaattgttgttgttcactcaataagtaaaataaatagtccctcctttttgcttgcagttaaatatagaccatgatacttaaaaaattaatttatgaataaaacttttatacaacgatttaaaagctaatataaaaaataaattatgataaaaatttaaaatcaacttaaaattaagatttaaaaatttcaattttggtttagatgaataagctgaaaaacaaacggtagaagtctactaacagatgttttttaacgaacagcactagatagtgttgttcattgaatagagtaggaaaatattacaagactagcactcaagaaaacaatagccaggaacgaaaaaagaaaacatcaccatcacgcactgacagcgcctacacacaacccaggagaggctagcaccgggccagccgtcactaagcatgaccgaccgccgctagaccaacaacgaagttatagtcggtccgcccaaaaccaaaccctaacagacaagcaccacactcaactctatccacgcctttgggattgaaggagagagggtgagagagaagaatagaaccgctatcccccacaagacccgccaacatggtcaatttgcaaaagctagggtgccgctgcaagaggacgaacatctagagagatcacacacaagttatcggagagacgttttgactagggggcctcctagatgatgtctctagggagaaaagcgacgataagtaccaccaccgccgttcgtcgaggtctcaaagagaactaggagaactttctgctcgacagccccactagaggaagagggacaactcgacaacgcccccagaaggccggagaacgacactcggaatgtcgtcgttgacggtccagcaaggccgggctaggttttcacctactgcccatcccctgtcatccgaagctatcactccatcgctccaccacccgtcatccttcgatagtgcgtggacactattgaaccgacccccctgctggccaacctccgcatgcctatgttccatacccaccatcaccggcttccctgctgccacgacgctagcctccctgccgtcgccgcgttgacctcccacgctgtcggtcgggccgacatcccttccgtcgcccacaccaacctctaggcaccaaccgtgttggcctctcgcagctatcactgactctcccacggccgctaccgctgtcgtgtttctaccgcgccgctcggccatatctgtcgcagggttccgcaggatcgctcaccgcaccggccacccgccaccgtcggtcatgcctcctcctcgcgctcaccgaccgctcctttgcagcctcccggcgaagacgccgctgggacgtcgaagccggctgaggggggtggatccggccgccttgccccgatcccctctgcctcgagccgcctcatgctacctccacttccatcgtcgacaagtccacaccggtgaccgagttctgaacccgggctagaggcattagatctggccggccccaccgttgttgagctcgcctgggagaagtgaggatgtgggagcaaccgcctcgtagcctgtgcgtatctgccaccgcaccgccatgacagcctcgccgcacgccgccatcttgctcagccttacaatgcgcatgcgccaccgcaccgtctctctcgcacaagggatagctcgccaacgagaaaagacctcaccacgactatcatggctcaccgcgcggttgtccagcgacttactccgacaacggcgaggtggatggccgagggaggggtgccgcagcgacagctagggtttttttagccccaagccacccgcgcggggaacaactcgtgggagcgtggaaaggttcgcccataggccctgctgacaaatttacttgacttactgtttcttcttattttctagtcatccaaccttcaacaataaaatctacttcctccgtcccaaaatataagtatttttgactatgacacggtctccgagatgctattttaaccaacaatatctataaaagtaagatattttaaataaaacgagttgcatattatgatagtttatttaatgataaatctagcaacatcaattttacatgattgatattttttatatttttgctattaatagttaaagtttaaaatgtttgacttgttactatgctaaaaatgcttatatttttggacagagggagtatgtcagctactttgataatgcaacattgaaaactatatttggctgacacacacaagcagccaaaccaaacaaagattatgacgatccaactcttcgtttgacagtcaaaaaaaaagaaagaaaagataattttctggagtaagtgagtactacagtctacaggtacaactgtgcgagtgagtacttctttatggataaagagattggcatgtgacgagtagatgagtacgagtacaatctcgtcagaacacgcaattgttcaccgtaccaaacacttggagttggtgagaagtatttgtgtctgtgtttaattaatatacgttgagatcacggcgaccggcggtggtggttggctcgattgatactactccatctgacatcgtagttatatgaactggtgcttgtttaaattatatgtcaaatttgattttggatttatatattttgaatgaagggagtagtaccgcgtggttcattttaatatggcacgggtacgcagcacaaaaggatctacctttgcccacccaggttgaggcattttccaatttccaattatctttttttaaaaaacaatttccaattatcttcaggtttatttacccgatgttctggttcattgcctgacgtgtacgtggatgctttgccctcacccgttcacatgccatgatttttttttcattccctacctacacgaagctcaaaacaaatctcactagcacaaaaaatcgttttcccaagcaacaaaaaatcatttttttaggtggagaaaggcctgcctgtaagcacaagttttcgcaggaggcatctccatcttcgcaggcgccatagccacccgcttgcaaaaatattttgggcgaataaaaaaaaattgacaccaccccaacctcacgcgcgcccgccctacccacctctatctaggggtgaaaacggagcggattcgatcggatagtgctgataccatatcctaaaccatattttttaagcgaattcgaagcgggtatggatgcggatgcggagcggattgtttcggatgtcggaaatagtgcgcaatcagttcgaaaacggattaaatttatcggatgttacatgtatatgcaatcaatgcaacatcgagttagcaatccaaggaacaataatacaataatcaataaatgacccatcgtaataattatacgattaagtgctaaacaacatgaatacatgatgtccataatataaaaaatatagctacatgcgacgataaaagccttagactaaaatatctatgttttttttgagaattacacagtacaacgcagacactcacaacacacgcgcactcacccctatgaacacacgcacacaaaccctacccctatgagcatattcgaagattgggctggcaaatcctggagagattgacagagttaccacaggagccgggtacgtcgcctaccactgaaaggacaacaccgttaaatcatggaaagttcgaccactgaaaggacaacaccgttaaatcatggaaaattcgctcccatggggagtcgaacccaggacctcaggtgctactgaagctcttttaaccactaggctacatgcccttttgtctaaaaaatctatgttaattgatgaatttgggcattggatataccaacttatgttatatgcaatagatagagtggttatatatgttgataatttcggattatctgacaaacggcttatcggataatccgacaaaaatgtcggataatccgcatccgccatattttagagataccatatccgcatccgcatccgcctcatactatcctcattcgtatgcgacagatttctaaaaacccataccatatcctcgttttggagcggagcggatgggatattatccgatccgtttttacagacggatctcttaagaggtccgcctgcaaaaataaaggtatttttgcaggcagatctctcctacgaaaatctattttcgcaggcggacgataatctcgcccacggttgtcattttcataggcagccatttagctctgagaggcctacccgcatggaaaaaaatgtcatcgtctataaaaatggttttttaagtagtgtctaactgttcaaattacataaaatgatatagtcttcctctatttttaatatataacgtgattgactttttaatatatgtttgaccattcgtcttattaaaaaaatatgtaattattatttattttgttgtgacttgatttattatcaaatgttatttgggcgtaacttttttataaaaatttaccaaaaagttaacgatgtcatatatatatatatatatatatatatatacacacacacacacacacacacacacacacataaaaaacgaaggtagtactaaagtttttttttatgagagttcatcgatagatgtacagcaaaatcgtgttggatatatggtttcggtcggtacataagtttatgacaaacaaatggtgaaggcctaagatccataggagtagtgggctgctctcctccttccagcccagcaaagaaagaggttcggcgcagcatcacggtcgtcggctgccccaaccaggcccagtggaagccaccgccgccgccggagaagacgagtcccgggcgggcgcaggacatggcgccggcgtgttcaccgtgggcgtcgccggcgatcgagttctctgtcccggctatctttgcgcgccacccactggtagtgctcttgccgcttgctcaccgccggcgtgctccggaatgacacgtcgtgtttgtaacaggcccagtgtggatagacataggtaaattcactttgattgaacgaacttttatagcagactcccactcatgaggcccagtttagtttccaaaaagtattttctaaaaacatcacatcaaatctttaaacacatgtatagagcattaactatagataaaaacaaaaaactaattgcacagtttgcatggaaatcgcaagatggatcttttgagcctaattagtccatgattaaccataagtgctatagtagcccacatgtattaatgatggattaattaggctcaaaagatccatctcgcggtttccagacgagttatgaaattagcctttttatttgtatccgaaaaccccttccaacatccgatcaaacgtccgatgtaataccaaaaaatttctttccgcaaagtaaacagggcctaaatttagcccatgtgcaggccaggccaccagcccaccactcccactgttgttcgttcgttcctcgcgctatcagagcaataagtttaatagtataacccaatgttagttccaattcatcaatctaatagtctattaatgcaatagttggttactatactattaatatattaatatatgatcccatctatcatacacacattgcgttttgaagtctgtgctatagctggatacagatctatagcccgctactcttctgtcttttcttttatctttttaaaatatatttatagccctgctattgtacgtgctcttttatctttttaaaacatatttatagccctactattatacgtgctcttttatctttttaaaaaatatttatagccctgctattctacgtgctcttaccgccgtgaatgcgagccctgcgacgcatggcgacaacacgcgcatctctcaccgatcccctccttccctctcccgcggcacgcgcgccaggtgaaaagcgccccgcgcgagtcgctgacgcatgggccagagcgtacgtgggccccgcgtgtcggtgtgatcggcgggggcgggaacggccgcggcgcctccacgtagcgggcctccgcgcctttggatggcgccccgcgctgcatggtctcgcgggtggccacgtggaggcgttcgggggcgtcggatcttgccgggttcgacggctgggatcgcgcggcttaaaacccaaaccccacggacgcaataaatgccgtcgctggaggatgggtttccatgtaacccctctatctctcgtacaatcatcaaatagccccttttccctctccacttagacaacgtaaggactatattgtaaaacagtaagggtacatatgtagagtacttgtatttttaagggggttttttgtgaaatatacatgtggagttaaagccaaaaagctctcatggtccatgcttcacgcaagcagcaaggacgagaggagaggacagagtggggaagctgaagctgaagcaagcggaggagtgcacgcgaatccctcctcgccggcgagaatgcaggagcaggcgacgagctcgcggccgtccagctccgagaggtcgtccagctccggcggccaccacatggagatcaaggaaggcaaggaagcgccacttcgatcccttctccttccctttcttgatttccattttactgttcctctttcgggttcggattctttggttgattttcattttacttctgtttcttggaagagaaattttttttggttcttgtgtggtatgggagattgatttggttttgcaggaatggagagcgacgaggagatagggagagtgccggagctggggctggagccgggcggcgcttcgacgtcggggagggcggccggcggcggcggcggcggggcggagcgcgcgcagtcgtcgacggcgcaggccagcgcgcgccgccgcgggcgcagccccgcggataaggagcacaagcgcctcaaaaggtgcccgcctttatatttactagagtacttttgatagttcttccctttgtgtttatgtgtacaaatacagttgttgttttgcttataattgttcatgagattaaaccaaaagggctgtgatcattggagtaagttgtgtatggctatctatatttaatacttagtggttagaattagatcatattggattcgatggagattaagatatgaaaatagttaatgcttgttgagcttgggctcatgcatggtttaagattaaacaatatggagcaagaacaccgaatttgcgatgataatcgatcgaaacggcgagatcttggagtatgatgtgttgattggagtttggagtttaggagtgatgaagaaaagaggggttgaatttaaatcctgatgaaatcgatggggttaggttacatatctctgtaaagcattgctcctagctagctagctttcatggtgagttggacgcagtgtacgatcgatgtcatgtgtcgcatgcgtgctcatctagatagttaggttgggaaacaagtggatgggaagagaacagttgtgggcacatcatatatgatactattgatatctcactataaattgccccccccccccaacctatctcattcagtgttgcaaatcgcaatgcatgctatgcagccaattttgagcttttgatatcaatgggagtagtgttatattcttgtaaaaaggaaaggagtgtcacgttatgtttgcatcagtataatataatgtgcttccattatatcaacagtttgttaccacatgaaacttgagttagttatctcagtaacatcaacagtatgactgcacactgatacacttatataaacacataatattgtaatggacaaatatattattttagctaagactatactatgttaacctgccgctgtttattgtaacaatttgtttgaattaacataataaacttcttgttttgccatcccaaaggcaggtgacagctttctttgtgtcgtatttgaactctatttttgaattggttgtcataataatatgaattgtatgatagcttagagtatataatctatttttttcaattgtttggtcctgcaattgtaccacgagagtatggccttttgatttgcctactgtaacttctttgaaattcaatacaatgatatacaaatcttttgcatattcctgaaaaaatctattgtaaaaattgtcaatctccaaatttctattctttggtcaactcgttttaaattaatacatttgtgtacattttagtttagaataaagatatctgtgtacattgttagtaatgtaggattggtgtcaaatatggtttgcttattgtgtctataaatattaaggttgctgaggaaccgggtatcagcgcagcaggcaagggagagaaagaaggcatacttgaatgatcttgaggtgaaggtgaaggacttggagaagaagaactcagagttggaagaaagattctccaccctacagaatgagaaccagatgctcagacaggtaaaattcctaattctaatgcatctttttcgtgtggtacaagttttacaagtttaaatagttgtttcctgtttatttttcttcttttaagcaccatagaaaatgattcctcagatgaaaaatgttccggattccttgtgcagatactgaagaatacaactgtgagcagaagagggccaggtagcactgctagtggagagggtcaatagaggagaagatgacagcaagtagtagaacactttatgctcgaatatgcttctgggtttgaattgatcctagaacttggaacttaatttggttggattaacccagggaaaaaaagagaacttttacggtacattcttcttgaagtatatactaccagtatatttgatctaacggtgtaaattcatctgatatttctcccaattattctgcagtataaattgaatagggtatatttatctttttatctatttgcgtgaggggtaattttgtaaattcgcgtttctcacctagtcagatctggccttttgcgcccagtcaaagcgattttttcttgaagccgcgcgcatgggcgaccgccgtcgctgactgcctctgcgagcacgccgcgccgcgcggccgtcgacaaccacaatcggcgtcgccgccatcgggaatcgattcgatttccttccccctttcttcacccaaaacctagttcttctgaaaatccccaaatcgggtctgcgggaggcggcaccagcgggctgcggaggtttgcgggaggcggagggcgacgagaagtttgtcctcaacgggttcaccgccgcgaatctcagcttcgatggcatggcgacggtgaccccgaacgggctgctcatgttgaccaacggcacgaaccagctcaagggccacgccttcttcccggcgctgctccagttccacaggacgcccaacagcatggcgatgcagtccttctccacggccttcgtcatcggcatcatcagcgcgttcgaggaccagggcagcggcagcccggcggcggcaggtggcagcggcagggcggcataattagcataactaatgtaattagcatggttacataccaatataactaatgtatgaacaattctgtgactactatccattcaactcccacgttctagtcttccagagaaggccttgaaagaagaatgttcagacagcacaattttttggagcaatgcagtatagagttgggctgaaataaacagctgttacaagctcaaattacaaagcaaaaaattgctcaaattacgtggatcacgagatccagaaaaaaaagaaacgaaggaattaaaattcacccgatggaaataaatctctattttaaatgactaaacaacccttttaagatttttaacaaataccaaatctaccctattatatactggtagtatatacttacattacaatgtactgtaaaagttctcggaaagaaactggggtaattaaatgggaaatatactaggttgtgcagatggtgataatataccaaactacctgatgtttaggactatttatgttacataatccaatgttcagaattccgaaatgtagtgttcgatttgcgttacatttacatgacatttttgtgacgaatgcatgcacagtctacactgaacttgatttcccttgcttctgcacagttttgtgagttcagtaattgtcaatctctgtttcattttcacctttgctttggttgcatttttcacccaggctgatgcgtactagtgctcacagttagcagaacccatgaatttccatgcaattatcgcgattaacacacgaaatttgccggttttttcacgcatttaacgtcgttttaggctttgataaatccaaagtcatgctggaacagtaaaataaacatcaacggtcaagtgtcaatttaaccaggccccctttgaaaaggtctctcgtgcatatgccaaaatagatctgaaccactcacagatgtgtcgacacattttaggatgattttagtcagatttcttcttcattttaatcgataggcatgtgttgacacgtcttgggatgattttagtcaaatttcttacgatgtgaacatcactaaaccgtgcatgttgtttttttttttaccgtcctccctgactctcacaaattttcactcccttaatttcaaagtgaatcaacttctggctatgtatctgatctatccaactttttaaaaaaaaacttctgaatacaaatctaatctatctacctgaaaaataaattaacttaaattttgcacaatcagaaccccacacatctggtgttggcaggtgcagccctgtgacctgatacctctttcatccatccattcctccccttgttttgatcccaaggaactcaagctgatggcgtgtgcttgttctagatcagttacaattttgacattaatctcttggtgttcttctctttgtctgcttctgccacctttgaaaggttccgtcatcatgcaccagtttctttgctaaatgttctttgctttgccatcatcatgcagaaggggtcaatcatgcataaccagaaagtgatgctactggctaggaaaattgcaatcaaggcctctaataataaagaaatcaacttgcaagaacagcagcagtcaaacgtacagacagcaacaagaacaaagaaactgtcactacctagaggggagtagaagctaccttaaaaaaaaagtcacatttgaataacagaaaggagaagagagcagcaaagcatgttgttatggtgtgcataaaaaaaattaaaaaaataacccaggggattatcctgggagagagaaaatttaacgaagcaaacaaacaaaggtggttgacctgtgaagcaagagaaagggatgaagatttgtccatggccgtgctgtaacctgagactgtgcagtgggccccacatgtcaggccccaggcttttaatgtgagaggtggtctccatttattagtgccaccaccttctcatctgatgtcttctccttgacccttcttcttcttcttcttcctcctcctgatgatcaaccagcataaaggagaggcttctggttgggaggttttgcagttctcttaccctcttctgttcatgaatcatgtgcaatgggtgttggagctgtagaagcatggtgatgattttggtgtgattatgtatatatatatctgggtgattggtggtgagtagttgttcttgctgctgtggtttcttgatactttgcttcagggacaggccatggacagaaggaaccaagctcctccggtgagtagtcttactttcttttttttttcttctctgtatttgttttgtgtttttctccatgaaattgttgcatgtttctgcatggatgtgccatcctaggattgatttttttggtcagaaattttagagggtttcatggctctgtgttggactgaatttttcagcttgcttggctggtgtttttgtgttagaagaatagaagatacaccatgccttgtgctcatcagtgtgaactgtgaagttgttttggttgatcagttcacatagagttcctcagagcactgcatattgaaagaacctgaactgtttgtggataggaaaatccatttcatacttcaaattgtaaattaattaggtcaacaaattactgggtttgcatgattgtatcaaagcaactttctttttcttcaagggaaaatctcttcaattagccgtgcaaactccaaaattagcaggatggtaacactagatttgggaatagttgggagtgctaatcatttattagaaggttagaaattgaaacaacaagagacatggtcccccacagggtagttcaactgtttctgtaagtagctgttgtttcatgacaccattgtctgtcttatgttcttgtctcatcattctaggtatcattcaccaattagcagtcacttttaagaaataaaaaccaggatttttcatccccgaaaataaccaaaattatgacacatacgcatccattgcctgaaaaacattttgcctacctcacattgttttttttctttccaaacacgcaaaagattatacgcgacattgttgcactacaaatttgcatgcaaaattgcaatatttgtgtagctacccgaactccttttcttgtcttgtgaagttgtgattgcaaaatgtaaattatgtaaacaaattaccaggtttgtatgactgtaccaaaaccaaaaaaaaaaaaaatccccaaatggcacaaaaattataacacacacatccattgtgtgaaaaacattttgcctacctcacattgttttttttttctttttcgaacacgcagaagatttacgcggcatttttgcactacaaacttgcatacaaaatgcaaaattgtgatattttgttcagctacctgaaactctcttttgcttgtgttgtgattggatataggttgatagctcagcatgcttgtgcagagtggagagatcggtcgccggcgccgccgcggcgaggctgatgccgagggcgaaggcgtgcgcgcagccgagcctcagggcgtccatccacccgctcaagcccaagagatcgccggggcgcgaccaccgcggcggcggcggcgccggtggcggcggcggccggcagtgcccgctcatcccgggtctccccgacgacctcgccgtggcgtgcctcatccgcgtgccgcgaggtgatcactggaagctgaggctggtgtgcaggaggtggtcccggctgctcgccggcaactacttctacggcctccggcggcggctgggcctcgccgagcagtgggtgtacgccgtcaagcgcgacggcgaggggcgcgtgtcgtgggacgtgctcgacccggcgcggctggcgtggcgcgcgctgccgcccgttccgggggagtacgccggcgccgccgggttcggctgcgccgtgctcggcggctgccacctctacctgctcggcggcagcgacccgcgccgggggccgatgcggcgggtggtgttctacagcgcccggagcaaccggtggcaccgcgcgccggacatgctgcggcgccggcacggcttcgggtgctgcgtgatgggcaaccgcctgtacgtcgccggcggcgagggttgcggcgttggcggcggtggtggtggtggcctcaggtcggtggaggtgttcgacccggccaagaaccggtggtcgttcgtgtccgacatggcggcgtcgctgatgccgttcgtcagcgcggtgcacggcgggaggtggtacgtgaaggggctgggcgcgcagcggcaggtgatgagccaggtgtactcgccggaggcggacgcgtggtcggcggcgcacgagctcgatgccatggtgaccgggtggaggagcccgagcgcgtcgctcggcggccgcctctacgccgccgactgcaaggacgggtgccgcctgcgcgcctacgacgaggccgccggcgcgtggagcggccgcgtcgacggcgggcagcacgcggggagctcccacgcggtggaggcggccgccatggtcgccctccacgggaagctctgcgtcgtccggaacgacatgagcgtctccgtcgtcgacgtcgccgccgcaagcccgcggtgggagacggtcgtcggcaaggggcagatgaaggcgttcgtcgcgaatctcctctccgccatcgccggcggccgcggccgcgccaagaaccgcgtcctccattgccaagtcctcgaggcctaagcttcacattcacacagtgatcgattctgctgctctcatcaacgttcagaaatcagatttttcttttttttcgtgttctctgcacattctattgtggcaaatacatctgagctgaagaactccaaagcatgatccgattaatgtacagtattttttctctttttttttggggtttcttgaactttgatcggtgtacagttcgtacagaaatgggagttgtccggtgaaataatcatgaaaagatctgggtttcttttgggtcgttgttgctgaatcgtcaaggaaagactaggcaagtttgtgaatgtgctcctgacctgacaagatgttccaagtcagttgcagtccatgaccacgcagtgaatgcgactgacacatgacgaggaagaaactcttctatggatgatttttcgtaggatcatatgatatcatatcaccgtcgacgtctcgacggctagtattctagaagtgcgaaaatgactgcacgaaatgttctaaccattaacaaaaatactcccttgggggatgatatgatggtgaaatcgtgggtgcatgactccaccaactaggatttaaatccgtgtgttagcggataggggtgaaaatggtcacggaaattcccaatcgaccgagcgccgttttcgaccattaccctttttggctatatataaattttgttttttctaatttctttctaaatcatagtgatgtcgatattgagtagtttaaatgataattatgatcaattaccggttaaatcaaatgtcgtttccaaagagatggtacgattccgaccattttcacccctaagtgcatatgcggagtatgagtgtaattttgcatgtgcagtggtgtgtatccgtcatgtaattaaaaaaaatactccctcggattttaaatttgagagaatgtcaactgctagtaccaccatacaaattataagagcttttttttttaagcacagacgtaaaatgcttgtataaacgcacacgcgctcttccctataaacaagaactatattaattttacagtctagaaacctaaaagttgtttcaattttcttgtgtaatccaaataagtttcgattttgctatatatttatcgataaattctgtcctaaatattacagtataatcgtagtgtaacttttatacaattacaccgtgacttttatgtaactttcgtgtgattttgaatagttggatttgcttcatgattcgtgcaaataaggaagagaaaatcacaacatgcatataggtgaagggattcggtcccacgacctccgattcgtggaaatagcatgataccgttgggatttttaaaaattgcatacaagtaatattctagttacatgtactgtatttatatacattgttgggttctcatctatccttattagagcaggtacaatagtagactataagccatctataaacacatttcgagaagataaaagatgagagagataagcaacgggctacagatttatagtcagttgcagcacggactcaagatgtatgtgtgtatgacagatggaaccagatattaattatgtagtatatatttatatgtaactattatatgaattggctattaaatcgcctgcagatgatttggagcccatggtaggctatactattaaacttgctcttatctcaggcacaatatcttcccagcacaccaactcattcggcccatttgacggaggagcggaagtgaacaaccgcgccacgccatggggcgaagcgagtcggcgtccgcaggatttccctctccgcccgtgccctaaaccgctcgccgccggcgacgttgcgcccccgaccgcgagtgggccggcggcgatgtccggccccgtcgttcccctcgcctggacggctcaagggccctgcgagccctcccctggctctggcccgctccccgtttccgccgccgctagcgatccgccggcgccctcctcgtcggtgcccgccggcggtcgtgagccctccgctagcgggctgccccccgcggtgactcctcagcttggggtaatgacctttggtttggcttgattttgatgtcctcttgatattgctcattgttcatttgaggtatagcagtagaatgattttgcttgcagcaattatgtactttctccgtttcatattgtaagactttctagcattgttcacgttcatataaatcgtggacaatgctagaaagtcttatattgtgaaacggatgaagtattttattaaaaaaataagtggacacgtgtacctggatatttctatgttcaatatacacgaatttgatctttcggtgtcaccaaaccaaattattccttgacagtttgaacattgttagtatttttgttgtccctaaagtgaacatctttcttatttttattttaccatccatgttgtgtaggatcatgatcaaggtggtttacctaactgtgtgccaaaagtggggatgacctttaattcagagaacgaagcttatgatttctacaactcctatgctagaaatgttgggtttagtatccggaagaaccacgcaaatactagggcggatgggagtctttgctccaaatatttcctgtgcagcaatgaagggcagccggtggcaagcactacccagccggggcggaagaaacgttcttcaacaagatctgattgcaaggctcgtcttcagttctatatttcccgagaaggtatctggacagtgcagaaggttgagctcgatcataagcactatctcgtaagtcctgataagtcacacatgttaaggtcccagcgccgtttgacaccgtcatatcaacagatagtgaatgaaatgcggcaagaaggtattacagcagctgatatgcaaagagtatttcggcaatggtccaggggagctgaaaatgtgcatcttctgaagaaagatactcagagaaagtacctccaaccaagttatgcacagaaattgcttgagtatttgaagaacaaacaaacagaaaatccttcatttttttatgcagttcagctgaatgatgatggtcgaatagcaaacttcttctggacagattgtcaagctattgtggattatgcttgttttggtgatgtcgtgtcttttgatacaacatttgaaacaaacaagtttgaaatgccgtttgctccatttgtggggactaaccatcacaaacaacccattttgtttggagcttcgctgatatatgatgaatcttcagagtctttcaattggctgtttcaaaccttccttacggcaatgtctgggaagcaaccggcaacaattttcacagatccctctgctgaaataataaagtctgttaggttagtgtttccaaactcaagtcaccgcctgtgtttgcggcatatctgtcataatgctgttaagcatttgaatcacgtaatttgcaaccatccagaatttctatctgattttaagagacgtatctatgaagaaaggtctgtaacgttctttgacttgaagtggaaggaattggttaacgcatataatctagacggcaatgattggatgaataatttatatgcaatgcgtgaaaagtgggctgctgtgtattcccgtgactcattttacgctgacatgatgacaatccaaaatgctgaaggcacaagtgatgcattgaagaattttcggaggaaactctgccttccagaattcttagaggagtatgagaagtgcataactagtttccgccaaaatgaactagaagcagattataattcccgtcaaaccagtccggttccctatgttcctgatttgcctatgttgaagacggctgctgagtcctatacaaggaatttgtattcgcattttgaagaagaattcaaaaaattgttcactctgtcttgttcgttgctatcacaagacagaacaatcagtacttacaaattgacacctttaaattctgaagaagaagcatatgttgtttttaattctgaggatacaacagtatcatgttcttgcaggatgtatgagtgcacaggtatgctaccatattggttatgtttccaaaacgtaaaagtttgattttcttgctataatcggagattgcatgtttttgtaggtatgctatgcaagcacgcgctgcgagtccttaactacagcaatatttttacattcccctcacactatgtttacaaaaggtggacaaaatatgcaaaagccggactatttggctgcagaaacaattcccaaagcggcaatggaagttcgatgttaagatgtgcgcgtatatctcaaaagatgcactcagttgctctaagatattcgatgtcagaaaaggcgcttcagtttttggaaagtggggtagataagttgacatgtgaagtagaaaatttacttagtcacataaacttaaatggaaatggaaatgataccggtcaatcttctggtttttgcaatggtgcaatggcagaaagtttaggccattcagaatcaatgtacagcgaaggggcctaaccgcctaacctgcaaaaatactagaaaaaagtgttctcaaggaggaaaatggaaatgcactgctagaaggagaggcacctacaatcaactgttattttctgtttatgttaaattcaaatctcagttcttaactgtgtgaggcactactccaaaaaggaaaaaaaattcaaagagaatcatgttggtctcatcatagatagagggcatccaattctctagttgctgtagttctcttaactttttctcctctttgttcagggatgaatcatacataattctgggcatatcatcagctctccatctacttggagttaacttcctaccacttccgtcttcgtccaaagcgaggcagagtccataaaactctagttcggtgatttgccgatgttgtttcgccatctgcgtttgaactgctgtgcttaatttggtgatccgctagaaatgcactcaaaatatagcagcgtaggatagttctaaaaatgtccgatatgttatattttaggacgaagagtacatgtaaggaacaagtgcgtaggagcagtaacttgtttaggagtagctctgcacaatgaaaatagtattctggttctctgttgcctttctgcctatatacagtactccctcggttttttaataggtgatgtcattgagttttaaacatacgtttcagtttcatcattcgttttacttaaaaattttatgcaaatcatgcttaaaagactttaagtgataaaacaactcacaacaaaataaattgtaattacgtaaattttttgaataccacaaatggtcaaacatgtgacttttgaaaaaagtcaacggtgtcatttattaaaaaaatctgagagagtatttatttatcttccaaaatgtgcaatgtgttagtttcgaattgagatccactgcagtcctaactgtggctgcgagttaggaactgcacatcatctcagtcatccatttttccagtgaacggtctagatctgatgctatagtgctgctgctacagtagttctgcagtttttttcagatgtgaacagtactttgtagattctagacccttggatttgcatcaaaagttcctagtgtgactgctcacactaggtgttgcaccggatccaaatccgttagtttctgttggctatcaaggtcgctgttgaccagagtctgccgctgcgtgccctcagcctaggtgcagctcgcgccgttggatcacttggtcgaagcgtgtccgtgtgccacgtcatcgtgtacaccacaccacaccagcttcgagctctgattggttggctgacgtgtccgtctccacgcctatttattcgctcttcccgcgcgcgtcccgcccggcgacggcgacctcaccggcgtcgacgtcaccggccgacgacgacgagacttcagcgatgaccaccgcccagccactccagcacgagcatgacccgtccccgccggagccggacgccgacgccgacgacgaggaggaggagtcgcgggtgtggtcccagatcaaggccgaggcgcgccgcgacgccgacggcgagccggcgctggcgtcgttcgtgtacgccaccgtgctctcccaccccaccctcgccggctccctcgccttccacctcgccaacaagctcgcctcctcctccacgctgctctcctccacgctcctctacgacctcttcgccgccgcccacgccgcgcgccccgacctccgcgccgccgccgccgccgacctcctagccgcgggcgcccgcgacccggcctgcgcgggccgcctctcccactgcctcctcgactacaagggcttcctcgccgtccaggcccaccgcgtcgcgcacgcgctctgggcgcagggccgccgcgccctggcgctcgcgctccagtcccgcgtcgccgaggtcttcgccgtcgacatccacccggccgccgccgtggggagcggcgtcctcctggaccacgccaccggggtggtcatcggcgagaccgccgtcgtcggcgacggcgtgtccatcctccaccacgtcacgctgggcgggaccggcgaggccgtcggcgaccggcaccccaaggtcggcgacggcgtgctcatcggcgccggcgcgaccatcctcgggaacgtcaggatcggcgccggcgccaagatcggggccgggtcgctggtgctcgccgacgtgccgccgggggccacggcggtggggaacccggcgaggctgctgctcggcggggaccagcgcggcggcgcgccggccggtgaatccatggaccatgcctccttcatgctggagtggtcggattacaccatttgagtaggagtggcatcgtacggactacatttgtactactccttagccatgtgtttgtacttgcctgtaaatgcaagtgtgtaagcagagttagcttgtaaccacctgaatttcgtcgaattttaccaattctgctgaatcccatcgaattataccaatacgcgccctgttgataaggtcgaaaaccgagcagttactgtcggttttgtgaaccttttgcttccgacacatgtactgaaaattcacctgtaatttcgcaaaagttccttaaaatttcggcatatgtgcttttgatttttagactttcttttacgagtagggccttctgtgaatccggcctgtaaaaccgggcctagttttcacatcggaagctgggcctatgctaaggcctggcctacagatccagcttcatttctcagtctgacactgggccccacctgccagtgtctgcggcttccacggactgagctgcctcgcccgcctccgagcagttggggaagagaaccgaagcacaaaccctagcggcggcgcagctcagccggggtttgcggaggaaggggaggggcaccgcccgcgatgctcgcggcgtcggctcggcgggtggcggccgccgccgccgcgtcgtcctcccattccaggctcgccaaccagctcgcccacgcgctgaatccgcaggtgaggctgggcgtcaaatggcacggcttggatttggccatcttttttggtttcaatctcatctcccccaatcgggaatgctgcaaaacctagcggggtttttttttttttggcgttgtagctcgggcgttcggtgatggatttgacgatataatgggtgatttttttctgtacgtgattatgctttgtagaggtggatccatgaccggaacaagaaggcgatggagttggtggccaaggggtggagcgccctgcaggaggttgatcgcgtcatcgactacgccgaccgcaacgacaagcgcctgatcccacttctcagggtacagctctggatgattcgtctttgtcatttgctccatttattcacgatagtctaagtgccctagaattaagccctaagtctaggaaatgaaactttgtgttgcagtgttgaatggtacttaaccagctaacccgattgtttggacctttattatttccaatcgttcatttgccaatgtgtaccaagtaccaattggttcttgccattgccaattgaagtctggagatattctgtgccgaactgtcttgctaatctttacaagttgcacaccacctgcatatagtgtagtgcgtcagctattggtttggaccaatgttttttttttacgttctgttgtgtaaatcttctcgatgctatgcattagggtgcaaaggaaaattttgagctggctctggagatcgacaatatgaacactcatgcgagattatggcttgccaagatgcatttcaagtatcatgttcctggagcttgtaaggccatgtgggttaactttcacttctggcaatgttagtattgcacagctttctttgctattatgtcttacaagttgcatcgtggtcattttcttatttcctattcattcttattccaagaacctgcaagcacattgcaaaagctagcttagtcactgcttctattgttgttttgaggtaattgaagaattatttttaagtattgttgttttgaggtaattgaagaattatttttaagtttaggtagttccttccagtggcgggtttaaaattttatcatgagcctgggcaagactaacaacaaatgaagtatatacaagtctatataattcatataccattttagcgtgagcatttgcagtataagtttgtgttaagcatgttttctgctgtgctgtttcttcatacggccttgccagtgactaagcaaggttattaggcattaatcaattggtgaattgctgcatgctcctggtggagcctaggccatttgcccatggtagccggccctggctccgccactgcttccttctataagagcccacacaaattgaacatgtcagtaggtgttgttttctttttttatgtaatctgtaggagttgatatggctcccaaagaaaagatgctgacatgtattttccgtttaatgtgtttctcatttactcattattgggtgcacatccaattgactgcatcaaagttcactaccacagcagttaaagctggcaaaaactgggttacaaaatatttgagattagcatcttgacttaacaaaaatagttagtaagtgtgctgcatggatcagctcaggtaggtagttaagttctagaggaattctctctctaggacttctcgttgaacattatttaatttgctgcaagcacagaacttactgttgatagatttgcacacgtatctttcgatagtcaattctctcttcacttttcatgggtgcagtggtgctgctctgttggttgaagctgcaaacatgggtgatccagatgcacagtatgaacttggatgccatttgagaattgaggttttcatgctctgttcgcacttttcccttccacttaattgattaaatcatgcagttttatgttatgctattgagcaattcattatacagattgattcacacagacattgcattactttaattgatggtttacctttgtttctcttgtagaatgactacgttcactctgaccaacaggctttttattacattgagaaagctgttgaccaggtttgcttctctgaattttgaacacatctttccatgtatgcttcttgctgaatcttctcaattacacttaatgcttgattgcagttgcaccctggtgctttgtatcttctaggtgctgtatatttaactggagactgtgttaagagggatatagcttcagcaatgtggtgtttccacagagcatcagaaaaggtagggatttctcttggacttgcttgtgaatagaatatcaactcaaacttgattttctttgttctgctcaccacctgcagggacactctggagctgcaattgcatatggatcacttctattaaaaggtttgtacaaaagtaaccctctagtgcgtcatgactaaggagcaaatcacatataactatttgttgtggaatattggtcatttggctctctaaagctggcggtgaagctatgtatcccaccattaaaaacttgttagctgattctatgaaagttaatgttaatagtattatcccgaagctcattcattttgtgattgttcaggtgctgaagtgcctgaggttattaccaggttcaactcaggtaagagtccatcaactggaaagatgcgaaaaaggcccatacagcaggatccagtgaagctagcaaaggagcagtttcaaattgcagctgaagctggatgtgatctcggtttgcgatggctgaagaggcttggggattatgaaaagcagcaagaacaaccaaagcaaatccagcaatgaccaccttcgaaatgatttgcttcacttcggcattgctctatgttgacatgcgtttgtcatacacactatacaggtagaacgtcagattctcaactgtaatcatgtaattgaatccaagcactatgtaaattttgatatctggcccaactccttgaaaaggtagacttgagttgatcccctttctctacaaaggatttttatcgtaccagtccttatagagttcgttactttgttttttcactttttctccccaactgtctactggtataacctgttacatgtcccttaattattccccggtgtgtcagaaaagtgtttaaattcaagcatacatgaaaaaactggactttttccgtttgtcaagtactgtcacggctaaggactattatgaatcctttttatctctaaggattatcctgagaaacccccaaaattaggcctctttgtaatgtaggaccttttaaaatcttacggaaattgagatgattcctattaaaacccagtaaatattttgcggtcggaaggagctcttatatcatctggttctcctattttagcctggtgaaacttagagcatctctaacagcctcttcatcctactcaccaaaccaaaatttagcaacttgaatgaaaattacactccaacaacatctccatcccactctctaagccatccagatgatcaaacttcttccttcacatgccaaacttggctagcctatttgctatccatgggtcccaccacctcttattcacttttccttcgttcgggagtagcgtgaaacttaggccatctccaacatcctctccatcccactctccaaatcaaaattttagcaactttgaacaaaaattacactccaacggcatctccatcccactccaagccatccgatgatcgacttcttccttcacttgccaaacttggccatcctacttgccatccatgggtcccaccacctcctattcatttttccttcattcgggagcagcgtggccgagggggagagccagtgtccggtagcagaagctcgatgatggtgagatctccaacgacccgatggaggcaagggacccggtccactcagactggcaagccaacagcgagatctctagaggcggcggtgccccttaggagaagtcggagaagaagcagcacgccctacaggaccaccattgctgttcgtcggcctatcgttgccactgcccttgcggacacgagcaggaggtctcgcgttaaccattcgcccgaaaccgcgtcgtcatcgtcctcccgaatccacgtcgccgccattcgcccgaatccgcgccatcgcttcgtcactagcccatccacgtgcggcctccaccgcctatgcccgagacaatgaggacggtggcagtgacctccactcccccacccccgcacggcctccaccaccaccagccctgcgcggattcagccggtggtgcgacagagaaaaggaagagagagaggaggggtgaaggagaaggggtgaaatagtaaagaggctggcaggtgggacccacttttagtttggatagtgtaatagaggttgttggggtgaaatgtaaattagactaccatttggtttgtcaaactgaccgaataggcatttggagaatgagatttgaagatgctcttagttggcccaatatgtcatttacacaagacaataagcactcaattttttgatataaaaagagagtatgcgctcctcattgtttgcttgttgtcttactaatgtcatttcaagattttatcgtagttttatctttctttaaacctccaataacataaatataaattttgtgcccataaactatggcttattaactgtagatcaaacaattggaccatattttaaagatgttctagttgtgcacttgctaataaaaagaaatatactctaacgtagatccattgtttcgggagatatttgattcctggtttgagaaatacaaggtgttatatgcaacttgcaatcattggccttagacccattacatgaaaaatcttgatgttttggcctccacgtagttactttggactgttttacccactggagttgaatccaacacatgagccataaccacacgggataagaatctatactaactagttcttactacttattcttttatttgaccctttattgtctttttttattattatattgccttttcctcctctttcattctagttatcattcttctttctttaacctttaacttgaaagactcctctttatcacaaatcatcaagcagtcatgatattttagggaggacatagtgggagactttgttgtagatgaataggagcattaatgggcagtacaatgatgtggtggagggatggatgctgatgtaatatacttgcatgttaaactttataagttagtgagtatcaattttacagtaagatatgattagtggtgccacgtaaatgtatttaatatgcgtaaagatatacacttgaattatataagagtgtcgacaagactaaaaataatcacaaatatagcattactactctattaaaaaataaatgaggttagattttgggacgggggggggggggggggggggg

SEQ ID NO: 47324 - DNA, 5353 bp, Oryza sativa
ctaagctacttcattagtgattagttgaaatgtagatcagaattaccttttggttatagaaacacctgcaaattggtgggtgattgctaatttataactgttcgtatttttagaggtctttcaaatgtaggaattttgcaggcttttctattatggaaaccaactagcttgagaagtatagatagatagatagatagtgtctgtattactaaaagcatcaaattattgaccaatggatcagtattttcttttataacagtagaaattcttggggttactctgcctaggcttcccggatggaataatgtgcccaatcgtcagtatttttgttcttaacaagcaaaatcatagcaattttttgtttctgtaaaaaaatgatctgtgttgatcctttgaccaaatccgaaactaccaatgtcatgttcaccattatttttttttttgccctcccttgtagcttcttgttgcaatttacgattgtctggtctacttgaataaggcaaagtgataagttacttatgctatggcatgtttttggcaccgaaggattgcaattcacattgattttagtataccatttatatataaaaaagccttaatgttggcgtgaaacattttctgtattttaatgtttcggacaaagtgttgacgtgaacttggttcgttgtgctttcccttttctcccccttggacttatgctttgttcatatacatgaattcctttatgctctccttacctgttaactttctccctgacagctattgcaactgtggtgactgttgctgaaattctgaaaaataatggccttgctgtcgagaagagtgagtcttgtttctcataattgataacttgattgcatcctccttctgttctcgtagcttactccaaaatttgtgcagagattatgacatctactgttgacgtcaaagatgattcgaggagtcgccctatgcagaaagccaaggttaatgttcttcccatgtttaacgtagatctttactttttccagatgtataagtgagcgtttcctgaaatcctatgattgtcttggccagattgaaatagtgctgggcaagacggacaaatttgacgaactgatggcagcagccgcggaagagagggaggccgcggcagcggaggctgaggccgaggagcaaagctaatattagaagccaaaaagcttcctgttgtagctttaattttagtattctgctgctaggtgttgtatttggaactccttgatacatcaagggcttgtgtaatcaattagtggcacagcttatttggtgtgcttttacttgattggttaagttttgatgccaacttatgacagtgaaggtgtatgagtacggtgctcatcttgatttgccccaatttacatttggaagatgtctaattgctttaaaagtcttgttctttgtgtagttgatggatgcttctctccatcatgcgctaaaagtgaaatcaaactggaaatacagggatcagatgcatcacagctgcatctccagatagtgaaatcatgtgctgggaacgaaacttagggccctgtttgattcagtttagaattattataatctggattattatgagtaagatgaaactgtaagctgaaacaaaccagtagattattatgctagattattataatctataagccatattactataatataataatctcctctagagatgctttttctagattattgagtggctaaagacccactacccttatatgcctctaataatccagaaaaataaacaactcgtagcttattttatgtcagcttattataatccagcttagagtaatctagatttaataatctagattataataatcttaaattgaaacaaacaggtcttaagctgaaacaaacagggccttaattcatcagacacataaacccatctgcaaatacttaaattaaattgaaacatttggtagagaaatccaaatcacaacaaacccatctccaaatgcagaataccatccaatacatcgcaggtacatcggtctaaaaagttgaaatctattatataattaaaggaatagaaaaaggagcctccacattcgctctcatggcctagaaattctcacattaatcggagaaaaagaaaaagcagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaattcggaattaaaaataaggaatattagaagtagagtatagagtccatgtagaaatacaattaggaaataactgaaattcggaattaaaaataaggaatattagaagtagagtatagagtccataataaaatttggaataaacataataaaattaaaagtagagtttagagtccgtataaaaatacaatttacaaatagttaaaattcgaaattaagaaaaaatgggaagaagagtttaatgctaatataggaatacaatttagaagtaactaaaattcgaaattaaaaattaaataatattgaaagatgagtttagagtccacatagaaatacaattagaaataataaaatttcagaaataaaaataaataatattagaagaagaacatatagtctatatagaaatacaatttacagaaaaaagaaatattaaaagacgagtctagagtccatatatgaatatatataatttacaaataactaaaattttatcttaaaaataattaataactaacacgtatataaaatgcaatatgaatattacacattagtagttttgtaaagttattgcaaaatttaaaattatgttgtcattttaatatatttgaataatataatgagaaaacatatatgctattatatgagagaaaatataatgatgctagccgcgcaatctgcgcgggccatcatgctagttgaactaaattgaactggaaatacatagattttattgaaaacaaacttgaaatgcaatacatagatatattgaaaacaaacttgaaatgcatcacttcattgaaaacacaccatatgcctcctgaacagaggaaatcgaatcctacgatgattcatccaacttcaaaccacagcaaccacaaacttctctccattttttgcttcttttttttcttcttttcttgcatgcttccatcatcacacccatgcacaatcagccaccatcttctccggcgccggcgagcccaaaccacttcacgcaaccttctccttgatctcctccgcgcactccgcctccagctccggcgccgcctcctcctcgacgagtaccttcttgagcgcctcgtagcacatgaaggagatgccggcggcgggcatgagcttgatgcagctggggccgaggccgcggtagaggcccgcggcgccctcgccgcggaggatgcagtacatggcgtggagcacgtggcggtacacctgccggccgccgacggcgccgacctgcatctgcttgcgggcgacctcgagcgggaaggtggccgtgctggcgatggcgcccgccgccgacccgatgagcagcgtcgcggccgggccgacgtcggcgcgccccgtggcgcggcggtacaggcggcgcagcgtctcgtaggcgtagaagttggtggccgcgtagggcaccacgccgatcaggctcggcgccaggccgcggtacagctcccccggcccgccctcccgcacgatcttcacgaacgcgtgcagcacgttgtcgtacacgtccttctgcaagaaaacgcaacaatggcggtggtgattagttggaaaactcaatttgggatatctcctcatttttacatgtcacttaaaagatcattaaaaaattttagtagaatagagatatgtcacttcacaaacatgcaaatttaaatttaacttgtacgagtagaacgcgtaatttatgggtcaaatttgttatttttgtttcgaattgtataagttgaattttaacttgcatatttgcaaaagatatatcatgtattgaatcgcatacacaaaactaggggatgtcatctggagggggaaaaaaatccactttcgtgattagtttgatcgattttgaaggttttgatgggggtttgtgtgtgtttgtgtttacctcgatggtgaggcgggtcttgacgagctccatggggtaggtgcagagggtggaggcgacaccggcgagggcgccggcgacgagggggacggggatggggatcttggcaggctcgccgtcctccggggtgaggtacttcttggccgtgtcgtaggtgaaatgctgcaggacgccatggattcgatcacgagaaattcaaagaaaaacaaagtggagggtgtgaggttgagttggttgcctcgatggccttgctgggggcgacgcggaggacgttgacggcgttgccgcggaagaggccggtccagccctcggtgcgcatgatccagcggaagacctcggccatggagccggcgccgcagctgccgaccatgaggtgggtgcggatggtctccagcggcgccacgaaggtgcgcgacacggcgccggcgatggcgccgctcaccagccggcgaaggtgcgggttcccgatcttcaccctcaccttcctcagcgacagcagcccgccgccgcccttcatcttcctgccctgcctcttcttccccgccgcctcctcggcctccgcggcggcgagctgccgcgcgacgtcgcagttgtcccggcccttcgccgcagacggcaagctgagcccgacgctggcgaacagcggcggcgcagccgtccggcgagggaactccaacctcttgctgctgctgttgatgcactccccttccaccgagctccacgggaacgacacctccgggacgaaccaccccttcctgtccaccaccgccaccgcgccgccgccgacggcgttgttcctcgtcaccatcgtcgtcaccgccatcatcgccgccatcgatcacaccaaaattaaaactacttcctgctgctacaagcgcaatcaaaattaaacaagaagaactaaaaccgatcgatcaaatatgacaactacgcacctagctcgaggaggaaagaaagaatcagagcgagcgttgctgcttctggcttctgattcctggctggtgttcttgggattcttggcaatggcgccccattttatagccattccgtcccgtccaccacctgcacggtggcgtgcactcctcgcgacgaaaagccccccacacagctagcaagccccgctccccgccgggcactccaccaacggggg

SEQ ID NO: 47325 - DNA, 7990 bp, Oryza sativa
ctgcgtgcgtgcgcagttcgatcagttgctccttctcgaggaggaagaaacggacagtggccgtggtcctgggcaggtgcattcatgtgctctgcgattttcgaaggtaggcatgcaagcaatgtgctactggttgttaggaggctgggatggaatggaatggaaggcgtgaatcgaagcattggcaatttggcgtcgggcaaagaaagaaagagcatgagctgcaaagagcaagggaggttttgggctttttggcggtgttcatggaaagcggagctggtagattagctgtacgtagtaacgtaaaaggccgtaacgtaaggggctagaatagataggtggctggagagcggagcacggagccgcgcgcgcacgcgcgggggcacgtttgggttgcccggcgacgaggctggtactcgcgcgcggggaaggttgtgggcttctgtgcgtgtgcgcagatggtttattacgaaaccacttggttttcgcggaaacttaaataggtttttttgttgggttgagatcacaaaaccgctcagtaaattggtcgagctaggaaaaaagagtttaactagattttaaagttttggtaaaagttaattgaatttcacggctagtcaatggtttttaagatggttttcgtgaaaagcagagggaacggacttcatagcggttttggaaggtgatttggtttcgtgaatccatgcagactctatgtcagaatgtatatatgtgaatgaattgtgcggacaaatatcgcacatcggttgtcaccatctaggtaatcttgtgtatggccacacaggtctcaaagagtggtttcgataaaaaaaataagaagagtatcggtatcctagcaagatgatattcagctggttacaaggtcttaacagacaatggaaaaataaaaactctcattttctgtgatacaatttcaaaattgaaggcgagtttttttccccttctgaagtgaaatgataaatagtaatattgtaagaaaataagacgtaactgataaaaaaatatccctttggactagtaacgagcaaccgaccattagattaggagctatagttatcaccaggatttcgatcgtagtctttaactagtgttggtatagaaaaactattagtggtacggttgacaaaacccacacagtggatatgccactgctcaaaatgtgagatttgttcttttctcacttgaaactttgggtattgcatacatttatgccactacgatgatagaatctgacaaggaccatcatcactccaactcactcaacacttatacttgtctttccttcgaatgcttatagaggatggattgattttatgagtgatggattgttatgttaaattcaagtgttattgatataatgtgatgaacacatgatggacctatttgtatgaatacacgaatgagtagcacacaactctatgtaaaattattatgggaccataagatcgaaaaggcgatgatgcaataacttagaacttatttcatcctcatgccaccaaagattcgcctttggcacaattttttctcgttgtcatgatccaacgcaactacacgctataaggtgacgtatacatcaacctttaacttcaaaggtaattaactattatgctgtttttttatgctatatgtgttgtcatgtattgttaccggctcatcgtcactaaggatgcctttagttccgagttagccgtttcaccaaactcatcctaattttatacccatactgttgttaacagtgaaattcgataagcccggaatagtcatcggcttagagtcagcgttggcttcgacgtcctgagattagccgatgagagttttcaagtcgtcagttgtcagattcttgctatattcagttaaggaaattgatctactaaaggaagcttatccagaagagactgagttcaaagagaatgcagtatggcaagttatctattaattaggaatagtttgttagtttccttttatctttaggaaagtgtgtttagtgtcctataagactttatcttttccttttatttttaggaaggtttctttcttatccgacaaggatttttatacccatgggtatatgtacacccggggtctatgtaatctatcgctacgatcaatacaatttggcgcatcgcgaccctttttacttctacttttgtttttacgttccggcggaatttggaacccgacgcggggctgcatcgtcttcgatctccggcgaagggataagtccaatgttccaccggtccaggcaattgtatcatctacgtcggcgtcgttcaaggctgcatcagtacattcgacctctcggattactctggtttggataatatatttgcctggctatttatcatatgtctatgttaatctagtcctagcatctcaatttagctctatcggctgtctctcgctttagggtttctaccggtatcggctaaatcaccttgctagattagattagcttaggcatctaccaccctgaaaatcagtcaacagcttggttgtctagatattgtgtttcttttcatacttagtgctgcatcagttaagtttgatctactaattcgtgcttagaaccataatctctagcctgttttttgactgccaataagggtttcatcggggtttcagccgatgagttatctaggcgttgcatcggcttacaaggattgtatacatattggatttagccgatcgcaataaagatttaattgtttaatataatcttgtggattttataacatcggatctccagctgatgtatgctttaaccttcgaatcgatgcttatttatcatatcattttttgccgattggtttatattggatcatattgttatatacatcatcatcaaccgattgtctttatatcattatctacattggacatatagccgattgcttaaaccctatcgctatcggctggtatcggcatcggctatttatcggctatcggctggaactactccgtcggcttgtcagctgatcgactgtttgatctactatttgcatatcttgtcagttgcaggatcaaactgactggcacgcccgcatctcaccaacctttggacctgcacaggagttaagcagatctcccaggccagtgtgtttgattttttcgtcaacaactgtgacggttggttatatatgagttaaaaaaaactcgacttgagaggggtaagcccgggcactttgcaaagaaaaagaccttctcaagctgttagataaaagctccgaacctttggcccactcttacacaaacgacaccgtagcatatgtgagaacgacaagcgatttaggccgggccctagacctatgcttaggtgtgtgaccaacgagggaattttttaaaccctagcttgaaattcgctcccacgtttttttccttggatatacacttgtatcgaataagttttgtcccgagacaacatacactgcctaccttttttggcttacatcatgtaggctggtgaaacatatttgaatttcatttccgcaaggcaaaaaccttcattttgtatgtttaaagacatgtctcgcaaaaaaaaagggaactaaacaagatgttgccatatgttgtaggatagggtaaagcttgttgtacgaaaccaaacatacttatatgcgctccttcacattcttccatgctccatatagcctatggctaccttttcccattatttttttcacatagtgtttgttctcctacagtctcatcaccgattgctactcctattatggagatcgcacgctttttcagtgtataatataattaggtgttatttttaattatgattgatgttttagattctactagttcaaacttttgtaatttttgaaaacaccaatggatctcgtagcatcagaattcagaaaccctctaaaaagaaaataaagaacttaaaggaaaaaaactcataaaacatcacgacaacaaattttggacggagccgtcagagcgacagatttatggtcacattataagggagcttttaattatttgccactgttagtaatttggtcgcgcggaacaactcacgatggcctcaactcaaagctccccaaaaacccggaagccgcgccgcgagctcgcctagggttttaaaacccatctcccctccctcccccgttccgccgaccacctgctccgccacctctcctcctagggttccggcgagcgacctccaccccggccatgccgccgccgcccccgccgcgcgagctcctggccgtcgtcgaggcggcgctgctcgggccatccccgccgtcgccggcgcagcgcgtggagctcctccacgccgtccgcgatgccgcccccgcattccgcgcgctcctctcctacccggtgagcccctcgccgcccctagcggtaggaatcgttcggtgttcgtccgggagctcggttttgatttcggggtgttttgggtttttgggcgtctctgtggtttgtgttggtaggggccgaaggcgtcggatcggactcaggtggaggccaaggaagtgcggctcccggacatgcctcccataacgctcgatgacaccgacgtgcagacggtaagctccctcgccaaccatttggtgtgatgcgctatgcatttacctggttatgcttggaacatgtgagaaatgcgtaattcttctgcttaaggtgagcatcacgtgatttatgtacccctgatgttgggcgaaacttgaaacttttgattagtctctggtagagatcctatgtggggtcatagttgcaaaatagtatcaagtctgttgagatgagctgtaattttgcccgcgagatagtgcgattttatctcttcctgagtattcagttgatttagtgcttttgtttctttgtagttttacaatgaaatgctttctataaaatctggtggctttgtggtcaaatatgtttctggaggtgattttttgggtgggaggtagcttgttatgcaatgtatcaatgacagacatgtatctttggtaggacaattgttcaaatttgtgaactcttgagctgtgaccttatcttaaggcgactaactgagatcgcatatgacactacttgctttaggtgcctatttccctcaaaacaaatgctaattaacacagtgaagtaaaattaagactagagcttgttgatttttttaattgatactggccaaccaaagaaccgttagaaattactgttgtgcttcaaatacagtaagcatcaacatggcttatgacaccactctttttatgcttaagatatatgctagagaaaacaagccttagtgcccaactgcccatccagtgcaatgtttgaattcttgaacctattctgacaagtctttacatgtgcactacgtctgctatgctagtgtggaaacattaccatttggttgcatcacccattatttgcttctttatattgaaggatcagatctgggatggctgttgtttgcacactttcacctataatgtagatccccgtgatttatcatttatttgttgatcatcatttgtccccagataaatgacattattttgagggctcttccttttgttttcttcactcaagtcaaagctcatatacattttttcaggccctgaaattgagtgatgaactcaatcttaatgagattgagtgtgttcgattgctagttgacgccaacagggaggtacacttttcagtataatagttatctctaattctatactatctatgtttacttcacctgaccatttgtgcggtggtggttttatagtgggttctatatggccgagagccactggaaatatataggctcgcagctggcctttggtacatggagagaagggatcttataacctctttgtacattctgttacgggtagtctattgatcgtgctcattccagttattaactagtctgagttttgaatgatgcatttaatagttctctttatcttctgcagtctgttgtacttgaccaagggcttgatgctgatctgatgtatgaaatacaaaaccaaatggaggctctatttattgagggtctcgggcagcgtataattacactagtaaaggttagatttgatggagcttgtgtactctctttcatgttttatttaatgagcaatgttgaacacgaatgctgtagtaacaatgagaaggctaatgcagatttggagtcttctcttgacagatgcaatgtacgggcttaacctatttttgtgataaatgtggaaaactggagagtgcatttgaactctagcttgtaggcttaaaaatagttgaagcaattgatgtgggtagggaactagcaaatattggtgctgttctgacattttctattcatatcatgtttgcagttcaatctgaagttatgacgttccatcagcacttctttggaactattaagcactgaaaaatatatagcaattttataagacttctagtaaactttcttagctttgatttatttatatttatttaggttcgtacctagatttttatgaacatttaacataccatagtgtttcttttattattattcttcgacatatttgcactcttgttggaagctgtgtcatgtctgcggcatcacttataacaaagggcgtatcatatttgggaaaatttattgtgctgtgaatatggaaaggtttcatatcatcttttttttttgggtgaaactaagattgacggttttaacttttctccccataaaggaacttaatcgtgaagaatcaactggtgttggccaaccaagctctgagcattatgtgcttgatttcagaggggctcttgtggagaggcgtgccattgtttctcgcgagagattaagtttgagccactgccttgctctttctgcacttattaaattgatgagtaagttaaatgctctgtatagttgctaatatcacctgatttgaccttctgatgtgtccgcttagtgacttgagtgaccatcatttcaatatttttccctgaaattcaaatataggaagcttgatagtttttctgagtgatagagaaccatcactaatgatgaactttatgtaggtcccagggaggttaaggatgtattttcattgttaaaagactgtgcagctgaagttaatgaaaattctagcgtggagcttcaggtttgaagtttgaacaaatgactttgaaattgcatttgtagacatgctattggtataatttgaattgtttattgttgttgtacaactcttactatcatttattgttgcagatcacctatggcgttcttttttctcttgtagtaacttttgtttctgatgccttaagtacttcccatgagaaaccatctttgtcatcttccgattcttcgttcaggcgtgattttcatgagctggtaatctttacagatgcccaacctgactatatttccaatgagttctttcctattatttgtttagttggaacatatggaaaaaaacatgctcattgcatgctttcattgttaacatgtcaggtgatgaggtcagataacaatttgactattgaaggatttgttggtgttgtgcgacttgcatgggcagttcatttgatgttaactcaagatcgaagcagtgcaagagatactctcactagttcttcgagagatgtgacagatatatgggcatgtctggagataatctgtcgccagaatagttttcaatttttgcaggaacgtattatgcaaacagctgcctacaaggtatttattactgtctttatgctagcatcctgggttgtcgggttaaagaaagtatgttgctaccgtgcataaaagtatggatcatgttattccctatcactctaatgtggctttgcctgtttgacctgtaagtatgaagtaagtacgttgctgcttcccaggaatttgagttcatgaaattttgcatcatgattcatgagatcagaaggtgtactgcttttgtttgagcgtaagttgaaatagagcatgcgattttgcatggttgcagatgattacaatggctatattagtactttc

SEQ ID NO: 47326 - DNA, 1216 bp, Oryza sativa
tttttggacattacatgctcgcactgttctcttttttcttccttttttctattacagaatatgtctattgctgtaaatagaaggcgttcaagtatgctttcccatgatgtttttcactttactaagctctaatttcaaggacatcacttatttgatatttatgtgctctcgccagaaagaacctgagctagtgcatggaaacgaggaactttggacctttgtcatatctgcaggagaagatcacaccaatacactaactcttgtggcattccttggacttcttagtactttggtatgcaaaatgttgcataacactgctgcacattcaatcttttacaccgtttgtaacaatctggtcttgtaggcttccagtgaagttggtgctgccaaagtctacgaactgctccagggaaaagtttaccgttcacttggttggagcactttgtttgattgcttatctatttatgaagaaaagttcaaagaatcccttcaatcttctgcaagcgtgatgcctgagtttcctgaagcggatgcacaggcacttgtttcgtatttagctgttctccagaaggtcttcacttctcagcatactgtcatattatcttggttccatccaaacatattctagcaatgctgtgaaatctttaaggactttgacctattttttttacacaatgcttttttttttttgcccagcaagagcattgtattccaatggttattttcaccttacttatgtgctcttgtggtggatttcattattttgatctgacaagttaattatggcctaacactcttcttgtgaagaaatactgactatatagtaaagtaaaaaaagctagagaaactgtactcaaaactatagctaggaaatcatacctagtcttgtaactccttaaatggttatgctatttccctcagaggttatcatggtaggattcttgtcaactgttaacatttatcttagctatttattctgcttttggattcttaataactagcatgttctggcccaatttgtgcttaggtctgacatatgttttactctctgtattttggattttagctagatgacttttctccagtcttgtttaccttttgtctcagatgcattcaatcgtaaattggtctgtgtcgcttttgtttctaacattcatgcatattcataataatctgttcctgtttcttcttttgcccatgggtatgttctttatga

SEQ ID NO: 47327 - DNA, 2114 bp, Oryza sativa
attcctgcagccctttctgcatcgcacttgcattttgtcatgggaattgggcatttgggccgtgaggccaaggcccatggagccaactctagggcagatgaacagcgcagtgggtactgtggcagcggattaggagataagattagggaattgggaaataagataaggatgggattgtattcatttggagttaagcaatgaaaatcaattagtctaatctcttcccctaatgttcttctccccaacctaagtctacattccttctccaagagccaacaccacttgctatctctctgaggtggttatcctgtcatggccttgggtcgtggcacatctggaaatcaaaatttgtttgctctataatgaaacgatgaaaacatagccattttggataatcgggagtttggagcgccctactgaagaatttcactttttaaaacccatattttactagaggaaacaccatattgcccagcccattgtacggccaactctttggtcctacactacacctacatcattgttaatttgtcattaccccacagcacttttggccaaattggatctgcagggactgaggtagtctcacctcagtccctgcaggaagtgaggatgttgttaaaagctaagttatttgctgggtgtggtgttttcctttttcctgcttttcttgatagtaagttttttaggcaggtgtgaaggaatagcatcattcacaagctgcattggatagatactttcttataatagctttattgaatgctgcggtacatttcaagcattgtttgcttgtgggttataaatgcaacatatggtatggtgagaacccatgaaaaatgtctatagttctccatagttacatcaacccagttgtaaaagagcattatcattagctattagctcagggcgaagtaaatatttgcatatactgctttatcctgaattttatcatttcatgacttgatatttcatataactttgtagttgtgctaggcctggtattatgagattctggcctacggaggtaccacatcagctagaactgattgtccatggcttgggtttgatttgtgcttgatttatgttatggacgctgattcatggatcgggtaatggtctgaagactgggataaagtccatatcattctcattggcattggcttgtccgatgttcaggagactctgatcaatctacctaagtaacctaactttatgattttcctgcttaattaatgatggggtacatgggctccctttatatataagaaggattgatttgacatctgaggaacaaatctataatattatagacactaatctgatctatctctaatttactgacaagctttatctgtcttaactagataatctcctacctttatttgacttattcctaatttgatgattaacctgctaattagctgtaagggctgtcctggccatgccatgacatttatcaacagtttggtgaaaattgacaggtttttagaggatgaaaatttggcctcaggtgataattttgtcaagagaggtaaaatggacttgttccattacttcctggaaacgtatttggaaatgttgggcttccctccggtgcaaattcttcatttggctggccatcaataataggtgttggacagccgatcgtctagctaagcgtgggctgcagcacacagtgatctgtcccctttgtgatcaaagtgaagaatccatccaacacattttgatctcctgtgttttttctcgccaagtttggacggcaatctttttgagactagggttagctgaggctgcgcctcagccctctaccgaccgctttctgaggtggtggagccaagcaacgaagaaccagccgaaggaggtgcggaaagggattaactccttggtaacattagtagcttgggagatttggaagcaccgcaacgactgcgttttcaataacgccaatcctagagtagcgacgtcttgcaagtgatagaaaatgagggccatctttggggtgttgctggagcttctcgccttcaaaagctccttagtgggacggctaacctaggcaactaagctccccgggttgtctagtgtgtgtgggtcttggtaggagggctcgggcgggc

SEQ ID NO: 47328 - DNA, 15797 bp, Oryza sativa
ttatatatactattctcgatttagtcatagttgtcaatactcaatacaatgcaaggtaaattaaccaggagaagcttggataagctaaggcatcagttttttcaatgacaagtacttggaccatgtatccaggtgaatatttttattagcttatttctgcaatatgtgatgttcacactgtacacacgatgctattttcactactgcaagaactcaaacaaccacttttgttcagcatgtctagaagattagatcaacaatattgataatgtcaaagggaaatcatattgaatgatgtttctacagcatttcactaatctatctctacagctgttgggctacaaatagctaactatatatttgattctcgtttgacattcatttgacaaataatggggtgagtattttctttctatcttgatagttgcattttacatgtgaatcatccatgtcctctcagcttcctgttctcttgtggcccatctatacttttacctctcagcttcctgttctcttgtggcccatttgatcctgcccacagcatatatgttggcgtttctccattttattctctgtggctgagaagagattgcacattggcacatctggtttttttttttttttttttactgggacatctggttgtttttcactgcaaaagaatgcaaatgcactgttagccaggtttttgaatcactcatcgattattgaacagggaatacagtttatctctgcatgattgatcttcttggactgctatgctaaatatgtcaggcacagtacaagcttgccagtccaggaaactaactaggagtataaaacatgataatcatagctggatcagataaatctcattgtgtcagcaccaaactgtaactgattaaccgtcttaagctgcagacttgcagtattgcatgagcaaaagactgctgggtacggtcagttatcctactgtaatgactaatgacagcaacttactggtaagtgatttggtctgaaacaacatccttagctttaagttgctggatcggccttcaacgattccaggtggtttggttgtaccaaggaaattggattacaatagaaggattccaagttcttttttttcccccgaaacacattataggtactcgtgtacatgtgcgtacactcatgaaatatagtacaacgcgtacacacttagagcaagtttaatagtatagctcactactagctccaaatcatctatagctaatataatagccaattcatacaatagttgtttactatactattaatatctggtcccacctgttatacacacaatacgtcttggagtccgtgctgcagctggctacagatctgtagcccgctgctcttctctctcttctttatctctttaaaatatgtttatagttagcttaaagcaagtttaatagtatagccaactactagctccaattcatctatagccaatctaatagctcattcatacaataatacatactacactattaatacccggtcccacctgtcatacaaatctgtagcccgctgctcttctcttcttatttatctacttaaaatatgtttgcagctggcttatagcctgttattgtacctgctcttagagcaagtttaatagtatagcccactactagctccaattcatctatagccagtgtaatagctaattcatacaatagttgcttactaaattattaatatatggtcccacttgtcatacacacatcgcatcttagagtccgtactgcagctggctacagatctgtagctcgctgctctttctctctcatcttttatatcattaaaatatgtttatagctggctaatagtctgctattgtaaatgctcttatagcctgctattgtacctgctcttacctctaggaagttgcatgtgcaataagtgcctttgaaaaatgggcctgttgtatacacactggcacactcatccctatgaaactaggtgtatccctgcgctttgctgcgggaattattaaccaattttcaatatatttttttcgataatcgagctagaagtaaaaagaaaaaaaataaaacgtgagggtttatcaatacttctataaaacaaacaaatgatacttgcaattttgacaagtgtatgttaaatattataaaaatgatagatagatttgttaaaatattgtggaaatgaagtgagggtgatgatcagatatacttacatgttgatttgtagaattaaataaattatactccctccgtttcacaatgtaagtcattttagcatttcccacattcatattgatgttaatgaatttagatagatatatgtctaaattcattaacatcaatatgaatatgggaaatattagaatgacttacattgtgaaacggaggaagtacatgatgttgtatgcttgcataaggttaaatatgtaactattgctagtgggtgatgatgtgacatagttgcattcagggtttacaattccaacgaaatccggtcggattttgcgaaatttcgacattccgacgaggcttgaaagtataaactgtttgagatttcgaggagtttcatccaaattcaaatttgaattgataaaaaaggaaagaaacaaataaaatcttataatatgatattaatagaatctattgggatataaatatttgaaaaaaatgatatattgtgtgtatttactgaaacttacatcagtaaagaaaagaataaataattaaaaaaaggaaaacacttacatggcccggattgcatgtactaggcccagtaagtagttggtccaaattacatatttttggtccaaattacatattactgatcgaaatttcgatgatttcgatcggaatttcgccaaaaccgaccggttttcaagaacttgtcagcaaaatcagggaatttgtattcaaattttggtttatgaaatttgttcggaattttccggttttccaccggatttcgcgaaattccgaattccgctagtgcccgaaacggaagggcctgtcgaaatcgtaaaccctggttgcatcttaagctttaggagttagtgagcatcaactttataataagataggatatgaatgtagtgagcaccttgaaagaagcataacttaagattaacaaagctaccatcagctttatggtcgcatgttgagttttaggagttagtgggcatcaactttatactaaggcaggatatgaatgcactaagcaccttgaaagaggcataacttaagattaacgaagtcaccgtaaacatcttgttatagactgaaaacttattgttaacagataccatgtaaataccaacacacttgtgttcaggttatgacatgaaactaggtgagtaggctccatcaactacgcttagggctagggatgaaaacggtatgtaaacttttcgaaaaatttttcccggggacctatttttcgaaaacaaatctgtcggttggaattttttcagaaacgaaaatgaattcggaaataatttctcgaaaacataattgaatatgataaaggaagccctcgtcggaactcggaatcggtcggaaactttccgaaaaatttatcggaatttccgaaattataaaggcctataccatagtctataattcctccccagtccaacccaaatcaacatcctaattcctaagtcactcaattcagcccaatccaatacacccaattcaaacttgagaattggacttatatgattgtgttttatgatgtaatgttgatatttgagacttgataattggatttgacatagtttaaagattagtttgaggggttttttattccgataagttttcattaccgtatcagcgttggaccgttttcggttttgacaatatttgattccattttcgtatccggggtttccgattccgaaaaaaaatatgaaaacaaaaccgataaaggtggtttccgtccattttcgtaccgttttcatccctacttagggcctctttgagttataagaataaaaaaacaaaggaataggaaaaacacataattccgataggaatacaagtgtaaaacggaggattgcaaaacacatgaatgattgtttgattcgataggaatgcatgtgtaaaacggaagattgcaaaacacagaagtgattgtttgattggaccgcagaaaaacacatgaatcggatgaaagagatagactaaagtattttttccaagatgctgaacctcttgctaggttttctccaaaaccgttttataggatttggaaaaccccaatcctctaaatcaaaccctttgattgaaaggggcacttagtttgtgaattccaagttacttctaccacgtaacaatattaaatttgacatgtttgcgaaacaagaactaatagagagtgtacgtttgtaattaagcataatttcacgggtacgactcaaacatatttgaaaacatgaccaattatgccacgaacagccaaagcaacacccaccttaacatcagcagcatcgacagcgacccaaacaagcacgaggattatgatctgatatttttcgtcgcgtatcagccaaagacgggggccaacgtcaatcacccgacggacggtccagatcacgacgtgacacgcccggtttctcctcgcccaaaacacgtgtactaccccgactatacgagccatccatgaggggaccacaacgagaccccacctgtcagtgacacacttgccctggcacggcacggcgacgcgcgacgcggccccgcgcagccgccgacacgtgggccccatgggaggacgaggccccgggcagccgccgacacgtgggccccacgggaggacgaggccccctttgacccgcctcgacgtcggtgccgccgcgtgaacctcctcgtgggccgaggcgagacgaacacgagagaaagacgaagaaaaataaaaacctccaaaaaaaagaaaaaaaagggagaaaaaacgccgcgggttggattaaagaggtaggttttgatgctggcttaaatctcaccccgtttcgtgcgatttatttatttattatctcgtcgtctcgtcttcctccctcctccgcctgatcgagatcgcttctgctccagccgccgccgccgccgccgccgaagtccgcaggtgcgaggacgccgacgagtctccagagagcaggtgcgtgcgcgttctccctccccttcttcttctcccgctcggtttgtttcgttcgtttcgggtgatgcgctttaatttgcatgtttgatcgattcctgttcgtggagacgggttggattgggtgatcggtgcgggaggaggggggcggattcacggaatcgagggtagatttgtgcaatttttgcgggcgatgatggcgtgtctccctcccctggctatctcctccgtgtgtcgaattttttttcttgcgagcattagcaacgtctcgttcgcgcgcggtagggtttgtggggggagaggtccccggcgtcgagattcgtgccgccgttgatcgttcgacagctgttgcatccgattcgatgtgggtgcgcgccgcaggggaggggtggggcagagctggtggtggttttttgctcttggagccttggatgagtgggggcatgatccttgttgtagagtatagggacttacagctatgggtttgtggattttttactggtacatatcttctttagttgcaagagaaaagtgatagctatgttggctgtgggtttgttgtgtgctctgaatttttttttaggcttttgtagtttgtcttatgtgattacctttgactgtcactcattttaaacttttcttgtttgtcatactaagtaaggtataagtcatgcttagatgaaagtatgaaaccatgtctagtcatcgatgttatgtgctattaagaaataaataggatttagcacggtgagcgcgtctggatatgtgtgcggggctgtggctgccaacgcgcaacgctcggttatgatgtgctatcatgctgtgcactgttcatgatacggtccatctgctgactggggctttgatgccctgaaggactaaacctaaagaggatttagatctttttgttcatctccatgatgcattgcagtgcaccacatcgaatgtatacaagaaagctggtcagccaaactgggtggtggctaactttcaccttgtcaaggccagattacgtcatcctgaaactatagtagtgcatgcaagtgtggtgaatcaatacagcacacatgccatggaatctattgtacccatggtgtgcgcaactgcgcatccaacttataacaatatataattaaaggtttgtgtactgtagtgttgctctgttttgggtagatgccttcatcctagcccatacgtgtgccttcccattgctatgtgggtaatggcgcaagacacttagttaaaccagatctatgctcgtgcaattgttctcagtgaggaattagtgcatgaacgactaggaaacagatgtgctctgcagtctgtctttggaatctacaggccaagatactccatgcaagatttcaagtgcaactaatcattcaatttctaggaataagagcatactttaagtcttaaaccaatgtttgcaaaagtgaggacagcgtatgattgtttatgactgtttgactattctgtgagctccaatgaggtccgggtaggtgccgcatggcatgaatttttgttgtttatatcaagttcaactggtgttcatatatatcgttcatatatccatgacacgctttcctcacccacataggggactagtgctttacattgtggaatctgtatccctgtgatcacaagcaatttaattttttagtgaaatcagaagcagtttaatacctcaagtttatataaatggtgatttgatcccacaattgactatctaccaagatttaaaatcatattctgctacatatagtcgaacgctaacatggatttttagtttgcactttgtagtttattaatgtatacctagtaatttcccatgtagaactcaggtacttagaagcttagtcatgttttagccgcaccagtcaaacagatacttttgacagtgggactattgctgaagatttttggtgttctatcagtagtactcatactggttttagtacgcttattaacacaaaagctaaaaggcttgagctgttcttcttggttgtgcaaaagcagagaatcaaagcatgttaggttatcaagtgatcgcttcctttggagtttggtcatggtcatgcatggaagcacttccctaggagagaatccaagctagcttttggcccctcagtttttttcccaaggactccatgatttgtatttgcttctgctttcacttcacccaagagaatggaatggaagagaaggcatatcatcctatggttttgaaacctacatatcccctcctggcatctactatcagtctaccaccagtgctagtgctagcaaatatagtacagtgacataatagaaaaaatagatagatgaaaagcaaaagtaaatccactgatgtaaagcctcaacctcaaggatgagcacaagtaaaggggcaaggaaacaacagaagagatgcaaaacacaaccggaaataaaaggaggtgaaaaagaattctaaagaggatggtcactggcacccttgaagactactgcctcttgatttctctatctttattgaaattcatgcattattatcagttatgcatcaggccatctctatttgctttctgccatcatgttcatcttgggttgtgaaatgaaggttaatttaagatgatgggatctttctctgttttcggaaattccttctcaatgtttcctcttataaaaaaggataaagccaattgctcaccacttacagctcagcaatccattatgtctgtcttgatttcaagtggttccttttctttcacttacccctgtcagcagtattaactccctgtcagtatgctttgggtttgcattagacaaaattgcacaactctattatggatatgactagagggctagaggctactatttttagttaatatgaacaaagttgtgtttccgtagcaccttattgttgataagagagggaacacaaggggcccaaagaggtgcttgaatttctgaaaggttccgaggatgtccttccaaacaaataagctcaggcaatgactgagcaaaagtgcatcaagtaactgatagttatcaaacttttatttgttactcttgtcaacataagaactatattaattaatcccaatctcagaataaatcttattcactgtgagatattctctctgaagaaaaaagagtttcgttcggtagatttaactttagttgagatgatacttctttcatggttttaaactagtgtaagttttgctttgtaacttgcacatcatgtcatttccatgtagatgttcaccttgtaggtatgttgacaaaagttttatgcccctttctatccttgcatctcgaatattcacatggtctacaagatcatggatcaattcatgcttgttccttcctatccaaaattttagccagtctatttgtaatctataaaaaagtcacacttcatttgagctctgcttgatatctattttttttggtctatactgatttatttctgccatcttaattagtgacaaaaaatgctttagccggttaattatgcttacaccagagtcatgggatttttcctagtttagataaactgttctatgttacactaacggatggttgatttgctattttggcggataattcaccggacatagttttaggcttgagccgatgtgaccgtttgttggaatggatgccatggaatttcctcaattattgctagtgaaagaaggcaaagttagcatcgaatataagggatgagaatagctttttatagttgcaagaatggatagttatatagcaatagatatagcataagttcagaatgataaccaccattcttgtcacctcatagacttgctcttttgagacctcacagattaactcatttaggtctatatccattttctcgtagaatcaataataagtgctgcttttacactctgcttctcttcttttcataagtttggtgtaatgcttgaaatagttgtgcaaatgcagtattctggttccatcacacgtgtgtggatagctctggagcaccggtagcacaattgcacaattcagtgtgatacgctgcattattaggcataactaattagattttgcactcttttagaatagatatggtttgccttgccattttggaatctgctaaagaagagggtgatgtgttggcccttggaaaattggaatgtcaggaattctgtctcacaacagttaacacagcaggcctcaactgcatgtctaaccaaatatgtacctattcttgatgtgaaactatacattcgctgtccataaagttcctgatatgtcagtctcgggtgaacacagattaaatatcatgtggtcctgactcgtctcagttatcctcatttgattggaacatttgaactagatacaatcaaatcaaaaccctcaggatcacccttttattctctgagacttaatctgaaactatttgtatctctcttatcaaaagcagaaaaaggtcagtcaatactcaaattagaatctttgccatttttagacatgaaacacttcttgattcagccatgcttgtccaaaattaaatatcgacctaagcacaataattcaggacctaatttcgagtcttttctttttcctcttgaaaccatgatgtgtcagtttcaagaatattggttatcactagctccaacactgtgaatcagtcttttacttgacctgaagatgtacaatccttttcatgtggaaatttgggaaatgtcaaacgcaccagtcttgcaaaactgttttctcatgagaccaataacttttgactcaagctgtacttaaagaacaaaaggagatatctaattgagtgtagatttatttctaaaaatttccagtctgatctaaagtcccctcttattgttggtccataatgctccctgaaaacagaaatagtggataatacttgtactaaccattagctccatttttctgaaatgattttctgttcttcctctgacattccatattagctttggtggctttggttctatatgtattttgctaaaaatattctggtcgaataaccactgttacataactaattgcatcttaatttcctaagcacaagaatattgcgcactagtgccatccctccaccccatgtctcaaaagatgttgccaaggcaggcagagatgcagggtaaaggaagcattcaaactccccatatttcttttgccctttaatggctttctcttcttttctttaactcccctcttctttctagttttacgtgattctcttgttcttcgcgggccaaagtgcaccaaagaaccaaaggcacaaagataacccgcccctcggtttcagcaacccctgccaccgcactataaatacccctgcacattagcacctcgctgcatcaccctttcacctcacagcattttccaccttagagctcaccaacacagcagctgatacttgtttaggtaactgagcttcctgttagtgtttgttcatttgttttgtatgcatgtaagcatgttggttgtggttttcctatttcttgaatgcaaaaggttttgcaaagagagaacagctgggttatcttataagtcaagtgtgcttctgggcttcagtttgatcattttttcttcgcccttgctctgatccaataatctttaatgagtggtacattgttgatgtgcagggtaagacaagatgaacaggaagccaggagactgggactgcagggcgtgccagcacctcaacttcagccgccgggacctatgccagcgctgcggcgagccgcgtggcgccgctgatcgcggcagcggtggtggcggtgactacgccaacttcggcggccgtggtggttcctccttcggtggaggctttggcactggctctgatgtccgcccaggtgactggtactgcaactgcggcgcgcacaacttcgccagccgctccagctgcttcaagtgcgctgctttcaaggacgatgctgccgtcaacagtggcggcgctggtgcctttgatggtggggacatgtcgcgctcgcggggctacggcttcggcagcggcgccgtccgcgccagccgccctggctggaagtctggcgactggatttgcaccaggtgcgtgtcatcactagttaggctatccttttcttttggttttaatatctgtttgctttagcaaatcaactattcatagccaatatatgatttttcccagcccttattatggtataagacagtacatggcatggataatttacatggttaatttagtggtagttacggacttttgaaagcttgtaatatttctccgtaccatttttgcatattagggggggggggtcctgtttcttcagaagagacaggaggatcaactaattatgctgcctgtcttcattcaatcattcatgagaaagctagtggttctgttatgctgcacgagaatattagtagcttatgtatagtaccgtagttgtaactagaggtattcatccatggttttctcaatctgtggaaaaccggaagtagttgagatgacactatatttatcgtagcatgcggcaaattgatcagtatggcctatttttgaacagtttcattcaaaatctgaatgaacggccctaggcctcgagtatcactgatgatgtggtcgctttaaatattatactgataagcgaagtgtctatgtcacatttttagctccctggcaactgtagcagcatagcatgttccatacatctccaatgctggatttgcataacttcgcaatatatgtgtctaataatgaactctgctttctgttaactcttgtattttctatgtttgatcacaggtctggatgcaatgagcacaacttcgccagcaggatggagtgcttcaggtgcaacgcaccgcgggactccggtagcgctatgacatacgaaaattacttgtaaattatcgtgaatctccccttgtctcctgcctcatgtcatgatctgatctcgtgcgtgttatgcatttgcaggcactgaggtgtaatttgccgtacgtgtccgatcgatctggatccgatgaggcttgcagcagtgacgacgagcagcagaagcagcgttaagagttgtgatgtctacataagaagaagaagaaagtagaatgcaaaagaaatctccccatggttttactagttttgtttcttcccgttttagatttggttctgattcccatttgggaggacccgtcgacccctgattatctatgttttacccgttttatttcctgtttctttcggcatgtttgctcttcgatcgagtcgtgtaacccgaaacgcttgcgcttgagaagtattattattattaactagtatgttgcttcttaattaattgccctgctcgatcgtgttcacttcattatccaattgtttgtttgatgtatttgttatatgcattttagtatctaaaaaatgttatcttatcggacagtaatgggataaccagaagtgtactgcgaatgcgaaatgtcaaagcgggatattgcagtaccatagtttggttgggggacaatgccatttgcagaaatcaactcttgtggatttagagatgtgcctaactgttaggagcaatcaaataaatgcattttttgtccttcaaaattgattatggtctactttggaatataattttttttagagagattgtttttctccagggcggcgtaaaccggccgaagttttttagggagattactacgaattgaccaacgaaatcccatgtattcctaagaatcctttatatttgagccagttgatgccaagtatagcagaaaacacagataaaatttacaatgtttgcacgtgagatcagcattatatagagataaaattcagtaagcgtgcgtgtgaaatctatgacattcggaactagtaaggtatggcaaacttggacatagctacgtccggtgcgccgtcacatgtagccgcactagtatacaagtatattgtaatagtaagtactcttttttctactactactagcagtagttgtacaactctttacaaaaccttgcgccagcacgtgcgcggaacaccactaccgttacggtgaaactagacccgaagtccaatgtggagggggacacatgcatgatcaagggtgcatgggtggtgaaacttcactgtcaaaaagtttcaaagttgcattggatgcccttgagatgcactcactgatattgcctcgctcttgtctttactcccgactactcctcctcctcctcctcctcctcctacctcttttcttttgcaagtaaaaaaaagaaaagaaaaagaagcagcagcagcagcagtgccatgcatatgcagcgtttgctgatatgcatgaggagacgaggatccctgtccctgcatgctgctgctgcagtcaaaagatggcttcgctcgccgtcggcaaagccatctgagctgagctttatacgtggccgcgcgcacgcagcagctttggctcgctgcgctgcgccggccgcgtcgccgcgcgcttgcgttgcgtctccggccacttgctttagcttcgccagcttttatcgtgtcaaaggcggcgcggcgcggttgcgagagcgatcgatcgatcagctcgttgctgcggccggccatttgcctttggagtttggagatcaaccaccgtctcatgtgtatgtgctttattatcgggaaatgctaaacgacggtatgtatatatcccgtttaaatgggatgatatatttgaggtagtatcgtccgatacctcataaatatcggtttatatctcgttcgaacagaatgttatcttctagatattgtctgatatctggtatatacatcggttgatactcacattttagacgataccgtccgaatgagataccgtcatgtagcatttgtgctaggttagcaagacggtggttgcatatcagcatgtgtgtatgtatgtatgtatgtgggtggtcccgtgggccgtggcggcccaacagttaacgggcctcgcacgtgagccgggaagtcggtctcggctcgcacgcacgccgcggatcggagagcatctgctgctcgcctcgctgcactccgcgaattttttttatttataattttttttattaaaagttttacaaaaataattttccattttgaaaattgacggaattagtcgcctaccgccctctgggagggcgatttttaaaaatcgccctcccagagggcggcgaaaatgacgtggcagccggccgttcgctctcgggcaacggccgtcaacgaaatttgcaggcggcccccttgccgccctccgctagggcgattttctactgtgggggggccgcctgcaaatgggccgcgagggggcatggaattttgcaggcggcccccttgccgccctgggggagggcgattttgtactgtgctctatattttttttaataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaaaaatgttctacataatctcaaatctagattacgtattaccaatgaataggcttccattttcgtgtgtggtgtgctagtgggaaagaatatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgaggtgccgcttttcatgtgtgctgttgtggactgtgcgcgctactagatctgacactaccgtgaagcgccgaaagtgtgttgtcgtgagtataagttgttctagcaccatatgaatgaaaagaactatgtagacgagacaaacacaagtagtactgcagtagtaatagcaaaaatagtactgctttataagtttgtaagccaaaagaaacggtcacataaggactgaagaggtagaacactactgacgaggcctcttacccctatccctcctaccctgcgccctaatgtgcccctgggagtacgtgagtcggtccgggggtacggcacggccaacccgtcctgcctgtacaggtgtgatctctggctgctcctgagtgtgcgcctctggagctcctccaagctgagaggagcctaggacgtcgtggtggtgtgcaccatgcaagtcgtcgtcgtagaactggctagtaggaccagtcctaccggcgtgagacgaagaggccccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgctcgaagaggtggcgaacgcccctgcggagctcgtggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgta

SEQ ID NO: 47329 - DNA, 5661 bp, Oryza sativa
aacaggaacaagaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgttgcgacaggagaagacgagcatgaccgcacgcatcttctgctgcatccggtcgaaggtcaccctctgctcaaagtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagccaaggtagtcacggtagttctcctccgtgtgtgggaagagctcgttgatcacctcctctgtagctaacacccagtcgtcaacgtactgctgtacacgtggagcccaaagtgcgcctgccagctgtccccgtcgagtcaacctgtgaagagagttaaattatatggctcgatgatgtatttatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcatcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacaatcatccggtcgcaaataagcatgtatgataataaacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtaaacatacgcgtaccaaggaacgtgacgggggtcgacacgcaaccactcgcgcgacgtgcgtggacggaaggtgccgagctgtgcaccctcaactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaatgactcacacatattaaacaagagtacaaacaaacaaaagtgtttagtccgaacactcatcacgataacattatgatacaacaccgaatagttcgcaatactacttgtacaacaatagtcggaggtactcattacaacaacattgaattgaaattacacgatagaagtatttagtccgaacactcattacatcacaacagtattttatttcctaaatcgaaagcattgttataccatggaatcgcctgctgcacgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagtaagaacgtgtgagcaaggaaggtgatgaagcttcggcttcatacaactgtaggtacatccaccatccgccttcaagacacattcctgcacgacttgcttgcgatagataccacgcctgctcctatcaacacacattatttcataccgatgcacttgtgtgccttgagcaacaactctatgtctctgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttccgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcataaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagctttaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattatacggactctctccccctcatccgccatacccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttgcacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcagggctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtacattacattctccagatcaaattaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaagtgagcgaaccagcagggcttcgccgctccccttctgctgccctcccctctctctttcgtttttttttggatttttagtgaatataatgaaatttcacagaggaggggctgggctttatagggggggggg

SEQ ID NO: 47330 - DNA, 1356 bp, Oryza sativa
atttcgttgacggccgtcgcccgagagcgaacggccgtctgccacgtcattttcgccgccctctgagagggcggcggtaggcgactacttccgtcaattttcaaaatggaaaactatttttgtaaaacttttaataaaaaaaattataaataaaaaaaattcgcactccaccgtccggagacggcgagcggctgacgtgatgtgggtaggaagaacgcgtactacttttcaaataatccccaaattccacctgctctcctggtcttcctctcaatccgcttgccatcgatcggctacccaccaaactccctcactccgctgagtgtttgacctgcttcggcagcggccgcgagagcttccttgggtataatcaattccccttttccactcgtaattgctggcttcttgctcgctatgaattgcatgttcttgattggtctgtggttgtgatccgtccgtgttggtggtggattgggagtttgggggaaaggggaatggttggtgatgtcgaggttgatgaaggaacgggaccggaggattcggtgttggagttggtggcggccaggagaacgcacgccatgtgttcgtcggattgtcgcagccagctctgagtattgaattcttgctaggggagagattggagcttcgttgctgttgctctagtggtttgtttgaccggaagcgaggccatatggatgctgtgaatgttcttgcctcggcgacccagctggtgtccgcgatgctcaccgcggtcggcgcgctggagcaggcggctgccgacttcgccgaggctcccaggaggctccaggttcttgaggattttgtgtccgaccttgggctgttgatgcagcaatccaagcagaagcacgcgcacaagatgcacgcgccgcagctcgagcgtcagctccagagcctaggcaagctgatggaccagctccatgccaacatcacaaaggcgaggcgggtgttgaagaaaggcaaagggaagaagggcttggccagagttgtgtggagctcggtgacaggggaccctctgatgaagtatgttcagctgatcagggatgatctcaactggtggcttgagttacagaagctaacagagagtgtgggcaatgtcatagcgtctacagctaagagtacgccatccttggtgagagtcaagtcggagcatggctatccagtgtcaaagaagtgcagctatgtcagggagctgcttatcaatgatggtagtcatcgagttgtcctgattgtcgggtatctggtattgggaagtcgtgtcttgctcgacaaatagcttctgacccgcctggtaattttgtggatggtgcaattgagcttagttttgggcggtggtgc

SEQ ID NO: 47331 - DNA, 2790 bp, Oryza sativa
tccagcaatatagtacgggagtatatataatactctctccgtattttaatgtatcacgccgttgactttttaacgaacatttgatcattcgtcttattcaaaaaatttatgtaactataatttattttattgtgacttgatttatcatcaaatgttctttaagcacgccataagtatttttatatttgcataaaaattttgaataagacgattggtcaaacgttggttaaaaaatcaacagcgtcatacattaaaatacggagggagtactagagtctatagatagcgttgtgcatgcaggatattaacatttggagtatgatgtttaattgttttaagtacagatatttttttcttaaccaagatagatcgggttattagaacataattttaaaaatgaaggaaaaatcatacataataatctagtttagagtttttgtagacctttttaccaatagtttttttactggttcaactaggttgttttttgtacaatcactcttttatttcgctaccctctttgccggatactagattgaagaagatgaatgcaaaagaatcatgagtgatcaatgtgtgcatcactcgtgtacaccactatttacctctgaaaaaaagcatcaaacctcacacgcccacaatcttgcataatactagttagtagttacaacaagttactgcacacatatgcatagccaagagagaaaatataatatataatatatgatctctatatgcagtgaggtgtgaaggatctaagcaagcctcatcacacagacagaggtagagaaaggaaagaacataaatggagcaagaaaagaagaggaccaccaagccaaagcaacacacacatacagtcacagacacccatcaccacacaagaaaagctcataagcatatactctctccgtattttaatatataatgccattaacttttttaaccaatatttaaccactcatcttatttaaaaaattatataattatcatttattttattttgacttgatttatcatccaatgttctttacgtctgacataaatatttttatatttgtacaaaaattttgaataagacgaacggttagacgttgataaaaaatcaacggtgttattcattaaaatacggagggagtatatgctcatgcttccttcacaaagtatgcactgtgctgaatcaatctacgcatctagctcacctcacaggaaacacaaaagaaaccagatatgtgcgcaccacatcagcaagcacacagatcatcacacacacaaagaaactccagcaatttctttctcacttgctagttgctactaccccccagaaagcacagaagttacaacaagacagttaattaactgaagaacatatatgagtaatagaaaagaaggtgagattgatgcacatcaccatatacatgcctcctctttgtcacaagaaaaggtagcaactaactttctccaattaggacaagataacatatatcacatggattaattcaggtttctagaactgaagagaggaagaggaatgcagtacctgttgttggagtactcgtagaggcggccgcggctggagaagacgatgagggcaacctcggcatcgcagagcatggagagctcatacgccttcttgagtagcccgttgcagcgcttgcagaaggtgacctgacggtccgctgtgtcctcgatgcttgagccctctgagctgccggagccgggggaagcagcaggtgctggttctggcatctaaatttgagtcacaaaaaaattccagagatatggatcagtcctctatgcaacaactcaacagcactgcataagccaacataatcaagaaattgcaagaccggaagatggatctatggcaagaaaatcaagaagtgccatagacatcatggccatcatctctcttaaaaattaatatatgcaactacagctcctttcgtgagttgtataattcttgtagatcaaaagaaaaaaggagagatctttggtcctgtggtgatcaatctctttgatcttgtgccttcctttcacctttttttcttctttttcttgttttgcttaaagagtaaagatctctagctatatctccccgtcttcatggccatctagctattctcacacatcagctagcagccatgattctacttttctactttcccaaagctcccatatgcatacaattaaaaaagaaatccaaaccctcttgcaaaatgacactgaaaaagaggaggaaatttaggagtttccaggccaagaaaagcaattaccatcaggccagtggatggttcagcctcctgctctttgtatatgtgcatgtttgctaaatcctctctataatgaggaagagaggggtgtgttcaaggagaagagaaaggttggggaaggatgagatgaaatggagtggtggtcgctgtggatagagtccatctatatattgcccttgttgtttttcttcctccttaacgtactttcctcctttcccctcttggctggcctacctgcacactgtaaccattaattgcatggggtttaataaattctttgaaggatcgaatagcaaaaactaagccaaccagaggggagtgaatggttatagtacttaaaaaccgaaacttttagcggaattacaagttaccattgtatctgatgtaaatcgatctgaccggtgttcatcacccgatttaaccgctgaaagatcacccctgcctcctgtcgccgccgccgccggtttgaccgccgtgtccccgttggtctgaccagtgcgatgccaccggtctgaccacc

SEQ ID NO: 47332 - DNA, 2247 bp, Oryza sativa
  unsure (1)..(2247): unsure at all n locations
tcaattattccgagtacatccttgtcggcaagactgttcccaaggattcggcacccattttttttctccataaatatttttactctcgtgcacaatgagcaattaaaaagttatttgaggaataacaattcaataaagtatgtacataagcatttatcattcaaaccacacactagcatcaatattgcatattggcttaattcaagtatagaatataagtgtcattcatcatctctcataaaagcaatatctaaacctcataaaatatcacgcccgggaaacagagcactagattccatttgtgagagcattatttccttgccctaggaggcaaggtacacataaccaagttgataattaacagagtttacaagtggaagcgtaaacatagtacttttattacatgggcgacaagggcctaacactgcaaagataaacgaaaaagaagaggcgacggccaacacgcgggcaaccacaggcaacggccaacacgcgggcaaccacaggcacttgacgtcaggcatgagctagaagtcgaacccaccatcttcaaggtactcctctgctaaagtgggaaagcagagcaagactgagtacaaccaccgtactcagcaaaccatgccgaaacaatacaaaaataatgctaagggtgtacaaaggatcatataagtatgttggggttaacttgcagcaaatgagcattttatttggcaaacagttggaaagcattttattaaaccacgccctatctctagtcaaattgctaccaagttgcgctacgacgtgaacttgcgtaagccacactatgacgcgaacttgcctaaggggcactacgacgcgacctccttaacccaatcccataggctccaaccatgtgttccaacctaatagacagaaaccactaactttgggtctttgctccgcttgcctataaccgagggcgcggctattcgaatagatttaattctggccagaggtgtaccactttaccccacccaacacgtctcccttacgtgtcgccacgtgccacatgccaccacggcatttgggcggaagctgtcatataacctatcgtccaacgttgccccgaacaaggaataccgacatagacttccacgaccaataaactctgggacaggtggacagattatgcccctaggcgcgactgctaggaacatcaacacaaaacttgggcctcatccatccctatccatgcctttcttgatcaaggccacactaagcgatacactacaccttacccactagacaggtggtcggatggaaaatgctttgcagtcgtgccccgaagtccggtccatatgtcggccgaggtgtgacaagcaaaaccaaacacctcaagcccagccgaaaataggttttgaggtatttcgaagagagagctacttttcacggaagaacaaccgctaaccaacattatcaaatgaggggagaggggagcggcggcgcagcgaggggagagagcagccagcccgggtagataatgggagagggagttcccatgctcaccgaggggaacggaggggcatacggagatgacgatcctgtaggcggcctcgtcggcacaagtggagnnnnnnnnnnnnnnnnnnnngcggtggaggcggcggagcggcgcgatggcgagggatgggcggacgggttcgggaggcgaggaaacagggataaggtggatcggggcttccttttataggctgcagaggaggaggaacggctgaggagcactcgtccggcagccatcaatggcgccagcatgctggcaggcatttactccccaccgaccacgaatcgcagggggtaaatagggagggagaggaagaggagggtgtggggagcattttccctagctccaatggagaggggaatgcagttggcaagcaggccgggcgcgccaaggagggagggaggagacgagccggaggagggaggtggccctgataggtggggcctatccgtcagcggtggtggcgagggcgttggctcggcttgggtagagctaggctagcatgtgagagatgggccggggaggcggcctaggtttgagaaggaggagggggaggtgcttgctaggctgggccgcgaggggaaaggtgggagggagtgggccaaaaacaacccaagggggaggaggggatttaaatcaatttattctttttaacaaagctgacaagggttattgtggcattaataatatttccagtgctcttaaaattcaagtaaaaattggtt

SEQ ID NO: 47333 - DNA, 749 bp, Oryza sativa
ttcctgcagcccagatcgatccccagtagaatgactcctgttcagacttcttcatgtagctccctccccggccagaccagtcaatttgacattattcttggagacaaacagatgaacacaacaatggtatatacagtccagtgtttgtacagtatgacactcaatctaactggcatcctgatttttttttgcaaattttattagcaatgactatggaagtcagagtgacatttttttacgaccaaacaatgctttagattaaacattaaataatatcatgccacagttgttctattgtttcggaaatataatgaacaaactgccactaactctcttttttttttggttgatatccttcaggaaaaaaccccatgttattttgaagatttgagcttagaaatatgtataatttgtcaagaaaaactctagaaaaaacttttactgtggtcaacagttcgtagttattcttccttccaatacacgcaattaactatttttgtgtgctacactacgcacaaatgcagcgtggaggaaactattgagaggtacaagaaagccaacagtgacacctccaataccagtacagttgcagagatcaatgcccaggtatactaacatcatctgaattctcaaaaaaaaaagaaatcatctgtcactaaaaatgcagcatgcagtagttttctatgctgtaattaaccaatgcaacattccttgtaattaaccaatggtttctatgctgtaaaaaatga

SEQ ID NO: 47334 - DNA, 749 bp, Oryza sativa
ttcctgcagccctgcgctagtattagagtagtaattaaaaacttaggtgtggtgtctacgttagagattacctttgttggttgggtatctcacggatttgtcagaggtaggcgacaggtgatgacagccctgaatcccgtcctagtgatcctccatgttcggatacattatagagccatagacggaaccacgctggcagactagcaggagtcggtgcccgaagcaataggtaggaaattaccttcaacttagcgtagataattaaaatatatagaaagtcctctctagccttgctagcctactaacggttgttgtccttggatagtcttagccttaggtagattacacacgttccctgagtttgatatccttttggagtcactcgaaggtgaagtgctacaacgtattccatgctcttgcggatttgtctgtggtcgtaagaaataccaacaatggttggaattgatcaaggattatgatgaacaggaagagtgttgacggtccttaaatcataatatctgaccattaatacctgcatataatgaaataaaatatgatatccaacttagtggtaggggttattactaaccaattctactagtgttggtgaaatatgtatatgcagatatttttaaggagaaaacacacccggcatgcaaggaaacacacctccggccaatcagatgcaagcacatggattggagggcccacaagtcaggtgaaaccgcatggaatgggtcataactgtc

SEQ ID NO: 47335 - DNA, 23202 bp, Oryza sativa
  unsure (1)..(23202): unsure at all n locations
caatttttttgaaaatttttcataaccatttagatgacatgcaagaaatgggtggacgtccacccgagtgtttaaaacagtttccctcgaggtcccaggtagtcgtagcgaaccaacaacaatgacgcgatgtagaaagtgagcggcctctgcatgcttctcccctctccgtcatcgcaccagtaggcagtagtcaaggccacagtcgcggccctcgtctcatcagaatctagaggaggctgcttcaccctcctgggagggcctcctcactgcctctccggtccagcttaataatatttgctcccttagcttaataatttttggactccaatacttcggctccaatacttcggtcagcctggttaaagaaaatgggtcaacatagttgaaaatcatttacatattccgaagcacttttagaaaagtaacatgacaaggtgaaacttatacctaagtatgagcaaaactttctccattgtataaaggaaggctacatgattcaattttttagcagcattttgttgatgcggttctatatgtttaccatggtacgtgcatatcaattttcatttcagcaggttgtccatggtagtcaaaccttagaacttcatctgattgttcctaatggggtaaaaaaggaacctgatattgcgcaattcagccagatgagaaaataagattccctaatggggtagaaaggtataaaaatcaatatattgccacccaccctgataatgatgttattggcagttttcggaacactggaaaaaggattcatgatagcagtattctgaacatactgcacaaaactaattcatgactgaacggatgtgaattcagatgagtgcgtgaaaatgaggagcttaatgccttgtaaaaactgaatgttgtcagaagaacaatgaaccaagaaccaccaaattaagtcaagtactaattggataatatcagaaactactagcatgtttacttatttcactaaatattctactccctccgcttcaaaatgtttgacaccgttgactttttagcacatgtttgatcattcgtcttattcaaaaaaaatttatgaaatatgtaaaattatatgtgtacatgaaagtatatttaacaatgaatcaaatgatatgaaaagaataaataattacttaaatttttgaataagacgaatggtcaaacatgtacttaaaaaaatcaacggtgtcaaacattttgatacagagggagtaataaataatccattacagcaatataatgacagatgaggacatgaacatgagactttatacaagaacagtggggtaaaccggggatgaacagcttcagaaaaagacggattggaaaataagaaaaaaaaaactatgaagcaggcatgcagctacgaatcatccccaaacatcacatataacaaatgttcatccggcattctgatcgttaccatgcaggcacacagcagctgctcacctctctgtctggtacatcgacgtcgcaccaaactgcagccagatacccgccatcgtcgaatccacgacgcagcaagcaggcacgtagctgctgtatgctcgcctccccacctgaccacctcgactgccatgaagcaggcacaccacgtacgtcttcgctccttcctctccccttgcatcccggcgtccctcgggctctagccggcgagtggatctagcgagacgcaaaccttcaataatggtcacagcattaactggtcgcgatctgacgcaactgggcgtggggaggctcgatctggcaccggggatagatgcgccagggccaggaagagtgtggcctcctgatccggcgacgatcgaggagacggacagccacgacgcgacgacaatcccgggcggcgcccccgaacggcggctaccaagcgacgggagagaggtcggtggcggtggtgcatatccatgggggcggagtataggacggcggcgagtagcgtgcgccgcacacggaggatgaccggggctcctctccatcgccgcctggctcgagcacgaacctcgcctgccatgctagatccgaaattcagaggatgagaggcgacaagtcgagaacacaccaatttgttgacagtgtatgtattccctttcgattttgctaaaggttatttgacgtttttctggccgtccgatcgtgaaggatatggttttgtatctttaagtaacacgaagtgcttagctaacctgctgctaccgtcggccttggcttgtcgtaagctttgtgcagctcgctgggtagctggcacattacatatcgtatatcgattttgctcgtgatttttttctgacatttaacccttttttttcagctcgtcagccggccggcacgtcctatataactaaatttaaaatatagaaaatataaaattacagtctatataactaaatttacatttgtaaattcagttgatatgacatgtaagcgcactgtaatttcgataaaaataatatgtaagtaaatatgtatttggtattttctttaaattataaaattacagtcctatgtaactaaatttacatttataacttcagttgatatgacatgtaagtgcactgtaattttggtaaaaataatatataagtaaatatgtatttgttattttattttgtagtccgttggatgtaaatctaggggtagaaaaaatctaggtgattttttattagaaatcacccgacaaatggatagatgctccccctttagggcacgtataacggtctttattagtggtctctctctattgctatgcatgacaacggcttagagtcgactcttagcattttttagagcaaattttgttgcatggtgatgaaagaaaggaaaaaatattaagatttttttgattcattaatgtttagagaccatattgtctctaactattgtagggtgctagtctctagataacgtagagctcatatctgacaaaaattttcacaatttgaccctttttaaaaactatttttacaaatgaaccgtcaccaaaacttatttaaaaaataacccttggcactgaatttagacacctcagcgccaaatagcgtagcgctgaatatgcgttggcacgctgacttagtctcccatccgcggtggcacggcattcagcgccagttgacatagcgctgaggtgtctaagttcagcgccaggtgatttggcgctgaccaaaagagtcatttttgaaataagttttggcagcggttcatttgtgaaaaaagtttttgcaaagggtcaaattgtgaaaatttcagcatatctgactctacctttgtacatgcccttagtaactacattactgacccttaaatacgttatcatatactccagtaactacattactagtaacaaccaatcattataacaagtgcggatcataaaggaaggtaggtgggtggggtgggtcgccccggttggaggggggagggtagggggttgtgttttaatacagcacaacccatctgtaatatagtatatgtatgtatgtatgaatgaatgtatatgtccttggtattggaaaaaagaactgcatgagcaaaatgataccacaaaaagtctaaatacaagcacaccaattaagttatatatcagtatactccatatatatgacagcacaggtacatcatcacatcacaggacacgtacatacatatagacacacaaaggtgcaggtgatgactcacatgatagcaagtcacatggcacacatacgcaacacgaaacattatttagcatgcatgcatgcatatgcatatatatgcacgcatgggcgcataacggatgacacactggattgtggggccaggttgcagaggatagctttgttcatcacttgccgcagttgcagccggcgcaggagcagccggtggtgcacttgcacttgccgtcgttctcctcgtagccgacctcctcagccatctcgaagtggctgcatgtgttgcacagaaatatatcacttacatctaaatttatcgttcaatatttatttatatgattcttaattaagtggaagcgaccgcgatttgttcgagttatgatgtttgcacgactttaattactttcacagaagtgtaagattcatgtattggggtccgttttagtttattcactatattatagaaacggatatattatttgctttgagcttcgaaaaatatgttttctccgaaacttggttagatcacatgttttaaaatatttgtagttataatattataattagcggtgataataacccctcagaatctaaatcaatcatcaggctagtagtatggctaaagctgttgagattataggcatataatgatttaatttattccataaataaattatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatattttgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattccattcgacgcgtacgtcgtgcacgcgcgccgcctgccctgccctgccaggcgagcgagcgcgcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaaagctgtactccctaaaaaaaactgaacagatcaagatatatatggtataatatagtacaacgaatttgggattatgtcacatctccatttaatttgggttttcttagatataggagttgttgtagagttaattaagaggtattggggatgggaaggggaggagaagccagtatgtatgtacctcttctcggcgtcaactatgacgacgccatagctggttcctttcttcctgcaaattaatcaacatgtcaattatattaatagattcgatcagttgattcagttcgcatgcaggactgaaaaattagtaaatcttaaagagggaatcgaattcaggagtggcagctagctagctagctggggtgtgtacttacacgcactggctcttgtcagcgcagtcgcagttgccgcacttgtccgacatgttgatcgatcgatcgatctgcgatgaactgagcttgattaatttggtgtggttgatctcgattagctttggaaggcgaggcttgtgatgaagagcaatggccgtggcttccccccgctatatatagccgcgccaggatacggacgaactgttttttctatatatttttttctcatcaaggtgtccaattgtaggtggtagaattttctaaagtatttttaaacaatattcctaaaatgatttttttttaaaatctgaagagccaagttagctaggaaaagtagtgccattcatataaaccatatatcgctacaaaatggcattgcctcagtttcaaattatttttcattttagctttgttgttactaaaacattctaaactttgaccattaatttttgaaattttatatagtttaaaatcgtaaggttcatgtatttagatttaccacaagaaatgctttcatatgtaatatataattcatatgttgttaaaatatatttatttctaaaaattgattattaaagttacatataattgatttacgacaaaaccaaaacgacatgttgctgcaccaattaatttgctttgcatgcatgcacagaggggatgtgacaccgttttggctggtgtggcaatgctgatctaattagcaactgttatccctaggatttggatattttccatggccttagtcgccacaatgaatctcaaatatatgcactataggttttaacccaacaaatgaataatatatttatgcttgatactactttctacgaataagattcccataaaagagatttcgttgttatattaagagcatgtgtagtactaccttcaatctaaaatataagatactgtacgttctaattaaacgtcatgtaatcatgactggagggaggatatatataagataggttctcaactggttttatataacttttctaaaatatataagcatttttaggtatatatatgtatgatttatttgcatattactttatatatatgagatttgttgtactcttctgtcccattttaaatgtagttgtgggtttctatatccaatgtttgatcatccgtcttatttaaaaaatttatgaaaaaataaaaaaataactcacgtataaaatactattcatgttttatcatatgatagtaataaaaatactaatcataaaaaacattcaaataaaacggacaaacaaatattggatatgttaaatttacaactccacttaaaattggacagaggaagttttaacgtaaggatatatagggggtgtttagatccaggggtgtaaagttttaacgtgtcacatcggatactatatagggtattgtatggggtgttcaggtactaataaataataattacagaattcgtcagtaaaccgcgagacgaattgattaagcataattaatccgtcattagcaaatgtttactgtaacaccacgttatcaaatcatgtagcaattaggcttaaaagattcgtctcacaaattagtcgtaatcagcctatatttaatacttaatataggtgttcaaacactggatgtgacaggtgcaaaattttgggtgggatatatacatgcccataatatatatggttgtgcattgaaatgtgtgaatcagataccatgttactccaggacgagcgatagcaaaagaaaagctaatttctggcttaggtggttcccacggttgcacagctcgcacacgcttcccactgaaggcacacgcttaattggaggagccttatctccacccataactcaaacgaatctatctcttatcactaatcaattatatcgatcattgatctctttttatctccatctcaaaaaagaagaaaaatgaaagaaagattcaaaggaaaaaaaagataataataaaggaatcttacaacagtaaactcagataactttgccatgtctttcacttgtggaacctgctatagttatagctgcactctcgatcaaagctttttttttccgttttggcgccacgctgaaatttatttgttcgatgtaggacacacgctaagtcgctacctagcctagcctgctagcctgtgtgtgaacttcaattctacccccaattaaggcttactcattttccgttaacacgttttccaaactgttatataatactttttataaaaaaaatctatataaaggttatttaaaaattttaataaatctgtttttttaatttataattattaatacttaattaatcatgtgctaatgaaatttctcattttatgtgcatcaaaagatctctctcaaaatagagagattgaatgcagccttagctggatatgttttttatccctcgagggatgtacctgtatttcttgcatttcatataattagtaattgaaaattttaatacaagataataagatagattaatatgagatagcatgtaaggttaaatttgacttttacaagttgtagaaaaagagaaattaaactaaaactagttaatataaatttatagttatatttgttatttttattacaacttgtagaaatataatttgaacttaaatatttgcatagtgatatatcaaactttaatcgaactagtcaatttttttagttaaactttttaatgactatttaggtgacaaataagaaacaagaggatatcacataactggtaaaaaaattagtgaaatcgtacttcaagaacaaactcaattttatataaaatctttaaataattctcagcaaaaaaaaaagctctcacatattagagcatgaaggcgatccgagaccaccacataaaatttcaggaaaaaacttaatttaatttgtggaatattacattaagtttaggcgaagaaatgagaatcatatgtggtaatgatggggagttaaatatatatggatattaattgcgctcttgagtgttgattctatgattgtgctctatgatattagatcgatctcgggggtgatgggatgatagaatctgagagttgaaggggagttgtttggtgcattagctcgattcgagccgatgcatatcaagccaagttttttttcattcctggaaccttaaaggtgtctgctcctaaatcggcacccttaaatcctcaaaggtgccggttaggaaacccagcacgtatagccagttcctaactagcataatcgccttttgttgtatcagtgaatggtttctcaaagcaaattacttatctagcctttcacaaaacaatacttgacccatagtttaaacacctttttgtttatacctttcatcttaagtcgttagattaagaaccatccctatatagaggcactttgcaaactataaaatgaggccttacatgtactcgcgacacttagagcaatagcaaagaagctcggccacctatgatgatctagctaggtagaagaagaattgttacagtttttcttactaaataagtaggaaaatgaaactattattgtttggaacacacgttcatatcatcgtcacgaagtatagttctttgtagctataattgtcatcgaacacttgttgaagctcagaaaaaaaaatcttgttctagtaaaaaatcaatgaagcataaagagataaactaaaaaatggagtgaagagatccaaaacatattagaacgcattggtataaattaaatatataatattaggactatttttcatatacggtcgcgcatctcgcatatgcccaaagatggccctggttagattataagtgattaacggccttcttatatcccaagcatcttagaaaatcctgaataaaattacatttatctattgcaattcaccgatatttttttcaagtaatatttaaatatcgatgtgtcccttcatatatttatcttagtccgggacactaatgttgacagattctcaggtgtttcaatcttcgaaaagaacataaaatatttcaatatgaactacacaatttcgttacaaattaaagcagaggtaaatagagggtaattaactatactacagatacttgctagggccacaataatttctgtaaaactatggccatacatgtcgctagtagacagaccgtaccttatcgcctaatttggtcgcttctcaagattttacctttgccgtagcaatcgccgtcattggcatcgtgtcaaatctgtccctaattaattcgccacttacgaaaagtgaagaacatattaaattggaggaatattaataatgaagtcaaacgtcagcaaacttgtttttccatgcatgtacaatcaaacttattctttggacctgctcaacttcacctgaactaaaaggggattggctattttttatgtgatggaaattgctacgaattttagtaatcttcagcataacaattaatcccctgttgtagtggtaggagagaggagggaggacgagacaaaggagaggtagcttgctggcgatagtgacgatggtcttctttcgatgacagcgagcttcttctcttctccagtgagggcaacaccataactccggtggagatacggattagggtttgaagttagctagggttaggatgggagggggtttagaggaggggaaaaaggggcttatacctaggcttggagggcattgggtgatggccggaccagtagtggctagggttggtggtgggggtgacaccaacaagtggtttggagacggggatggcgaagatgggtccgggggtggcttgccccggagaagaggaacgaccagcttgacgggagcttcacatcattggacttggagaagaaaaagagagggaggtaggggcttcgtgttcatgttttctggctagccagtgaagccagggcagcaaggtcgagcgggcaaagaacggtgccggtgaacgtggtgatgttgccgagataactacgcgtcggacgttcgaggaatagcgaaaaatcggacgcccatgcactagtctttctgtctttacggtctatgccacatgcaaatgcgctttctagctgtctctagttatagctctctgctctctctgtagcatgcagtcatgcatacacactatcacagttgctctctcttccctcatgcagtatgaaaatctactaactctaaactattttttatcctaaaatatttatccgatgcatgatccgattatatcactatatttatcgcaattaaatctttaaaacaagaccacacatagatatattccaacgaattctttttagcttattattgattttttttgaaatgttgcacaacgttccaccaagtatttcgggattgtttcactaagtagatcgaaaatgtttcaatcgtttaaatcgggtgttgtttcaccttatatgaaaacaatgtttcagcaaatagagaaagaatgtttcagttcactgcaacattagatctatacatagtgaaacattatgagtacactaggtgaaacattttttgtgaaataaaaaatgaaacgaattcccttaatagagggtttccaaaatatgtgggtaatttgttgcaaaagaatgtttcggttctctgcaatattagatctatacacagtgaaacattgtgagtaccactaggtgaaatattttttggtgaaacaaaaaataaaatgaattcccttaatagtgagcttccaaaatatgtgggtgatttgttgcaacggagtatgtggtagagacacgtagcaggtagacagtgacacatcgtggggcccagggcgcacgtgtgcgcgcgcgcgtgtcgtggggggaggggggagtgaccaatttttaccctaccccgggcgaccgaggcgtaggacaatcgaatacttattaaaatatataaataaaataatgtgaaacactgaaaaaacatttattgcaataaaaaaataaaaataaaatatttcgatcagaatatagtcatgtgatatcttattatgaagatttaattaaaatgaatataatggtataatcgaatcacaaatttgatagttgattattggaaaaaaaacatttgaaacttattaaaagaatgcatgcatgcgtaggggagagagggcaagagtagtacgtgggctatctgatgtgagagagaaaggttttggtattgaaaaagagacggtatgcatgctggctcataatatgagaaaagtgttatacggtgcatccgccgtccgagtatccgatagttttcgctggatcggacgtccgatcgtaagcattttcgtgatgccgcccgtgcgtgaggtcgcccgtttggaggtgaaaaaggaaatgagtggatagctgtactgctgttgcaccaatctcgagataattctagccatccaaaactttgactgaattcttttattttagtcaccttagaattaattagactgtcctaaaaaacttgaaaaatctgcttgtttacactatcgacatggaaaccagacaaatatacagccgtaacgtgtcaaggcacaaaatagtcatctagctattgacgtgaaaactactaccactgaaaaccagtcgaaggtgatacttttatcgtgtctgaaaatttaggaatgacaaatagccggaattaattcaaggcgaaaatttggatccatagagttttatggccatttttttctttttgttttttacattctcactcatatttttgtctctctaaaacgacctgtgcatgtttccccttctcgccaaatgtttttcgttggccccgctttcactatcatctttttgtataactttgtgttctagctatcctttgccctgtttccggaaagtccaaaccgttccaattcaaatttctgtaaaattcgtcacaaaaaagttgctgcaaattttctacaaagttcagaaaatccacttttcagtcaactcccctatgttgggccaaccttcttatcttgatccatccagtgtgagccgctaactagaagggcccactcagcctatccatcttggaataagttcatctgacgcccctcaattgtacgccaagtctatctaagccgtaataccagaaatgtgtacccctgaagtatgtaaaaccgtccaaataaaatctcggggttgtggagcgccggcgacggcagcggcggatgagcggagtcgtcagcgcctgcctctccccatccggagccacgacagacacgttgcccacggcgttggggatgaagctcctccaagtttacgtacctgatcgatggagcacacgttgtcatcagctactctagttcagttttaattttgttcatcactttcttgtactgcctcatctcattcggactagagctagctttgatctaatctagggccccgtttggcacagctccagctcccaactccaacttacctaaagccggaggtgtgccaaacggttcagatcctttattttatagagcggagttggcagagctactccacaaatttgtactacgggggtggagctaggtttttgttgctccacagctccactccactccaaaagacccactaccctttaaaattttagtgtatttacatgaaaatgccactgaactacctgtaccaacctccccctcccgttctctctccttctccgtctccctcccgagccctaatagatgcagtaggcggcattggcgtcggcgtcaggcggcggcgttggcggcagctgtggtgggcggcggcaccgtcggcggcggcgtcgtcggcggtggcgatggcaggcgccacggcggcggggcgcggcaagcacgcgggaggaagatgggcggcacgaggccggcggcgggtggcgcgtgcggcgacgacgcgcaaccgacgggggacggcgcgcgcggccaccgggatgtgcactaccgaggcgacgaagctcggcgggcggagggcggcgcgcggccggcggagggcagggggaggtgggcgggcggcggagtgcggggggaggtgggcggcgcgcgcaggggacggggacggccggcggagggcagcgcgcgcaagggatggggacggccggcggctgggatttttgtttttttttctttttcttttttttttgcagatctggagctaaaatatagccaaacacttttgatgagtgtccaactctaactggagctagctcccactagagtaggagtttggagttaggagttggagtatggagccctaccaaacggggcctagagtagcgagcagcaagtgtctgttgcgacgtcccgatagatccggccaaatcttaattgctgttcattggtcagatttgacaattaagctgcggatggggggaggcgggtgctgacgacttccgctcgcctgctgccacgcccccagcacccctcgcccatctgctccgcgtgggagccgccgccgacgaggccgagcggtgcggagtcggcgccagcctctcatgtcaggaacccacactctaacctcaataggtagtatccaatacaaaacattggtgaatcggtgtgtaattgatggtggagaaattatagaatacaaactgaatagaaggttatagtagtttctagacaagtagagaaagaggaagggtagagaagaagatcaagaagggtgccaagcccggccacccaagtagccgccgccgtcgtggccgaagccgcctttgccgattccaaatgtttgatgcctccaagtgcttgctgttgctgctcatatatatatgctgctagttgtgcttgtttgggccaggattgaaacatgactaacttagcccatctgcagcccaactgtgttcctaacaatcccctctccttaatattcgacttgtcctcgagtcgatgcaaattattgccagtgccaccaggatcccaatgtgtctgaagttcttgcatataattagcaaccctctaaacaacaagtgattgtagattattaccagcaacacttcttaatttcatcttctggttatgatccatcaaccaatgcaccaaaagttctacctcccccaatgtgtcattatctttacctggatcgaatacaagtataaagatattccaatgaaccaccagcttattagtctcaattttcttctttgttgactctagtatcattgtcctttcgtcataaaccatggccttgatagacaacttaacagccacccttcccattgcattcttaatcaagctgagcttaggtacaactagattgacaagtatcagacctacttaatggttcatgacatgcaaagccctcatttccctcattattatagtagcccagtgtagccagtgaggcaattgactgctaaaatttcttccatgaaaatcaaatatctagccaacttcaatataacatgttggcactctgacttctttcaatcaataagcccaataaagagaacaacggacatgttgacagcccatgcattctataccttctttatcatgtagaccaagaattttccaattgaaatcaacatcttccaatcttattttgtccttcagcccagcaacccatttctcttctataggggagatcctagtgatgagtgtcctttgatttgtctctagcagtagcttttgttgtgccacaatggaaggtgtctttgttgagataaactgtggccatttcatacatattaaatactgaaggacatcgtaaattccaaggtggacaatagcatgaattgcacgactcaagttcagcacacatagcgcagtgactaagattgatccatctgcagttgatacaatccaaattgttctccataaatttgcacttcgtccttgattcactaggatgtgtgtgatttcagtttcatggggtgggggccaagggttcagctcagcccaatgcaagtccatagccctcatctcagtaggaagtactttgataattcgaaattgcaattcaaggcaacttactttagttggtggcggccgaggtgcctttagttctacaaaaatctgtaatgcacccagatttccagaactagccagaacttcaagatcagcattaagacttctaaacaagcactgacaccatataacaggcggtggccatggcaatggcttcactagcatgggcaattgaccatatctaaatgcatgccatattagaagattcagcacacctttgtttcatcggcttactagtgaatcagcccgctgttttagctccaccttggcacacagatcatgaagggtatcttctgtttcctcctcaacctgagtcatgtcgccttcggcttcctcggtctcaatcgaaggcaatgttgttgccctagcagctgagataattgagggcgcgaacaaacttgtggtacccgggaacacacgttctggtttagtaggagtgccattgagcactgccttggtggtagcgtancttggtcccggcgtcgaacactgggtgggcactaaagtaggcaaggtcgaaggtggtggttgccctgatgctggcagaggactcctcttctctcttcacaaaggcctcactcctttcttccttacaccaaacattgtagtaaccgatcaagtttatcatcaaatctgcgctgggattccatcagctcaaagtcctctagtaaccaatggattgcctcatccctggttaacatctcctcgttcatgacgtgaagaacatctccctcggacaccccatatcggctagacatttcattgaacaggtgatgggcactgctctgatgaacatcttccctaccaaaattttcctccctcttgcaatgctgagtgatacaagtgctccccaaacgcctccatactgtgaatcccacggatcgtgaggctctgataccaaattgtcagaaacccacactctaacctcagtaggtagtatccaatacaaaacaatggtagatcggtgtggaattgatggtggagaaattatggaatacaaacggaatagaaggttatagtagtttctagacaggtagagaaagaggaagggtagagaagatcaacaagggtgccaagcccggccacccaagtcgctgccatcaccgattccaaatgtttgatgcttccaagtgcttccagttgctgctcatatatgctgctagttgtgcttgtttgggccaggattgaaacatgactaacttagcccatctgcagcccaactgtgttccaccgctgccgctccccctctgcaggaagaacgaaagaagaagggaaaaaagaaatgagaagaaagaaaagagaaaggaaaaaaaatgatgctaacatatgggccccacatttcttccttctcacgtacatgtgggtcccacatatttatttttttattttttgctgactaggatgccatgtcagcgaaactatgcatctatactgtcatcgtacttttttttggacaattttatatagcacaggggtacacatttatggtattgcggttaggggacctcacacacactcatcatacaactgagggacgtgaagtgaacttattccatccatcttcctcatcgcgggccagtcacccagtaattaactcctatggcccagacagcatggaaacgctaatgcgcgcggctcatcacgcgattaatttccttacgagttcgtgtatatataattgtatatgtatatgcaaatgtttatacgcatatgttataatatatacgtacataatttatatacgcaggggcagaattaagcatgggacagttaggcgcgcttgagctccattaaatcctaactccatgattcccattgattatagtcgtgtttagatccagggtgaaaagttttggcgtgtcacatcagatatacatacacatttaaagtattaatcgtagtataataacaaaacaaattatagaatccgtctgtaatctacgagaagaatttgttaagcctaattaatccgttattagcaaatgtttactgtaacactacattgtcaaatcatgaagcaattaaacttaatagattcgtctcgcaatttacacgcaatctgtgtaatcaattttttcgtttatatttaattccctatgcatgtgtctgaacatatgatgtgacaaggtgaaaaattttaccagataatctaaacatgcccataggctgtgttcttaccccaagtttcccaactcatctccctcgttttccacgtgcacacttttcaaactgttaaacggtgcgttttttgtaaaagtttctatgcgaaagttgcttaaaaattcatattgatccatttttgaaaaaaaaaactaatacttaattaatcacgcgctaatggaccattccgttttccgtgcgcactatttcggttgggaacatgctggagcgaacagagcctatagtcttgaaaagtaccacaatttttaaaactacttgagatcccattaattcagccctatgtatgtatgtagtttttttttctccgccagtatatgctatgcaatgaacttatttttggatggactttgcacaccacagcgtgtttgtaacccagcaaccgccaattattagatagacataggcaagagttgagtacagattcagaaacacttatttacaaaacatcatgcacctatcatcattacatatgtactctactacagaagctaattaaatgacctgtaaatatctgaaagaggaatgaaatgaaataatacaccataagatattcctggtactacaaacatgtggatatatagtactagaaagtgtcttattctatactatgttctatactaggttgcacagattaagtaaactatatcaagcatatgcataatatacgacctatctaaacattacaaaatgtacagtacgggaagatactattcccttttttctgaatgtttgacgctgttgatttttttaaacacgtttgaccattcgtcttattgaaaaatttatgtgaaatatgtaaaactatatattaacgtaaaagtatatttaacaatgaatcaaatgataagaaaatgataaataattactgaataagacgaacagtcaaatatgtttaaaaaaatcaacggcgtcaaatatttagggacggagggagtacaaattaatactcatggcgccgtgggtataaaatgacaatcacgctaagaacctttgctggcagctgagtgtcctcgccatcgtcttcgccgcccggagctggtcgtggcacgtcgccgccgccgacgtcgacgccgtcgtccgccggttgaagctcctcctggcgatgtccctcatggagccggcgagggacagcttcgggttcagcctcgtcgtcgagttgaagtccctgcacacctccatgtgccaccgcagcgccgcctccacgccgccgccgccgccgccgccgcgcatccgctcgcgcacggcctccgcgcagaggccgcacacccagtctccgtagtgcgccgcccggatgtggcggatgtaggccgccgtgcactcctccgtcacgctgcagcacgcgcaccgcaccgtcgtctccacgtccgagccgctgccgccgccgccgccgccggaggcaccgccggaggaagccactgccactactccggcgccggcgacgagatgatccgccgctctggtggtgttcgagtattccgagtacgatcgccgcagctcagtttgatccttgttctgaaatagagacacagatttgcatcaatatttcaccatctttcatatacttcaaatttattgtttcttgaataagaaatactctaaatatatatattagcttaactttataaatttcatgtagctttgcatatatatttatttttaaaattttaaaagattgacttcatattaactctgacaaatttttacaagacgcaaaacaagttggtactaattatagtgtgacgactataccttggacagcagcaggaagcaatttgttggttccaagcttgtgtttactgccatgatctgcatgcctgtctctgatctctctcgtgtcaattaagctaaatttcgatatgattttggacacccaactggctaattaatcaaagcagctaccactacatatgcctactgcatcaagtactgatccaatttataggcatatctaaaggtgcatggtaagtactgcaacttggatgtcgctctgcaaccgaacgaaaatgacagatttaagtgcagattagggcttgttgcaacttgttctctgaaagacaaacgtgtgtgtgagtgacagttagagagagtgtgagatcgaaacgcacttaattactcgagaggcattcagacatatatccatgaatttaattaggtttgctcgatcttgtgacggttagaccgttacatgtcctgttcaatcaggatcgatcaatgatgatcttttcgtgcaaaatcattgcatgatgtgaactccaacttaaacctcctacactgcattcgggacagtacatatattggtttacttaaacgtcataggatcgctgagaaattaggcacgccacgtcatatgttttttcaaaaaaaacccgtcatattttgtgaaataacacacacacccaaattcgcgtgtgccatccgatctcggtgaggcagggatccaactgtacacgtgtcccagcgtggcggctgtttcatcaccgtaggatcggggagacagaaatgaacggctcagatctcctcaaccgatgctcccacataaaccctagctagcgtcgctcctcccttcccctcgcgcgacctggcggcggatgcgccgtcctgttgcgctacctccgtccctcccggtgcgcctgctccaccgtccctcctcccctcccggtgcaccgcttccgctgctccccctcccctccacgctgtgcttccttccttcctcctctgcacctcttcttttccatcgttcaaagtcagcgagtcatggtggaatcgatacgacctgatggtgtttgtcctgcatcccagcccttgcctcggcatggatttgggccttgctgccgccgcaagttgcatgcattcgattcaaaaaaaaaaagttgccagcgttgattcattaccagcatgagggcctgtgctgcgctggtttactgctccttcgtcatcatcgtccaaagcaccatcagcgactaggtaggcagcctaatttcctcccattcaatttatctttggctaatagactcctgtgtgtcttggttgtaagaagaggaataaataattggggtgtcgccagtaaaattattagaagcaaatctaagttcattctcaaaatacatttgttcctgcaactttgttaattataatgtcctatatatttcttttatgtcagttaacttcagcgtagataacttctcactaataatgacagaatattgtcagggatgtacaggttaaagattcttacatggtccttagcttcataatgaaatcctgatgtacatcggttcatgtacatgccaattttttctggaatcctaacaaatttggtctacaagaacatatgcttcgaaaaaattctgattttttgttattctcagttacactgattcaagattgtagatatgagtatatggcatggtactacatggcagttatggtttactttcccaagatatgcacttcataacatacaaagttattggagagtacaagttttgatgttcttggctccgctgcccttttcctgtaggagtagatgctaatgagtgaattgtgtagtaatgtcaatattccttcattgtttaccagggagtaacatttggtgaatatgtcagcgagttttcttgcagcaatggaactttcctgaagccacctttctgtgcttctgtttggaggtatgaatgttttcttattgtcttctcttggtgatatatgtggccttcagatttcttatcacatatttttagtttttgtttcatgatagcatataatgtttatactatgagtaggttttgcctcaatttccttcccaatgcaacaaatcatattttatttttgaatttgttgagctcgatatttttacacacagtagaaataaacatgcattgatgatatcctttgtagacaatattatattggtaatagtgatgcatacatcataaaaaattatctgtagacctggcaacttggcatatgacccctaaatttggatcgtgcagttctttttctaagacacaaaccaaaaggtctttaggactcagtatagactgatgattgtgccaatactaaggtaatgatatgatttcatggcgcaagtcttttatcctcatatctggagactccattattctacgagtcatatcttaatgtataaagtgggctgatgttggctctataagtcaagacagtaatcacaaagtatgttgcacatctagcagaaaaaatctctctccgttgaagatttcagtattggtaagaaatttactaaaccacagtaactacatttttaaatcagttcaggctctattgtaacaagctaacaccttttcttccactataaccatttctaagctactaatattgaatatttaatggaacattaattccatagattagcgttgtttgcagggtgtttcaacgacactctactatttacccgaaaggattaaagccataggtacttctaagttctaacctacatagtaccatcctcgcttgatttgttagtccatacagaatgacaatacatatgtgccaccccaaaggtccaagcctccatatctctagctatgtgtactcttttcttctttgatcataaatttttattttaatttattggtgtgataaagctatatgcacttcaaacaattttagatgagacatgccatatgttctaataaggacgcagtgggatgttatttctatacaaacattattcctgcttttgttttttccagctctgtatggtgttggaattttctaatgacccatccttcaagattgattatttgttttgaaaatattcttatagagttgacttcaagatatgatttcattaatctttttttatttaattgattaaatgttctgtttgcccccttctaggaagacagatatttcaatatggtttctttgatgagtgttttgttctacctgccatatatactcatcacgtagcaatatatggatgacatccaagcatgcctgcccttagacatgattatgtaggggctaccttagtattcagtggcactatgcaaaggaggtatcacttcctgtactaaactgttgcaagtacgtaatgtgatgcattgttgtttttacagaactaagcactaaaattttatttgcggtgaagtgctatatatatatgtgaaagattcaattagttaatgatgaagatctctatgataaaaaagttgaaattctctgatcacctaataatttccttttgtcacactgtttcttctctaatctataccctcacattatgtaagcaccattgtcctctgtgattgttatttttctgtaaatgagcatgtttgtacaaacaattatctgagcaaacggattatattcatatttaaatcttggtgatatatagttgtaatgtgtattcatatgtaagtatgcttctgacataatgcttttttagataatgtttggatatataatgcttaaaagttgcaactatatacacgttgttttgattatgatatcacagcttcaaacatt

SEQ ID NO: 47336 - DNA, 1069 bp, Oryza sativa
tgtcctccaactgtcatcaggaagtaatcaggagcgtacacgtgtaaaaatggtgatcaactatgccagaacgggatcggctggactggtggttcggccgaaccaaaaaaccctcctcccggccctcctttggtcgggaggttgcttaatgggcccgcaacatcatgtactattttttggaccaattctaagtggctttggttgatgtatgggccccctaatctgtgtaaacacgtcttgattgtccagaggtgtattttgttgcataacgggtgtgttttctccttaaagtacctgcatacacatatttcaccaatactagtggaaatgattagtaataaaccctagtactaagttggataccatattttatttcattataagcaagtattgacagtcagatattatgatttgaggaccgtcagcaaccatcttctttgtcggagattcaggtctggctgggtgaagatgtacttcaagctcttgtggtcggtgtaaacttcgcaccggttcccgatgagataatgctgccatattttcagagcatgcaatatggcggccaattcgaggttgtgggtggggtagttgccatcgtgcagtcgcagttgtcgcgaggcgtaggccaccacatgcctttcctgcattaggacgcaacccaaaccctgacgggacgcgtcgcaataaacctgaaagtctttgttaacatctagcagaacgaagaccggggaagatgccagcttcgttttgagcaattgaaatgccttctcacatcccagtcaaaaaaaatgccttctcacattgcagggtccacatgaatttttcttcctttttcaacaactgggtcatgggccaagcgatctttaagaaattttcgatgaaccggcggtaaaaccctgccagcccaaggatactatggatctgcgtgatgggctgcctccacttggtgactgcttcgaccgtggcggggtccactgccactccttgtggaaagataacgtggtccaaaaacttcacttttgacaaccaaaactcacatttactgaactctgcatacaactgatgttccctg

SEQ ID NO: 47337 - DNA, 4639 bp, Oryza sativa
ttcctgcagcccattaattggtcatcccaaagaatatcattgtgcattcatacaaaccttatcgggtggtgaaggctgtcttggggatatcttcctcgcgaattcgtagctggtgatacccggatcgtaggtcgatcttggagaaacactgtggcacccttcaattgatcaaacaggtcatagatgcggggtagcgagtacttgttcttgatggtgacctcgttgagagcacggtagtcgacacacatgcgcttggtcttgtccttcttctcgacgaacacattgtttagtagtttgggaaacgtgcgtatgaaaaatatagataatagaactcagccgagtatagaacttagcacacctgtaaatgtggtcaagcactatagtctaataagcactacatttttttaaagaagtttatataaaaaaatatatatgagctatatatcttttcttttggtatccctccgtttcaaaatgtagcaacttaggatgttgttagacccatcctaaattactatatgttgaaatgaagatcgcagtttctttcctaaattcatatatgtgttacgtggtccttttcttaataacagacttatccatcttcgcttgtaagaacctagctataaccagttattatagagtttacaggttgaacgactgtgaattacaaaatcataacttaattaaaaacaataaaactacttaaataccagcctaaagacaaagataacacctattgctaaatttctatatatctatggttggcaaaaatctgcacagtggctagcgagttgtgcatagtagtccttgtatttctcaaatcagcagctgatcattgtgccgatcaaatttcgcgttcgtcaccattaatgactagtgccgaactaaagcggcagataacgtcggacggtaactgagttataaatcaaccgttcacatagatcttgctagcaccacggccatcgaagctgattcattggggacatcttgcaccctgccgtcgtggaccgtggcgaggtagcgtcttacattttcaacatatgtctatctaataagctatcctaagcttaattcaagtttaatcgtaacagtgaaaattgtgatcttgcacacacttcagtattccattttattatttgcataatttagttttccattgtgcaattaaaacgagaggcggatctatccattgggtagggtgggacacccccccccccagcctctctcctcctcgtcctcctcatagtagtgatgggccatcaaaattaggtatagcaagttgtgaaaatccaacatatcatcccgcatcaagcatcaacgtagctagtgttggtctgcctcttcacaacacatgcacgcacgccacataggggtggacattcggtctaaccgaaaaattcggttcggtttctcggtctttttgaaaattcggtctttgtaatctcaagaccgatcggtctccaacaaatcttaggactgagcaaatcggtcttcggttagttcggttcggtctcggtcatagaccgaactaacagcaaaaacaaagcaaatcaacaaaactatatgtaaaaacagcaaaagcaaagcaaatcaacaattagtggaggcggcgcccggcggtggagccggcgtagggccggctgggggtggcaccaggcggtggaggcgaaggagtgccggctagaggcggcacccggcggtggaggtggcggtgtgccggctggagacggcgcccggcggtggaggcggcgcaccgactggaggcggaagcggcgcccggcgatggagcgaaggaggacgcggatgggatggagacgggagtcgggacggcgccgctccaggatggatggggatgaaatgatgcgtcgatgcctgtgacgcacctgcccctagggtttttattagtgggcttattgggccaactagatctattgggcctaattcggttatttcggtcaaatcggttaattgaggcccatgaccgaataaaccgaacatatttcggtcttttagtagttgagaccgaattacagaccgaatttttcggtctcggttttttcggttcggtcttattctgcccacccctaacgccagaaacaatgatcgaggcagtgattattcttcgtctttgcttcttcgcgtctttgcccgatcatgggatggcatgaagttgatgaactggtgcttttgtaggccaccaatataatttcatgtaagagccaagttttgggtttgaattaaaaagagaagaaaatactgaaaacgagctcaacacaacaccatgccttgccctgttctttctgttttcggttaatttcttcagtttactgtttacgtctgaaaagaaaagagtcagaacgagcaaattcagagagcgtgagttcagagttcgaagtgattcctgaaaaaaccgcagctaacgaaacagcacttatatgtatacacaagatattatcaccaatatttcatatataaacataggaagggtatgaagtattttaatttcacaggttgaaccaatacttaggtacatcaccttgatagtgccaagcctgaattatgggataaagttaattattcatgcatacaagagttcacacataaaagttctactgacacagtgtaatatctaactgatcagtctccttgaagaaggcacatgcatgattgagatagttgcatgatacggatccatatttatctttcatctgcaagtgcaaggaatgtaaacagtaaaacaaaattagttacgcgttgcatctgaacgtacttgcacaaacttgtctcgaccacattatttgtctataacttatgcctccgaattccttctataatttgatgcaagggaaatttgagttataattcttatggttgcaagcaaatccaaacaatacctagaatgtgagataagccctacacatttctgaccctgcaatataatcctcccaagaaaactcttcattattttttatttttttattttgaaaaacttgatgtctctaactacgactcagatgcttacaatgagaaggtaatgaacattcaaatttcatttgttgaactatgaactctgactatgttacactgagaatattttttacctgacataaaggcctttcggtcctcctgttcaggataatactgaggctgatgcatgatgttgaattgcaggaagtttcttggatcataatggatcatattttgcacgtactcgctcgtagatgctgaacccatcatgttcactgtttgcagtcctctttcactctcagcaaccttcacaataataattataattaattagtatgatgacgtagaatttcagtcaattaggtatgatttgctatatatgtaggttatttcagtaacttcaattcagatttaccatgtagctaggttaatctctttttgaaagcgaatctcattcttttttttttgcaatgtagaacagaatacttactttgctctttaagtacatgttgtcattctgcagctccgtttcctgaaaagattatactcgtgctgttatcttatgatgtcaattaactagaccaaataattttgcaagaaagaaaacagtggtattttgctgatagtatttacccttctctgcatatactcaatttcagcacacagcaattcgttctgcaggatatggaatgcttatcaaattagatgaattaattaacaatatgcccttttcaacttggaattctatgtaaatgtagcacacaattaatataccttccgtgctctaatctttcctaggcctttgtccagtctgccttccagctgcttaagttctctgtggttcatggtggtgatattatcacctactagggtcctaattcattaattaatggagaatttagttataaccagatgaactactttgtcaagttgaaaaaaattctaagcagctgagtgaaataatgaacctgttggagttctgcaggttggtgatctgttgcttcagcttagcagcttcctgctggtagtgctgcaagtttgtaatttgattttttttttagtactggtagttaaaatcatgacaagttgtgtcagtttgctaactggaatgtttgactcttcatgtttattttgttcaaatgtgcatcatcaaatcataccatattaaactgtgtaatcaacctgcatgcatgcatatgcatgaatgaatgacaaaagtgccaaaaacatgcagtgagccatttcaattttcaagcatggaatcatgaagaactttgtccagtggacaaacacagataggagtatgtctgttggtcaaaactatatactactactatatatatagcatcactggaatttccattgtgtaaagcactgtagcttctattcaggatgtccaatctgaagattttggtcagagaactcattttttacagcatagaaaccattggttaattacaaggaatgttgcattgttgctgaatgataaaagctccagagaaaactactgcatgctgcatttgtactgacagatgatttttttttgtttgagaattcagatgatgttacctgggcattgatctctgcaactgtactggcgttggaggtgtcactgttggctttcttgtacctctcaatagtttccttcacgctgcatttgtgcatagtagca

SEQ ID NO: 47338 - DNA, 3881 bp, Oryza sativa
attttattaaagtactttttatgactaatctatacatatagtcatcatatttaacagaaaaatattttaaaaatgatttataatcaaatattctaaagtttgacttcacccttatctaaaatgacataagtcccgtgagagtagctagataaccacacaacggcaatcacgtgtgcgatagggaaatcacttttagtttgacatgcatgctgttcaagttagggggtgaatgacttgacataacagaatttaagtctcgattgattggcgccttacacacgtgtgggtgcactttaggagtttaattaagcagtaaaaattaaacttagagtgagctcacagatattactggtctccatttcatgagtatgcgtgattctgataaacatgtaggggctcctttggatggaggaattatatactattaaaatgctacatacatagattttttttcttttctatttggttatttggaagaaaagattgggctttcaaaatccgatgaaattgattcggaatgcctcatttcataaagattttaagaaaagtcaacatgagttctaacatcttgaatatgtttctatgtctatctctcaaatccaaatttatatattttaatttctttcagtctatccaaatcgttattcacagtggcaaagctatattatctttggggggggggggggggggcacctattcatatatttttttcatgtattttacaattatccattttacgtgcacatttctataaaatttctctcttttcactgggtatatattaactgttttccattcctgcattcggaagtcggaagaaagctgtagtgtgtgtatcttctctaatcggaaaaaggctacacatatgcgccgtgcgccgccggaagtagcacgcaaataacccgtgcataggagcaaaagaaggtggacgttgagttttagctagctggggaccatgctattcctaggacggaaattaaaaggcgatttttgtgtatgtgacggcacaagtgattcactaatccgtttcaccttttaattaaatcgcaaagcagagagcaattagagatccacaccatccataacccgtgatcgccgcctatgcatactgatgatgccatcttgatgtccaaaagtcacatcatcacccactagcaatagcaatagttatatatttaacctcatgcatacatacaacatcgtctacaatttatttaattctataaatcaacatacaattatatctaatcatcacctctcatatcatttgtataatattttaacaaatctattgattatttttataatatgttccacattaaagcgtgtgctttgttttatagtaagtattgataaacccacacatttcattattttttttttgtttttaccctaactcgatggtcgaaaatatatattaaatattacttagtaattcctgcagcaaagcatgaggaatcacctagtgtatagaaaccgcataccccagtaccttacagattatcatcgtattcatgtacaattttttttaaagaaaagtgttcattggtatttcacataaaactttttaaaatcaatttaccgattttctaaaaataattcttttgtgccctcaaataatgtcatatataaactcggtttaataaatccatcatgaaaaatctgttgacaacgcaccaaagcgtattctccattttagtttacttttcccttttgaccacgattcgaaacatgatcgtttgagtctcaaatactacatcattttgtattatttcttatttgccaacatttatcactttcttttcatacttcctcacttgttaaatagataaaaatttaaaatatgcacaaaaatatcactaagaatatttttatgttaatattaaatgtgtaattagaaaaaaaacaatggtaaacatagtgatcataactcaactgattaggttacttattatggagcctactcacctgattgcaggtcctaagacttagcacgagtgctcgtatttgtagttaattattcttttagtagtaaaccatgtatccatcgatagcggcgtcattaatctcaaaatatactggtctaatcttcagaggtaattataatgtatgatacatgtgtgtacatttatagagataagtatataagcatagtagtatgagcttttttttagaaaaaaggaaaacaatgatattatatgaaaagggtataaattacatgcccataaattcattgtgatttggttaggaaaggctggtgcggttgaaaacttcaattctagcccattcgcgatgttggccgctaggtcgattaggttgaaactccggattgatctattgtttgtcatggttatattttacaagatcgcagaaaccaagatttataagaccgtgtggttatcgcggttatcacgtgtggtaaccttttcagtttttaaaaccatggtatatctcgcgataaccgcgtagttatcgcggtaaccaccgctactacggaattctaaataggtaccagcctaaagatacaggtttaaagcaaaactggcacctattatcaattattaagtgcgggttagagacaaaaccggcaccaatactttaggttctggttattaacaaaaaaagaggcatctatagttcattcggccactacgggacaaacctatatgtaccggtttaatttaaaaaccagcacccatatatacttaggaccagtacctatgctattaggcattggtaccgctaaattagatctgactaggaaaccgattagagtttatgcagtagtgagccaaactgatgggtgacggtgtaaccccaccaccatacaatttgttaaaccctccgagcacgacaacctgcttgtggcaaacaccacgatgaatccggagctgccttgcgctggactcggctgttgggtactttggttcgctggtggttaggggtggatgccgagccagctcggctcggcttgactcgctctagctcgtttagtcgtttagacggctcgttatctaaacttttgaattatgatctaaattcatttgcacttaataaaagccagcttctgctgtagtggtgcagaggcccgtcaccgatgtagaatacatgtctagagttccatattctagtgctgttggttttttgatgtatgtcatggtttgctcccgtccaaatttatctcatgctatgtgtttggttagtagatacatggctaatcctggtaaagaacattggaaagctgttcagtggattttcgggtatcttagaggcacagctaatgcttacttgaagtttgacaggactgataaggggcttgttagatatgtggattcagattttgctgcagatttggataagagaaggtccactgcaacaggaacccccctctagcaatacatacttggcaacacattaagcatgcgttgccaaaatgcgagcctaacaacgcttattagtgggtgagcctaatttgcaatagataatatgtgttgtagaacatgtgttgcagagattgagtatcttgcaatgcctgagtccactttacaatagataacattcgttgcaatggtctcaatgccctgtaaaaacttttggactaagcaaacttattgtttatttttataaaataattgaaagagatattcttttttttacatttcggacatctagcgagctggtttttttttaagaaatcatcaagtgagttggttttttgccatgtaaaaacttttggactaaagcaagctttctttaaaaataataataattgagcgagctgtttatttacattgtgtactgggcgagctgttttttttaaaaaaaaaatcaagcgagtttatctttttttttaaaaaaacgaatcggcctgtgttaatcga

SEQ ID NO: 47339 - DNA, 965 bp, Oryza sativa
caaccccagcctcggaagacagtatttggaattggaggctcaactgcttctctcgaactcctacgtatagcacattatttatgggatagttacctgatgggcctgatcttctgtcatagtgctaaaagatttttggtgcattgaacctgttcgatgatatggcattatcaatgatgcaaacaccaattaaacttatttagctattgagttgaacatgatattctgactagttcatgccatgtacgagcagaccatggacattcagcattctattgaatgccgcagaaactttctgctaccctgttaatcaagcaaagttgtactccctccgtcccattataagtgcaaccataagtttccgcgcctaactttgatcgttcgtcttatttaaaatttttttataattagtatttatattgttatgagatgataaaacatgaatagtactttactcgtaacttatgtttttaaatttttttaaaattttttcaaataaaacggacggtcaaagttgggtacgaaaaaccatggctgcacttataataggacggaggtagtagtcaatagtaggaaagtattacaccaatatgttatgccgctggatttgtttataaaacaattaccaatctgtttctctacattgccatgcctataggattttaaataaatttgtgctaacaatattttcactggatttagaccaaagcaatgatccccttcatttatgttgcctcttttccaattaaaggaattaactaagttctgaattttcaagagactaatttacatttatggatgataatataattttgatagtttatttctcatgtttaaccttgaatcatttgtactaaaaacattctctctatcctttaatagtcccggcgctgatcctccatcaacgtcgtgactttcaaccccgcagtcaatcgccggaggtctcaccacttggcagtgccccgatc

SEQ ID NO: 47340 - DNA, 1175 bp, Oryza sativa
ttcctgatggctgttctcaaatatatccaaatgtgtaaactgtgccgaaggaaaaattcatgggctcaagacacatgattgccatgttctaatgcaacaatttatgccaattgctttgaggggtattcttcccgatgatgtcacatccgtcttgtttgacttatctgcttacttttgaggaatatgttcaaaagttcttcatgttgatgagcttgaccgtttggaagaagcaattaaaatcacattatgcagaatggaaatgatatttcctcctggattcttcacggttatggtttacttggtcgtccatttagctactgaatgtaagattgctgggccagtttgctatcgatggatgtactttattgaaaggtactttattaaatatattagtatacaatttataatatttgtcatatgtcatatgatatagtcgtaacttattaattttgtgtcttgtatatatattacaagtacttgggtaaattgaagtcgtatgttcgcaacaaagcgcgtccagaaggttcaattgtagaatcatatttggcagctgagtgtatggcattttgttcacgatatttggaaggtttccctaccaagcataacctaccatcaaggaataatgacaaaccagatcagtttgagactcccatgagtaggcaagaatccactttgtttcctccagtaggaaaaccattgggaaaaccatcggtgtactccttaactgatagagaaaaattgcaagcccatagatatgtgctatacaactgtgatgctgtagtaccatatctaaagtacgtattcttttatatgtggcataaagtgttttgcttagccttttatgtttatttgttttgcagagaacatgttgctgatttaaaaaggaataagcgcaaaaggttaactccaaaaaacattgaggacatgcaaaatgaacaatttcctaattggttcagagatcatgtaagtatcaaaatttagatttttcttttcaaatatgagtaaaactaatgcatcttttggtgttgtgtagatcttgcagttggagaatcaaagaggtatcgatagcattgatgaggatattagatggttggcacgtggaccaattgaggtagcaaaacgacatagagcattcaatacccgtgggtacaggttcagatcaaagcgttatgaca

SEQ ID NO: 47341 - DNA, 20921 bp, Oryza sativa
tcctcacttggcgagctctttatttttatggtagtaattttggatggagatttactgggatcaaggcttcttcaccacaatagctttactgtgtcattagcagatttccttggattgtccaagtgattgagccagatggatgcattttttttatttgcatatatgctttgtgtaataatgttctacattagttatatacagaattggtggttagatcttatttttcaatatataagatatcatattgtttatatgatgataaaatggaatggccgactataatttttgcatctatctgtgttgtgttattctatttccatcttatacaaatacctggagaaaactatttacattgtcaatggcacctaacgtgaataaataaataaaacagacttctccaacgtgaagtggacatagcctagtggtacttggctgcttctactgaattgaagactccagttcaaatactagcaaatgcatatatttttttcatttcttctctagtgacgatttttcatttcttctctattggcgattcctaaaactttttaaattctgtcggctcagattttttaaaatttcttgaacttttttatttctaaattttaaaataaaccatccaaaaatatatttttagaatatgtggtttttcgctcgtcctaacataatttaaataactattaagaaaaaaaatatgttacgtccaaatttcacgcggtctatccgaatcaggtcgacaacgaaataacacgtggctaagacaaaatatgttacatctggatttaatctgcggtgtccggaccacaagtgttttttcggtagtgctagcataatttaaataactataattttaagacaaaattatttatgtccggaatttattcggtctgtccggaccgggtcgacaatgaaaaaacaagttattgtttggtagtggtaacataatttaaataactataattttaagacaaaaattatgttacgtccggaatttatccggtctgtccggaccgggtcgacaatgaaaaaacaagtgattgtttggtagtgctaacataatttaaataactataattttaaggcaaaaattatgttacgtccggaatttattcggtctgtccggaccgggtcgataatgaaaaaacaagtgattgtttggtagtgctaacataatttaaataactataattttaagacaaaaattatgttacgtccggaatttatccggtctgtccagaccgggtcgacaatgaaaaaacaaaaattatgttacgtccggaatttatccggtctgtccagaccgggtcgacaatgaaaaaacaggtgattgttttgtcgtgctaacataatttaaataactatatttttaagacaaaaaatatattacgtctgtttttcatgtggtatgtccggaccgggtcgatgatgaaaaaacgcatagtttttcggtcgtgctaagataaattaaataacgattattttaggacaaaaaattgttacgtcttgatttcatccggtctgtccggaccagattgacaaaaaaatacgttttttcggttgtgctaagataaattgaataactactattttaagacaaaaatatgttctgggccgagtcaacaatgtaaaatcaagtggttttttttttgtcgtactaggataaattaactaactacttttttattaagacaacaatatgttacgtctggatttcatccagtctgtctagaccgggtcgacaatgaaaaagcacgtgatttttcggtcgtgctaagataaaataactaactactattttaagaaaacaatatgttacttccggattttatccggtctctcaggaccgagtcagcaatgacgcggtttgtactactagaaaataatttttactagtgcatttatgaagttttataactacttcttattgatccgcacaaaaataaattagctgaactagattagataactggaggttaaatctgccctgaaaaaatcgagcttaaatttacttgatgtgaatttaacattttgtgtatttgcgcaaattattttgctctccctccattctttccctcttttttcagtcttattccaaatcattccctccaaaaaattgagcttaaatctacccagtctgaatttaacattatttttatctccgacaaaacgtttgctctcgctccgttctttccctcttttttttttcagtctcacgttattttccaaatctttccttcgaaaaaaaatgagcttaaattattttgctctccctccatttttttcggtctcaatatttttttttctcacgtctttcgttgtcgcgccatttattccctccattttatccctccaagaaaatctaattgcccgtgaaaaactctatcccctctctctccattctccaacaaagagatcgtgggtgggttttcttctccaacgaaactctatcccctctcttcttctctccgctccgcgtgtccactcctctcccaatctgtgttggctgccatcctatgcacctacctacacctccctgccgaccaacaaccctgagcaggcgagctcccccacggccgctgagggccacgcggcgacgcctcgtgcccggtggccgtgcactgcagcgctagtgcggttttgcctccccagcgcctacgtctacaccgcgccgcgcaccccacggccctgccgccatgctcctgcatctccgcctcccttcctagttcctacatgtttcactacttagctgtgttgccaaatcacactcgggcctaattccatttcagcactatactacattactaatttgatatatatgttctgtatgcaggttttggatcagatgcagtgatgaatcctaggtgacagagcctattaggctagaacagaccagtaagcaatccaatgtgtgatctttttatattcctctgtcctggatgttgcaatctagccgaataaaccacttttgcttttgatcgttcactgtccatctatgcattttatctccttgcgtcaaattaaattttgttctttctatcaattacttgtttcaaattgttggccaattaaaatggacaaaggaattagtgactggcaaataaatccaaattggaattggtaaatttattgttcaatttttaatgtgttgacacctctatttgaaaattgttcattagctaacagaggtatctaataacctgtaggctagcacctttctcatcaatacaaaccatagtggtacttttttggacaacagtagagtaaaatgcctaaagttttagccaattctgaaattattcttctagagcagtagagaaaagtggtactcaaactgcaatacataggtttatgctatttttgttttggtgcagcagatatggcaaggagtagaaggcggtgcattgttcaaagccatgaggaatatttgtcagaggaacacattgcagaagaaaatgcccctaaacagcttgccacaccatctgaacaagaaacaatatgtagtgatgttcaagagggtaatgaagatactaatgacgatgttggagaagccaatgaagatactgatgacgatgctagtatgaatgctggagaaggcaatgaagaatctgatgatgatgttgaaattaatgttcgaggtaaatactaaatcttgatggtaagaaataatgaaattattcttcttatccttgcaatttaacattgaacagatgaaaatggaacaattgaaacacgtgggaagacaaaactgaaagatatttggaaccttccgaaaaggcttaggattgtggttcagtgcaatgatctcaaccaggcagtaggagatgaagctggaattttgtctaaatttcttggaatggtagctaggaatggtactttgtgtagcttaagctacacagactggagatttctaataggaaagagagagagaaaaacaaaatccctagatgagtttctttgttggtatccagatgagattcctttatgctcctcggatggaagaattcatattaaaaacaattagagagagatggaggggacataaagcaaaactaaaagaaaagtattttgatgtgaataagagcaaagaagctaattgcaacaatgtcccagctgatgtgcttcctgaccagtggattgctcttatcaatcattggatgagcgagaaatcgaaggtatataggcattgcatattcactactgtgatgttcttacaaatgagactatcaattgaactaaacaatgttgtgctcatgtatatttgctaactcttatgatacgagaacagaaaataagcaagcagaacaaggaaaattgtcgaaagaagaaggcattacacacagcagggacaaatagttttgctcgtacaagagaagagatggtaaaacatgtcctggaatagcatttgtccaatttccattccaatcctatatagactgtgtaggatttaatgatttgttcacatgttccatagagacaaaaagatcctgcaaagaatcctcacagagctattgtgtacatccaaacacacaagcgcaaaactggcaagaatctaaatgggcatgtggtatactatcaaatctaaactatagataatttaagtttcaactttttttcatatgttctattcatattgttcctgtgtttaggataatttgaagaaacttgtagttgaacaaccagctttagcagacactagtgaaggaaggactgcttggaaaggagatgcattgaaccaaatacttggagatgacaagcctgggcatgtgcatggtcttggactagttccaaagcctaaacaagttctcgatgtgccaaattcctgacgcttaaagaatataaatgttactagactggatgataactggagtgaagatgttgtggctgctagactgcagttggaaaagatcgaaaatcatgtccagaatcatgatgctgagcttttggaattgaaagcgaagacaaacaagttggaaaaagaacaaatgaatcaggtgagaatttgaagaagttgtcctaaaatgtttgtaactcactgaatgtatctaacctacctagttggtgttacagggaggtttagatcgagtatctacaaacaaagaagctagtgttgatggccctatttcgaaaaggagggtatgtatctctatggaagattaccctatatagtttggaaaaaaatatggtctaaaactccttttcttttctactgttgacagagagtgtattctgaccatcccttgcaagaaatttgtattgctgaggaggaaaacgatatggttcaggaggaaaacaatatgatggtaatatactggaattgcactattgtaaagctaggaatagttgcactattttgtaattgagaatatatggtccctttcaaaacagaatatacagagccatgttccaaatgaggatttgcaaccaaaaaccaagcaatgtgttgaagacaaggtacttgtcttaccaactatattattattctgaacccaccatgattacttaacattatatgattttgtactgtttgtagctatggttgtttactatagttcataatcttatgcattttattttagaacaaacaaaattgggaacaacatgactatgggaaacaaaggaaggttatttctgcacaggttagttttcattttttttattgattgcaactcaccatgtttgtgctattttaatgcaacaattgatgaaacaatccatgtcttagagttttcgtaatgtttttttaccttcttctatagaaaaaaaaaactaacaaggaaaaccatgtgatgaatgcacgaaaagttgttgaagcatccaaggttattttttattcatcatgtctataaatttctgttttttacaaaatatagcatgtatgattgactagtagttttgattacattgcagaataaagaaagagaaaaaaaatgctcagagccatgttagactaggccaaaaccaaccaactgctgctcctaaggtttgtactgtttattctattatattttgcaagggattgactttgtgcacagatttatgttttgctttagcacttcaacatttattttgactgtatgcagttaagttgcagactcatgatcgaaacaattcttatttttacagaaaagacagtgcagcacaacaaactttatcgctgacaattcaatggaggtaaaccatattaaagttttactgtacagtgcttcataaatatatggtatgaatctccatttggtttctactattgttagagagtgtgtgttaacggtcccttgcaagaaaattctatggttgagcatcaaaacaatatgattgagcatgaaaacaatgctatagtaaagtataaaaattacactgtttttagctgggaatagttgcactattttctaactagtaatattgtctctctttcacatcaggacacaaatatccatgttcagaacaaggttttgcaactaccaaccaagcaatctactatatataaggtcattctcttcttatttgttatgtcgaactcactacatagcattatatgatctcgatattgtttgcaactgtcaacgtttattgtagctgttcattacaatcttatgtcttattttattacagagcaatcaaacttatggccaaaatcaccttgagaaacagaggaagattatttgtgtgaaggctagtcttcacttttttattgattggaactcacagtgtttaattataaaaataactagattattgtagtttgtgccaatattttgatattccatgcagaataaaggaaacatgaaccagaatgatcacatgcaacaagggaagaataattctaatgcttataaggtaaatttttacttctggagccacctaatataaagataagctatagaattctatttggtataatatgtttgtactttatagttaaattattgaatcttgatccaaataactttgtacataaacaacagtgcaacatagtgaacattatggatgccaattcattggagataaaacttttaatatgatgttcttttccatacttaattgctctttatgtagagataatgctcatggacatatatttatgcaccagattggaactaatgtattcttgaaaagctggaaaaatcgaaataagaatgtggctgttgcttcaattgtaagctgtgatccaacacgcaaagttgcaggtgttgagctaggaactgaatacttgatggtgcatgttcattttccattggcaaaatatgaagaattgatcaggccatacaaaggctacaaaattattagcaatgtcgtaaaacttgatattgcgtggccagcaatttttgtacggtgctatttctcaatttctttagatgtggtcttctttcttccaatgttgtatcaatggttgtttttttctgttacaggttgacaagataaatggatcatgatctggggcaatatggttactgcaaggtggacaactgtcatctaaagatcccttgtgaatatgatgatgactgtaatatggaagatggtggcaatgatagtggcaacttcagatgcatgtttttttttctatagtttagtttacatttgtgcatgatgttctgaacaaaatttaatgtcatgacttatgaggatgattttccatgtaatacaaaaaattctctttaattacaattagttttatgaatgacttggtttttctcatgtgtacatcatttgagtttatgtgcctctaacccaacaagataattgtgcaaaggcatgctggaatgaatagttgcctatattgcaatacttataagtgttggtgcaacttgattatagccgttgcaaggattatatagaattgttcatcaccgaaactaccaacgcatacaagtatggctgaaaactatttactttgttgctaactagcaacgtttattcttacatgttaccaacgattgtgtatgtgttgttattggtgctagcaacagcagcataggcaatgcatattaaatgcattgatagcgcatattaaatgcattgatacagaccctagcaatgcttattttcactttttgcaatacatatatgtattgctaaagggggttcctcttgtagtggtcactcacaggttatgtgtttaccattgatagttgtgctgtgagttggaaggcaacattgcagcctgttgttgtctaatctaccactgaagcagaatatatggctattgctgaagcatgtaaagagtcagtttggctgaaaggattatttgctgagctttgtggagttgatttttacattagcttattttgtgacagtcaaagtactatatgccccaccaaagatcagatgtttcatgaaaggacaaagcacatttatatcaagtaccattatgttcgcgatgtagtcgcgcaaggtaagctaaaagtatgcaagataagtactcatgataatcctgctgatatgatgacaaagcctattcccggtgctaagtttgagctttgctcaagcttagttggtatagtggtttagcccaagaggctatttggcgccgaaagtgttttatgtctttgttgtgttcaggatgaaggattgattcatgctacaagaaggaatttgtctcaaggtggagtttgttgagttgtgatacaaatttatttgcacttaataaaggccagcggagcccccgcgaaacggatcgttatcccttttagggttccaccatatatatacctcatgtaagccgctgtgtggcgatataaactccccagatatagtgaagatattttgctggctggcgcccgtggttttttctctcctgttttggaagggttttccacgttaaatctcatgtcttatataattgatatattgttttttatcgattgttcgcatatcatttccttaacataaacgaccagaaaacgcagctcggctcggctcggtcagtagctcgagctagctcgttttggctcgcgagctggagagggcaagatatcagacatcgagattagaagagctaggacaacgaaacgtgtgccgacgagcagcctgcagcggcgaggacaagcacgacggtcgacggcgaggcaggcaggtatcccgcagcagcgagttcgagtgcgacgaccgacgacgcaacaatctgcagaggcgaggtgacagcgcatgcgacggccagctggggcgacgccgcgacgactgacggtgctgcagccctcagcgcaaactggcagaggctcgcggcagagaggcggcgacggcgcaagcaccagggaccgagaaggaaggggcagcgcggcgtggctgcgaggtccgcgcgtgcaccatgtggcggcgctgggcgatgagcggcggcgctgctggcgcagatggattgtgcgcgatggtggcggactggcggcagataggcagagtgaagacgagagatcgagactcgagagaggcatatagggtttgtggtaagtagtagtactactggtactttccatgctctgatgggcctcgtggccttgtggcttgggattgttgttgcctgctgggttgtcaaatgtcaaagttcgtttcggctcgcgaccagctcacgagccagcttaacgagctaaaaggctagctcggctcattagaaaaataaaacgagccaagccgagcttgtaacgagtcgagcgaactaacgagtcacgatcttttatccatttctactggtggtcaccacccgctgggacgacgccgacgccaactgccctcctcggtacgtgttgtgcacacgtggctaccagccatagtgcaacttaggctgtgtttagttgctcccccaaaaaaaaattttgacgtatacggatgcacatttgaagtgttaaacatagactaataataaaacaaattacagattctgcctgtgaactacgagatgaatttattaagtctaattaatccatcattagcaaatatgtactgtagcaccatattgtcaaatcatggcgtaattaggctcagaagatttgtcaagcaatttacatgcagactgtgtaattggtttttttcgtccatatttaatgctccatacatgtgtctaaatgtgacggaatttttggaagtttgaagggaactaaacacagtcttaggccttgtttaggcatggtttagttcccaaatttttttcccaaaaacatcacatcaaatttttagacacatatatggagtattaaatatagattaaaaaactaattgcatagttatgggggaaatcgcgagatgaatcttttgagcataattagtccatgattagccataattgctacagtgacccatatgtgctaatgacggattaattaggctcaaaagattcgtctcgcagtttccaggcgagttatgaaattagttttttcatcagtatccaaaaatcccttccgatatccggtcaaatatcttatgcatgcgacacccagaaattttctttttatgaactaaacaggcccttagttcccaaaacagaaattttcacgctgtcacatcgaatgttttaaatgtagagaaaaaaccgattacatgtaaattgcgagacgaatcttttaagcctaattgtactataatttgataatgtagtgctacagtaaatatatgctaatgacgaattaattaggcttaataaattagtctcgcagtttcctgacggaatccataatttgttgggactacctaaaaaactgtcgagtgtttttaaggtgaaaactttcaaatctaactatagtgtataatttcactagaactatactataataataataacttatatatatgtattaaaataatatatacaactttatatctaatttatatagagataacaatatagttacaatgtaattatagtgtaactacaatgtaactagcatgtaactggaatgtaacttagatgtaacttaaataaatctaccataaacatgtgatgatgggactagcttgtgaaaagagggtttagatccgataacaaaatatctcagtacaaatcttagagcggaattgatggccaaaaaatttgacaattttcacagaagaaaactgtcgacagtcatctagcagttccgtaatttgttttgttattagactacgtttaatacttcaaatgtgtgtccgtatatccgatatgacatccaaaactaaatattttcccctactaaacgaggcttaattagatcgtgcggcgcaatcaagccgcctgtcgcgcagccctgctccacgcgctgccgcctgtgtgcgcatgcatatgcaggaaggctctgcacacgttcagccgtccgcaagtcgaacgcgacttgcccgctcctccgctgtgctcccatccgttctcccgacgcatcggacggacctgattcttccgcgatggggactgttcttctttctcctaagtcctacgtactcttctgacctgcattggatctttacctttttataccttggtcctcttccatgaaaataactgaagcaaagggatcacggacaattcagcgaggaattgaacgaagatattggttggaatagatcgactacggaggtgtgtgacgtgtttgtcatgagttagaatggtgacaagcggcggcaagatttcttatttgcttcggcaaaccggggtggaggtagagtatgggaagagggtgcccagtaacccggttaagaaaattttttagctataactcaccgattttcaccatgtgtacagcccctaaatacaaactttggcagccgtatcagtttaaacttgatctaaagtagagtaaattaagcaagagccaccctcctccattttgttctagctccgctcctggcaaagcgatatatcatatcatcaacactgaggatcaagtgtagattgttaatctgaccttgattatcgctgtaattaacaccgtgcagcaaaatagcagattaggatattttctatgccaagcatccctaaatacaaacttgggcacccgtatcagcttaaacttcatctaaagtagagtaaattaagcaagagacactctcctctatttcgttctagctccgcccctaacggcaaagcgatatatcatatcatcaacattgaggatcaagtgtagattgttaatctgaccttgattatcgttgtaattaacactgtgcagcagaatagcagattaggatattttctatgccaagcatatgttgccctcatatctgaggtcattacctttgatttctttcgtaggagaagaatggaatggatcattaaggagtagttctagcatacacttcacttttcgttgaagatatttcttttccttttggaaaaatgtcgtcgttgatttggaagggcagagaagaagctgcaggacccaccgctggagaaacaaagcggttcgatgtatcgggagcacggatgggagcaggcaagccacgtccgttttgtgggtggacggaaagtttaagggacaaacctataaaggaattttgtgcgtcgcaatgaagacggatgatttacagtgtaaatagatggataaaattaaaagaactaggcaaaaaggtatatgcatattgaaaaaaaaatgattcaattggttaattgtgttgaaagtgattgtgtttccaattaaacaggccttggcccttaaaatagacggtattgcctcctataggtactcatctatattcaatttgagatagagagatcaattggaattcaaaatttgctttggacttggactcaatcggtctgaccggccacgtatcgccggtcaaactagccccatgtatacaattcaaaccataagccatgcaccttgaaacagtactcaactgaaggggttgttttgtgaatagtttaaagatgtgaaatcactgatagggtgcggaatcatttgaattcaagagggcatttcagacttttttttactagaaaaaaatgtccgtgtattgtaacaagtgatggctattatactcttattattgttatatggtttatttaagataaaattctctattaaattcgcttggatatatattttgttagaaaatcatgagctgcattaggaatccgatcgtctcaaattagcgtgcgagtttttttaagagatttcctatacaattccttttatattttcaaaagcgaacaaacttaaaagccgactcaaattcgtatttatattttcaaaagcgaacgaacttaaaaatagactcatacacaaataacgtatcaaagtaccgacaaaaataacttcaatttataatagtagagatttcttattataatggagacaaacatgttcctcatacatgaacaccacatgcacacatatgtggacgtccctcttaacgcaggccacaatgctatgatggtttaaactaagaagccgagttatggaataacaattccttgaccacaccaaagttttttctttatccgaacgcacgcaaatgacatattctctttttacaatattgttttaagacacaattatgtgtgcgctttgatcagttggaaatttgtgaggttcacatatctatataggttctgtctcctaaacacgtgtttaaagtactccctccgtacaccgttgacttttcaaccaacgtttgaccattcattttattcaaaattttcgtgcaaatatgaaagtatttatatcatgcttaaagaatatttgatgatgaatcgagacacaataaaataaatgataattgtataaattttttgaacaagacgaatggtcaaatgttggataaaaagtcaacagtgtcatacattaaaatatggagatagtagtatatttaggtttgtaaatacatcagcacggtgtacaggaagtacaggttatgtggtgtggtagagttgtgagtgtatgatttcaccctttaagatatcatacatacgtcggtgtgttttcaataggtttttaagtcaaaatatggattaatttagaggacttttacggtacattctactgctagtatatactaccagtatatttgatctaacggtgtaaattcatctgatcttcctcccaaatatcctgtagtataaattgtttagggtatatttgtctttttatctatttgtgtggggggtaattttttaaattcgcgtttcctcacttgatctgatccgatcgatagccgcccgcccagtcgaagccctttttttctcgatgttgcgtgcatgggcgaccgtcgccgctcatttcttctgcgagctgccgacgaccacaatcggcgccgccgcgccgccgttctttctttagtaagttcaatgaattaaggacttggtatgtgttagggattcagacacttagaaactgatcgaaccaagaatgtatgagataatccacttcattgctgtgaacagatcaaatctatttacactcttatgtggtcttatgcaaatcatgcccattgcaaactcaatctactagattaaatccgaccgtcgaaggaattgctacgcctccactcgcgccgtcgccacgcacgatgggagcgctacaacacccggacgacgagatccatgaactcccgattgaattaaatcgcaagaaataaatctcaatttcaaattactaaacagccattttcagagttttaacaaataccaaatctaccctttaacatactgctagtatatactagcagtagaatgtactgtaaaagtcctcttaatttatcgttggtgtccatatcatgttttacagggggcatttgatttgtgggtgtatttgaaggtggtgtgcaggtgcgtgtagcgtatacgttttctatgtaatcacaaggaaaaatatatgtggggtgcgcctctacggtgatatctcttaatctttatgtctttgttctatgtaattataatagaaaataaattaattatttaatgacttatgaacaaataggtcaatgaatggattcatataagtttatgtgagatcaatatttatttttgcaacacatggtgtctgcccgggatcaacggcccgtcacatgatcgatcgtgccaacgtgccacacagacaaacctgagctatcagacgttatggatctagtatttctcaaagcacatgcgtgcacgattcatctgtgcgcaaacaattgcataaacataaataatatctgaagttaaaacatagtcccaagctcagtacaggcgttcaaattttggaaatgcaagaaaaaaacaatttgaaacctaaacagatttacctaaacttgaacagtaattttttttctaaattcaaacaattttgaccttttgcaatatgcatgcatatccagctatggcctaccgattgctcaaatccgactttgtatagtttgcaactgtgctacgaatatgtaccgtgcaatagtaaagtggattacgggactcaaccgtaaacaacgcatagtcggagtctcgaagaacaccccccctctcccgcacctcccctcttttcctcctcaacacatacaatagatacaggggtgaaaaatatcattttgaataactagatgagatttgtcatatatacttaaataggatttaagtttagcaactagaagtggaaacacactaaagcagggccctatcaaatgtagaatgtttcaagaaaaagcttggaaacagatagtgcagtacttttcacctttaatcgagatgatggcatccgatttgatctgtcgacgattccccaagttttggattctcacccgatggaacatatgcacacagcctagctaccgcaatttggccacacatcgatcacaagagggaataattcgattccatttcaaccttcaaaatatttgcaaccatacaatcatcgtgtggacggacgatctcgatcgatcaaacgtaatcaaacgaaggactacgaaatgtacattgtcagcaacctaaaaagtctcacatatggaaaaatatttcaccatcgtccacgtacacattgactagcaaacgaacactaccttctaatatatgttcttttagacttttacacgatgaattaaagagtaataaaatgtgacttgatatctagatgaaccaaacaaatcattagaagaggctaattaagcaggaaaagtaattaaaagtttacttgatttattcttctagctgcgagcggcggcggcgtcgtcttctacggcaatgtcggtgacggcggcggcggcggcggcctcgatccgctcggccatgcccttgccggcggcgtcgaggtaggcgagcaagccgtcccttgtccaccccttcacgggctcgcactcgaacgcccacacgagcttgcaccctgcggcggcggcggccgccggcgccggagcgttgacatccacgtcctcgccgtcgtcgtcgacgagcgtcatggtggcgacgtagcggccgaaccccaagttgctgccgacgacggcgtagacgaggcggcgccgggcgtcgtccctctcgagaagctcctcccgcgcccacgtctccaccccggcggcggcggccgccggctgctggtcgtcgtcgtcgtcgtcaccaccatccttagctcgcggaggtggtggtggcgggcgggaggcgacgtagcggacgcagccggggacgccgtcgtcgccggcgacgcgctcgcagacgtcgatgccggggttgtagcggtgcagcgagcagaaggcggcaaggtgcggccacgccgcggcggccggtgtcgacggcagccgcgcctccaccgcgccctcccactgctgctgaggctgcgcccccatctccggctccggctccggctgctgctgctgcggctggtccgccattgtcgacgtggcgttgaaggagagctagcttagcttagcgaggtagcgagagtgtgaagtatactgcttggagcgtgaaattagatgctctggtggtggagacgaagtagtggagagggtgaagatatattatgaacgccttccactcacgttaagtttagaccaccccgcttttgggggagagatggcatgcgaaaatgtacagcgtcatgtgcactccagccatattaatcccctttttttaagtaggtttgtttaaattaagtatggctcggatgccgtccagtggccactctgcagagatagggccaaactccatagtaattaattaagtattaccagtacctattataaattttaaaaataaatttatttgaattttaataaaaaaaacttaagtaataatttatttcgaaaatgtactgtgtttttaagccgttcgataagcttgctaacggaaaatatgagaaaaatgcagtctatgtttcggatcactactagatcatccctgccggttcgatagtgttctaattttctcgtccaatgtaatcccatcatagtatgacactattacagtttggaaaaagtacgaattacccctcaaactatcgcggtcgaccgaattaccccctaaaccataaaataggacattcctcaccctcaactatgtaaaccggacaaattacccccctcgacccaatccgcggtggttttggtctacgtgtcgcacgtgtggcagtccagtcagcattctattcattaaaaaatgtgggacccactctcttgtctctctcactcttcttctctctcacgcgcacagtggcgaggacggggccggaggcggcggcgaggacggcggcacgcacggcatggcagcgcgcacgcacgcacgcagcggcgaggacggcggcatgccctgcacgctccgtcgacctccctccgccccgcgctttctcttccttccctttcacctccccctccatcggatcggtgccgccgccgcaggagctcaccatcacgcggcccgatgactgacacctccacctctgggaaggcgatgtcctgtcagccgtgctccccacaggttggtctgctcggctcggcgtcactggctcgttttactggtgccgcacgcctagtgttcgatgttatgtctcagtgaggtggcctgactgcttgcatgatcgtgtttgcatgtttttgggcagcgcgatgcatattgggaggccgtaatgcccaacttgaagccaccggtgaccacaacagcacgagctttggagtactaggaggagatcctcaaagcgctgcgccgccgcctccgggccctatccacgtgcgtgtgcgccgccgtgcgcgtctcagccacgccgccgtcctcgccgccacctccgtcccctggccgcgtgcgtgcgcgccgccgcgccgtgtgtgctgccatcctcgccaccgcctccactccccggccacgtgcgtgcgcgccgccgcgccacgcgtgccgccatcctcgctgccgcctccggccccccgtccttgccgctgtgcgcgtgagagagagactaagagagaaagagtgagagagaaagtgtgtgagagagaagacagagagtgagagaggagagagaagcgaaaaagagagtggccccacatttttttttaatgaatggaatgctgactggactgccacgcgtacgccatgtagaccaaaaccaccgcggattaggtcgagggaggtaattcgtccggtttgcatagttggggtgagggatgtccggttttgtggttcaggggggtaattcggtcggtcgcgatagttcgtgggggggtaattcgtactttttccttacagttttggccttctacgatgaattttctttgacactttgaaaatgctatagatcactagtaatagaacatttttttccaaatgggtcaaaagtgattttcgcgtacggaccttcagtcaatctgcccagaaagatcaatgaaaaccactatttttccacgcaggtggtccacccgcacacaaaaatcggtgtttcgggtacgggaccttctgcccgaaaagacatgcgaaaatcactatttttccatgcgggtggcgcacccgcacacgaaaatcggattttcacgtgtgggtgcttatgtagtccgcacgcaaaaataaatatccgaaaaaaatcgcaaaaattcaagggctcgtctgcccgctgccatcttactcctcctgccactgccgccgctgtcgctggatccacactgatcggggatggccaccggatccgagcgggggagccgccgtcgcctcctttaatgcgtgggggagcctgccatcggctgtgcctcccaccacccgctgtcggcggtgcctccagccgcctatcgcgaggccggtggaggtggatccgcttgttgcccgccgcctgccatcagctgcaccgtctatcgcctgccgcccacggatctggtcgtcgcgggcccggccaaggtggatccaagcgtccaaagaccaagccgcgcgccaatacctctcgtccagagaagatgagagggaggaaagtgagaggcggggaggtgagatgttgtggggaaaatgaaaaacgaaccaacccaatccccttgccggagcgttgagaatgggcagatctggccaaggcccttcatcgagcggatctagctagcgtccacctagccggagcgtgacagcatgtgagatggccaggacttagccaatccaccaaggcagtaggcggccttgaatagtgggcaactgtgtgacaacaacgagggcgtgacgtcgagactcgttcggggcgctctcgccactgcagccagcacgggggcatacgcacgcaggtgcacggtagctcatgatcccccttggcccgatcgatggagctggaggttcgggatgtcgtgggagaacgatgatgggtcacttggaggacaattaagcaggccggatgacagcggccttggacgtcagtgggcgccaaggcgtcacccaacagccttctcggtgatagcaaatgatgtgcgcacactgtatattgtctctcatggtctcttgggctaacctaaaattttgtactatcaggccttttagccgctcgtctaggaaaaagtacaccgaagttcggtccctcaacttgtcatcgagttacaaattcgtccttgaaccgcaaaacttcaacttataaaaccagtgcaaactatatccctcggcgatgttaactccagtttcatccgacgtggaagcttactcagcgtgggacccacgtcggtcccacctatctgcctctccacctctcttcctcagtcctcttattttctctcacttttctcctctttagttgggcagcgcaggatgggtgggggaggtgggagtccggcggccggcgacaggcaacgaggcggcggcggcaacaacacgggagcaggagggcctcaccccacgccaccgctaccgccgccgctgacggcgcgggcgctagatccagccaccacgggcggcggtccatggacacgtgcggtcggtgaacactaaaccgagggacacgtgcggccggcgacaggcgacgaggcggcggtggcaacaaagcgggagcaagagggcctcacctcacaccaccgccgcgccgctgccaccaccgatggcgtaggtgccagatcccactgccacgggtggcggtccatggcggcttgtcgatggcgcgggtgaacatgtccttcactccgtgctggcaaggtcgccacggacgtgccgcgtgagcgcgtacctcctcatcgcctccccatccaccagctccaccgccaccgcctgcttaaagtagtcatccgcgtcaccggcatggcatcatcgttaatggcaaaacacgtgggaatgcaacgtcgatggcgacgatgtgtgtgtacctgtcgaggtccttgtcaaactggtagaggagctgcacgtggttggagaggatgagcgagttgacgtcagcggcagtggcgatgatcctctcatatgtcgccttccatcggtggacacggatgatgtcgatgatctcctgcaggccgccctcgtcgtcgaccaactccaccagctcaggcatctcgacgtcggcgtcctcgatctggtccatctcgccgccacggaccaccactcgtggcggctggatctggcgcccgcgccgtcggcg

SEQ ID NO: 47342 - DNA, 2416 bp, Oryza sativa
gccgccgcctcgtcgcccgtcgctggccgccggctgccggactcccgcctcccccacccgtcggctgcgctgcccaactgaggagaagaaaagtgagagaagagaggtggagaggctgacatgtgggacccacgtgggtccgatgttgagtcagctactacgtcaaataaaaccggagttaaaactaccaaggacctattttgcactggttttataagttgagagatgtgttgtatccggttttgcggttcaatgacgatcttgtaactcgatgacaagttaaggcatcttcggtgtactttttccattcgtctacaactggctaatgggcttagaatacgtctgaattggcctaaatatttaggtccagaaaaggcccattaaatgttactgatctgacattttcacaaggaataagttcacttaaaatcccttttaacggatgaaccaaatagcaagtatatatagtccatccactgtatcattattatgccgtgttaactttgatctacaatgatcagttttgattgacgtaggaagtggaacccacgtgggtcccacatgtgagccatgaaggacgtctcgttggtacggtgcggattacctgtggctgtgggcgcgagtggtgcacgcgccgccgtcgtgctttcacccgcgactttgcaccgtggctttgcgggggattcctaacgcggcggattgtttaggtagcgtaacagactgttagttaagaataatgacagtaattaaggaaaaaaattattttgagatttttttcactaattgattgaaaatttttaagttatatttgaaaattttcaactcgagatttgaaaactttcaactcagatttgaaaactttcaactcagatttgaatatcgaaaactttcaactcagatttgaaaacttttaaaacttttaagttaagatttgaaaattttcgactcaagatttaaaaacgttcaactaaaaacatgctaaagattaaaaaaataatcagaaaaaagtggggaaaaaaagcgaaaaaaatcggttaaaataaaagggcgtggggaggaggcgcgcgcgaattagcaaatccgggctttgcacgccgcccaacatcgctatctcttcatcgctgccaagcatccactgcccaaccatagaacacatcccatccagaaattcgcatctctgatttgactagatagcacccaaacaaaacacaaatcgaaactcccctaaatgctccataccaacaaactaaattcacgattcatctctactattataaaatctgaagatgttttcgtggtccgtcatccatgtttgagtcggttataaataaatgatataaaatttaaagatgttttcgcggtccatcatccgtgttttgagtcggttttgattttatattttggttttaatctatatctcttctctatctctactattataaaaattgaaaatgtttttactgatattttagtatgttattcgtgtatgagtcggtttttaagttcgtttgctttttaaacttgtcaaatttgtccctcgcaaaaaaaaaacttgtcaaatttgtcaaacctcttatgcttggtacactctaatcctttcccgtgataacttctcaaattcactccagaatacgtttggcatacaaatcaaagaatagaggaaaggattaggaagaagcaatctagaacaagaagaagcaggctattagaggctagagaattagagtttgaatcagagaagcattggagaataggagacgaggcaaacgcctttgttcgatgccgtgttctgtggctggcagttcctttgtactcctgctaatttacttgctcccttttatgtgacttgggccaagcccagtttaacctgcagaccactatccagcccatcgtgtatcacatcattgggtacatgacatggcgctagctcttcttcattggcatgtaatcttaatcttaataataactaattaaaatatttatatttttccgttcgtcacccctctattcgtccgtattttcgtccctccctcaaattccaatccgatttcaattctgtgaatgatcgaaaaaattgaaaaaggaaaaagagaaagccaaactttaacacccgaaaacaccaaatatatcgacccaaaacaccaaatacatcgagtccgtcgccgccgctcgggattgggttaggcgccgccaccgttgccacctaccggtgatgggggagggcgccgccgccgttgccggtgttaggggaagacgccgccgcactgccggtggtgggggaggacgcagccacgccgctggtggtgggggagccgctgtcgccgctcacggggggaggacgcccctgccactcgcggaggaggacgctgccaccgctgcccctgctcgttgccgctgccgctcggggggagaggcg

SEQ ID NO: 47343 - DNA, 8771 bp, Oryza sativa
gggagggggtgggaatgagtcctagggttaggttttgggtgtagttatttaggttaggattaatctgtaccgtccattcgatcggacggctctagctgctcccgcgttaggccgccgaatagaccgtgtggtcgatttcaggaggatgcaaaatgaacttcaacagagaaaggaaacaaggcagatacataaaatagacgtaagggtttagaatataagctttctatattcagcccaaacctgaaagggaggatgttgattccttttccaattaaataattgttaaatgaggtttgtattattaaaattagcaattaagctctgaaatttctaataaaattacaaagaacgtaactaaacatgaagaatttaataataaaattaaatttaacctgttattttatttctcacacttgctttacttaaattgattttttacacaagggagggaatataaactttctacacaatgtaaatttttcttaactttccctcaaatttctggtctgtacacttcctgttgcaacgcacgtgcacttttaatagataatgtatgaatcggtaaaaaaatgaagagcaatactccctgcgtgttgcaatactcgagcgaggaagctagcatcggcggcaagtagcaatttccacgacaggttgacaggcaactttcaggcacacaccggcgacgcgctaggcgtggataactggacacaccctcatctctcccgatttataatcatctgtaggtagtcccggtaacaaaccgagagagggaattcggcactaaagatgacaatctttggcccagattcaaatacccagaagtaaagaaatatctttagtccactaaccggaactaaagggggttgcgccacgtgactggcacaaccatctttagtccactaaagattttttttcttttcctttatcattgtttattctgtttgaatattgatttcaaaccaaactcaactataaaaacatcctcattcacaaaatcatccacaaatcaacaataaaatcatccacattcacacaaacacctcaaaatcacccacaaatttacatcacaaaatcatacaaaaaacatctaaaaatccccaaatttacaacacaaaaacatctaaaagaatccccaaatttattcccgcagccccactgggcgctgccgcccacagtcgtgatggccacggcgccgccagccgcagcccaccgcgccgggcggtgccgcctgccaccgacggcgcgcctaccgccgcccgccgcaccaggtgctgccgcctgccgccgacggctgccgtgtcctctcgcatccggtcgcctgccggcaacagccgacaaagaggggaggggaggaggaggaggagtaggagggacgaggagaagaggataagaagataggagaaggatgagcactagtaggcgataaggttgagggatacacacacacacacacatatatatatatatatatatatatatatatatatatatatatatatatatatatatatatatatatatatatatatatatatattggcctctacgcacgtttttttctctctctcccccgcgcgagtttttttaatgtttagtcccagttggtataagtactaaccgatgctaaacatactagggtgcatgccacggcctgacactaaatgaactgggactaaagatgatctttatcccatgtttagtcccggtcgagactaaagaccatctagttttaaactgggactaaaaataatttttagacctgatttttgggtgaaccaggattattgtggtttttgggtaacccacgaaagatagtttctccagtagtgtccctcgctcgcttgcgcgcacacacgcatgcacacgccggacacattatggttcgttctgatctcgctcgcctcccggtcatcactcctacagaagaagagcgtcaccgccgcagcctcagcctctcctaaatctcgtgccgccctgctgctgccgagaaggggacagagagaggacgtagggaaggaagaagcgagagatgatgacacatggatctcactgtacttttttatttttgtgatgaatatattatcacgtggatgttgtatcagcgaaaaccactcgtaaaaactgccgagggagctactatgcatggttttagtgattgaagaaattgttatacctgatttgattttacagttaagagatacgaatcagatccgacctatgttgagagactctaaaagaactttttcctatggttcagtgtcattaggccggcccatattcagcccaaactagctgtgagaacacatagactgaaaaggaataaattcaccggaggtccctcaacttaacagcgagattttttgagatcccttaaccacaaaaccagaaatctccacccctaaactatactaaaccgttcactcaaggtccctaggaagtatatatggatagtttcgctgacgtggcatcctagtcagcaaaaaaaaatttaaaaaagtatatgggacccacatgtcagctgcacttttttttttcgccttctcttttcttttctctcttccctcttctgttcttcagtgagggagaccggcggcgatggcgacgtgcttccgctatgcgccgtccgcggcggcggtgtccggccccgcggggcccagcctggtggggcccatgtgggccccacatgttatctccctcaccacgccgcagcatgccgacgaaggaggagctgaaggcgctcctgtcagcgctgggctattctgcgggcgactgccgaccaacgccgccttccgccagtgctctagctgaaggtgcacacagcgcagcgtcgacgacttcggccagtctccggcgttcatcgcgtcagcgttcgaggagcaagggcagcgcggcgtcgatgatggctcgctggacgcgaccgtggcgggagcgcgattctcctcaactcctcaaggaggccatccatgtcgtcagctacgcgttcgaggggcagacgagatgggccaaagaggtcgcagcctcgccgatgatcacttcgccttctgctcccatggatcacaggaaaaatttgagaaactaccaatgtttcaattaaccatgatagatttatgctagaaattaaaattgagtatttcatgtttcgtttctttcttccatcgagaaaagctgctgctgcccccacacgtgagtgtgctgtgagcgtgggtcatgctagctgttgtctgctgccgatcgacttatgttccagtcgccaaatgcaggctcaccggaaggttcggcgccgtggaagccctcaacgtcagctagctgccgtcgctactcgctcgatgagaaacttaatttacacgaatacacaacgtacacaaacgggggagtgatgggccagtgggagtgcgctgggacggggtacgctacgtactcgcggttgcggccgccggccggcacgaggcatgcctcgccctaccgagcgctccgtcgctggtcgtcggcgtactgctcgccggcgaggccggcattcaggagctacacgcgggccagccccacggacgtcctcgcgggggcgtcgcggcgagcggtggcggccatggagatcctgctgagccggcggcacaccccgtctggaccggctggggcggcaggcgcctcggactcctgtagctgctgggctacgtgacccgcgtcgcctacccgcttgcctccctcccgctcaccgtctactgtgcgctcccggccgtctgcctcctcaccggcaagtccacgttccccagcgacgtgagctactacgatggtgtcctcatcctgctctcttctccgtggccgcgtcggtcgtgctcgggctgaggtggagccgcgtgccgctgcgggcgtggtggtcggacgagaaactctggacgcacgctctccagccggcagcgacgacgaggactccggcggcaacggcggatctcgtgtcccgcggtcgaggcagggacgggagcagcagcagggagaagagagaagaaaatataagaaaataagatatgcagttgacatgtgggctccacgtgttttgtttaaatttttttttgctgactaggatgccacgtcagcgaaatcatccatatatactgcctagggaccttgagtgaacggttttgtatagtttagggatagagatttctggttttgtggttaagggaccttaaaaaatctcgctgttaagttgagggacctcgggtgaacttattccgactgaaaaacagggaaactgggccggaaagtgtttatccgtcgatttgacccagtaaatattactagcatccaaaaacccatttagcgcctacatccctgctagtacagtttctccctcgatgcatctgatcatctgattagtatgcttacaaaagaattactacatcactagctactaattgagtagtactaatagatatatatatgatgaaagcgatgatgaccacagccgcatcaatcacttccgaacacagccaaactgtaactgtacctacatttatttgtcggacaagtagttctgactttttacatatagtgatccatacatatcacctgacagcatcagcggagattatgtgcattattgactctgcaataacagcaactaacgcatgacctactccctccgtcccagaaaaaacaatctaatattggctgggacattttataggaccatcttctctagctacaggccaagcacgcacacgaagaggcacgacgctcaggccatgtctagcagagcagcccatcggtgctcacgctgtagagatggaggccgttgagcgcgacgagggtgctccctggctggacacgctcctccagcatgtgtgcagcgcagagctcggtgtcctacctgcggagttccttcctgagcaaccatgatctcgtatcctccttcttcagccccgccgccccgttcaacaccgcaaaacatgcctccatctcggccgtggcggcgataagagcatcaggtcgcttcggcttcggatctggcgggagggacctaagtgtgtcgaagcggccggctgtcggggtcagcgttaaggggatctattgtgccgcgtggaggatcacttccacctccaccttgtcgccacaggagatagccgtcttctggccatagcggaatggagcggcagccatggcagtgacacggaggaagggatgggcgcaaggaagggatgggtgtggtttagcggatgaccaccatgtggattcgtcgccgtccacgaccatcagccagcatacctggagctcgctggccggccgtcctctggcgcaggctcgctacttggagatgaagatgactagtattgactgaggatgaagatgcctacgacaaaagtgtgacggagatgacagaaatcctgatggaatggtatggttctaattttagaagattgtagtggaatctactcaacttcacgagtagtactgtcatttttccaatatgtggcataaatcaaatcaaccctttagggtactgtagtagtggaatttatcggtttatttcaagacggagagagtaaggaggatttgttttccttgcacatgattttaagaccggtttatttgccagccacttgattctgctccaaacaagaatatgtatcctctacagtaccaagatcatatgcatgccaacggtggtggccatccgatccactattaacgtatcggatcaaatgcccaccgttacattacaaacagtgacaatgtacagtaaatctcaagaaactattgctacactgtgatgggtacagtaacaaaatggtacagtaatcctgttcaggcaggcatcgatccatggatggctaactgcgtcacagctcacaagacagcagctgctgcatatccttcagacacacaggtagctgaaacagtagtagtgaggttgatgatccaaaggacacattgctttctcctctctgttctctgatttgcgacctgtcgactcttgatatagttaattagtttttgtcatagtacaaggccaggtgatgaacatttccctgtctatagccctgaagtatgagaggatgaacagtagtgtgagttggaaacagatggtaggagtacgtacgtatatatagctgtgttctgcgctacgtacagtaccatttccgaatattcaattcacacagctaatgtactacagtactacgatctatttatatatgatatcttgcgatttccagttattgtctgacactgtttcatgtgatgtgttgtttctcaacgtcaaagaaaccgcatctagcttgtctccctcctctttgggaggaattacttcttgttatagttatatgtattctctctgtccacaagtcaagaaattctatttttccaatattacccatacaaaaatactatttttccattagtgagatagaaacgagcctaacttggttatttaaacaagagagtaaaaacataagctcagctatcagctcgtttcttggctcaagctggcacgcaagctagcctcccaacaatgattatcggagaggtgatggatgacaatagaacgacgacgtgagcgaccgaggtagacatagacgtaggatttcaagatggatcattaaagagtgcaagaataataataaaaaaaaagttgcgagtcaagaccaacaagataacaagaggaagtagatcttccaacttaatgtactcttattttgagtggctaatatttgagctccacagcttattggttctcagtgactcacgtcagagggcagtacgtcagaagatccctctccggtggcaaggccgccaggcaccattcacgtcatgctgtatctcctgatgcggcaaacccgtgacttgcaggccatgtccatttaggaaaataggcaaactactgggttacaggggaatgagggttagtttttttttccttcctagcgcttcagcttgtcatttggccaaactaatgggccataccattagctccggctcacctcattttaaaaacgagctgtggatgaggcttgggcttcattagttaggctctcgagtcgaaccgagcccgtgcgaccccgatccaagcccgagtaatatatttttccacccatagtgagaagcactttggtgttttttttcctctttactacaattaattaactattttatgatatgttaataagaagggttgattttggacagagcaagtatgtataataatctagtcaaaattttcctcttctggtatttgctaaggagagaaaggttatacctgcacattttgtcagccctagcctttggtttgggttccatttattgcgagctagctagaacacggggagttaactattttttttttgacatcggagttaactaatttcactgcaccatgcatgttataagagtaccggtattcaccaatttaatggtgtacacatgtatgcgcgcgctaatatatgcttcgtagcagcttgatggaaccaacattatggaagtatgttcatcagaggacagaggatgtatacatatgtttgcgcttatagattgtttaattatcatttctaatgcaacagattatatagatttataccaccatccaaatgattagtaatagaatatatagtgatattgaaactcataaatcaatggctgatatcacttttaatagtgatagaactaatagtagaatactaccagtagaccgccaatagatttataccaccacccaaatgattagtaatagaatatatagtgatattgaaactcataaatcaacggctgagatcacttttaatagtgatagaactaatagtagaatactaccagtagaccgccataagatactcgatcaaacttctaaattatcgtaagtagaagacatattgtgttttatgtgaaaaaggatgaaataagctaaaattaaaaacaaaataaatggccctataatatcttacaagttgtttaagaggttagttgtcaaacatggtaggtaagtaatatacagttacgattgcccgctgttaatcaaaaaataatcactacctcctcttttcctcttaagtatcatgccaacctcaataaatatatatgaatcctaaggacatgtataatggtgatgaacagtagactctcaacttggctaattaggaatattcactgacatggaaaagaaagaaagagaagagacaaaatatcattggtattgtccaagaggctgtactaggctctatcattgtacatgtccaaagctatgtctaccatagtaccatcattaaatttgactgaaatgtttacagatttctccaagtatgacatgccatttatctccacatatgacatgctatatattgccaaattttaattaacatgagagtatatcacagctgtcctaataataactgcagaaacatttttgtcatatcaatatgataccatacagtaaaaaaacatagggctccttcccccctacaaacaaccaaatgaacaacacaacaattaatacttgatacgatataaaacagtgcaataaaaccccacgaaacagtaacgccaacttggttgatcctcaaacagcaatggacgttccaagcttgttcacgtcgccggagttggcggcctccatcgccaccgcggcggcggcggcggcgtcgccacggcggccggcgagcgcctcctgcaccctacgcgccatgccgtcgatcccgtcctgcagccgcgcggcgagcgcctccttggccgtgccggccacgggctcgcactcgaactcccaccggagctcgcacccgccggcggcg

SEQ ID NO: 47344 - DNA, 11144 bp, Oryza sativa
tcatgctttactgagaagacgatggttttggtggatcagaagagaggacaatgaatggaaattggagatccagaggagattgggatggatgattttggagagcaaaatggacgattgggaagcaatcaagtcaccattgacaaaatcaggtcacatccggcctttcgaattaacgcgaatttatgggatcgagctctagttctattagaccgacttcacactactgctttattgaggtcaccacctacgccgtcgttcatctggttctaacacatcttctaatgacatgcaagagggaaagaggcaagaatgggacaaggtagatggagatgatgccatcaatcggctctccctatgaaaagaggaaaggaacttaggacaaagttagatagagaaaagttctccatgacaaaaggtaggacaggtggtcagagagaatgtgtaaggagggagaagcggtggcaatagggggtcatcgctggttgtggcaaagaaagatggggatctacggagaaagaaagcatggaggagaggaaaaagatgtttagagtagctgacagtgggtccttctcatgaggttaatcctttttcttttgccatagtaggatttaaaatatataaaaaaaataaactatgggtggtgtggtctatttatgaccacacaaagatgtcggtttttagatttagaagtgacatatgccaattaattaatatatcaaggttagatagatttaaccatacggtcttgtctgagatgcgctagtttttgttaataatatcttgcacgaattatatatatcatacgttggaactttgtatgagtttcatgtgagttacgaatggtactcatgtgtgaacgggtgttacgtgtgttcatcttctatgtgaccgtaaaaggtttttcgatatagtccatcagaactgataataaatgtcatgtgcataatttgattaggggatttaattaaaccgaaatttgcaccatcaaatttctgctgcatgaattgcatgtgttactctccttctcaaacaaccattgaatggactatgtgtctctaacaaaaagttggattgtggcttgagaccttgggttaaggttcatgatcgaagttttatagaattaattattatagtgataccagatagggttcagagggatccaaaagtggtagcatgagtatggtagttggctcttggctgtgggggtggtaactgataagagggagacaattaaggaacaaaaattttacaaggcaatgagagcatgcacatcgacccatggggtataggagcctcctgaatcctgatacagatgaggatgttagatggggtgactcagctagactgatcctcaccggagacaggtcagtgaggcagcaccatgtgcgaaaggctatatacacataattcctacaaaagtacaattgtagttaatttcagaatcactatattgataaaatcgaaagtaaattaaaaaatatcaagacaggttctttctgcttcgtaatacaagacatgcatgtatatgtgtaattaactaacacatcttataaaattatttttttaaaccctccacactcaagatctctaattccataggatgcatatgcattgttttattaggattgttcaaacgaggaactgataataattctttcttatcattacattaatgatagttacgcattatatgttggaatagatggagtacaaatttcgaagctactttaaactaaatttatttattatgatcttaatttagaatcaaacatcagaaaatagaattcacttgtatatgaatatttactcagcagattatatacaaaatttaaaaagcattaaatgcattatttatataaatatatgtaatatcactagcatgtacaaatgcacagattaatatctatgttaccatggttttcctttcagctaataagtcgttgtcaatatttaaattttaaaacgtattttcgtagttgattttagtttttcatcataatttattttactgaattactaagtacacaggttttccgtcaaaattatattttcgaccccctttgattcaaagaaatttcatatgaattttaaaggatttcattcctataggaaattttttctatatagcactttgtatcaaaggaatgaatcctatggaatgcctcttcccatgtaagttttggaggaaatttaacatgaggtaaaacctcatagaaagaattctttgagtctttatctctcctcaaatttggtgctatcaaatggtcatttatatgtttttcctgtgctttgcaatcctctgttttacacttgtattcctgtcagaatcctatcattttcctattcctctatttttttccttcctgtgattcaaagaggcccttattttttaataagcctttttacgggttatcctcagctgtgagctagatggtcaagttccttatcttaaatagtatataatatcttcaaagaaagtgctatagttgttagcatgattacatacagaagttttgtctccatcctaaaatatatgagaccaagcatgcatctctaacatactacataaatcagactttccaaacacctatatagccagctctgcaactgatttgtcaagccaaacctatggttcattctaacagactctccatttcgaatctatgacaccaggacccatttgttagcttatactactctcttcttcttccttctctttctccctccctttctatcttccctggggcgggaggcgacaataggaacacatggcggcaagggcgaggtggggactgaaggtggcggcaagggcatggcgggcaatggcgatagagcaacgggggatgggagccacgccaatgacacggggtggcagcggccaccgtggatggtggcgagtctttggtgatgctgccaagggaagaattaggggaggaggaggaggtggtagcggatggtgaaggctagcagctctgcgacgacttcagccagtggcgaccatcgatgggagaggcacgtgggcggtgctgctgctcctcgccgttgcgttggatgggtaggtagtggggggactcgcggtggcgatggaaattggcacatggaggagctgtgccaaggagaaggagcgactgaaataccatcaagtaaccgccgctgtgcccctctccatcgatctgagtcctggcccgtcgtgacgacgagacagtgcagaagagggaagagaaggtgggaatcacctttggcaagccaagaaggctggctagatttagccaatcggagagttgattcagacagcaaggtggcttggatagccagatagcaagttttttggagtgtgctttttctcttcactctccaaattttagcttggagagtcaaatagccattttcttggaaatgctcttagaatgcaaagtgaaacctcataagcttaaatgattactatatgaaaatattagaaatcagagtaaattttacaaaactatatgtattttgatcaaattattgaaaaactacatatttaacgcgttgtattacaaaactacagatttaaggctaagtatcacaaaactgaatatttagtattgaagttatcacaaaactatagcttttagagttcatatccctagcactattgtaatatgtttgagctataaagattattgttttgtgactaaattggttataaaacatgtagttttgtgataatttagtaactaattaaacatgtagttttatgacacttcatcttaaatgtataattttgtgataaatttgttgttaaatatatagttttgtgctgcatcgagttaaatctgtagtcgtgcgatggtttggtcatactatatgtagttttgtgaaatttattctagaaattaatatgtaaaaatgatattaatataattataatgaaaatactttctatagttatttttaataattattaaataaataaatagaaaagtaatgacataacatgcgcagtggggatattgtattagacattcacaacgtcaagtaaaaagatatagagcgatgtagtatttcaagaatgtattttgttctcttagcaagttaattatctatgagatattcaatatatataacacaagttaaaattaaggcttttgtgttctctcagttaaaatacacaataggacaaaagctgaccaaacagatcccggagtgggccacgggcgatctcacaatcagtcccaagttactagctgtggaccttgaatcaacacatggcctggatcggagcttacaaaagtcaggattactatttgatgggtcaagaactgaagatgcatggcaaccgggaccagccgattccatttcagggctagctcacttttgtgcgctcccaacctcttacatatcgatgctggacctggtaggggccgggtggtaggcctacatatattgcttgtctaattgaaattaagtttccaaaattttgggtttacttgtttgtcccggtaggatatgatgttcttcaggtgaaaattttaatattctttaattcagcaaaatttattaggaaaaccactcatttatttatttatttatcctacattttgtaattttctttctcaaaattatattaccgcattccgaaatggtgaaccacactagcaagtctagttaagcattcgatgttagagtcacgatatagcttacgtatgacctagaaaagtattaaacgggaatgcaggaggtgtcaaacagcagaggtacgaatggccgcataatatatcacacagttagggggccggtgtttttggttgccagtcacattttgccacaatttgccatgcctaatgttaggtacgtttgccaacatgggcagtttttcgtttgcgatgtgcgtgctacctattgatttgtcgcggtgcggtgtagtgccaactgagggttgagggttaaggggggaggctcactaatgagctggctgaactgccatggtgtaggaggaattgcgactcgggacatggtagtgggtagtgtctatgattgatcacatactcacattagtgtttggtacgtgtaggtaagcctgagctctcgatctcgatctaaagaacagtaaatgaattttggctaattttatgaacacatcaacatcataattgataaaaaagaaatatctgttttgagaataaaacaaagaaaggttaattagatcgttctccaacatgtagaaattctctttagtgagaccaaatctgctataggatcttatctgatgggtctatggtggttacaggcaggcaaattaaagcaaggtgtcatgggtgcttgctgcaccaggcatgctgcctgcaggctttagggttgtgtgtgatcagtttagccagagccaccatatataacactggaccccggccccaacctatcacgtcattagcaatattgcttgcatacaggattcctcccattaatcatgaaataatgcatgctgcaatggtcggggccatcctaaaccctagctgtgtctctgcgtcgtcgtcagattggctcgacatataactgatctcttccataattcatgtgctatgtaccaggcactgtccctcacctttgattcctgatgagtcaatcggtcgatcagtcgaaggtgtgtaacagtgatcaccatgcatccatggcccctcacattccggccatgagtgacaaggccagacaatatggctagcatggtcacaggttttgatacctagcgatagcaggaccatccccttcgcgaggtcgacggcgatcgatggattggtcgttaaataggcaaaaatgtggacatcttcaccaatagtgaaaaccggcaaatgtcacacctatggctaaggctagatgtgacaattttcccactggggccagtccccggcggataccaaccccaacggggtcatggtcgggtgggatttccctcccatagtgagcgggagtagggcctcataaatttgtggggtggggacgggggagagaattcacccacgggtgatccggcggggccccaaggtttgggctctcagtaaaatatagctaagttcaaggtccatctaacccatttcaatggagggatatataaactccaggatggagcactggtagcacagatctgtgatacgccggtagcctgcgcaagtgagtacactggtggagaaaccatctttcctcccggttggtaacccccctttagtcccggttttccaaccgggaatagcaatccgggactaaagatttctatctttagtcccgggtgaaataaccaggactaaagatggaaagatccatctttagtcccggttggtaacaccaaccgggactaaagagagggatctttagtcccggtcgttgttactaaccgggagtaaagagagaatagcggcggtaccaaatggtccccttttcttttttttcctttttattttctcccgaatcaagtggcatgcaaattcccaaatcaaactctaaatcccaaatcagagtaacatcccaaattcacatcacaaaacttagagttacacacaaatcaaatacatcataaatcctaaaaaattacacacaaatcaaatacatcacagatcctaaaaaattacacacaaataaaatacatcacggatccatacaataaatcacaaatttatacatctcagggaatcacaaattatatataaaaaatcacaaagccgctcgccacggccgctgcctgcggccccgctgccgccggccgatgggcacggccccgccacccgccgcccgccacggccgccgcatatggccgccgcgcacagtgccaccgcctgcagtggccccgccgcccgccacggccccaccacccgccacggccgctgccgcccaccgccgtgcacggcgccgccggccgccgccccaccggatgggaaggggaggagggggaggagaagaggaaggggaggaggtggaagagatggaggagaggggatgaggaagagaggataaatgtgagttgagatctgtgtgagaggagaggaggagaaggggaggagattcgatctgtgtgagttgagaggataagtgataggaattatatactacgcgttcaattttagtagatgatctttactcccagttggtaggaccaaccgtgactaaagtggtaatctttagtctcggttggtagtatcaaccgggactaaagatccacggcaccctgacatgcctctgacaggggatgaaccgggaccaaagatcaaaatttttttaaccaggactaaaaagactaaaaattatttttagtcccgatttttaatggaactgggactattgtggaatttggttgaccgaccaaagatggtttctccaccagtggtattattaagttatgctactgctgtagggttgtgattcatgtctgattgttactcgattaatttatggctgctagttctcggttatgttaatagattttctacattctaaacaggaatttgatcatgtcatggtttgataaatttcgatggctgatggcaccaacaattaaggttgaggaaatctgccaatagaatgcatgcttaaaagttaaatcaccaaggtatgaccatcttgactttactgttgtttgccttttgattatcatacaaggttaaatattctggtgtaatgtaatgcattcttagttcagaaaaaaaaagttagaagtgcttattcactcagaacgtttatgaagcaagtttttcaaatgtgtgtccaatccctacatttgaactttttctgtccacagtcaaaactgtagaaattcctaaaacttcaaattgtactgctcagaaaccttacttggaaaataaccccaagatgtcaagcagtgttattcaacaatgttcattgctgcttttaattactttgggcataatctgacttgtcatgtgaattaatcgtatcagatagctatctaaatcaagtatagctggataagtcgtacatttttttagtaacctttttcagaggtcttataaaagcttgttgcaggacagtgatacattttatggagtattgttaaatctacagcatgacttgaagttggggagcagatgcaccgatatctgcgtggaaacttagcagatgtattccaattagtcaagaaaatgccttttgagaacttgtagcatgcatgtccagtgcatttgcactttaattttgatgtaccattcaattgtaaactattggttataaataatattattgacatttttccattgctacgttattttcttatttttgtccaatataattctagaaaaaaggataactttgtatatttatctaagatatataaagtatttgataaaaatgttataatgttacgtgaagttcaccaaaagtgcttttagcttaatagagacaaagtaaagcatgtctccaatgatgtagggatgatatttgcagcgtctcaacgggtgtctcatttctggtttagacgcttaaatcgtctctatggttttgagacggtccaagcaaagacgttcctatgacgcttttttttaaaggtgtctctataatcatgtggagatgatctaaaatgtctgtattgcataaataaagtgtctccccaaggttgttttgttgtacgttgccccagtctaccgtcactgcactttcaagtttgaggatgttgcagtggttgtctcatggatggatggatggtgaaggatgaatcgatgatgctggatgaaaatttagtgacactgtgattatgtcaatgtttgagaggatgttgcagtcactactacagaaatacataaaagagatggcactatagatactagaacaactaaaactaacacctatagcgcttttgccatccaaacgcgcacccacggggcaccaatggctagaattggcatctttgtggataaataggtgccggttttaaattggaacttgcaccacactttcctatcagataaaggtgtcgattccaactgaaaaccaacacatatcataaacttataggtcacaatttttaaaaagaaaatagacatttgacccaaccaagcagagacgagcccattcaccctgccatccttattggcgcacagcgggaggtccaggcgcgtggatccggcggcaacgggcacccttgacccttttcctccccttgcgctctctcgcgactaactctctctcggctcgagtggatctggaggcggcgaggcctcgcgcgcgtggattcggcgagggcggatgccctccttcgggtggatccaacagcggcgaacgccctcctcagcgaacaatggcggcggcgagcgcctcctcggcgagctacggcggctttccccaccaccaccaccgcacgttctcctctccctccgagttcttgatttcttcgctgagttggggatggttgattttgggattaagttgtggcttgttcgagatgttcttagtttttgttgaaaactgatactgttgcttctgggattcagttcttggctcgaagcatcgaataaaatcgagccgatacatcaagccgtttttttttgcattcttggaacctcaatggtgtgttcgaaaccggcacctttaatccctcctcttctgtgacacctgcaaaatgtcagccgggaaatacgatacttatgtgggattcccaaccaacacctatctatgtttctgtagaagtgagtagttgtcttaattatttatgtgattatttccatgtgtgatactatggtgagtccatgtgggctgtggctattgaaattttggtatattcttattcaggatatatgttgtgttgtttcaatagagtattaacttcaatcgtgtgctgcggggccccgctcaccctccaggtcctttgcagggttgaggaaggttttccacccggtggtcaatgtggggctggggacgggggtgttccaatgcaacccggctccgcccgcctcgccttgccctgttgccacccctaactaaggctaccctaggagcgtttagaaagcgaaggcctaacgtgaggttttctgctgagaggaatggagacctcagcctaagaggagagaaacgacataagtagaacacactgcaacaaaaatgagttttgccaggcaccgttcgactgcaaaagcgataaatgggtaaccgcatgtgcagtacgccacgggcgccctagtcaaagaccatcaatagacttattttcatatgtaagcgacttaagtgaccgtttgtgataacaattattggcatcaatcttctgatctatatactataatgaggtgcattttttttaataatgaaaacggtttagtctccttcctctaccattgggcttacacccaacaagtctttaaagtaaaaaaaggaaagggcaacaaggacaaaccacccacctcgttctaataaaagattagcgttttcaaaatcacattggtacataattttttttgatgtaaggtaatatgcaatttgaactgttataaaagatccttgactataaattcaaagtatatagcaccatcgcgtgcagtatcatattgttcctacgaaaacatcatacaccaaaataatgaggtgcatgttcaatagaaaatatttgattgctacgcatgcatacatatatatatatatatatatatatatatatatacatatatatatacatatatatatatatatacatatatatatatatatgtgtgtgtatatatatatatatgtgtgtgtatatacatatatacatatacatacacacagatatatatgtatatatatatacatatatatatacatgtatacatatacatacatacatacatatatacatatacatatacatatacatacatatatacatatacatatacatatacatacatatatatatatacatatatatacatatacatatacatatatatatatatatatatatatatatatatatatatatatatatatatacatatatatatatatatatatatatatattggcctcctacgcacgtttttttctctctctcccccgcgcgagtttttttaatgtttagtcccagttggtataagtactaaccgatgctaaacatactagggtgcatgccacggcctgacactaaatgaactgggactaaagatgatctttatcccatgtttagtcccggtcga

SEQ ID NO: 47345 - DNA, 1052 bp, Oryza sativa
attttctttaaccaggctgaccgaagtattggagccgaagtattggagtccaaaaattattaagctaagggagcaaatattattaagctggaccggagaggcagtgaggaggccctcccaggagggtgaagcagcctcctctagattctgatgagacgagggccgcgactgtggccttgactactgcctactggtgcgatgacggagaggggagaagcatgcagaggccgctcactttctacatcgcgtcattgttgttggttcgctacgactacctgggacctcgagggaaactgttttaaacactcgggtggacgtccacccaagagattagaatccatcctcgggacctcgacttatctgcccctgtccattcgctctactcggcttggtaaaaaaatcccaatttttcttcctgtatgtctaagtttgtaaatataattgttttgctgaatggagatatatcatttctacaaagaatgtcagtatgtaggtagaaagagtgaatgttgttgtgtattttccagtttatacctactaaaatctgaataagccaattggctgggcgggagtatataatttttggatgtaatgtacctgtgcattttttccaaggttaatgtgcctgcatttctttaaatatgccgataaaatgtaaatcttttggtgaatggagatatataaatatcagttatagaatgtcattttattgccagcctatctgaaatactttatgttttctgagcaggacaacctatctgaaatctattttctccttgttcttttggattttgagaggcaggacacaacagaactcaggcagtggaggcatgacatccagggccgagaggttggcggctcagtagggtagctgaatggcgattggcgacaatggcgttggccaagtagcgccacagcggcatcaaggagtgctggcggtcaactgtgccaggattcgtgcaagtatcgatccgcgtcgtcggccctaattagtccttgcatcaatctccattagcatatccatcagtgatggtgctagggggatccactag

SEQ ID NO: 47346 - DNA, 11971 bp, Oryza sativa
  unsure (1)..(11971): unsure at all n locations
aaaaaaaaagtgcggacgggaagagggaggggtgcgggaggggggaggagggacgggagggggtgagggggtgtatctgtgagggagcgctttagctattgcgcaccctagacgtggtttagcgtgtccccatacatacatacatacgtacatacatacataacatacatatgtatgtacatatgtgtggatggatggaaaagcaaatgtgaaccaaggttcatttgcacctataatctaggacgttggtgtgttccaagatgtgtgcaagttaaatgtttcctagtatgcatttgtgaaggcttactatagtgacaaaggacatggatggtacataacatcactgtgcctcatggtcttattttgcagccttcctactttacccctgagccttaataatatcgatatgatatatatatatatatatatgtatatatatgtatatgtatatgtatatatatgtatatgtatatgtatatgtatatgtatatatgtatatatatgtatatgtatatgtatatgtatatatatgtacacacacacacgttgatcttttttaaatgaattgatgcatcgcaaaagtaataagaactcatgtgaaatcaagaccaccggtaaatatcatttgtggtgaaccaccgaaacataaacatcatacacttaggcaattaagagctaggagatgttattattggtattactttcaagtgatttgtactccctctatctacttttgatagtcatgacttaattatgtacaaggtaagtagttgtttgtatttcttgctgagaaaggagaaaaagttattctgttataaaagaagtcatttaattaattaattctcaattcacaaacccagcgttatgttagatgttactaactttgaaggagaagacattttcacacatttgaatacctatcctgattatcttgtactccctccgtttcaggttataagttgttttgactctaatcaaagtcaaactgcttcaaatttaccaagtttgtagaaaaaattagtaacatttcaacccaagacaaatttattatgaaaatatatttaataattgatttgataaaactaatttagtattgtaaatattaatatatttgtctataaacttactcaaacttgaaacaatttgactttgataaaagttaaaacgacttataacctaaaacggagggaccgggacataaatagccatgaaaaagtttgtaaaatattgtaacatagtacatcttatactagctctactacaatctctgtcccaatatataccagggattttggtaatacaaatatataggcagctaaaatctctaatatttttggacggaggtggtaactcttatattactttagagtggcaagtctgctttttcaagaaaaataaaaaaaaacaaatagccttttctatgctgttggtagccaatcgatttttttctcaaatcaaatttggagtctagatttataaacattgtcaaattatttgtattaaacttttttgcacaactgtcgttattggttgatatttcaagagtgagaaactattgatgtaaaaacacgaggcctgggagatgtgcttaactccagtgcaggttcaaaagccagcgtttaggtggatgagcgtgaccatgttgatgttgatcattctatcaccaagcatctcttactgtgtaacgtcggttaaatccataaacgatagccgatcggctagttgccgatgacgtatcatttatctttgagccgatgtcatatgttgatcgattggcagtaatgaataagtaagaaagaactaatctattcgatcggctgtagatattaacgatatataatccttatgtcgatatatacttaaatcaggtgattgggatagatcggtcgccatgccgagatagtataaatcacttaggtcgaaatatatattaacaacaagactatatatattcatagcatagccgatcagatagatatagcatgtatcggctaatactccgataccactctatattaagatatcaaaggcaagtagaatataccaaacaaaaagcctaatatacttaaatgcaacaagatcttaacataaatagcagatttaacatgtcaatcaagtatataagataaagataattaaatcaggtaagatcggctgaaaccccgatactaccctaatcggcaaccaaagacaggctagagattgagattctaatatcgactcataagatcaaactcaactgatgcaactataagtatgaaaagaaggacaatatctagataatcaagccgttggatgtttcatagagtggtagatatcttatataatctagttcaatgtcaatatataacctaaccggctgccttctagtaacagatgctagccaattaaaggttagatagcgatattgccgaagattatgtaagatatatgataactcgatgaatcacataaacaagattagagtatcatgaagatggaagcactaatcccgagaacgcaagccgccataacaagttttaccttttgttgaagattgaaaccgatgcagctcaacccgaaagcaagaactcgtcgaaacaaaataaaagtaaaaagggcggcgatgcgccgagattgtattgaacgtgtgttagtttgattacatggggctcggggtctatttatacccgagattacaaaatatgtccatatcggacacgactcttatctctaacaaactctaagataccataagtctttgcggcagacttttgcccaaacatatctctaaggaaataaaatatcctaactaatagatacaattgccttctcaggattctatccatgcgtggccatcctcatgaagctcattaacttaacccgacaacatattccttgtcatattgtcgaattcggcttgatcggctaaccctgtccaactcggactctgccgatcctggtcgcagccgattcggacttcagccgatcccactctgtttccggaacgatctccatctcgaactccgctttgattccttcttcatctccgatacttagattaccaaatttggtcgttaacggaaacacatgagatcatatatatgtgcctaaggtataaaaatccacatccagctgccattaggatgtaggtgaaaaacatgaaatcctaagtgcttcctctagtcataaatattggatatttaggtcaaacttttaaaactttgaaaattaattatatatgacaataagtttataaaacctaataacttataataggatgattgtactttgtcaagacccaacggtgaaatttttaaaaatttgatcaaactatatcttaaacgtcccatagggagtacatatatgatttgaggtgaataatataatgtacactacattggtcctaaaataactgccattctaaaggcgaagggatgaattaagaaaaatataaaataacctatatgcccctcattctaggtgaatggagatgagatgggacaactaattctctaggattacacttattttcaagcggaggtagtgctttaccaacatgagtatctgatctatttctcaagagaaatagatgcatggttggaaaagaaatagatatatatccctctattttgtagtgttataatataagatcggtcgcgcaaacacaaactgaactcaaccaacgccatatccacaaatcggatcaaataaagaacatatatatatacatatgtacgtagcaatgttcgcatagatagaagagagtaacaaatttgaggggattaaattaaactacataattacacatgaaacgatcaccagcaacacacacatatgatccttccgcgaaactcatcgactgatcgaacaaaaagaaaaaaaaaggagatccaagaacatcatcacatcacatatatataaatatataatcatcatcatcagcagcatgcatataaatacaactaatcgattaataattagccaatatataataataatgcatcacacacacatatatatatatatatatatatataatcgatccatccatgcattcaccgaccgaatcaatggattggacgaattgggaattggggaatttggatggacaatgatgtgatcaccatcatcatcatcgtcagttcatgttgcgggagcagcgggtaatggcggagcagccgcggcggtagggattcgccgcctgctgcgacgcgcagttctggtagtaggtctggcctcgcttgttgcacggcaccttgttcgcgtccagcgccgagtagctgacgtaccggttcgtcggcttcctcgccgccagcgcccgccggagcagcccgccgtcggcccccaccgccgctgagcactgccgccccagcctgccgccgcacgacgaggaggagatggcgccgaggtgggccgtggtgaccagctggctgtagccgaggccgccgccgctgtaggcctcggcaggcgacgcgcgcaggcaggagaccaccagcgtggccgccaccaccgccgcagccgccgccgccacgccgatgccgaggcgagccatgggatggattcacgccgaattccgaggtggtggggggctggggaggttggcgtttggagcaatttggggagggggttctttgagcggggtgggtgtctctctctctttcaagcgcgggaggaggagacgagcggcggtgagagaacgcgggggagacaaacgcggccattcgcacaagcctccacggacggtaaaatgcataccattagactcatctggtcagaaaaaaatcggacgtccaatctaatgtaggtgcatggctaagcagttcgttaagagtacaagggagcgtgcatgcaagcatgtttcaaaacttaaatgattttttctcttaaactgtttatccagatttcaatctaattatattactggattcgttacaattaaatctttataacaagatatcacatgactatattgcgacaacttttctttttactttttaaatgttgcacatattgttaatgaaatgttccaacaagtatttgttgatgtttcactagtgcatttgcaatgtttcatattatctttttatatgttttggcaaatactttttttatgtttcaacgataactataattcgatgtttcaagctaaatataaaaaatgcttcagtagttgggacataatgtttcatgtaataacgattactgttgcagtcaattgcatcactttttatatgttgcacagtttatgaagtgcgttgaaacatctccacaggtgatgaaacattatatatatatatatatatatatatatatatatatatatatatatatatatatatatatatatatatatatatatatatatagtgcaacataagtttgatttttccagaatgcacatatatattttcccaaaaaaaattggatggtccaatgttagttacagttgaccaacaagtgaaacattatgttatatatggtgaatctaaaaaatcagaaactgaaacatttaaatatttatgaaacatagtgaaaatacatgttgaaacatgtcgctataacataagaaacaacaagtattaacagactgaaacatatgtttttctttcatcaaaatataatcatgcgatatcttgttctaaagatttaattacagcgaatacaatggtgtgatctaaccatagattggatgcgcaatttagaagaaaaattattttaaagcttgctaaaatagatgcatgtatgcatggatgagatggagagaggagagagggtagtagcacatagttttagaaattttgtgaaacacaatgaagacacacattgaaacatatcgctatcatgtttgaacatttagttttgacggtttgaaacacatgttttttcttttgacataatataatcatatgatatatgttgtaaagatcgatttaattgcaacaaatacaatggtgtgatcggatcgtatatccgataagtaatttaggagaaaaaaatatttaaagataggagaaaaggagaagaaatagttacgcatgcatgtgacagtgactgacaggtgctgccatgtgtcagtggcatgctgccatacatgtaagaagccgtgtgtgtagtgcttgttgcctggcttggcgtccgatatttggtaggatatcggacgtccgagccatagcgctttcctcacggacgacctcgtgcgtgttgcttttttgcttgggccggcacaaggcccagttcctatctgggttgggcttagctaaaactgggctggtgggcagcaggcttgaatgaataactgggcaaggatatagcttgaaaaggttactagtagggatgtccactttggttccctcaaatataggtctgatcagattaaactctttccatcgtaaaactggatatcaactattgcaattggtatagaatgactccattagcgtttctgaatgcggttttcactgatgtggctcgttggcctgatccaaccggctaaatcaacatgtggggcccacatgtcagcatccccttctcttcctctcctacttttctcttcctttctcccatctctttccccacacgtgcgaacaacaattagctcaagtggggactacgacaccggcacagtggtagcacagcctcgtggtggacattcattggtggggacatcactatccatatctctactcttccttcggcttctggatccacgaagatggccgcaaagggagtagtcaatgtgcctctctgatcctgctctgccttctggatgcaagaggccaaggtcgaggcaaccacagttgctcttcctccacgacaccctcgactagatctaggtcctcgcctcactcacttttcgctccctgtcgctgctgccctcactatcggggcctaccccaccnnnnnnnnnnnnnnnnnnnnnacagccacaatgaccctcttctagcatgaggatggggcatagcgtgtggtaatcgcaattggtactttacttttttcacatgtaattacacataagcattgcatgtgtcatgtgaggtaaaggccaagtcaacatgccacatagacgtttacatcattgaaaaccatcttcaaaactgtcaaggggtcattctacaccagttttaatagttgagtagtggatatacttggtttcagggatgcaagagcgggagccgtatctgatcgaatctatattgtgggaatcaaattggactttctagtaatagagaaaaaaacagacgaacaagaaagccagaccagcaaaagtgcccttattgggcctaatttcgagtggacctatatgacttctagtccaaccatgacaacaggaagctttgtgtaggtttgtgacacgtttctgatctgatcagaaacggtgacaacagcaacggcgggatggatagatgaatcaccggccgaccggccgcctatctacttgacggcccagcactgggtgccggcgtcgaagacggccggcgcagtggcgttcgccggcggcgggaaccatagacaccttgtacatgagcgtcagcgccacgctcaccttcacgtgcaccgtcccctccgcggcctcgcgctccagctccgccgccgtgccgccatccaccgccaccacgccgcggaacgccgggtgcagcacctgcatatccgaaaaaaagtcaaattaagaacatcatcagaacgtggagctagttaaattgtaaagaaaaaacgtgtaggaaattaattaatgtacggaacggttgtgttcttggggttctggcggaagagcgggagcgcgtcgtcggcggggccgagcttggtgtcgaggtagcggatggagaggcggcggtgcgcgttccggaagctgaggtccacggcgaggtcgtagacgagctgcctggagctcggctggtcctccgtggcgttggccgccggcggcggcggcggtgaggtggagggcagcgaggacggcggagtcgatcctggggtggaagcgatcggggccggtagagaagccatagcaggatgaaggtgatgctgaactgcgtccagaactgcacgcacatccacgcgcattcgatcatggacttgcagcagtcccacggcgacggctcgccatcgtcgtccattttctttgtttgaaactatgtccttctcggttgatgattagatcatactctacattgccgtcgtgtcctagctaagctttatcggacgtttggcgtgcaggtgattgatggagatcatagcaggaaagaaagaaaaacaatgactgcgtcgatctcgatccggcttagatcaattaatcttgtttcttgacccggccggactctccgctcaatatatgcagttcgtttactttgttttttttatataaattaggaaggaagctcacgctcaatatatgcacgggcaacttatttattgtttataaaaaaaagctaaagaaagttgtttgttaccttattcactataagaactatatagtactaccttataataataaaagaatgaaataactatatcaaaaaccatttacttgatatactaaatgataataatgtcttctatattgaaacataaattgttttatcatggttatatgtctatcaccactaattattatggtatggaaacctgaatgcatttttgatagatggaattgcatccataccaaaagtaaacctaatacgttgtaaatactataaagcgttcatttctacttcataccactgcatttctaatcaatagaatctgtatataatattttaaaatacctttgataaactaataggttaaaatcattaaaatatatatcaatgcacctctaacgggtgaaaccgaccgtagccacaaatgctttcttttcttatggcttataattaatatgggtctcatactgacataattgtgtctcttaagatcaacgtagagcacaagtttaatgtcaaattcactaattgccaatggtgacttctcactgggcatgcccagtgagaagatggatgtgatgcagatattcttttaaaaagttgagtcaaattgtgatatagaatagacaacggtacaaatataattttcccttttgaaaataagcaggagtgatccttcgacactactttaaaaaatacaaatataatttttccttttgaaaataagcaggagtgatccttcgacactactttaaaaaatctaatagggttgatggagccgtttgtaaatgaatataatgcccgctattaattatttgaaaaggatagagtaattgttaagaatatttgaatgagattgaaaaaaagatagaatattgttccacataatattttttaaattaaaatatatagttattatgggatgtaacgatatacatctaggatatatcctagtcaaatacctagtaaaacaaaggggagcgaaattaaaggatccacataggagtggactgaaagttaggagggaaggattcatagttttttcgcgattagtagtctcccggcaaataatagtctctctaccatatatagatgtatatatgtacatatttttttcggacgaatagtacaaattagacaggagattaggaggaagggattatttacttcaggagatataatctaataattgaaaataataagtttactggtttaagtgtaaattgatcgctccatgttttgttttcttccaatttttttagattttattgatcctaaattatcagtttaactacaaattaaattgagacattaaactgcattaaattgcttgcaattcctaggaagtagagagaagggagagagaggaaatatatgtcctgcacgtagcccatgtacgtatacaggtatgtacgtatgggttcgttacgtacaggggggagagagaggtggaggtggaaggatttgtttcggttaatataatggctgaatataatgggtccaccaactttaataaaaattaaaggttaatctaatggctgaatataacggtttttttctcagaatttcttggatttctctatttctatagagcgccacgtggcagcctgagagcgtttataggaagtttaatggacttttagtatataatagatagataatagatagatatggtatgaacgctcacatatggagtacatgacatgatcgtacacacatactttttccttgtatatcttgagattgatgaaatcattacaaagatcaacataaactacatacgtatctctatcgatggatacgtcgtctatcactgaaaaataataaggccctttttagatttcactcaaaaattttacaccctgtcacatcgaacatttgaacacctgtatgaagcattaaatataggctgtcgacgtttgatgtcgcgattccggtatttgcatagtatggggatcgttggtactaggatatatgcgagactgaggtaaaagagatggagacagggatttttatacaggttcgagcccctgaattgtcaggtaataaccctactcctgttggtcgaagccggtcgttgctcttattcaccataatcacaccagtataatatttggggtagcctatctaactgttgtcgactttagcggactgaagtatcatcacgtagtcgacaacagggtagtcttcctcctcgaatccgtatccggcgagatcagagaccgctagatccctacagccggcctccgtaggtaccggatagggtcgtccaggcatatctttgatgtcgatatccggcggcttgtcttggcgtatgtaggcttgtgttggcttgtggctttgtggtatctatgttgtccgtctcccctctcctcctagggggccttgtatttatatccataggtatccccttgtccaagtagaactagggaaaccaatatggatataatccgagtagtctttatcgtttccatgtagaactctagttgtctttccttatccggaactactcctatatccgaaggttgtttccgtataagacatggtatgtggtgggtcttgctgagattcagtcaactactatttggtatgtggtatccatagccctgacataggctaagaaacaattaattgcacagattacaactaatttgcgaaacgaatcttttgaacctaattactatatgatttaataatgtggtgctacaatatatatttgctaatgacggattaattagagttaataaattcgtctcgtactttactaacggattctgtaattatttttttattagtgcccgaacaccccatacgacaccctatataatattcgatgtgacacgataaaactttactccccgatctaatcaccttctaagttgtaaatgcgtctaccgtactggttaggtttttttttttaacaacctgtccactcaggttcaattccgagcggttgtttatttgacggctctgatcgactccagtctccggtccaggtcaacgcttcgttttcttgaaggaatctcagcagtctggatctaacaggtgatagaaattgatagaggagtttagttggagattagatcattaataaaagggtttgttagaaccatgccaccttaattttgtaaaatttaagatatgctacccgtatctcaatgacatgtagaacccacatgagtcaatgacatgtgggtcagggtggcatatcacattttctgtaaaatttatgtggcatggttcaaattttcccttaataaaaatggttgctgagatttgcttagacaaagtagaggaggaattcccttttaattatctgtccctacccaggtattaaaaaagagggagttccttcctcaattcctcatccccatcccactaaaattttcatccccatccctaccttgacgtgagggtgaagacgacgctgacgtacaggttctggcccaccaagaccacccactactacgagtacgactgctggctgcagttcgcaccgccgccggggaacggtacgccggcggtcaccggcggcgtcaagtgcggcaagcacaagtggtgcatacgctatatat

SEQ ID NO: 47347 - DNA, 6081 bp, Oryza sativa
ctttattcgttcaaaaagaatagttacaagaagttgccgaatgaaggcagggggatcacccagggttggaaattttggaccgaaatttcggtcatttcggcgaccccccgatacgatattaattcggccgaaatttttgaatttttgaattttttcattaatttgggtaatatttgtttaaattcaattaaattttgttcaaaatttcgggttagagtgaaccctgggatcaccacagaatatgtttatgtttagggttttacttctgtgaaataaatccgtcagtccatcataaggtggtacgatgggaataagcgaaacaatgaaaagataagcgaaaccgcacgaatccatctccttcctcgcgccgccggcctgccgcattctcatctcttcgctcttttttcctcccttcgcatatgtgcccccacggcggtggaaccaccggcgcacagtctccttcaccggtggcggcgcatgcatcatcgagtagccatcccgcacccacgcccccgccgctaccgatttctttttctccatccccgcaaccagtccacatctatctgcccaggagcgacagtgccatcgctaccgaggtgcctggtacaatctatccacagccaccaacgtggcaacgccgcccctcgccggagggaggcggataagtcgggtgctagggaacacgatagagctgagtgctcgacgagacggaggcggcagctccggatgagtgcgaaggtggaggtggtggcggcagcgacaccgatgccaggtgtgcggcaaggcagatgcgacggcgtagatggcacattggcgaggctgtcggcgagagcacggccatccgagataagaaaaggcagacacggtgagaggaggaagaagatagaaaatttacataattacctttttcagttagtacctcctttaatggttaatgaacacgtgggaagtactaccatgtaccatttttccccagccgttggatggaatgaaatggatggcctggattgcatgtaccggcaggtaccaggaaacatgatgaacggtaaaaaatctcttatgtttatgttcatgagtttatatgaatgaagtgtcgttgtgttccttgaatcgagtgaatgattgacactgtatatcaccttaacttttatcagtgggactagctctatatatcacgcggaagacttttaacacaatactcccttcgaattgataatacttgtcgttttagacaagggtacaatcttaaaaaaacaactttgaccactatttttttattataatacgtatacaagtgttaacaaatacataatcttattgaagtattttttaaaactaatctatatatatagttaccatatttcaaagacaaatattttagaaattattcataattaaagattttatagtttgacttcacccttatccaaaacgacaagtattatcagcccggagggagtatatcacaattttcactgtggcaattaaccttaaattaattaagccttttgatatctagatcagtgattgcaatttcacttggaaatttccgaaatttcggacccccccccccctgcaagtgattatctcggccaaaatttttaggtttttctcaaatttttgtgaatttggtaaaactttagtcgaattcagttaaattatgttaaaatttcaaaacatttcggtccaaaaagtgtcgaaaataccgaaatttcgagaattttggttgaaccaaaatgtgcaaagtcgaaattgaaaaccctgatctagatagattataatgttgagaacgttaagaacatatacctaattaattgtagcggatatatatatgatatgatcacttcacttgaaatcaaagttggtcatggccgtggtgtcgaagctttgctgcggtgtgagtatcctggggtgcggcagcagcgcggcggagacgtcgacgtcgccccaccactcagcgccgtgctcgacgtaccactccgccgtcttcttgatcccctcctcccatggcgtccgctccgaccaccccagcgccttgagcttctagtcgtcgacgaaatacttgtggtcgttgaacggccggtcgctcaccgtcgcgacggcctcgccggggtcgagcccgaacacgccgcagacatggcgggcgacgtcgatcaccctcggctacgccgacctcccccggtggagcacgacgtcgaacgcctcggctacgtcgtcgcagtagaggtagctccgggcgtggcgggagccgtacgtcgccgtggacggggagctcgcttgccgccgcgcatggcgaggaggatgagcttggggacgagcttctccgggaactggcgcgggccgtacacgttgttgccgcgcgtggtgatcgccgggaggccgtaggagctagcgcacgtacgccatgacgagcatctcggcggcggccttggacgcggagtacgggttggtggcagggttttaaatctcccgttatagctgccgctatctcccgctatagctatttgagaaaggttctagttattttctcttatgtataatttagcagctatagctttagcccgttatagcgggtatagctgattgagaagctaactgctaaatgcctttgcccgctctttaaaagattggttggtggggagcagccgcgcccgcgacgcctcgtggttgcccgccgtggcagcgtcgccgtagacctcgtcggtgctgacgtggacgaagcggcggatggcgccggcggcgccttccggcggcatggctcgaggaggacgtgggtgccgagcacgttgttcttggtgaactcgaaggagttgtcgtcgacgtgggtgtgggcggcgaagtgcatgacagtgttgatccgctcggcgaggaggaggtggaggacgaggtcggcggaggcgacgtcgccgcggacgaaggcgaagttgggcgacgccatcgccggagccaggttgttgagggtggcgcagtagtcgtcgagcttgtcgagcgccaccacccggtacgacgggtggtcgcgcaacagccggttcgccacgtgcgacgcgatgaaccccgccgcgccagtgatcaggatgttcctcggcgtcgtgtacgacgccgccgccgcatctgcggccgcggagacggaggcggcggcggcgggcgccatgattaatttctcgctagcttgtgattaataattagtatttgttaggttatactgatactgatactaatctcgagtttcccactagatccgtatttatagccagacgcctacatctcatcacttcatctgctttcattttttcttttctgaagaagaaaaatggtgatttttttgttagcacaagagaaaatgttgttgaaatttcatcacgtatgtatgtagtaccagatcaaattgcttccatcttaaaagttttggggtgtaaaaaacttgcggaagttttctaccaaatgcgctctccaataaaaaaaaagtgtaggttatcaactgtatatgagcccatgcatggttgtaaaaagccaagtccaaatgcagcccactgagaagagcccgagggcctcacacctgactggccgatgatccagctgattcataggcccacctcaccgacacacacccacattatgactactattataaaaattaaaaatatttttgctagtatcttgatatgtcatccacggtttttaagtttgttcatttttggaaatacagatccgtgtttgaattggattttaagtttttttcctttgggaagtataaaaggagtcgtataagaaatattttgaaaaaactcacatgctaacttgagacaatatgggctcctaattgcagctcatgattttctgaaaaaatatctaagcgaatttccacagtggattttaccctagctaaaccatataacaataataaaattaaaatagcatttacctgttgcaacgcacgggtatttttttttaagtatataaacattcttaaaaaaagttgtgatggtgaggtgggtcttgtctaataagcactattattttaaaatatttttatgtaaaaaaatatatgagctatatatcttttatttggtatccctccgttacataatgtagcaacttaggatgtaattagactcatcttaaattgctatattttaaaatgaagatagtagtttctttcataatttcatatatgttacgtggtccatttcttaattacagaattaatttccatcttctcttctaagaacctctatatatatatatatatatatatatatataaccagttatttatagagtttataggttgaacgactgtgaagtacaaaatcataacttgattaaaagtaataaaactacttaaaataccagcctaaagacaaagataacacctattgttaaattcctatatatctatggttggcaaaaatctgcaaagcggcttgaaagttgtacatagtccttgtctgtctcaaatcagcggctgatcgttgtgccaatcaaatttcacgtatggtaccaaagcggcagataacgtcggagggtaactgagctataaatcaatcgttcacgtagttctctagctagcaccatggccatcgaagccgatctattggggacatcttgcaccctgccgtcgtggaccgtggcgaggtatagcgtcttacgatgctcaacatatgtctatctaataagctatgctaaacttaatttaagtttaatcgtgacagtggaaattgtgatcttgtgcacacttcagtattccaaattattcttttcataatttagttttctattgtgcaatataaacgagaggcggatctatctattgggtagggtgcgtaggtcgactggcacaactacgacccatattgccaccccccctcgggcggagccatgtagggccaagggggttcatgggcacccgactgcaaaagaaaaattaacggtcaataccacttgttggccatatgggcacccccccaatcaaagcttggtgtacccccacccacattagaaaagagatggaagcacagacaacccacaaacccacatcatgagttgtgtccaagcctgacctagcaaatgtattgaaggccaagaggagcccaatacgttgtagcttgttgttgtcgcgaggacgcacacgcgcatgtctctttgccttcttccttttattttctttctagcagcttcctgctgctctttcctcctgaaagtagatctaacctcctttgtgggttttggtgattaatgactaaatggttaaagggactaatttgtttattgagtttatatacggataattagagcctgtttggttgctaccctgagcaaaccagcctggcctgagcccaagcctgtaatctgcctgagacgtgtttggttgctaccctgagaattttagcctgaggaatcttgcctgacgaaacttgcctgagtcaggcgtagcaaaaaggtcgcctgagcaagccacagcatttcccccaacatgcttgagtagaatcacctctcttctactacttctcctcctcactgtaccaccgtagggttaggaggagaaaaaaatccccatcgatccatccatggctgcagcagcagcgaccaaggggctgctccaccttgtagatccggtggccgtctacttcctcttccactaaaatctggtgccatcagttggagctcagctctatgcgtgagagctactagaaaaaagagagcactttttcagatctgaaagggaatcaacttttcaactctctccttccctgtgcatgtgagattgcaagtctccactagtttttccacgatcttctgcagcaaggtgagaacacactctcaagttctcttcttctttttctttcttcttctttttttttttgttgcttttcccttctattgttgctttgttattccaggatctgtcaagagcatgtctgttagaagaaaaatctatgtgaaccattgcaatatttgtgtttttctccacctatttattattatttgtcatgtgatgctcagatggatttagatcatactcatgaatacattatccaacaacaagctagaactttggccattttagctaccgtgttggcta

SEQ ID NO: 47348 - DNA, 8621 bp, Oryza sativa
  unsure (1)..(8621): unsure at all n locations
acgtaatacgttccgcatttgcagcttgagaggtgagaggacaactcgcattgtgtgcttctaaaaatccgctcggtacatgcggcaacatactagtaggagcactgtattttggagcggtgtattactgtgctctcggaacttcttttttttaaggtaaggttggggatagcctgtgttgtttggtactagtactagtagctattttgctcgaatatcagaaaaaagggagagaaatactctgggttttatcttggtgtcactggtcaagaccagggtttacgattctgacgaaatccggtcggatttcgcgaaatttcgacattccgacgagggtcgaaagtagaaactgtctgagattttgaggagtttcatccaaattcaaatttgaattgataaaaaagaaaaaaaaaataaaatctttaaatactatgatattcatagaatctattgggatataaatattcggaaaaaaataatgtattgtgtgtatttactaaaacttacacaggaaagaaaagaataaaaaattaaaaaaggaaaacacctatagggccagttaatagttgatccaaattacagattactgatcaaaatttcgatgattttgattggaatttcaccaaaaccgaccagttttcgagaacttgtcagcaaacttagataatttgtattcaaattttggtttatgaaatttattcggaatttaccggttttccaccgaatttcatgaaattccgaattctgccgttacccgaaacgaaagggtctgtcaaaatcataaaccctggtcaagacacaagcaaaacattttgttgattatcgatcggttggattggtttgaaccggcacagcacagtacatttctgccgatgtgagaggcagaagtgttgtggttgggtggtgtggcacgcagcggcaattcgcatgcgaatagcgaggcgtggtggtgaaaaggcctgcgcggttgtaccatgattacaagggggagctcgtacctctcgtagctgctgcttttgattccctctgacggtgacgtcatgtgacacgtcctgtctcccgagtggcgtggcgtgggccccgcccaccgcaacattcccgggattctgtctcccgctgctcccgccaacccggccccaccctctcatcacacacagttgcagtcaccgttctcttcgtcgtcgtcgtctcgcaggctgagacacggcacgacagtctcatgcccgaccggaaatcctcgcatcccgacggcgacggcgagcccgtggatccaccatccgacggccacaaacgactgcagccgaaacagtgcgcggcggtacgcacatcggagtactacagtatacagagaaaagtanncgtgtactgtacanncttggactgggtacagaaaaaaagtttcacgcctgcactgcatagctggacctgttcgcctgtggttgtgtgtggttgccgatgcatgcaaaaatacaacgcccaaatgcattcggtgcagtcgtttgtggcgtgtggtcaagcttgcttggaaaacctgtctctctgtactgctcggtcaagcaggctccgtacgtacgtacatgctccagccagtacatgaggctgtactcctacatggaaggcgtcttcttttggcacatctatcgttgatcgatcggtcgaatccgtcgttcgacgccatggtgatgcacaagacgacgacgcgtgtgtgtgtttttgtgttgttatgtgatgtgatgggcctcgctgagactgagtgcgtctgtgtagtactacgtgtgtgcatgtgtggagcgagagctcgagcttcctgcccgagacgacgagatatggatcggaatcggattccatgcgccgcgcggcgagcgatccatccatcgacgcgacccaagaccgaagcgtgtgtgcgggtgtgtagccgcgtcctggttttttcggctacgtcttgtatgacatctgctctgctcagcctcagctgaatcagtactagctcagcacaagattcctgctgcctttgtcacaccctaaaaatcctaaatatataaattgttgtttaattgaaattattagaatttattttaaaagcctagaagagaagatctaattttaattaataaattccaatataaaatagggccagataaaatttcattaaatactttgcttaactctataattcctagatttttctgggatttatttgagctaaggaagtatttttaataaatagaattacatttaatgaataatttaaattgaaaaagatttttaaaatcctcttttggcttcggcccaaaaccttctctctccctctccccggcccaagccggcccagtccgcccgcagccgcccgcccgcgcgcgctcggccgctgacaggtgggtcccacctgtcggactcgtcgtcctcatcgcgccgtcgcccggccggaaccctagccgcgccgccgccgctattccaaatccagccgtccctttccgtttccggtgaaatcaattgaggggaaaggatccccatgatccactctacgttttcccttttggaaacatcgtctaaatcgctttggaaattcgcggattcgatctcgaatcggattcgtctctctctcccgaaccctaatctttccatcgcgtcgccggtcgccgtgggccttcgccgccgcgccctagtccctatttaagcacccccaggtcctccgctactcgtcgccaccctcgccttcgtctctcgtcaccggtagaaccctagcaccgtgtagcctcgcgccgccgtcgtcgccgccgctccagccgtgtgtcgccgtcgctccagtcgtcgccgtagctcggggaggtcaccgtcgtggtcgccgtctcgtcgccgtcctcgtccgccccttcgccgtcgttgtcaaccgccggagcaccgtcgccgccgtcgacctgatcgtctccgccgccttttcctcatcgccggcgccgtccgttgcccctccgccgctactttggtcaccggtgagttcgccgtgccgtccgctaccagtaggtgccctccgttcgcgatgtcgtgccgtcgttcgccggcgagcatgcacgcccgagccgccgccggtggtgacgtcaccaccgacgtcatcgtcgtcgttccccgtggcccggtcgtggaccgatggatcttggccgtccgttgtggataggatcgatctcggccgttcgtttccgtgagctgccgccgtgcacccgattcaccgcgaaccctagccgctgacgcaataattcccttttccttttcaaaaataattcattattgcgtcataattcaattaaaatctaaataaatgatttaatccgatttaatctttgaaaattcataactaattcatcttagctcggatttagttggttcaagtctctaattttttctaaaatagagatctacatgttaaaaatatccacattactgttcatgcttgtttatgtacttttttggtgtttttgctcttttctgtttagatcccgacgtttccggagagtttgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattgacctattgtttgttatagcccttttgttcttgattactttattccttgataccttgggttattataacttgactagttgggctatatatattggttcagctagatattagatatgattgcttagccatgcttagaaacattagcacactattgggttgacttatgactcactattatttaacaatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcctacgggggtcgctggggagtccatgccttgtttataagggggtgattatgatctaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggctagagtaaaactattcgaatagccgtgcccgcggttatgggcgggtctaacaatgtctttcgtgattagtttcacacttctcaccataataaaagatgctataactggtaataatttgtttagctcttggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgacccctatattatgccattctttggtatccttgtgcacttgcatatttgctgcgtggcttgctgagtatgtcatatactcaccttgcaatcattcatcagagaaagagttctacagcgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttattattgtgtgcctcggctgattcctggacgagggttcacacacatgtaagcgtttggaattttggatagaaattccgggcgtgacaagttagtatcagagccccttgaccctaggttatgccaaatggttacccatagaagccctctaaaaatattggaaaagtagaactgttctcctccctttctcttttaattaaaccaaactaatggcacatgcacttcataatctcttttagtggttctcattcaaaatttattccagtgttattagtactgtacatctattactgtactaatggctcatttaccagcaaatgttttacaacattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttataactttattcaaattaatccaaaaacttgtgctattaattggataaatatcttaactccctcctttcacttgtctttagatgccgcgctacaagcctgagtacttgtttggtgttgagggatttgtccaggagttgcgtacgatgtcctttgccataggatttgggactgcccctttgtatgcccagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggatcgccataggagagctccgcgatcgctacagtgatcagttggccgacactgagtatcgctaccatcctcgccaaccccagggaagtgaccgtggcggctaccttgagactgaggagattgagaatgatgctaccacaaggcatttggttgagatgctgtgggctatggatgaaacccgcgcggaggttgtgctagcagctcaagatcgtgaagaccggaatcgtggtaagatttgcaggctagaggacaaggtggatcgtttggaaaaggaactagccgcgttgaagggagaagcaccaccgcagaaggccaggattcgtcttaccgcaaggaagagagctctatttgtccctcgctaccaattggcgccaaaggtccgtgtggtggagaaagaagttaccccagccctagcggatcctccggtcgtcaatgtaagtgatgatgaaggagaaaaattgaagcgcacccattcaaaggtcgagtggggagctactcaagatgatggagacgagccgaacgagccttcaatcaactccgatgcccggaagacctagagtgccttgtcaagccgttgtcttagattgttgtgttagtttgtttgtttaagtttggttgtgtgtgtctcgcatgtgatttacatcagtggtgggatgtaagtgcatgcgtttgtttgcttttgagtgttaggaagttggtgagtttggtggtgtgagagtctttagttttgtagtaatgaaactcagttaagatcaataaaagttaagttagtagaaaaattaattctctgtcctaagtagttttccccggtttctcttcttgtgatcctacccatgccagatggtgctcactcgcagcaacgggaatggccccaacatcaacaataacaacaacaacaacaatggagagaatcccacacttgcccaagtcctggctcaacaggcacagctgatgaacatgatgatgcagcaactccagaaccagcagaaccagggaaataaccatgcacctccccagaacaagttagcagaatttcttcgtgtgaggccgcccactttctctagcaccactaatcctgttgaagctggtgattggctgcatgccatagagaagaagttggatttgcttcagtgcattgatcaggagaaggtctcatttgcatcacaccagctgcatggccctgcctctgagtggtgggatcacttccgccttaacagaactactgctgaacctatcacttggcttgaattcaccgctgcgttccggaagacgcatataccatcgggagtggtgtctctcaagaagaaggaattcaggtcgctcacccagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcagaggccgcgtcttactttaggaccccagtccatgccacagggaggttcttcgtctgttgttcgtccgcagcatcagttcttcaacaacaatgctggcaacaacatccgcaatcaagctccacgccctgttgcagctccaacacagcaacagcctgccaagagggagcaaggcagcaagcccggggtgtgcttcaactgtggagacccaggacattactctgacaagtgtccgaagccccgacgcgtgaaggttgtccctgcccagaacaactctaccgcaccagcatcaaaggcccgtgtcaatcatgttgctgctgcagaagctcaaggtgctccagatgtgattttgggtacgttccttgtcaactcagttcctgcaacagtgcttttcgattctggtgctacacattcatttttatctatgagttttgcgggaaatcatgggatggaagtagaagatcttagacgtcctttgatggttagtaccccaagtaataattgtactctattatcaatttgttattgtgtgcctcggctgattcctggacgagggttcacacacatgtaagcgtttggaattttggatagaaattccgggcgtgacatgcctcgtaagcgttaccattgaatcgagattgttttcagccaccaggaggagcaactctaagagtaaggccattcatagtggacttatatgacattcagcctccaataaaaaatgaatattccttgccacatccttaaactgtgtagctttattaggttcgcgtagccaactttagctactcgttcctcgtctcaaggcgggacccacactagggcttgaggagagagaggggagaggggcgaggtagccgacggctcggaagaggaggggagagcgggggaggagaagaggaggctagtgccgccgtcatagtcatcactcgcgctcgacggggcggcgtcagcggcctgcagggagagacaaagattgggagaaaggaggaaggaaccatcgtcgtcgccaccgttcgaggatggatctagcgagctcaatgccgccctagtctaaagaggtggatatggcgagctcggcagtgccactatcgtcatccaccagagaggagagaaagacccagcaccgtctcctccaccgtagcgaccgaggtcaattcgtcctcgctcccgtgctgagtccacgccgtggacctcattgacccccgccgccagattcgcgccaccaacctcgcgcttccccggctcctgtgccgattccctccgtcgctcttgccgcgccgtcctctcgactgctgctgaagcatcta

SEQ ID NO: 47349 - DNA, 72052 bp, Oryza sativa
  unsure (1)..(72052): unsure at all n locations
ttgtggaggagttgcccggtgacctctccgagaagattatggaggaggcccggcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccgacgagtttccgaacctcggtgaaaaatctcttgtctcattgtctcatttgattgtcacatttacatttgtgcaatttacatttctagaaacacacttgagatcatatcaccctaggattgcaaaacattgacatatgagcgtgatttactttcctagagatataattgagccactatcaccctaggtttgcaaaacattacttagttgcttagttagagttcatcctcaccaagcctagcaacttaggttagatttgattaggtgttatttagttttaaatcgcttattctcccccctctagtcgatatctcgatcctacaagtggtatcagagcttggtctctcttgattgggcttcaccgcctagagagaagatgtcgaacgagttgaaccatgtagggaaggctcccatgtttaatggcacaaactactccacttggaaaattaaaatgtctactcacctcaaagctatgagcttccaggagtattgtggatgtaggctttgccatcaccgacacacccttgacgtagattgatcaccacaacctccaactcaatgcccaagccatgaatgccttgttcaactctttgagccaagaggagttcgatagagtgagcaacctggagaccgcatatgagatttggaacaagttggcggagattcatgagggtacaagtgagtacaaggatgccaagcttcatttcctcaagatccaatatgagacattctccatgttgcctcatgagagtgtgaatgatatgtatgggaggctcaatgtcattgtgaatgatctcaaggggcttggggcaaactacactgatcttgaggttgcccaaaagatgcttagagccctaccgaagaagtatgagacccttgttaccatgctcatcaactccgacatgtcaagaatgacacccgcaagcctcttgggaagatcaacaccaatgacatgtacaagttgaagaagaaggagatggaggaagcctcaccctccaagaagtgcattgctctctaagccgaagttgaagacaagagcaagagcaaggtgaatgaagtcaatgaggacttggaggaagagatggtctttcttactagaaggttcaatgatcttttgggaaggagaaaggagagaggaaggggctccaactccaataggagaagaaatagaagacctaacaagactctctccaacttgaggtgttttgagtgtggtgagaatggacactttgcttgcaagtgcccttccaaggatgatgatggagacaagtcatccaagaagaagagtggaggctacaagctcatgaagaagcttaagaaggaagggaagaagattgaggctttcaacggggactgggactcaaatgaggagatctccgcctcatccgggtccgaggaagaaggtggtgatgatgcaagctccaagaagaagaagatggccgttgttgccatcaagaaggctccatcactgttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggctctaaagaaggatcatgcttctttggaggtcttgtatgaggagctaaagacctctaatgagagactcactatttttcatgagaagcttaaggaagctcatgacaacctcctttccactactcaacatggagctcacatagatgttggcatatcttgtgatttgcttgatgatagtgctacttgccatattgctcatgttgcatcatctagcatttatacctcttgtgatgatcttatggatatgcctagcccttgctctagttctagctcttgtgtttctatttgtgatgcctcacttgttgttgagaacaatgagcttaagtagcaagtggctaagctcaacaagagtttggagagatgcttcaagggtaagaacactcttgacaagattttgagtgagcaacggtgcatccttaacaaggagggacttggattcattccaaagaagggtaagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgagtgcttgatagtggatgcactcaacacatgaccggtgatagggctatgttcaccacattttaagtaggagggaatgaacaagagaaagtgacatttggagacaatagcaaaggaaaggtaattgggttaggtaaaattgctatctccaatgatttgtcaattgaaaatgtctctcttattaaatctctaaatttcaatttgctttcggttgctcaaatttgtgatcttggcttgttatgtgccttcttcccacaagaagttattgtttctaaccttcttgacaagtcttgtgtgttcaaaggttttagatatggaaatctttatttggttgattttaattctagtgaagcaaatttgaaaacttgtttagttgcaaaaacttcattgggttggctttggcataggaggctagctcatgttggcatgaatcaattgagcaaactttcaaaacgtgatctagttgtgggcttgaaagatgtgacgtttgagaaagataagctttgtagtgcttgtcaagctggcaaacaagttgcatgttctcatcctactaagagtatcatgtccacatctagaccattagagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaagtttgcaaaaagggcccaaaatgaattagttgcactcttgtgaaaattagaagtgacaatggttccgaatttaagaataccaatatcgaggactattgtgatgatcttggcatcaaacacgaactttccgctacctactcacctcaacaaaatgctgtagtggaaaggaaaaatcgtacattgattgagatggcaaggactatgctagatgaatatagtgtttccgattccttttgggcggaagccataaacaccgcttggcatgcaaccaataggctttatttgcatcgtctcttgaaaaagacttcctatgagctaattgttgggaggaagccaaatgtcgcccattttcgagtttttggttgcaaatgttatatttaccgaaagagtgttagactaaccaaatttgaaagtcggtgtgatgaagggttttttctaggttatgcctcaaatagcaaggcataccaggtctataacaagaacaaaggtattgtggaagaaaccgccgatgttcaatttgatgagactaatggctcctaagaggggcacgagaatttggatgatgtaggtgatgaaggcttgatgagagctatgaagaacatgtctattggagatgtcaagcctattgaagtggaagacaagccatccacctccactcaagatgagccatctacttccgcctcgccaagtcaagctcaagttgaagtggaggaggagaaggcacaagatccacctatgcctctaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatctttaggaacaaacaagatgagaacggattggtggtgagaaacaaggcaaggttggtggcgcaaggtttcacacaagttgaaggtttggactttggtgaaacttttgcccccatagtaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaattctaaccatgtttacaaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtttgtcaaatttatgttgatgacatcatattcggttctactaatgaggtattttgcaaggaatttgatgatatgatgtttagggaatttgagatgtccatgattgaagagttgagcttcttccttggacttcaaatcaagcaactcaaggatgggatgttcgtgagccaaaccaagtacatcaaggatctactcaagaggtttggcttggaggatgcgaagcccatcaagacacctatggcaaccaacggacatctcgaccttgatgagggaggtaaactggtagatttaaagctttatcgttccatgattggtagcttgctttactttaccgtatctaggccggatatcatgtttagtgtttgcatgtgtgcacggtttcaagccgctcctaaggagtgtcacttagtggctgtgaaaaggattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatcccttgtgtcatggtcatccaagaaacaaaactccgtagccctctctaccgccgaggcggaatatgtttcggcgggtagttgttgtgcccaattgctttggatgaaacaaaccttgttggactatggcatatccttcaccaaaaccctactcctatgtgacaatgatagtgccataaaaatagccaataacccggtccaacattctagaaccaagcatatcgacattcgccatcacttcctaagagaccatgttgccaagtgtgacatagtcattagccacataagaaccgaggaccaactagctgacatctttaccaagcctcttgatgaaacccgcttttgcaagttgaggaatgagttaaatgtcatagatttctctaatgtggtttgagattgtgcactatggttgcttcttttgcattttatatatttgctcctatttgctcttatgctttggacttattgccatttggttcttcattgcgaaaatggagcatgtcacattaagggggagttttggactcttgcatgtgctttacttccttttatatgtgagcaaatcaaccaaaagtgctagtagtgtttttcaaaatgcccaagtcaacataagtcaaaacttttgcaaaatcaatgatatttgaaaactaactctttggaaaatgtttcaaaagggtccctatatgttttccaagcctcacattgctagaaaaatgatttttgaatgaaaaataccattttggctctcttttgaagaatctagattcttgtttttggtcaaaataagattaaaccccaaaatgagtttgagaaggaatctgagaaaagattcaaaacaaagttggtagtgaggaggatttgaaatgtttttggtattcaaatcatattcaaaaaccaaatatttcaaaagttgtttgaaaatcaaattcgtccaaaaacccctatagaccataaaaggccacatcctagcactcaagtgagttttgttgcaaatcttcataaatttcaaatattatgaatggttggcaatatttcaactcacacatttcaaaattgctccaaaaatcaaaattttattgatttttattgagtgggggcagccaactgtgcaagggctgtgcacagtcggctggggggccaggcggtctgactggcgctatatgcgcggtctgactggcctggtagtagcggtctgaccggccactagggcacggtctgaccggcggcaacccggcggtctgaccgaccacgtaaagccggtctgaccagctggggatggtgggcccaggactttgtcctttcttcctcctcctccttctacccgacccctcctcatcccatctcatctcttctcttctccaactcgaaaaaactcctcctctctcctctcccaaaccctagccacctccctccaccaaatccatccggttcaaccgtcaaaatcactccggttacaccgtaagtgaatctcctcctcttcctctctctattccatggattgatttgagttcttattgagtttgtgatccatggcatggaaccctaggtgaaggaagaggtgttcttcgatttgcaccaatagagggtggtttcttggtgtgattcaactccttcaaccggtaaatcactctcactcttgtgcttttctctcaaatcggtctatttcaattctagggttaagggtagtttccccctttgcttcaatctctatgaaatagacctacactttgatgttcatgttccaatcttgtgcaactttgtcctaacaatatttttttagaatcatttgtgtggattgtggaaggattcggttgtgctactgtcagtggcggtctgaccggccgagagcctgcggtctgaccggccgaggaccgtcggtctgaccagccgtaagccgccggtctgaccggcctatggccgtcggtctgaccgacttggggcttgcggtctgaccggccttggctctcggtctgaccgcccctgacagacagcactcccccttctcccacttcactatgtggcttctaaaactgttgtttatccatcctttgctccatgtttttcagctatgcctccccgcactcgccatggtcgtcgtgagcccacgcccgatcccgtcagtgagaatgaggattcaagcggagatgagtatgttcaaagtgatgatgacaatatggaaaatgttgagggtgatgagatggaagtaagtgatgatggtgatgacaatgagagtggaaatggtgaagatgatgaggcaagtgatgataggagtcctctcgattccaccatccaatttgtgcttaatttgaggaatgctcaacaatacactatcctccgtcatcataatcaattccgaaggcctaacgattgtaatgatccaagatttcatacacggttccaaaagtccgtgtatgcacaagtgtatgccaacaaagccttcgccgaacacaagtggatttcttggaagcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcgaggaccctccgatgctctatcaaccgccgtgaatccaaggagctcttgcacattcgcttcaacaacggggatgaccttcatgatgagcacacccacaaccccttccccattgatcacttttctcagttttatgaagaagggggaaggcacacatatggcaaggtggcgggtttgagggctctcccaagtgtgatcaaccgcatagtaagggccaccatcctcccaagatgcggcaacaatgatgacatacgcggagttgcttggcatgttattgatgccattatggatggtcgtcggtttgatgttatcaaccttatgatgaaggagattgccatctcaaaggggactcttggacaaggaatctattatgctccctacataatgaggttgattcaaagcaagttgggacaaattggtcacaatttaaaagaacataaggagtacaagcctcgtctccaactctcctcccctagagctcctcgtgtgcgccaaccaacattcgatcaaggtgcaagctcaagtgcagcccccccttctcctcaagggtatgatccaagtgcttttttccatctacaatatgcctactttggaatgcaacccaatgacttcttcaacccggtccttggggctattcataccctaagtgaaagcattcaacgcttatccaccgggcatgaagcattgcatgaggatgttcgtggcttgtgcaccgatgttggcaacttgaatacttcggtgggaagattgcatactagggtgggtgtattggattctcgagtccaaaccttggagagtacccaagcttttgtctatcatcgccaccgtgatgcttctcatccttccacttcggcgcgtcctccttctcctccacaagagtgaagacctttttggtgcttgatgccaaaagggggagaatagtgtgttttatgttttgtgggttgggtctagtagtagtgaggttagtcacctcatatttaataggttaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttgttctatgatggatggttggtgtgacattgatatatttgtgaccatcttatgctcatggatgaatatttcttgaagttcacattgagatattgctcttgtgtttgtgatatgttgaaatgtgaaattgaattgtgcattggctccatatttgctatttgtgattgttatgcatatgtttagggggagcttttgcttgtcaaaacaatatatgtccatgtgctctatgtttgattatatatatttgtggtgtttgtcatcaattaccaaaaagggggagattgaagcatctaggcccctagtgttaattttggtaattaatgacaagcactaattgtggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaacagatgattttaattgccacattaggtcattgcattttcatttgtgctctctttttcattacacacacattcacttgcaaattcactgggttctgcctgaccaggggcggtcagaccggccacatagtggcggtctgaccggcgtgccctggccggtcagaccggctacatagtggcggtctgaccgatggcactttcccggttagaccggccccctaaaggccgagatggtgctgctcgggatggccgatacagagccaacggagccgtattcggtcagaccgagccgatggtggtctgatcgagccgaggccggtctgaccggccaccccatgccggtctgaccggccagaccgatggggccctctgacagggctacaacggctagttttctagccgttgcagagtagcacggtctgaccggccacatacctccagtcagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagttagtgtggcacttgatcatctccacaccgggtcatttcttgttactcttggaggttgccgcctcctagacggcttgtggaggagttgcccggtgacctctccgagaagattatggaggaggcccggcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccgacgagtttccgaacctcggtgaaaaatctcttgtctcattgtctcttttgattgtcgcatttaaatttgtgcaatttacatttctagagacactttgagatcatatcaccctaggattgcaaaacattgacataggagcgtgatttactttcctagagatataattgagccactatcaccctaggtttgcaaaacataacttagttgcttagttagagttcaccctcaccaagcctagcaacttaagttagatttgattaggtgttatttagttttaaatcgcctattcatcccccctctagtcgacatctcgatcctacagctgcacgcgcccggtgccgcgcagctcgtgcggaaggagctcgggccgccgcttgattgccccgccgcccgatgccgtcctagatcaactgggggagtcgggccgccgccaagctcctcctccacttccgcgcgccggcgctcatcttttttcgccgcggggggggggggggggaggggggaggaggaggctggtgcgccggcgagagccaagccccgtcgcccctccggtcggtgccgtcgccgcttggctgctcagtgcggtgaatgcggtggggaaagaagacaggagagaggggagagaaaaaagtggtaaaagctgatactggtgggacccacaagtagtaacttgcactgtggcacatgtagctaaacattgttcctgatctaggtggtgtgcgaggcttcgcaaatactagtggcgcattatgaatgtcctaaggtatacacgctgcacaattgcacagtacactatactgatggagtatgcaactgtgcacgatgtgagttctgtcccaaaaaaactgcttttggatacaatgcaaaggttagtggattttcagctcacaatatgaaagtcgtcgcatgacttctttttgtaatcgtactaatcgcgcgctttttgtgacggcatggcatagacgcatgtaaacgcatgccttttcgcaaatttgtaaaacgaaacgaaccttttgtcccaactggtgcaaaagcgtgaggaaaacgaaatgattcgtggtgagctacaacacacttcactcgatcgatcgtagtagcaggctactagccgcagcagcagtaggtcatcggacgccacagcgatgatttgcatgattcctcatgttgatccctggcggtggtaagaagagggggaaaaagtgactttttatcgtcaacagcgaaaagcaaaccgctcgcgggaatctcattattggcgtaccatttgttttttaacctttcgaggccaaatacgccatgccttccatccgtcgatctaccggttggagtagtagctgttatattgtgctcacgtttttgctagtgttgtagacgtggccgcgtgcgtgagaaaacgagaccgagaaaatgtggcgtgcgtcgcatggtggagggagggacagagatgtggcacggctcggcgcgtcgcgtttggctggacacgaggacagtacgtacgcctgcgctgacaagtgggggatcaccatgggaaagagaagcgagcaaatggggatagtgtcgtgcattgagagagagagagagagaggcgatcgactgacgacgacgacgcaaggaaaagctacagcgggtagcgagggacgacacgcagcgagcgagcctgcgcaaatgaggaatcatggcttcccccctcgaaaggtcggcatctttcgcgcaaagcagccgcggtcagcagcatcacacactgcagcagcagcagcagcagcagcaggagagaggctgggaagccaagaccaagagagagaaggcaaaaggcgcaaaggggaagaggggagcacgaccaccctcctccgtatcattgccatctactgcccccatcctactactactcctacacccgtctactccactccacaacctcttcttcttcctcctcgcgtgcgtccgggcctagctgtagcacgagctcgcctgcccatctctctctcttcaccgctttgcctttgctggcgttgcgcgttttgccacactcgctgcttcttttttatacttcgggtttgggcgggtgccactggagacattcgtggggtgccattgcggcgtcttctcctctctcaggaggtgagtgggctctgtgctcttggcttgtctctcagctacttgcttcttcttagcattacccattttaagtttttggttgttctaatccggtgatcttgggtgttccctccggcattgccgatgttcttgagactacgatcacacattcatatgcatgggtgagtgatggtcttcgcttcttgtgaaaatgcctcacctgggggaaggagggctggtactagtgctactagaggggtggcgttcctgttcccttgttcgtaggcattcgcctggagttgtgtttgcatttacaagctgcacggcagaggatgattgccaagtggcatttcgtcgagcacgtagctgatatattcgtggtgacatttactagtactagtgctactactctccgcgtagctttctactgctactaatcctagagacatgagctgtgtggcgtaaaaacacaaaagccgcctgctttcttgggaaagggaggtggttttggccgccatggggacccaacacccaagctatagctagccaatgcattttgaacctcccttctccacgaattcctattttattttggctctccactttgactgctgctcacactgcacaccgtatgaaatgatatcctctgcctctgttgcaatggtatgcaggcatttgtgacatttggtcgatggtgaagtgtggctaagctgctcgcttggcttagtactctggaattgaggttttatcagaatcttggcattcagattgcagctgttcttgggtttcttggagacatatggcgtcctcgcaggagaaggccaagacgggtgttctgagaaatgccgcagcgctgctcgacgaaatgcagctcatgggagaaacacagggtgagtgtttcagactttcagtcagattctgctgcttgttgatgcataattgcgcacaaatttgttgcaatttttggcatgatgcgagtagcgtccgttccttcttcaggtgccaagaaggtgatcaactcggagctctggcacgcttgtgccgggccgcttgtgtgcttgccgcagcgggggagcctcgtgtactacttccctcaggggcacagtgaacaggtcaatcttactgtcttttttcacaaattgcagctaatctcgttttgaaatgctgcaaccatagacaacaatttggtcagattgatgctcaataatactttgggattgctattggaatgatcaatgttgaagggatgatgcccttgcaggttgcagcgacaactagaaagattccaaattcccgcattccgaactacccaaacctgccatctcagttgctgtgtcaagttcacaacatcaccttgcatgtgagttcaagcaaattcaattccaaacatatttgtggccaaatgtgttttgcctgtgcttgattgtttgttttgcacaggccgacaaggacactgatgaagtttatgcacagatgacccttcagccagtaaactctgtaagtatgatgtttctctgttacattgtgtactgagttctgtactactttatttggttctattaaaatgtaaacaccaattgttattgaaatgcataaaatgtgattacagaaacaaaaattcagtgtgcaaggaataaaagatggattctaaattaatatttatttgtgccgtctattgtaggaaacggatgtattccctattccaactcttggtgcttataccaaaagcaagcaccccactgaatatttctgcaagaatttaaccgcaagtgatacgagtacacatggtggtttctcggtgccacgaagggctgcagagaagttgttcccacaactggtatagcctttatctacattttgtttgccgcatagtttttctgtaaaaaaatgcttcagctcatgggtttaagttttgtaccgacaggattactcaatgcaacctcctaaccaggagcttattgttcgagatttgcatgataacatgtggacattccgtcacatttatcgtggtagggtcaaacaatattcggattttatttgtcttgttcattgatacataaatatatgcttcttgggccactgtctcctaaaagtttcttcttttcttgtcccttgcaggacagccaaaacgacatcttctaacaactggatggagtctctttgttggggcaaagcgtctaaaagcaggggactctgtcttatttataaggtgaaataagttctataaatacatgcaaagtctgtttgttacttaacctgtgtgtgctatcagaaaattgaatctgagattgttaagccttttgatactaaaccctatgcaacaattcatgcattgaaataccacaagaactgcttatgttatttgctctttcgaaagaatgtccattaccagtattagattttcctacagcggctatctacttaaccttaaccaatatatacatattcaactttctagaatattaaaatctcaacaacaataacttttctatttcttgtcagttctaatgtgaatatgactgttataggacaccgcactttttactcgctcggactgacaacagcttgtatgtaatagtataatattttcttcacaaatatgtgaggatgaaatgccatttttgacagaagttcctgattgcagggatgagaagtcacaacttcttttgggtgttaggcgagccacgcgacaacaaacaatgttgtcatcttctgttctatctactgatagcatgcacattggcgttcttgctgctgcagctcatgccgcatcaagtggtagttcatttactatctactacaatcctaggtacagaaatttacttacccttttacatatgcttttttttttcctggtgagcatttggtcattcatggaatctccataggacaagtccttcgccatttgtaattcctgtagcaaggtacaacaaggcaacatatatgcaaccatcagttggaatgagatttgcgatgatgtttgagacagaggagtcaagcaagcgcaggtttgtccactttttgttctcattttacatagcttttgttttctgtttcagattttatctttatgctatttatttatgtccacaaactagaccttggtgtacaaccgtgtaatggattatgctgctttaaaagtataaataattcaactgtgaattttcatgattcacattggaaaaataatgactacatcaaatgtcgttgcatgggcatacttgcgttctatgttgagtttagcgttttgttgattaagtacagctagaaaacatattccatattgtaaacaaaattgtcttgttttacagatacacaggtacagttgtgggaataagtgactacgaccccatgagatggcccaattctaaatggcgcaacttacaggtgcctttttcatgcaaaagcttaaggaaaactcagaattctgcctatcatggtgtatttgatatttatatacttcttgctactaggtcgaatgggatgaacatgggtatggagaaagacctgagcgtgtgagcatatgggatattgaaactccagaaaacactcttgtgttcccttcgtcgaccttgaattcaaagcggcaatgtcttcctggttatggaggtatgtctctgacatatgctatacaaatatttatggtcgtgcaatatgctgaaacatgccttacccttttgcagtttcagtgcctgggatggaaattggatcagcaaatatgtcatcatttccaagggctcagggtaatccctatggcagtttgcagcacattccagctgttggatcagaattggctatcatgcttctcaaccaatctggtcaaacccttgggagtccccttagttttcaccagtcctcatattctagtattatccaaaatgtgaagcaaaattatatccctcctctaacagttagcacttcagcttgtttgacaaagcaagaaagcctgccttcagatgatgcccagcaccagttccatatggcaaatatgcagaatggtgatcttgaaggctctgaagtccagcctgtcattgattcgatttctgagtcaaagttgaatgctacatcaagagatccaagaaacacagattcatacacaagtcgaagtacttcggagcaaaacagtaagggtgagcctagaggcaagactcgtaggagtaagaagggcttgcctcacaaaaccgtttcagagaaatctgacctttcttcagccccttcttggatctgtgacaatcagcaggttggtttagaatcgaaactggttggttgtgatgaacaagtaaactgtggaaatattgaagattcatcaggtgcacttactcaaggtaattttgttggacagccgcatggccatcaggttgaacaaaagggagtgctgtcgccaccaaaggtagaatcatcaaaatcacctgatggaggaaagtctgtcaattcgtttccaaaccaagggtgtttttcgcagttcattgatggtcttgattggatgactcagccttcctactaccaagactccaatgtaattcaaccagccggtgtgtcagagaacattttcagttcttctgcagatatacctccctcaatgattgctgatactatggagacttttcaggcttcatgtctttctgattgccttcctaattccatacaagaattcatctccagcccagatctgaattcactaacctttctttcacctgacatgcaaaatttggaggtccaactccagcatgatggaagcaatttgccaagcacgtccaactcgtttgtacagatgagtttttctgaagagagtgcaagtcagagtgcaaacttaagtggacttcacatggaatctacacacagaagcataaacaccacttcatgctctcaaccaatgtctactgggggctttgatgcagggatgtactcaaagttgccacgtttaaaagaatcccaaatcttgtctttgccagagattcataccaattccatgggaacatcagcttgcagtatggatgcaaccgagtacagccttgaccgaagtgcgaagccgatgaaaccaccagtgcggacatatacaaaggtttatactacttgactgtttatatgttaccatttgtcaaatgctcttgatagtaaatataacttaacaactatctattatgtttttttttgtaatacataggttcaaaagcaaggatcagttggaagatctatcgatgttacagggtttagaaattaccatgagttgagatctgccatcgcttgcatgtttggtctccaggggaaattggagcatcctggcagttcagagtggaagcttgtatatgtcgactacgaaaatgatgttcttcttgtcggagatgatccatgggagtaagtagacatgtcttcgaattggtgtctcctgttctttctactcctggtcagcatattaattgacactcatacctatgtgcttttgcttctacagggaattcatcaactgtgtccggtgcatccggattttgtcaccttcagaagtacaacagatgagcgagaatggcatgcatgttttgaacgactgtattcaagcagcttagtagtaccattttctggatgaagctctatatcgacatgaaggccacaagagaaatgcacatccgagaagctgtagttctctgaatgcgttgcattactgaatgttaagctgatttgttgacacttgacagtagtgtttgtggtagagacttacaggaaaaaaaaaggctcatcttttgcaagaagaccaggtaggaaagcccaagctgtggaaaatagtgtgcagtgattactcatgctttgatgcatttccaacttccactgtatgttgcgagctatgtcgaatcagaaacttatttggttccttacttcactcagtatacattcagtttgatctctctccatgatgcaatacgaggggaggtagtacagtatacaaacatgagttagattgtagaaccaaaaacaatgattttcaaatttttcaatgtagtattatagaacgacatatatgatctggagaagggtgaggctacaagcaaggtcgcaaggtccgtaggagtaagagcttgtctcacaaaaccatttcagaaaaatctgacatttctactttgagcgaacaatcattgtttgcaacaccccgagtacctaagaccctcatgctacatgtgagcatcaaaggatgatagaacaatagccaaaaaaccagtgcaatcacaaaggagtagtatctactagcgacgatccaaaagaaaccgcttcctggtagaaatcctctcctgcaaacgttccaatcaatccagttgatttcgccacccgcatcttgataagtactcgtagaagacttcaccagacataagttcgtctgcattcaaaatatgtgacccaacgtaaaatttactcattattttgattgctaataagctatatgaataagcatataagtataattgaaacaatgagtccctcactttatgctatatttttccatgcctccagaaaccatacctttagaggccggccacatcaatatcaacactggccttgcaataaaactggatagctgcagcacccatgatttcaagaaaataagcaacagcatgcgcaaccacctttgagtgattttttcagatttttgtgtgacccagcaagagaaacaccacaagtgtggaagcatggaggcacagatggatgaactcggtctttctagtgggctcaaaatcataggcagtgtcaacaagatacttcccagcttggagagctataaagagaccaaaccaaaagagagcaatatacacatcaagctctgactcatctgtaatgtgtttcagcagcttccaggtaattagcacaagtgagccatggaacgcaagaagcaatagtgccagtatacctagccgcatccaacgcttgcgttctttttccctactttcatcactctcagtatggccattgttgatcccattgctgcctctctccctactcctatcgctgttcatgttgttgctcctcctgctgctgctactgctgctgcagctgctgctgccaccgctgttgctgcccctcctcctcctcctcctcctcctgctgctgctgctgctgtctctctcccttgtcctctgtctgaattgcccagcaggtccaagcagcctttccgtgccattttcagtgtcttgagctgtatcccactcccgagccaaattgttcaagccattttccatcctccattcatggcctgatccagtgttgttgctctggccagccagattttgtaattccactatatcaagagttacatcagctctctgcctgtctgtcaccacatttgtgcttgggcctgccagaaaattggagctgagctcaatggtgctccttgacatttcctggtgaggcacttggcctggtggattgaaaggcgggagaggtggagcacggaaagatggcagggatccatcccttgagactgctgctgaaggaggcggcgctgctgcacttgccgtagtggacgaggtctgtgtagaaagccgaaccgtgggcggtgatggaaccattggcggcggcagagcgcgcgagctggcggacgctggtggggagaaggtcggtgaaggcggtgatggaaccattggcggtggcagagcgcgcgagctggcggacgctggtggggagaaggtcggtgaaggagaaaatcctggcaacgacgaactggaacagctcttccataccgtcgacgagctggtcggtgagagctccagaagcggtggtggtgttggtggcgacgaggtggatggagccgagaccttcgtcgagggcggtgacaaggagggcgagcgggccgcccctcgccgccgccgtgtaggagcggacgtggcgtcgcgggtatgcggcggggccgacgaggagcgcgtaccccttccccgccgtgccgaggtagctgctgctggtgaaatcatcgtcggcgacgtgcttgtgatcggcgtggagtggaggaagacgaaggttggcgacgaggagccgtcgcgtggcctcgcaatgttgcggcggcgccgacaaggagagtgtacgccctccccgccgcgccgcggcggtggggttggtttgctcgcgttcttcgtcggaagggacgaacagtaccccgcagatttgggaggaatcggatttgattttggtaagacggtagaaataatggtgagaggtttatgaatttttgggggacacgccggtggcacgggaagtgtgtgcacgcagcaattcctttgcctcgttcccgcttcccgctggctgacagacagctctgtttattgctgtgtgtacgctgtagaagttacaccgttcttgcaacaaatcgaaaaacaaaagatgcatttatgagcagggagtagggaataaacccactaccaccggtatttgttacggaaactactagtacgactagtcctgttcttctgttctgggaggagctaaggcaaaccatggttttctctgtgttctaggagtagttcgcaatagattctctaactagttttgttttgtccattttagattgatgccaaaatatgttctacaattttttttatgatttgaatggtaattgtgatgttttgatttgaaactaaatggttggcattgcccatccctaataatagatagaaatccgtcctctacatccatatacacaaccagacatgagataatcataaacgtttgatataattagtgagcatattttaattttttggacgacccttatctctctcttcttcctcctcctcttcctcctttcaccccttcactggccaactcctctcattcctcttctccacatcgccccccttggcagcttgttgtgtgggaggtactttcacctcctcaccttggtgacgttgctggcgagggatggtagtggtggaggccacccccatcttctccacctttggcttgacgatgctcgactgccatcttcattcccaattcgggcacaaagaagaagagggaggaagtggcggtcaagaaagcgcgttgagctttggtcgaagtgggaggaggaaggaagaggcagcttcctccatgaccgccatcgccggacgacaccaacgtggcaaggctggttagtgtcgtggcagccaccatcgtgatcattccgtcgaacggtgggggaatgacgctccttgtcgatgggtgtcgttgcaccaacaccgaccgccatccctactcgagcccgtgtggcactatgaggaagggagaggggaggggaaacatctaaggaagaaaggtacatagattttaatagttagggattaaaatatctggtattatagttgaaggacgaatcagattggatgtagtagatttgaggagttaagtggactaaggccctacttggttcatgggactaatccattagtccctccattttagtcccttttaatccctaagaattcagacataggtaactaaaagtgtacactctgggactaaaatttattagtccctcttgaaggtacttataggcatagtagaaaaaaccggaacggtagatgactcgatcaccatgctggttcaccagttcgatagtccaaccgtaaaccggctggtagaaccgcggtttactaagtacatataatatatatgtaatatatatattttcagactgtcacatacattcggctggtagtatggctacaggggttggcttaacttatcttacaggggtcgactccccatcggcgcacatttcctttgatttttgctaaaaaaaaacaagcctgcggacatatatggcccaaaacacactaacatcgcattccagagcatgacaaagagctgcaccatgctcagaagcgaagcccgacaacccattgcgcttgcagacagtcttgaagaaccggcggcacaaccaccatggcgaccgtttgtgacagcactggtgcgttggcgtcggccgtaccatggggcctatcagcctatgcccacaacctacccaggccgtgtttagttgagccgatgtcgctgtcgtcgtgaaactctacgtaatcgcggacaatgagaacgaatcactcctccatggctggcgccctctcctccagggctacattcattcttggcattggcggcgcttctacgtagatcaaaccaatcatggttaactgaataactggtggtgaagatttcaatgcacgctcctcattgacggctcatgcatgaatcaaggccacagctcagagatacggtgtgtcccaagagtgtcccgcgtccgacgttgtgagcgatgtggtggtttaatcacattaggaatcgatgtatatatgtctgaaaacacaaaaattaaagctacgtgactggtgggccggggcgtatatcggagatgaagaaagaaaacacaaaatgcggacatcgcacgtggcgaacacgactacggacgaaagcgtgtacgtaacgattgagaaaatccaaatctactttaagtaggttagattagaatagataaatccgaacaaatggcgtttttcatagtttttcatattttatacttacactattacgcatgtgcatcatataatccatcactccgccctcttccactacactattttcgatgcaattgaattttattgtcttcatattgatgaatgaaaatggcgtgcatgtttgtttacaactagatgaaatctcgtgcgttgtatgaaagttttgtataatattagtgaaaataacatgtaaaatagctacatattatagtaatttttttatcgttgatcgactattgaaaaaaaaagctatatatataaaccatttgatgatgtggtctataactatttaaatcatatatgtattgatcgtttaaaaggaaaactaagatgatatgacccaataacagaaggaaaagagaaaataatataaattaatcatcaaagataaaactaaggtgatatgattttataagaaaagaaagaaaaaatgagataatttgggcataaaaccattccataactagaaacaattaagttgatgtgacgtaatgaaagaaagaagtacgtagtagtactgaagatgaactttctaaatttctataggattagagaggcaaacaggaattaaatcagcatatctccatgagtgtaagtcgttatctcggtatatagatcacttttatctcctcgtcgtcaagtcgtgtgcgcatgcatgcatgatcctaatgatcctttctcatggataatgtttcacgaggatttgttcgtttaatccctcccaaaaaaataagagagatttagaaggattaatttcacatctacgtggaattattttttcttaatcccctctataccttttttttttgagattatacgaacaaagacccagatttgagggatgatcgatttttgagatcgatatatagccgtcactcagcaacggtcgtgccccacgggcggcagttgatgctcttcgttgctgaagtcggagatcttggggatggacaagccatactctctgagatggccgacgacgaggtatagccagaataggcactcaaacacaccacaggtgacgaagaaccggcgccacgacacggacatgtggtggtcgagggtcccgatgagcaacaaaaccacccaaaatacgaggaagacagcggtgccgatgactgtcagcttgaattccctgagcttgtgtttgtacctggcgacttggcgacgcacctccgcgtccacgatctcacgcgccgtctcatcctccgccgtatgctcgctccccgggtcctccgaaaccgctctgtttgggccgctgccgccgtttccaaggcagagtaccggaataatctgcgtcttctcggccgccatctccaaactctctgtacttccggacccgccgctcattacgccgacgacgacgagaaacgcgccggagactcgattcgatacagctcgacgacgaacgcgcggcgtagggcgcgaatcgacgaggaggaagaaaaggaccagcgtggtctgggcaaattaagaccgagtcggtgtcggttttggagttctggacgacgtatggttgggctcggctcacattgcaaaggcccattgatctgtgagactgtgacgatcagcagcccttttttttgggaaaagctagataccggtatcccgtccctagcatccacgacggtatcttctttttccttgttcccagagcacgagcacacacatgcagctgcggagcagcgctagcatcgggcatgcgacaacggaggaagaagggagctcactggagaagctccccgctgcctcgcgagcacatcaacagagaagatatgcagtgccgcgggcgacgcgttccggcgtgacggcggagcacgtggccgctggtgacgagttccggcatggggcgttgacgatggaggtgttaacagtgaaatttggtaagccctgagtagtcatcggcttagagtcagcatcggctttgaagtcctgagattagccgatgagagttgtcaagtcgtcagttgtcggattcttactatattcggttaagaaaattgatctactaaaggaagcttatccagaagagaccgagttcaaagagaatgcggcatggcaagttatctattaattaggaatagtttgttagttttcttttatcttgaggaaaatgtgtttagtgtcctataaagactttatcttttccttttatctttagaaaagtttctttcttgtccgacaatgacttgtatcaacccatgggtataaatatgtacaccaggggtctatgtaatctatcgctacaatcaatacaattcggcgcatcgccaccttttaccttttctactttattttatcgtccggcgggacttggcacctgacgcggggctgcatcggtgttcgatctccggctaaggggtaagtccaatgttccgtcggcccaggcaattatatcatttacgtcggcgtcgttcaaggctacatcagtacattcaacctcttgaattgctctggtttggatgatatatttgcctacctatttatcatatgtctctgttaatctagtctttgcatatcaatttagctctatcggctgcttctcgttttagggtttctgccggtatcagctaaatcgcgttgctagattagattagcttagacatctaccaccctgaaaactcagtcaacggcttgattgtctagatattgtgttttttttcatacttagtgttgcatcagttaagtttgatctactaagtcgtgtttagaactataatctctagtctgcttcttgattgccaataagggtttcatcggggtttcagctgatgagttatctagacgttacattggcttgtaaggattgcatatacatacatattggatttagccgatcgtaacaaaggtttcactgtttaatctaatcttgtggatttaatgacatcggacctccagccgatgtatgctttaaccttcggatcagtgcttattctatcatatcattgttagccgattggtttctaccggattatattactatattatattatcatcaaccgattgcctttatatcattatctacattggacatatagccgattgcttaaaccttatcgctattggctggtatcggcatcggctggaatcactccatcggtttgtcagccgatcggctgttttatctgctgtttacatatcttgtcagttgcaagatcaaactgactggcacgcccgcatctcatcaatctttggacctgcacagaagttaagcagatttcccaggccggtgtgttcgattttttcgtcaacaggaggacgcagccaccagtgtggggcgtggcagcggaggcatggccgctggcgacgagctccggtgtggggcgttgacgacggaagacgcgaccgccggcaacttgctccgacgtgggacgtgacggcggaggacgcggccgtcggcgatggcgatgagcccggtgtggggcgtggatgacggaggagcggtcgcaggtgacaagctccattgtggcatggacagtggaggatgtggtcgccgacgacgagctccaacgtgggatgtggacgatgggaccaccagcgatgacactttggtgcccggctcccgatatctcgtaagtatcacctaatacatggtaggaatcgtctgatatctgacaggtatatcacctgatacgtggtaggaatcgctgttaacgaccatatttggaaatgccacgtcatggattcaaagctagagtcaaagccgatttggagaaattccgttcgagaaagcagaatacgcatcggttacaagcagcatcggctaccgcatgaatcggctataggcggtatcagctgccacatatcggctaagtgtcggatccgatggagttaagccgatgcaaccagtctcaggaaagatggtcccacgtccgtcattggaattggtcgaagcacttcatagccattgccacgcaaggattggagtcctaaaaatacaattgtagctattaattaggacatttttcagtttccttagagatatgtttggtaagagtccacctaaaagacttattcgtattttaggttgtgttagagataagaggtgtctagtaaggacacattatgtacttgggtataaatatgacccgacaccatgtaatcaagggatgacagttcaataatacttcagcgcatcgccaccctttttattttcgttgtttcgataagtttttactttcgagttgggctgcatcgggttcgatctccgacgaagaggtaaagctttttatggcggcttgcgttctcgagattagtgcttacatcttcatgacactctaatcctgtctatatgtaaaccaccgagttatcaaatataccgcataatctagattgatctcgtcatctaaacttcatcagctagcctctattatcgaaaacagccagcaggtttaggtttcgatatcaagctagactatgcagtgtatctaccatcttgaatgagttttcatcgatttgattagatattatgtgtcttttcacgcttaatgctgcatcggttaggttcgatctgttaagtactgtcttgaaatattttatctagctctttctttgattgttaatagagatagcatcggagtttcagccgatcttacctgatttagtcatcttgtttccttatttggttctagatcatctaaatctgccccttatatcaagatctcatacgtttaaagtatattaagcttcctatcaatctgctagttcactctgcttgttagattggtttcagttttgtatatttcatctgtgctgatatcttggtataaggtggtatcggaatactagccgatacaagttaggtttgcccaaacctatcggctatgctgtgaacgtacatatccttactttggggctcgtctagatattgagtgatttatactgtctcaatgcagcgaccaatcttatcccaatcacttagtctaaacgtgttccattggacagattatgtatcgttaacatctacagccgatcgagtagacccaacaatctccaagttttatctgcctttgccaatctgacgcaagttacatcggcatggcttcggacgatatgtcatcggcaatccagccgatcggcaatcgttgatggatttaactttggctttttttatatcttattggttgcaggatcaaaccagctggcatgctcagaacccgaagaaaatctctttgaacctgcactagagttaagtagatctctcgggccagtacgtgtttttcgtgtcaacaatcgcctgataccttataggtatcatctgatacctcgcaagtatcgtctgataccggctaggtattaggacatgatacctcatagttatcaggacctgatacctaaacagtatcatcccgtcccaacaggattccgttgtatagcagcccttctttttttcatgaaggttgttgtcacaccccgaaccggcaccgccgtacaacttatgacagagacaagagataacagaaacttgacataatagtatgatagaattggacctacatatatagaagtatagaacgatctggattttggagtgaccccctcttgtgagggataatcgatctatagccgtcagtcagcaaaggtcgtggcccacggggcggcagctgatgctcttggttgctgaagtcggacatcttggggacggacaagccataatctctgagatggcagatgaccatgaatagccagggtccggacgcaaccatgccagagctgacgtaggtctggcgccacgactcggacatgtggtggtcgagggtcccgacgagcaatagggccacccaaaatgcgaggacgagaacgatgacgatggctgacagcttgaattcccagagcgtctgcttgtacctggcgacttggcgacgctcctccgccgccgccgtatcctcattccccgtgtcctccgaaaccgctctgtttgggccgccgccgccgcttccaaggcagagtgccatatggtcgcccggcgtcttctcggccgccatctcaactcgctgtacttccggacccgccgcttctcaggccttccaaaatcgacgacaacgagaatgccgcgccggggactcgattcgatacacctcgacgacgaatgcgcggcgtagggcgcgaatcgacgaggacgaagaaaaggaccagcgtgtagatggatcggtctgggaccgagtcggttttggagttctggacgacgtatggttgggctcggcccacattgcagaggcccattgatacgtgagactgtgacgatcagcagcgcttttttttttcatgaaggttggttacttgtgaatttgtgtttgacagtataaatccgacacgggtattcttcagttttctgatggttttgaaatttttgaattgtcggcctttctattagagatgggattgtctagtagtgtttgaaaataccaccatgatataatgaggtgatacccacgtttgctttgaaatacatgttaaatctctactattataaaaattgaagatgtttttaccgtattttggtatgtcatccatatttgagtcgggttttaagttcgtttgttttgaaatacagatccatgtctgagttagattttaagcttgttcctgtcggaagtataaacggagtcatataagaaatcttttaaaaaaaactcgtatgctaacttgagatgaaatacgtactcctaataaatatcctaactaaaccataaaacaataataaaattaaaatagcatttatctgttacaatgcacgggtattttttagtattataatataaaagataataatattatattctaaatgatgtcatgtttgaatgaaatttaagatactcttgagtagttattggtacaattcaattttttttgagcgattcgatccgccatgctcgtagtttttgacgaatctaaattgtttggttagactccagctataggaaaggtggattcgagagatggagttctgctaaacagggccttacatgatctttattttctaataattgctagtagatgttaattatatgtaaggtaggagtatatatttattgccatgaacaccaatataaccattggggacgctatatagctaggaagtgactatgattataccggtcatcgataactgagtggtagtaattatggatatccataaaatgtgctgggaaacaatactcgttgatatatttttcactctgctaccaataaccatggttcattttaaaacatagattatgaaaacacgggaataaagaaaacacataaatgaagttatagccccataggtctataggaatatttaatttattatgtttttatttcagtcctattcttttgttgtaacttgtaaagtctactagaatttatttttaaataaataatgaaattccttgatgcaaagaatccgtaagcgaagccacctgatccaaagcggacgctgctatatagcaaaaaccggctcattctctcgagtccgagcagcaaaccaaaaaccaaggctctctcccactcgaccgaaccccctctctctgcttcctctgctcctcggagagccgcagccaaggacgccaagatagggaccgaaacccccgccgccgatggcgacgccgcccgcaagcgggccagcgccggcgaggcgcccgccccagcccccctcgtcgacaagcgccaccgccccaaccccccgttctccggctcccgcgaccgcgaccgccaccaccgccacggccacagccacagccacggccacgcccggccgtccaccgcgggcggcggggagaagaagctgcgggcctcgcacatcctgatcaagcacgagggctcccgccgcaaggcctcgtggcgcgaccccgagggcgtcgccatctccgccaccacccgcgacgacgccgccgacctcgcgcgggccctccgcgagaagatcgtcgccggggagcgcaagttcgaggacgtcgccaccgaggagtccgactgcaactccgccaagcgtgggggtgacctaggtcagtacgccacacgccgctacccatccacccccatgtcaatctgttggtgtgtttctatacagaactatgagatttgctttctgatgagcgtctgattagatgtgcggatggaacttgttatttcgaatcgatctgaattttagattagtactaatgttatacaggcacagaaatttgatttatcaagtacacttcgtgagatctatgtgaaggaggtggtgccgtgttagtttgtattaggacggtcaattttgatgaagctatccccgttttaattatgtgcagtaattgaattttacatgtgacaattgtgctataattcgtgaagacagtcatgttagctcttaatatgagacaattactatcagtgtaccatcgcttcagcgtgataaagtatgaacatcactgccagattctcagttttgattggtgacctagtccacttaataagagtcttaagaatcatgcgctgatgcagttttgtttgcgccacccttatctagtatccgttgtgttttccatatcgaactgtcctttttgatggaattggggctctagtaactgctattatggcggggatcattaatttcttttcttgttatgaacatgtcatgtccttatggtccgcctttgggtatgggccgagagggccaaggcccaacaggaacggtannnnnnnnnnnnnnnnnnnnnnagtctagggttagaagttcccctctatctatatataaagggttaggaagttcccctctatataaaggggatggttccccaggttagggtaggaattagattgaattatctcttcgtgcccaccgaccctgtctcctcggcgctgtatatcttattctttaggaaaaaggaaaaatgttactccgcaggcggaaaccatggtcatggtgaccaacttggaatgtgtgacagcagtcaattccttcatttttcttctttctatgaataccttgtaaaataatcacctgtattttactctgccatttgttgataagatggacagttttgcggaacatggcataatttgctatatgtagttatgtacatgaggcaaacacattcggggcatgagacacagcacaatacactattacagatatagcggtgtgctattgctttttttttttctcaaaaggattttctcagcatgtgatggctggctatattgatcttttgtggatatttgcattcagaccatttccatccctgggactattaagcactattatgagcatgcacatgagggactaagatcacaaaaacaacgcacgatacactagtaatgaattttcttgcaggtctattgttccctgtgcgggaaattattacctgcccaaatcggaataaccacttgtgacatcacaattaagttggaatatcttgggctgggtggtctcccctattatgtcgctgccataatgaaatgatgcttttggagacggttattctggcagatgcgttagcatttggcacagtatctgacagggaacatatgagttgtaattgaggtctcatggtttgctagtgtgattactatgaagtagtgagaaggagacggcaataggtgtaagctgacagaaaattttgatattgtccctttttttcagatgtctcctatttatctgttctttctattccacatatatgattaatatgtttgcaaattatttggtactgtttatcttggtgttagtaattttttggtgcgaaaaaggagaagaaattgcaggggagcaaagtgccacatgctattgtggcaactaacttggttcttctcacaaggaattcatgtccatgattctatttctactgatgattcttgatttcacacttctcttactagccgagacctcataattaagagtgatcttactttcgcagtttatggctgcaggtccatttgaaagaggcaagatgcagaaggcttttgagaaggcagttcttgctctgaaagttggggagataagtgatgtggttgatacagacagtggggtgcatatcatactgaggactgcctgattacggcggcagtacgggccttctcaatctctcattctctatacactccgtcgctgtctgcaactctgcatatcatattgaggctgtttgggggcagaagtatgggccttgtcaatctgtatacactggggaaattggatgttggttattgcttcgttacaaacctgtgcatgtactctcgatctgcgaaaagtttatgttttactcttacattttgctggagacatttgctctggaatgatgctcaagacaacctatgaatattgattgttacaacatgtttggaattagctgaactgagcaggaagttatcgatgcattcctgcttacattcttgtttttgggtcgaaatgcgagctcagtcagatgatgaattttaaaaaatttctacacaaatccagctgtttggtagagtttgccactttcgaatgaaattcgaacgaaatcgtgaatctgacaggcgtacgagtgctccagcgtacaggaggcagctgccgattggatcccgcaaacctcgcgccttttccgcgattcagccacgtacacgcaccgtccccttcctgggctcctcttcgtcttgctgctgcagctttccttcttctccaccccctcggatctccaggagtcgatcgattctcttctccttctcccccaactctccaccttccacacccttcggcgacacgccgacgcagacagccaccgcacgcggcggcgacgacagcaacaccggccaccatgggcgcgtccacctccaccagcaacccgtcactggaggcgcaggagcaggagaccctcgcgtcggcctccctcgccctcccgcttctccgcgccgccttctcccgctcgaacggttcgctggcggaggcgctgtccccgccgcccgccgccttccgatccgactcgccgccggtgcccccgcgcttccacgacctcgtcgcccgcctcggccccgccatcgcctctctcttcttctccgacgtcggccccgcgggggacgcggccggctggctcgggttcctcaggggattcaaccgctgctgcgcgcgcgttccggcgtcgcagtcgctggcgctgctcctccgcgtgtacgccgcggcctgcgccgacgcgggtgctccctgcggccttcagttccacccggacgaggacggcgccggtggcgaggggaaggtcgtgggggagctggcgccgggggagatcgccgtgttgctctggatgtgctgggtcatggcgtggagcggttcggctccggggtttcgggtggtcaggagggaggcggcaagggggaacccgtgttgctcccggacgtgacgcacctggtgctgtcggcgctcgtgtcggcgggcgccgtcgcggatgacgctggtgtttggggatgggaggtttcccgtggtgggaagggggtgaaggtccaggagttcacgtcttgggtgctgtccacggctgctgggcttggcaactgcctctcgcggtatgtgcaggaaaggttccggtcgtgcgcagctgatccagtagaggtaagcaagctgcattgcagagtcagtaatttactgtgaaaggttagctgcattgcctttgttttgcatagaacatggattttgagaaccagacatattgcatacttcagataagtgcaaaatggtgggggatcttcaattgatgtgattttgccatgttttcattagttatgctgtactccctctatttactttttcaatttaacgtcctcattaaaaaatgatggaagggatattaatcttaggtgttctttagtagattcatatttgatgacacattgtcagttgtgggagaactaaattatgtagtcagattctgtttattcccagtatgcaaattataagaaaaattctgggatgcttagattcaaaatgagtaaatgactggtaagaagacaaggatgcttagagtcaaaatgaataaatgactgctaagaaaacatgccatttcttctttatatctgatagttcagggtgactaaagaatcctactgaggatgtccaggcataatggtgtttggttagtaaattgctctggtgtttctgatgtggctgggtctttactgtaacaaaaagataaataagtcacaaaaacttttggtttgcacttggttttagtagtttggagctcctttctgtgatgatcattgttttgctacaatgatgaagctttatttattttacccattttattggaggaaccaattagatggcatattaatgatcattaagcttcaaccaaatgtttgatcttagacgttgattcttacacgcaggaacgttctgtttcaactggtaacacgtcatcttgtaaccctgacgtatatttgttaacacgtgggagggcatgggcaatctctctcagcctcagaaacacattgagtgaaaagtttttatcagcatctgtcattggaatggatacagaagaccttctttataggttactccttgttctaaacatctggtgacattttactcgttcttatgtttttttaatgtttctattgaaggccgtaaacttctaaactgtaatcaataccagatcaattcctattatggtttttcattacattttggtaacttttagcctttactgaatacatctctgcaggtcgtcagttcatggaaaagggctgagccggttttggtcttgtgttgagggatataaaggaccagtgctaattttactctcagctttctctcgtagtggtggtgacaatgttgatactgatcaaagatggggcattggtatattaaccgaggagggtttacagaacaaagacaccttctatggtagctctgcttccctgtgctccacatatccaatattccgcatgctcccaccatctggtatgacttgtgctggtcatttcctttttaccacagctgatagtagcttacggccttactgtgcctctgacctagcaggtaaggagaagaatttcatatattgccacctacatcctcagataagggtgtacgaggcaaagccaaagcctgttggtttaggatttggtggaacgattggaaatgagagaatctttttagatgaggacttctctaaacttacagttcgccatcatgctgttgataagacttaccaacatggctccctcattcccaaccaggtgaatttttgcatgtactagtcattacaaattataacctgattgtgctgtgaagttttttaggtaggaaatctgaatctgttttgttcctgaaatacagtttgtcaattagttggtagcagaagcagaatgggttttcaaaatgtcgttgtagtgccaagggaagtaataagattgaggcaatggatgatttttcagttgagtagtactgacactaagctaaaaagaattcacaaattagaaactgcatcctgtttataatttacataaattacgaacaacactggtagccatgtaaactgccttttaggtttcattttaatagggcacaagaacactttgccactttccttcccttgtaaggtctggaatgaattgtagtagcagtatgtgttgtgaaacaaagaattcatgaactgatatcatctgacctcgcttcagacaaatcctggccttcgattaaatgctagcaaaacatattactctacactctgtttcttttcatgtagggttatttacctgttgaggcttcagtacttgatgttgaagtatggggccttggtggagaagcaacgagacggcaacaggatatgtacaagaagagggaggatattttctcagagcagcgaagaaaagtactaatcaaagcacctaaatcttttaactactaactatgctagtactgttaaacgtgtgacagaaattttaatgactgtcccctatttttgttttcaggttgatctcaaaacatttggcaattgggaggactctccagagaaaatgatgatggacatgatttctgatccaaatgcagttcgacgggaggaccgttgaatacaattttggactatatgtttattatagctcattatctaaaaaatgtttattatagctgccttagtgccagtacatatctggacatgggaaatggacgatcttgaggtttcatctttcttgtaccttggagatatatagaggagtaggtgcacatatttgctccatttgatgtttgggccatttgactgggcaacacgtcatgtaagtattgaattgaaaagagtcttgtatacagaatatcggtctacaacggcatagagcttcctttctcatgctccccttgttttatgggaatcgatagcaaacaaatttgtatctgtattgtaaattgtagattattcccgtgtccagactatcacacagacatggtaatttccgattatctcacatcggtttgcaaacggcctggtttctcgttaatgtctgacggttcccttggccgattcatcccggctcctgcagtatcataggctcacgttatcagtatctgttaaaccaaactacattttctcgagttctgtacatatgctgaaaggtgctccctccgtggcttcatccaatttttttttatttctagctacaaaactggacaaacattgagttcatagttagaattgaatttttggaccaagaatgtagctggtaataatataaaaaagctgagtttgccggcttataacttctaatttattttctaaattttgtaggtgcttgttgtcaaaaactaggtaaaaatttaaatcgtttatgactcaaacagtgcataggtttggcccgtgtctgttccaagagagaacaaggatacctttgcagccatgattgggtagaaagaacacacacacagttacacatagtacgatggacgtgacgagacagtacgagataaacacacacagagcgggagctagcggtagaccatatgcctgctactagtagcaaaagtacgtgcaggctgctgctgctgcccttccccgggttgtgctgttcatttcacaaactctggtgcaaccactggcctgatcgatgatcgatcgatcggatagtacaaaaaatgtactaggcatgcatgttcagtttcaccgaccaattgcccatcaactaccgcggcggcaacaaattctctgcccgaccatgatttgcccggagactcaccaccccacgccatgttggtggctgctactccctcctgtggtcctgcctgtcggctccttaatctcgagagcacacattccattttccaccttgggcagacatgtcccttcaacttcaacttgtccgtgctcgcttccactgtagtgcattcattttgcacaccaaaagttcctagtgagcaaccaattcagatcctatatggtggagtattacaatttacacatgtagcatttctcaccgacatgtgagcccgaggatctatgcacccacgtgttagtgagcagtactacagcagaggaccctcacttagaagaaccacattttttctagtgtacctagatatgtttttcaaatattatctttatcctaaaataattattgtttaaaaataattatcattttatactaatttggtataaagattaaggttttaaaaatataaccataggatatactatattgaataatgtactccatcactatttactcctactaaacaacatattaatctttatattttgcaatagtgggagtatttttatcatgatcatggatcgtacagtttggatccaaaaactttttttttaagtacgtgtctctcgcctcgccttctctcttatatcctcggtaaaaaaatattaaattctatctataaatctggataatcatttatctaaatttattgctagaatctttttttaacgaaaagagtatccaactagacattaatatgagatgtggagatcactatctcctattgacaggtttattgtatctgcccctcgtttctccaccactccgacgttgccctaccctggctagctctgatcaccatgccgccattccattcatgctactcgtactcccagctgctgccgatggcaaccaagggtggcgccttctccgacctccatgctactgtagctagcaattggcaatgtagcatgctgcaagcttctgctggctgctgctgcgtgtgtgagataagtactagcttctgctgcctgtgtgagataagtactagctagcagtagtgatctctatagagagagcagctgaatctttttcagattacactgaaaggtagacgtacgagctgtggtatagagagcagctgaatctttttcagattacactgaaaggtagacgtacgagctgtgaatagacgtacaatgtacagtactctcctactactactactacgatggctaccaccagcttatcctactacttctacactgtaaaagcagaaaagaaatgatacgacacgaagtaaataaagatggatctatgggtcgatggacaggcggcggcagcagcgcaacgcagtggactgaaaaccggctgctagtagcccccttccaacgctacagtagcttttcttcagtgatagctagcctcgggaacgtatgcttgcatgaatacgatcgccatacgccttggacaagagcatgcatgattggctcactgaatataaacacaaactccgatcgatcctgtacaaactcgcgacactgttttgtttacggttgattcgataggtgcttttctctgcctgtcttctggtcgagttattccactcccctttctgcaatcctcacaaagtttgatttgttttccccagctgatctcttccttttcttttttaatatactacctccatcctgaaataaattaatttttcacccatacatatcaatatacgaaggaaaaaactgaaatatccttcactttatcaaatatttgctactaagtttttaggaacaaataaattgaagaaagaagtaattttggtatgaagaaaatagttactactcagtaatgtacaccaaatacggttggaatttcatatagacaagccaatgcagcaagtagccatgaatgtgtgtttggatacatgcaatatgacggtattgtattttgttttcgttgcatatttcatttatttcttcgagtaaattggaaccatgccattataattttcccttcttcattaggagtatagctgatagcaagagtagcaagcagaagattcttgtagccatgtgtttatgcagccgaacggctacgctgtacagcacagcttaaaacgctgtaacaaaggtctaccgaacaggtcccatgattacatgagtatattagtttctttgattaaattaagtggagttattttgagacggagttagcataacatttctttgaacacacccgaaacttgttaccctctactccctgtgtatcagtttggatagttcctatgagtataaccacgggatccccgtgaaacttcagttaaccgtagcttcagccctggtactgatagcaggagcagctagccggagtagctagagctttcatactgcctttcttcagtcaccgtttgcctgtcttccagtttccatgtggtgccacagagatgttgtccactcctctccctatcatgcaaaacaagaagcacttgatggctgaactgaagttatacacaagctctcttgcagttgcagctcacaacacattcaattcgcacacctctctcaatctctctctctctctctctcatgtagagagagagagaaggctgcaggagggcatgcagaacagagcaggcccttaataggaagaacctaagttccttagggacagataggtacaggggaggaaagggggaagagagagacaagtttctatagggcaatcatgctcctctttctgatcactgcaagaagagaagaggagaggagatcaccgagaagatatcacaaggtgtccatccgggcacagccatggatgcatgtgttgttctgtgtccttctgttggaaagcaagaaccagcgtgccctttgtctctctagctgcttgctgcttgaattgccatggacacaaaattgcaccattgatatggagtgaaaagggctatgagatgagatgggatcagggagtaggttcttctcttgactgactcggcgtttcccattctgtagagattcgtcatactcctccatggtgaaccaaccggttgatcgatctctcatctctcctcatgtgatctgctgcactgcacaacaggggccggggttcagttcaagtcaagagttatggcgaggtagctggctggaattgctgctagctagtatactagggttcatgcatgcattcttgtgaactgtggcggtcactatgtgaactgtagcggtcactgtgccggggcggcgcgtgccgtggacatgcttgtatgaggctgtgttgagatacagacattggatccaaacttcggttcttttccatcacatcaacctttcatacatacataacttttcagtcacatcatttctaattttaaccaaaatctaaactttgcgctgaactaaacacagcctgagtataggcacgaataaattgtaggaggttccaataatcaaataaaaccgtgaatgcaaattaaaagaatggatacattttcccctttatgctcccgtcaattgatcacttgccacacgttcacagagtgagtataatatgtaaactgttaccccactcaattgaattgatattgaattagaagagagagaagagatcacaaagccggatgcagcacaaggtacaacagacgttacaagataaagagatatgccgtactaaaggttgttgtggaatgagcggaaccctagggttttctattcctcgctctcgccggtgttagtggttctcaaatccatcctgcaggaaggccggctctggtcatcggcgggtaccgctttgtttgggggcctactaggagcttagtggggttccctccaccacaatctccctctatatgggagcagcttctctcttgtagtttaatctcagtagtcttttagtttttcacttatttttcatgtcccccggcgatgacctttttggttgttgcgttgtgtacttgaaactctgcttttttctaatatattgatgtgcaatctatttgtaataggatgtgtcacatccacctaaaatcccttatattatgggacggagggagtatttagcatggttgcattcccaacacacactttcataagagagtttttttagttaaaatatttgtaatattcaatatggaagcttgagttcacaattgaaaagtttcatgtgatctaaggcattgtttagttcccttcaaacttctaaaaattacgtcacatcaaatatttggacacatgcatagagtattaaatgtggacgaaaaaaaatcaattacacagtttgcatgtaaattgcgagatgaatcttttgagcataattacgccatgatttgacaatgtgatgctacagtaaacattgctaatgacaaattaattaggcttaataaattcgtcttgcagtttataggcggagtatgtaatttgttttgttattagtctatgtttaatacttcaaaatatgtgtccgtatacttaaaaaaaaatttggcacacgaactaacacagcctaacttgaaagctttggttgaaacttgaaagtgctaaagtgtgtgctggcaattcgtctgcacgtactaaattgcaattctcttgttatagctaggagtatggttataccagcaaacataatttagccttttgatgaggagcacctatatatagtaccacattccgagtacctttaggataatctatattgaaaatatcctaatactagtattatcagtactagtaaaaaatcttaattgttgatttatgagttttacaaataaaagataaaatattttacagcaattaagtggtaatagtataaatagatactacaatccataatacgatcaattaaaattaattatactactaatcataaagatcattgtaaaacatctccagttcggctgtatttaaatccaaagtttggatcaaacttcagtctttttccatcacatcaatctgtcatacacacaacttacatcatctctaattttaactaaaatccaaactttgcgctgaactaaacacagccttcatatacatcgaccacactgaagttcatcaaaaccgtacgttcgtcaaatttaagaaacataaaacagaggatatatgcaccactgcatgtaaggcaattgcacagaaaaccttgtgctagctggatcgtatgctacagtagactgcgtaggatgcattggtactgaaaaaaagttttgttcagaatgcatgcaaccgcgcgcctaccagcagtctattgtgtccatgaaccaatcatgacagaatatcctcgcgttcccgagggagaaaaatcgaactgaatgaagctagagtttacacgaaattcgaataaaataatccaaatgaactaggagtatatgtgcattcatatgtgtatttggtttccttctaatatactccatccgttttataatagtcataataaaaaaaaattagatgtatatgacacatccatccaaaatctcttatattatgagatagagggagtaacaccacgtaaatccatcttatgtcgttacaaacacccttttattcttataagtagttaaaataaaacccgtattttaaaagttttagagggtgtctcgtaaagacctgtttttgcgtgtggttgtgatgtcgcgcgcgcctaaaaattgtttcaactgtttacagatatttggggatagacggttgctacatccatatatgaaaaatacattttagctgtttgcaaagactttctgtagtaatgtgagagttcaaaaaagaatatgggtatttggtacatggagtatagaagtcagctaaacctctatctttctttcccctgcgtaccaggctaccagtagcttacatttcttctttgtaatttctctcatcaaaatgcaaggttgaaaaggctatatacctactagctaatagtatctctcaagatcaaaacattgtcgaatcacggatcaaaataacgtcagatttcaccattcaaacgcagtactgaggctatgtttagatgctaccctaaaatttttcatcatattatatcaaacgtttgaacacctgtatgaagtattaaatacatgctaaaaaataactaattgcacatattgcgactaatttgcgagacgaatcttttaagcttaatgacggattaattaggcttaataaattcatctcacggtttactgatggattccgtaattttttttgttattagactatgtttaatactttaaatgtgtattcgtatatccgattttcgatgtgacacggtaacaaattttacccttggatctaaacacagctataaagcaccggacgaactggattattttccctgtcaatctgatcgacacacacctctcataacgtaacattattcacagagaactgaaaacacaggcaagtttgaagaagcaacatggtaccaactctcacatcacaaccacaaaccatgccaccaccatggttgcctccaaatacagctcaatgaaagcatcaacatgcatgctctctctctctctctctctgtgtatgatgagagagaaggcttgcagcttagctaaggatcggagaggagaggagaggaggaagaagcgattgccataaggaggcgcctgcatggtagtacgcccccttgcgtagtccccacatgcctctcttccttctcctacctcgtgtgtcaacttcacttgtccatctccaaaagatatccatgattctccctcagagcgccccaacctatatcaccccccctaccttccatagctccccttccctagctaccttcactccatccttctctcctccttataaaccctcatgtccctcctccacccagtccaaggccacaagccctttcttcctcttcatcttgatcttgatcctcttcttgatcttctacttcttcttcttggtttcacttggcatccgtttccatggatcacatgcagcagcagcagcggcagcaggtgggtggagggggaggagaggaggtggcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggtacgttgctgcgtcatggctaattccgatcgctgcttccctgcgaagctgtaatgcgcgagccggcgccgagccgccgatcgatgcttctgcgtgtgcaggcgcgacggctccctctttcccgggcttctacgtcggcaatggcggcgccgtgcagacggatcaggccaacgtcgtcaactgggactgcaccgccatggcagccgagaaaaccttcctgcaggtatgatcacacgtactactacctcctccaggtgtgtgtgaattcaccatgcaagagcaagctaatgtgcaatgctgcaggactacatgggcgtgagcggcggcggcggcgccgccgcggcggccccgacgccgtgggcgatgacgacgacgactcgcgagcccgagacgcttccactcttcccagtcggcggcggcggcggcgacggcgcgcatcgtcacgccggccacggcggtttcccgtccaacttccagcgctggggttctgctgctgctaccaccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatgtgatagagctgttttgccttcatgccatgatgccaactgcttgatgagaagaacagtgtgagtgtttctgattgagagagcaatggtgtccatgtcctagctactagagagcttagctagaaggaagcatatatagaagcatgtctgaaagatactatatttatatagctagggagtatgcagcattataacatgcatgctgcctgtagaatgcagtggtcctcaactggtagtgcactgcatgctaagttgctactactaactacactagtggctggctggttgtgatgtgtttgggcacagttgtgtcaaacttgtctctccctttgatggcttccagctgaaggaaaaaagttatctatatctctctgtctgtctgctgtttactactgcctggttgctcatgctcatcacctgttgagatttttctcattccttttttcagcaggagtataattttcgctttttgtactgccagtttcttgtttcagaattccatgtatagtagcaagcctgggaccactttggttgaacttgaattgttggctagtgttaggaaatggtcagcctttccagtgtgatcatcacatttacttctgcagtgttggaaatgctctcgcctgctcacgtacacacattctcgctttatgcctttttcatatctgatgatcagacaaagcatatcgtcgcaatagctgttagcacagtgaagaaatgcaagtttttcttcgatagagatattaagagaaaacttatatatatattttttgttcgatagagatattgtactatatactatgaccctatgagctgcgattataaaaaatgaaaatgatcctgaacatttcagagctttctgaaacaaacaaacaaaaagtatagtaggagttcactcatagattaattacttacaaagcctaagaagcattcacaacctaattacttgaactgagagcatcatttttaagatcaaacatagctgaggaattggttccataatattaccccctcaaaagatagtacaagtgaaagatgtattaccacgcctaagtcctaactactgaaaacttacatgactgaaagtagctacaatataagaacatatgaaacgcttgcacgatctgctcttggttctaaaaaaaaaagatattacagctcttttccagctgagattatcgaagaatttcagaacaatggtttcatgctacatgcttccctcatgtcaatagaactgaaggttggccacctctttgtctctgatgtgaccatgctgctccccaacaccagctcaaataaacaagatgggatcacattttcctatgaagaccatggaaaaagcggtgttttcttcttcttgagtgctttcgatataccctggacataacgtgcggcgagaaataaacctagattgacagaacatagagatgaagtcaaacagatgtgtgcagtatcctcaactgtgcacactttgtaagtaatataataagtattactagtaagtaatatcctcaaacagatgtgtgccatgtaggttaaactgtgtcatatcatcaaataagacaggcgctcaaattttgtactagaatgcaaaaagaaaagagaaacagaaaataaaggatataactcccaacaagcatatgtgattaaaaacatttaacagaaaattgacgaacattatggttaattaaagcggatatactctggtattcttcaataaaagaactaccttggagttattacaaatgccattagacgaaagcacggaattgtcatctatcaacttctcattttgatgtgtcagacagtagttatcccaaatatgcttcctggaacaaagagaactaatattacagagggcatacataacaataaaaatgcataaatcagatttcagatgttcacaatatccttaacggtgggagatatcgacaaacaacatgtccgtgcatttcagttactatgtgtagggaacagatggaaacatggagtttgcggaacggattcagatgaattatgaaacaaagagatcgatgaacatctagctcacatataacgtattctgtgggctgtggctcaaacctgaagcaaacaaagagtcagcctattcaggataacgtataactcttatatcagctattctgtgggctgtggctcaaacctgaagctaagtttctggctaaggctgtgttagcatcagggagacagaatctcaaactagttctatggctacaatttcaacacaacatgttatttcgttgcttcctttaaaataaaacgcattattttgttgtcactagtcatctggtaatgcaaatgctctggttgtacagaagtaacaaaagttactccttccataatttatagtttagcttaacaaacagccatacttgattccagggattgaacttacccccagcatgtcaggcaccatatatgcaaatttagtggtagtagtgttgggatctctttccagtgatcactacttgctaggtaaaagaaatgcacaagcataatcagcagagaagtgtgatccttgacagggtaggacaacaggactgaagcttcctaaaattaaggaaatatgattatacctgtgaagggatctgatagttcttgaaaaaaagccataaagaaaaatagaaacctagaaggatcagcacgatcatgattataatttacttagtttcaactgacaagtaataagatatggaggacctgtctataacctcaactaaatgggcttcactcattatgcatacagattcaggcctacaaaagttgagctcaccaatttgctgtaagatcaactcaaaatcaaaacaaatttcagcttgggttcatatggggtttgagctaagctgcaaccctacaaggctgcaactcaaatcaatctcatatatcctgtgactctcactctttcagcatatataccccatgacatccttatgcacaatacctctggattgatcaatacgttgctctagtctcccttgtaggagatgctagacagcgaaattacattgcaaatgtttcaaagatcatttagtgatcaggacaaataaggttaccatgagtgaaagtaaatggtattcatcgcaggatatcatccaccgtagaaaggagaaacaatttgcaatcatcacattgtttaaagagatgtgggctttaccatgagatatgacgatggcccatcttttcctgttcaatctcatccgtcttcttcctgatagccatcttcaaatccttgacagtggctgtgttcaacattgcaacatctttcacacacacaaagaagacattaaaacgtcatacgatttatgcaatctactagtagatgcaaattaaccaaacaggcagtgaaatgtggcattcgaagggaccagtaccgaaggaggtgccatccagcttgacgacggttagccgcatggcgctgccgagctcgaggttgatcagcgtgtcgacgtcggcgagggagggcttcctgggcacgtcggcgagtatggggtcgtcgaggagggcggcgagcatggactgtagcttcgcctgcttggcctcgctgctctggtaagccgcaacctcctccggcttcgtagagaccgaatccgtcgcctcctcctccgccgcagagaacgatttcccggggtccattgcgtttccgccgccgccgccgccgccgtggaggacgaactctcgccggccagtgctagttgggccacgagcgtgtggcccattgtaattaattgggccgtagcgttattcctgcggctgcgcgttccagccgttggattggattcttgagcaatctggacggagatcctctcgtttgatctgtctctcttccgctccaaatcccccaaacccttcgtctccgccgccgccggaatcgggcctcgccatcggagtggcggcgaggagttgaaggccaccgaccgccggcttcgaccacgccgcctcgtcctcgtcggatccgcgaccagaacgccgccacctcgtcgtcggttccttcgcgcagatcgccgccgcgtctcatactcttcggtatagcaagcaagctctcaacgcctctttttttgggttccctaatctcaatctgctgcttggattgctgaattagtgaataatgctgggcttcgatggtggattttctgtcggttgtcggctacggggctgatccagccccgttgccatccccggggagggacgcgccgagtagagcagcttgcgaagtggttgcggccttgcggggagggacaccgagcagagcgttcttgcttgctggttgggctgccaatctctggctatccgtgatctttgatccatgagattctgttgctattccttcacatggaggtttgtgttgtactttgggcgaattcggatggatgttggattaggcagggttttagagagcttgggttaagaatcctgcttactgatgcacaatagaattaaggtggggattagaatttgctaagctgaaggtttgagatcagggggccagcactgctccttggttagcttgttaatttgatgatgaactactagtgatcctgtagcatgcatctctgttttgctctgtatactcttgttagtgtgattgcaaggtggttttcttttgctactgggcagtgtactgttgattcaaaccaactcatgttcaggccacctttagctgctaccccgttgtttaagtcatcccctcctcatgtccaggttgctcccagtccgcagccacctcttcctcctcactgcattgtgttccctaggtgaccttaggccttccttgctgctacctccacctgtctctgatcccgagtcctgaccacccccttcctccttgcattgccatgacactcttttgagatcattggctgcatgtacatttctgtctttggctttggtgcagcttatcagtaaattcgcatgccaaacttggtggttgcatattgcagcactagagtcgatggaatgacctggtgacagtatggttaactatattttaaggtctaacaaaacggagtggtcctatatctagcagtttctttcagttagtaacccatttgttcaaccatgagtatttattgttttagaaattgttctgttgatgtgcctgttaagttcttcactggaaagtctgtaatcagcattgcttctcttacacatactatgcccaaagatcatagagttgttcgaccaacagctgaatagtatacaaatggatttttttttctgcttgttttttctgttagtgatggaccagcattgcttgtttctgatatatatttgcattctgctatggttccacaggttagcattcgacagccatggcaaagcatcatcctgatctcatcatgtgcaggaagcagcctggcattgctattggtcgtttgtgcgagaaatgtgatggcaagtgtgtcatctgtgactcgtatgtgcgcccatgtacgcttgtccgagtctgtgatgagtgcaactatggttccttccaggggaggtgtgtcatctgtgggggggtcggcatctcagatgcctactactgcaaggagtgcactcagcaggaaaaggaccgagatggatgtcccaagattgtcaatcttggaagcgccaagaccgatctcttctatgaacgaaagaagtatggttttaagaagagatgatcaggaagttggatttgtctggtccatttcctcgctgtgttttcagtcgcactgatatggttgttaaggacttaaggcggacatctttgtattctatggaatatggtctagattcttaaggctgcatgtgcagtacgtacctgatgttaatgaccatgattgttgacatgagatgtgaaccgagatacttttaagtcttataattatgtaagccactgattgtagggaataagtgaatgctttagctgttcgaacgacctgatatggttatcaactgggaagcaatgatacttatctaggagctgagatgcagctgaggttaggatacaggttgttgaagtcaggataaatgttgttgaagtcaggatacaggttgctaggaataccaacctaactcaaaatatatccttcagtcattatcctcgttggatggatgacagagttcttatctgaaacgtctcctgaaacactgatctaatccattttaaaacaacacgacgagacggtcaccagagtccatgattgagttcaagaacgaaaccgtcaggcacatgacctgcctccgtcacggacaagggtaacatggtaaacacgcaaagcgttgcctagaagatccggagaagtttttttttaaaagaataaaccgctaaactaagcagcccaaaatagcgcggaaagagagcagaaattacaaaaaaaaaaaagagagagagaaaagaaaagcaaatcgacgcgaagaaataagggcaaagccgccgacgcgagagccagcccatccgcctcaccacctcccgtccctcttccgctccaaatccaaccctcccctcggccgctccgcttgcgccgccgccgccgccaccggagcgacggcgagggagggagtggggagaagcaggaggaaaccccaaaccgtcccgatctcggggtcgggaacccgccgccggcttttccgctcgttcgtccgtccgtcgatcgcccgccccaccctatctagggtttcccgcgctgtagatcggatcggttcggattggttgcttgggtttggagagtaatgatggggtcgaggcgatccaggcgcgtttcatgggcctccggaggcaatctctgcaaggtactgtgataaaaacttgccaccgccacggcgaggagacggattcgcttatcctgtatctcccagttttgttgcggagatttgcatcgtctccgtgcagtgcattcgttggagattgttttgctctgctagctcgctttctacccttgatttgctttttgatttagtcgccttttgttcaaactccgcgaaaaatacgatcaaatacgatctctcaattttttttcagtggtaaatgtgtgaatgcttacaaaaaaaacgaacatgctattctcagtttgcaaatccatgagcagaagaatcgactgagatggatttcattctgccaatgatgcagaatttctatgctgaatttgcagcgaaaaaaagatgggggaacccccagcaaatatcagtaccgaaccacaattaatacgcagataatgaaacaaaaaggacgataacaacatgatacctggtgcatgtaaactatcattcttttggggaatatgtcccattggtgtatcattcttttggggacaaaatatgtcccatcggtgaagcaagatttagccatttgatcttcatctagaaaattatgtaccaaagaatcttttttttttcatattcttgagtggaaggactgcatgctttaagattctattcaaattgtatagccagataattttaaatggcatttgttcacaattttcgtcttaggttttttataatttttattccataggtctataccaacttctgttagtgttcacatgtaatgctgaattttatgccctagcaggcagcaagcactgccctaaatatgaatgaatttggggcttagattttcaatagacaccgaatgagtttggggcttagattttcaatagacaccgaatgagattggggcttagattttcaatagacacctgatgcaaagcaggtcatgtctctgacacatcagtatgcatgataggacgtgtatttgagaaatgtctcattatttaccctctataactcgaataccatgaattgtttagcttgcaaaaaatgctggattttttttacttttttttttacctttaattgactaggcattacatatatttcagaattgtcatatattgggatgaaacacaagcaatgttaatttgaagcatgtgactgttgtctaggttcaaattgttaacttttatatattaaaacctaatctaaaggatgttctaatgtgttaataggatacaaacaaaaataattcaaaagtatggctgtttatggtataatatattggattgtgcttcattttgggctcaagaattgaactgtagcactacactcaatagtaatgtaaacatttaatcaggattgtgcttcattttgggatcaagaattgaactgtagcactacacttaaaagtaatgtaaacatttaatcaggctatctcgcttcgtctcattttgaccatttcctgccattaatgactctaataaactttgatgattcaattcaaagtgtcctatagaacttaatgaccaatatatcatttttaacatattaagctatgtggagcttatatcacttgttaacacatgactttaaaggatgaaagtaagacatgaaacaaatattctatgagttatatgattcatctcaacctttttttgctttgaagtacaaagagtgatctctaattgattcagcaattcacaataatctctaatttattcagcaattcacaataagctcatgagatactaaagcatttatttcaccgaaaccaagtaatcagcatatgcagtaagcatccttcaaaggccacgtctatatatatgtaatcacacatgcatgttgcttccatgattgttatatcaccagtattttttttagtgatatcaataccatgctatgttgtgataagtccagagtccagagttggctccttgttccactcatccttatgctatgttgtgataagtccagagttgactccttgttccactcatatcctttttgtacgtatggacggataactgacaaccgtatgaaagtgcatccatatcaccaatacaacactccttttccccttgcacgtgcacctttctttcttcgtgctataatggtattcattgttgttttttaaatggatcaacaatgtgaacaaaatattcctactgccaatccagctaatgaacagctaaattggtattcatatcttaagtatcctgtttgtgagatgacatgttagttgcagatttacataggactgaatgaagtactttcctcgaatcttgattgctggtgcctggtagctgatatgttatggactgtgaaatctaagaagttaatatggatttgcatatacaacgtgtcaaatcatgtatatattatctgaaagttgattttagcacttcacattggccttgagtgtttaaattgtacagattgcgggaataaaatttggctgatggtttagtagtactttgaataaatgatcaatagtaagatggtattaattgtaagagatttttattggtgttctagaattttgaaggatggtcatagtcttctgttaagaaacatcttaaaactagtcagcaattgtgttttgtggattcatacaagctgcaatctgccggctgttagaatgtatgttaggaaaattaaaagaataaatagttgaactgctgaagtagccctgaaatggcattgaagaggaagggtttagttcttgtttcttttcatcttgtcttggataggcatataagatatataaaagtggcatgaaggtattaaacaatccttttattttactggataataaagaatggttttaactatcctggaggcaggtaggtgctaagcaagtgattgaacattggatggagttctttcaaaaaagaaaaaagaacattggatagaaactagctccttgctttgtttgaggttaatgtctgtcacaaactgttatcatgccttaacattgtgaaccctcctaaaaaaattattcttttttgagacttcattgaactatacattttggtagtcagcagaagattaaatttaatctgagctgaagtttttatcacccagcattatagcccttttgatgatacgatgaccaagttcttcaaatttgttatttggctcacagaatgcttcatgatagtgaatcatcttattgcccatgttcttcggacttgattgtctcgtttaatgtttcttgtgtcactaaagcattgtaataaattataaatactgaacaaccttgtatcatgtgtttgtgtcaggtaaggcttttcctgtcagaggattccccctctcaagctggattaagaccgcaggataatctccaagcaaaaggctcatggttactgcatgcagctggcccaagctcagatgattccttgcctccaggctttgagtcattgccgccaagcaatgacctcaaaattgacatgtctcaaatccccctaattaggtggaaatgccccccacatgtaaggctcacagttactgttgtgttggacaatagcaagacaagttcaaagattactgaaattcccaacactctcttgattgcagatagtattggagcaggattggcatattgttgctggagaagaaagtagggagattgaaattcaaaatgagagaataaatggagcgcttgaggcaatttacccacgtccatcgaacattccgccaaagtaagcaagctccttttttttcattacaagttcttcagatgtcacataccattttttataatgatttttttgtgtgccaatccagcccatttctttctcttgatgtgaaagatgcccattatgacgattccaaaaccctgttggttcctttgatccctcttgaagatgatgatgcatctgatcaattggaaggaccaacccttgatctaccaagccattacaacataacaggagtttcaaatactcctgtttccgctgagcaacaaccaccatgtggtggtgctataagttctggattcaccattgagcctcaggctgcagtctcagcaacagtcactgcaattatgcaaaccatacagagtaatcaaaatgggagcatggctgaccaaaacgggagcacgattgaccaggaactactcttcaaaatactaagtgatccttcacagcttcagaggttaatgaaagaatgtggcccagtcagacatgaacaatcagctagtagttctgttgttgccccattggtatcaatcccaccaccccaaataactgcaagctctcctgcccccttctctgatcatgtcggaacctttcatggcatgaatcctaccctgccgcctccaccaccaatgatgaatcggccaccttcaaccattccttcagttgctatgaatcatccaccaagttcaagcccagcaatgaactttggaagtgccctgccaagttcaagcccatcagtgaactttggaagtgttccagggaggggtgtcggctattataaaaccctcatccatcagcatggaggggagagactggaacaaccatttgagcagcatggaatgcagtttggtatgtaccgccaacctggtcctccacaaaatggcggtattgatgccatgaacggtgctgctgctatggtgagcagagatggcaaggtgaggccgatgaaaccgtgtgcatactttaacagcccgaagggttgtcgaaatggtgctagttgcacattcctacatgatgcgtcagccccaacaagaaaagatcatcagaagcaaaagggatcaaaaaggataaaattagacaacacaatgggcggtcgaaattgagctgaagccgccatttaatttttgactgttctttggttcatctatcatggatcagtaaatattactccgttagctcttccattagcctccttttttatgttcgtcgaggagaggagatgttctgaaagaaagcaaaatatttcatgattgattggtgctcaaatttttactgaatcaagttcgagctcgatatcttgttctgaattcactaattctgtctctagttgtgacagtcggtttgtcagtgaaacgtcgcactctgcaaatactagtgcacggatgaagcgtagtcttcttcgcattcattgtgccagtctattcttaggtgattcggtgatttttcgtgtattgctgcatgaattactaagtaatttttaatatatttttttacaaccaagatagaagtaaaaaagaaaaaataataaaatataaggtgtatcagtacttatcatgaaacaaacaaatgataacctaatatgaaacatattgataaatatatgttaaacattataaaaatgatagatagatttgttaaaatattatgcaaatgatgtgacgggtgatgattggatatgtttgtatgttaatttgttgaattaaataaattgtagatgatgttgtatgcttgcatgaggttaaatatgtaattattgttagtgggtgatgatgtagcatggttacatgttgagttttagacttagtgggttataattttatagatagtatagatacatactctttttccatatttcgctaacttgtagtaaatttatgataaaactatatcaacatctatataaaatgtgtgttgataatgtattttagttgtcgttataggtgttcataggtttttctataaatttagctaaaattagagagatttgacgtaggataaatcatatactcattccgtcccaaaacataagaaacttggactggaggagaggagatatttcctagttatacgaatcttgacatactgtagattcatactattatgaaatgtcttatccgatacttagttatattttgggacggatagagtatgacacaacattgcctgatcgaccaccattggcgcgccacctagtcaatcgtttgagctctctcatcgttgtcttcttaatttttcattggatcctcctcctttaataagaacgtgttttcgttggagggaattgttaattcgagggtaggggttcttaattacgttgtttggatggcgaagtttaagagtaaactctcactttttcaatacctaggtaggacatataactatgagggaatttcgtcgtaagtacgttaaagataaatctgagccggacatcatcataaaatttaattctcactcgaactttccgtgattctcatctctactaccaaataaaggatgatgagaaaaattgaaactttcatgaccaatctttccaccaactcttaacatgttgagcatactaaaaactcaagaattttggatagtttttttttttttgaaacagtagacggtaggagttctaccggataatttagaagagaattgaccctatttataaggaaaactagtcccaaaaaccatacaactgtacagtttgctaaagggaaaccgacaaaaccttacattgaaaacatgaaaaacctgtgacaaaactacaaaccacagtacacaccgagggaagagcaggaccttcaagacgaagcctccaaggaggtaaacaacgacagaatccgctgtcgacacccacccaactgagctgggttttcacccaaaaggagagagagtccacaaggcaacacctccaaggagaaaacggcgcccgcaggtgtcgatgtcgccgatcttaggagaccagactaggctttcgtctaagacttcctcaaaaggtgtagagcctctagaaaatcagagctggagtgttgaatgttatnnnnnnnnnnnnnnnnnnnnnaattcaatgcaacagctccgactccatcgaaacataaagactctagcatcgtagaggacaagaattttggatagtcaatggaggataacacggctttggagagaggggctaatacgcatgtgtccatgcacattaggcccgtgaacatgtcgtggcccaatccaagttcgaaagcccatgtgcattcagcctacaaccacacgagcattcgacttggttgaattttattttaaaatataaacttttagtatagaaattatatatataaaaactttatgtgtagaaacttcggtatagaaattttatacatagaacttagatgcaaaaactttgtacataaaagaatatttggtatagaagctttatacatgtatttatggatcaacccgagaaaggaaataggaatgaactaaaaccacacgctaaggaaggaaatgagcgcaagttgcgcaaccacctgacctaaggctatgatctataaatctttcccaacttctcaacggtgtaatttttaaaaagaatttaaaaaaatatttatagaaaagtttttaaaaaattatattaatttttaatttttaagctaagaatatttaattaattatgcgctaatccgtcacattgtttcgcatggggaggaatggatttgaacccgcgtttgcatgccgagcaccgtgtggtggtgttggcatttcgtgcattaggaattgggactgtctgtataactttgtgggccacatttggatcgttgatgtcagaaatttaaatggactttcctcgcaaaaaatgcttcagttcgtaactccatttgattttgttggccagacatgattgtgcgtctctttggactgggcctagcgggttcattggtttgtttttttttctttccctgcgcactgacacacgggagtagaagacaaaagatagagcaagtcaatttcttgtcgacagaacctcatacagcggtcaggcatttctcactccacaccaacatgaacatcaatattggcaaatataacagaccgctgttgcattacaagtcaagatatattacacacacaaatcattcattcattcattaccagtcaaataacaacaaaccaagaaccaacaaatgtacattataggaaagctgttgctgttcttctcccaagttccaaccataccgagtattccaacaaagaataaaaaaactgacgaattagatggtggtgtgcggtgggaaaacaagcacaaatctgagtcatctcatcaaatgcttctatggcacctcgctaaaaactcttgctaggcgcactcatcatatatgccatctcctatctgcaaaccagaagttcttgtttagatatatgtgcatcatggatggaaatacagtctatcgtattattctatactgttcaatagatggtaacacaaacatagcaacagcactggtagatgatcatactgagcaagcacaaaaccacactgaagagagtaaaaatataagtacatgataatattcagggattagtgcattaccatttatcagtaatatagccagtaataaactgaaaacaatgaacattacatataaaggacgaaaatgttctgaggcgacactaaaagcaccactgaagagatcacaggtcgctgggaatgttcagggaaggcggattaccggtaatgcccaaacactacatttctatgttcatcttaattttaatgttatgcagttccctgaaatagcttgtgtatgcaagtgggtgcttcacaaaagtggacctcacaaattagagtagagtttaatgacctaaactgcatatcgaggctacaagatatttgttgctacagtgatccagagaaaaacaggtaatcattacaaatcatcttcgtaaactaagctttcaagtgcaaactgatcatactaagatcataggatgatagtagcaactagcaaaggaatagacttgtgcgcacttagtcacttaccagatgaattgggaggaacaggaacagcaccattgcttttcacattctgctgagcttgggatgatgatcgttgcatgcgaggagatgaatcttgcttaccgttagtcatgggcaaagagtgccttttccttggattgttgtcttgcacatccgggcttaactttggtgatacactagcagatgcctttgcccttgcagattctgtaaactgcatataacttggcaatggagtgctgttgcttatgcgaggttcttgatcaacatgatcagatttaaccttgcctgagctctctcgcctcccaagtctgtaatcctttgacagattatccatgctgctccgtcccacagaatcgctgcttggactagttagtgatctcttgcttacatgagacttgggccttttgctcttgctttttttggtgttaacagagacctcacttgatggtgtcccatgagattcagcaaaggtagttcggctcaagggagtaccttcaggtgtcttcacataagatcctacagatttttccagttcatcatgtaaatcaggcttttcctgtcccagatgtggttgttcaacaggcacaggatcaattgcattggcagcgatagcagtgtcatcagtttgtacttccttttctggctcgatagctcctccagaagtgttcacttcagaatgcaaaacactgttatccttttcagcattatcaccaacatggttcctatcttccagggatccaatctccagtacaatctcgccaccatcagcttctgatctatccggtgagtcaagtgtagaggagattgatatctcagttccacattctgaagcagcaactacgattttaggatcatgccccactgagctctctggtatgcttgtgtcattactttgcttgggtgagacattgtcttgtgaacgaggagtatgtacctttggtttgtttgccccatccagactgttggacctactgaccgtcaaattggaagtcaactcttcaaattttaactgtgcagcagcaaatgcaggattgcatgactttctagccataaactttttaccttccatctccgaagtctgctcagttttatatgcatccatagtatcatcaaaggaagattcaggtttttcaggaagaggaatgggttcccttgatgtatcagtttgagtagattgttcaactgagacctccaaaggttgttccgcaacattctcagtctccggttcagtcaatttttcaacatcttccttgaacttttcaatcaaatctggttcaggaacatcttcaatttccattccagaagttctatctggaatgcatgcagaaacctccaggggatgagaatcagatggccttagtgtctcttccgcatcatcaggcaccaacttcaggaaagagatgtcagaatccaaaggaagggtattttcctcatgttgagcatctccttttattttctcatccaccgactcgttattctctctatcctctagcaagtgtcccccagtgtttggtggaatcatggatgtccatctctccatccatttccatgcaacatcaggttcagaaggatcacattttatgtgaatggattttgaagtcgacatgctgtccatgagctgacagaaggtaacaaacatgagaaaatccaaccaagaactaacgtatgataatcttagttaataagggttctttcatctaaccttcagagcaaatccattattgagtaatttctcacttgaagaacagatcaaagagtcctgcaaaaagaaatgtaaaatcatgaacaaacaagcaaaatgttcaagcaaggctactattcagtattgtcacacagaaacaagaattatatacgtgttaagtgcagcagataaggttttgatccaaaattaatgattgtgcgtgcatggaattcaacatcgagatgcgagatatccaatcaatgtagcaactaaagtggattgcctccgcacatactaaaccttaagatcaattgccaacaagaggttgacagctttcaggttactagaagaaggaacttggcgaaggaaggataagaagatcatagacttcacatagcatattaaacttatattgaataatattaaaccaagcttaactgactggcagcaaaagagtttatactgtctagatacaatgataccatacgtgtctaaatgagagtgccttgaatacctgaaactttcctccatattgctgtgcttgatgaacccggacaagtccttgcattttaacaatagcaagcaagcattgtaatgattctgcagcctgcctcctaacaagatgcccacgtatcacagcttgcagtttcacaaggtccttatcatttggtagttcttgctcttcctatagtcatgtaaatgacaataatgtaataacactaacagaaaaataattaataaatataaatagtgggaaatactgcaacatacagtgtgcactctgatgccagactgaatgacagcagcagcagtctccgcacaatcttcctgatggtcttcactgcttccatcaaagagagagacggtttcctcctgcttcacctcagttgatgaaacaaaaatactttcatccgtcttatcagtgtgttcctcaacatcattatcatttggctttactattggagtttcagttaccctttcagttggttcttggattggcacttcagttactctttcagctggctgctcaattgacctttcagttatctggtcagctgacttttcaattggttcatcagctggcttttcaattgattcatcacctggctgatcaattggcttctctatcagtttttcatcaggcatctcttcattcaaaggcccctcatctggtttatcttgctgcaaaattttctcgtccggtttctcttgctgcagaattttctcagctggttcgtcttgctgcagaattttctcatctgatttctcttgctgcagaattttctcatctggtttctcttgctgtagaggtttttctgaggcataggagtaagttgaagaatagatgttgcttggagcaatttcagcttttgctttgctcgaactaagagtttcaggttcagatatatcagaattcttcaaaacacgatgccttgtagacctcctacgaaagctccacctacttttatctgatatggccttgttctgtaaaagccaacatttaacagccattagcatgattcatctacttgatataaggaagagaagacagatattctgtggtagctttttcacccgagacgaactagaagagatgttacaagcaaaatgcaggtaatgagggctagtttcgtgtatctgaaatgtaggcaaccaacatacttctcatttaatgaagcaaaatgtcgttgaccaggaagggaaacaacacaaaaagaaaggaagtggcagataaactctattagttttgaaattaatgtaccagttcctaataaatctccccaaagttttcctcgcaaaaaaagacccaaagtttgttaatgccttactggcgtgatatatccatcaataatcaatttatttccaaaaataccagttcagtaaataaactataaaaggaggtaagctaacatgattcaggtaataccttggtgaaattatgcactacttaatcaggagtatttttaatttgccaacttctaataattgcaggtggaggcatagaatcctagcaaaaatacatttggtttgctgtcagctatcaccactgatccagcaagaaaaaatttgtccttttgcaattatatcaatgaaagagagctaactactctctcttttccctgaacatcaaaaagagctaactactctcagtcactcactatagttggtacagatcctctaggctgtcccgtgaaaattccagatcccatttcaccaacactatggtgcggctgtctcctacgattagaggatttttctcgattcaacatagagattttatacgatgagcgtccagccaattagtgaaaaatgagctgctccagagtccagtgaactcctccccacactgagattcttggtagggaaaaacagtaatcaacagcgcaacattacaaccaaagtgtcaaatcatgggggacaaggctagcaacactcagctccgaggaagagaatgacagatgccaatcatgcaacaagacgagagacaccatacacagtgagtagcactttgagcagcagataaacaccagatcccttcctgacatcttgcatggactcagggcggcaagagtagcagccataatattccagctgctgcagctagagccatgcagcaacagaagagaaggggtaaaaaaaaggaaggaaattgaaatcaaaattgagcctttgaatgaactcataggacgtgcgggaacagcacgggatcaccagccaaaaaaaaaaaaaagctctcattttgctggctgcgtcttgctcgccgccacgaatcaaccccagatctaactaaaacaacacgcgcccgcacctcgaccccacgcatcccactgagatctgctgaaaacaaacgcaccagctcgagagaacccccccaaaagaacaaaaaaaaacggcttcggcgagcaaggccggcgcggcggcgcattcaagcggaggtgcggcgcgcgagtacctcgtcgacgtggtcatccgcgtcgccgtcggagccggcggacgggtcggatccgccgccggcgcaggcgaggatcttgaggcagccgttcttgggcttcgtcatcggggtcgctttcgccgccgccgctgccgccgccgccgccgcgtcggcctcagtcagtgcagcgcgtgcgtgcgtgcgtctggagcggaacaggatagggagctgcgttcctctgacttgtttcttctctggctttgcgttggttttgctttgcgtttagctgcggctctgcttgtttgcttgcagtttttatattccggaggattcgggccctccgctatctctaccttgccgctgttcctttctcctccctttttttttccccttctccaatgcagctttatatgctttgtttatttcttttccttttattaattaaggttaattaattaatacgtaattgaggttttaaaaaagttttgcgagtgattttatatttgtttcttttacctttgcatttcatccgggagaagatacacacggaagacggtatacgcgcaagacggcgagacacatagttttcgtgattgtacatacgcaagagtactagacacatgatatacgtgggtataggatttataagcctctagtatattaagtcagtaaatgggttatcatatgagtgcttagatgttctatagcccaaccatattggatctttaaggccgtgttctagctttcgaaggggtcagaaacatcttccccgtgcacataaaacggagtgatatattaactcatgattaaataagtattagctataaaaaaacttaaaaatagattaatatgatttttttaagtaactttcctatagaattttttttataaaacgcgtaccgtttaatagtttgtaaagcgtgcgcgtggaaaataaagaagataagttgggaagaaaagtactcgtactaaataggccactcaggttttacattttctttttttcccatcgagaaggatgtgtatgggggttgggatcatttcctccctaagggcaagtataatgggaggttctaagtcggctaaatgctcaagtggaggagagatatgagaagcaggctgtaaacttacatctggcttggacacaagaaccaaaaaattttgtgagagaggcaagtgggccatatatattaattataaatagctaactattgtatgtgtagactaagagaaggctgtaaagaaccttatatgcaacaattcggctatattattagccttgctctaattgatctgcaccttgatttgagggttggcaagagaggagaagggaatcggtgagaaggtaattcatagatttaaaagatagcgagataaattcgacttgtttcttaaaaataacgctagcacgtgtgacacaccacatgacaatctaatttaattgtgacaaaattagtccctctaattccgtgggacagtgtctcgtcgctgcatagctcgatctattggaatataccgcaatatatgtggggagttagcatctctcattcgatcgttgtcttgtaccacatcactcgtaccgtccttggaccgaccattaacaagcctaggcctaggggtgcaaacaaatgttgttcttcttcatggcgctggtaccgtcccgtccggccacgatccggtcagttgtgattgcaagtccacggcgcctttaagttcgcaataacaaggccattaatgcaagcaacaatctaactccgacgagcctagccatggcaagagcgtactttggtggggcttccgtttctccggccgcggccagcctattgttaccaagtacagtacacaggtcagcacttgttcttcccatagtcgtttttactcctaaattctcagtactgatgctactattaattaattgtaaagccgatcctgaccctgtcactgttggtaaagagcgagaggccagccagctgcatgcatgcggcgaaggcgatacccctgcaattaagcggctggtaagtacagcgaccttcgtaaccaacaaacgatcgagatgacacggtaccggcactaaatcgcggcaaaaaacggtacgggcgtcgacgtgacggcccggcggaatgctcgcgcgcgcgcggccgcgcggggcgggggcgagcacgagaaagtgcgtggccgcatgcggccgcggttgctgcttgcattgggcggcgttgggttgttggtggtggcggtgtggcggtggtggcgcggtgatcgcgcgagctttgctcgctggccgcgcgccgcccaagcgcgggatggggcccgtggttcggttggttggttggcgtttcacgtgagacacagtgatcgcgttcgagaaaaacgggagagcggagcggagaattcatcgcctccacggcctttttcactgtgttaactctcacgagctgcaccggccagaccagtcactgacactactgagtttctggcacggtcgtttcggtccacacgcggtcaagcgctcgacagctagaccgtcaaatggggttagtaatttatggtggttaagtggtcaccacgcgagcggttttgcacgcaacaacggtgtggcaattaagctcgttacgagtgtttattaacggtggtgagtgagtgcatgtgaaaacaaagtggggccacgtgcgcaacgaggggtgtccgagccactacgagcagctgcgagtggggccaccccgagaccaccgggcacgtgccagcctttcgcacatggacacgtagcgcgctgctcgccacgttacagccacgtgcgatgccaccgtaaacgttatctcctacagctcctgcctttgttctactctctccccctctctctctctctcaggaccagaaagaaacaggcagaaagaattcaaaggaagcatcatctaatcacctagttaacaacggtgtcgtggcacagtaattaacggcctaagcaagcgtcagatgcataaaaccataataagagatactactatatccaaacaacaaggtgctttttggcagcgtgcaatgatgcttacactaaaggcatcctacgcgaaaagaacgaccggtagtgtggattagattagggcagagcatgagcatatatggagggatggaccaggatccaaaagcagccatgattcttcatgtagtggtggtgctaccttttgttttcattcttaatatcaattgttgtttccttcctactaccttgatcttaggttcttagcaggccaacatttgttctgaccatgagttgatgatcagtggtagagtcaccacctagctagatagtactatattctagcataatgccaatagcattgaggaagaattaatgctgaatttgatatgtgccatgaactatatgtagcagaataatttggtaggagtaagtagaggtgaaaaatacagttccagtgactgtgatcatagagaccaaatgtctagagctgtgatagtttctgaaattgtgatatgggatcagctaatgtgaggattaaactaagaaagaacgaaaggtcattgctctcttatttcctccccacttgttgaacttaacacaaagatgtgagaaactaaagcaagaaagcagcaagcacatcttatcccatggtccctggatagcccaaaagtcgtgcatgcccaacacaaagggggcacacacactacctttcttttttctctgctcactcactgaaacatatatatgggttgcatgtttcagaagtagacaagagtgattggaggcacacaaattggcctgcattgcaccagctcacatgtattaggtcagggtttgttgtgacagttcgtttattcttgttaatttgggaggtgattaattaggggccacatgaaaggtcactgtcagagagttgggaggcagtgacaggctactccatgttgcttgtggaggaaaaagagcaagtttgagggcacaggccatctgagaggactggagactactgccatctatctatctgaagatgaagacgagatccaacggggttctctgctttttattattgtctccaccagtttggacagtacatacacagattcagtatcaatcataaccttctttcatttctctctttattataactccggctaatgttttgtactatatatgaagctttcatatatatgtaataataagaaattaaataaaaacaatgaagatcgaattaataggtaaaataataaatgcggttatgacaaagaacaggtacaccatttccgtattgacatgatctactgtggttaaggttatgtgttaatgatgctcactcttgaaaggctgtattattattggttttggggggcctaaacggctaaaccccatcctaatcaaacgagctgtacgtggtacgtgcactaatctggatcctttttggtaatgatggattgatgggatagcgatgctatccaatatgtattcctatgcagcggcgttcgcgaaaaaaaaaatattcctatgcagtggaactgatgtggttgccatatcatttcttagaagactttacagatgcacaactgggattttttctactattctagccttctcgcaattggaacagaggaaattgggtccagttaattggctaattgcgttgttataaaataaaatgaagtgattggaataaattgtcagcaatgttgaaatcttaacggataaaggataaaatagttaaggaaaggtcaggcttcgatatcaaatgagatttgcctgtttatcaggaaattaagccaagctgtacctgtctgaagtctagacaagcttttggtggtatgttctatctaccggtagaggaaaattcaaagaaatttaattaatgtttgcccatatgctggctgtaccaggaatattcttatgtacataatagaataattaattagtccatggatttagaaaatttctagatagaagagaaaattgttcacagaatttttctgcttatacaagtcatatacatttgttggaattaaattctgtgcagtgatggatgacagcactatatatttaggtttcaggagatacacatcaatgggacagtttcatgcatgcaattctaagctacatactcaaccaacactagtctttgatgcattatatggcagattagtgaatcaatcgcaggctacgccgaggatgaagcaacaatgacaagataacccagctgatattgaaaccttgaagagagggggaaactgaaaatgacaaggagagttagctgatgagtagctctataacccaactttgtcctcataaactagctagcactcaggacaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47350 - DNA, 11163 bp, Oryza sativa
tgtaccgtatactacctctgttttcgaacaggctcagtatctgaaagcttagagcaagtttaatagtatagtcacctgctagctccaaatcatttataatcaatataatagtcaatttatacaataattatctataaaaatatactgcgctaataatacctggtcccacatgtcatacacacgttacgccttagagtccgtgctgcagctgtctatagactgctattgtacctgctcttatttgaaattcctgacttcacacgagaatctgacttcccactatgatcgccactttcaccttgtggcactagccgcactactactgtgtataacacatttgtactagaatgtgtcttcacatctagtattgggttgttttttacaggacgagaattgatctaataatactattaactagtaacgtattacaaacttaaaaattaatttatctgaacattttaggaaagtcttatacacaaggtccgcacaaaaacacaccatttatctttttgaaaatatctctactggaaacaagaaagtagctcaactgaatagctgattcgaacttggtccaagttagaatagcgttatactattactcctattataaaatataatgcataatctagacatcaagaaacaattattattatgaactcattgtttgaactcacatggctttactagtaggcttataacggaggagtgacactgtgactgcgcatggcaaacggcattgaggaacaaataatagattagtgatttactgggcctcaattgacgggcctgtttggcggcttgatccaagttgggccatgtgggccttgcaggcatattgcacagtcgcccttcgaaattcgatggagcacttgtgttacttgtgtacgtagtacagtatagtatctcttgttcaagtattattgtcttagtcaaatcccactacagcctcatcgttttctctcacatgttactatcagggagacctacagaatataaatcacggatcatatcgacgagcatgtctatctgttcaactgtttaagttcaaacgtccaaatccggacatgttaaccgaaatcacaagtccaaacattcaaccggcgatttttcgctcgtcagcatgttaactgtagcgtgagttcgtcacgtcgccttgtctgcttactcaggccaacaaccccgctgatctggaatatccgtggcagttgcgactcaccaaactttgttgaagacttcaccaaatcatcacgcgcaggcgcagcacgaaaccgtgcaggcaacacattctacgcgccgcgcgcaatcttcatcacctgttagtcgctctcacctgtaattattttggaagactcaactaccacggcttagcactactgaatgtctcaattgaccaatcatgcaaactgaagcctagagaaagaaactgaaaactcagtttcctccttctgctgatgatctgttatgctttgactatgctatatattgctatggacaatggatcaatgcacctaccacggtaatctgtttccgtttacgtaggttgatttgcccttacttctgaacgtaattcttgtgagcaattctgaactgcccgactacatggaacccaacaatgtatgaatggcaaaaccaagctagaaatttgacttcttacaaggaagcaagaagtttgactaaggaatggttggtgtagagcgatttgactataagaaaagtacacacttcactaccttgtccaaacatatatgtcctcgaaaaaaaaaatagtaactaagaatttggtttaaaaacaaaactcaaactccctccaatccacatgataagaaactttgatttttttagtttgaccaagtttatagaaacatatagtaatatttatagcactaaattagtttcactaaatctaacattaaatatattccaataattttattgaaaatgtttttttataaatttgatcaaacttcttaaaatttgactcaaaaaatcaaagcaaatcataatatgaaacgaattgagtagtaactaagaacatggacatgcataaaatggataattgcgtcaaaaattcctgcaatattttttttatcgatccattccttgtctattatctattattaagcttgaaaacatggtactgaggtgtagaaatttcatattaaccagagaaaaagagagaaagatttacatggttagatcatgatgggtcagattgtgacagtggagattgattgataatagttgtatatatacaaagtataattgtatactgataattagaaatagaagctagtattatatataacatacaattgtactttttagatatgttgaatacgtaaattctgcctataagatggtagtctaaaaaatataaagtatatgggcggtcatatctattatattattaaaacagccttaaaagaaggcaccacgttcgctgtggaggctaaaaattcccacattaatcggagaaaagtagaaaaatattaaccgttagatcatagtatatctagattttagcgcctcagatctaatagataaatatatcagagttgtacagctaatggaaatctttccacggaagcttaaagaaacatactagaaataggaatcggagtaaaaatcggagtaaaaaggagaaacgtacttaggaatcagagtaaaaaaagagttcgagatcaatacgactaaataaacggcctgtacatatatgtgaaactaaccaatctgaaaaggaaaagtttatttctaaccgggatatttaaattcgttttgtctatatgaagtatttgaactttttctcatattaaaattaatgtattgatccacagcttgcgttccttaaaaacgaattcatgtctatgtaaaaattagaacaatactgcctccttaattaatacggagaaaaagaaaagaagagtccaagtagaaatacaatataaaaataactgaaattcggaattaaaaatatgcaatattgaaagagcagtccagataggaacctaatacatgattaattgaaattcggaataaaaataaaataaattttgaaaatagaaagagtaaaaaataagagttcgagtagaaatacaatttaaaaataattgaaattcggaattaaaaataaggaatattgaaagaagagtccgtacaagaatccaatacaagattaattaaaattcggaataaaaaattgaaattaaaaaaaagaaaagaaaataagagttcaagtaggaatataatttaacatcaacttaaattcggaatttaaatataagcattatttcatgactacatataagaacccaatagtagattaattaaaattcggaataaaaaataatataaaatccaaaattaggcaaattaaaaatagagttaaagtaggaatatagttttgaaacaactgaaattgaaaataaaaaataaaaatatcaaaagaacacaattcaaaaaataaaataaattctaaaattagaaaaataaaaataagatttcaactaggaatacaatttataaataactaaaattagtgataaaaaaactattaaaagaaaagaccatctaaaacaaatgacaagattatttaagtaacaggcctctagaggagcagagtggtggcggttgatgagacatctaaaactattaataaaacaccaaatagaatcgtaatgatgattaaaaggaaagacgacgggcaggtcgtgaagcaatcggttcaaggcggttggcgatgacttcaagaaagtaaaaaaaaataaaccccaatgataatcatatttgatttttaaaatcttaattacaataaaaatgagaggcggcgagagggtcgtataggagtacaatggcagacccgccgatggttggtgggtcttttagaaagtaaaaaaaatgaattccaacgatagtaatgttagatttttacaatcccaattacaataaagagtatgcggcggacgggttgtagaggagtatggtggtagcgtttgacgggatttctaaaaattataaaaaaaacatgaaacccaacgagacaataaactctaaaaactataaggttaaatttttaaaggttcgggcttcaaaatgtaaaaataaaaaacctcaataataatcatgtttgatttttaaatctcaatgacattaaataagagtggcagcgggtgagccgtataggagtacagtgacaaagtcgctgacgttttgacggaacttctagaaagtaaaaaaatgaacctaaacgataattatgttcgattttaaaaatagtaacgacaataaaaagaagatgcagtggacggttgtagaggagtataatggcagcttttgacgggacttgtagaaattataaaaaagaagcctaacatgacaataaactttatagtttttagatccaatttttaaaagctccaaggagaataaatagaaacattggtagatcgagtaagctaataaagaataatatgacagaagtaaggggtagcaactggtgtgacttttaaaaactatagcattagaaacacaagaattataaggtatgtagtggacggttgtagaggagtataatggtaacgtttgatgggacttatagaaattataaaaatgaagcctaacaggacgataaactctatagtttagatccaatttttaaaggttccaaggagaataaatagaaacagtggtagatcaagcaagctaataaagaataatatgatagaagtaagggatagtaactggtgtgacttttaaaaactataaaattagaaatacgaggatgataaggtttggtttttcaaaatcttaagacatcgaaataactatttaataaattttaagtaaaatcatattaaaaatatataattttatatgggtgctagccgtgcaattgcgcgggccacccagctagttattattaataaggtttctaaactcttaaaaaacatttttaaatccccaaacttgttatagtgtcattcccgtccaaaattgtcatgacacctttaggattctacgtatcactgacgtagcatgtcacaccattgaaagtcgataagatttgtatatcaatgattgtataagagttgtatatcaatccagttaaccattgaaagcgtagccccatgcgaaactacacataaaaatccactagttatattattattgagagatgtcctcatcttcactcttgtgcggactaaaaaccaccacattaatttaagatacataaaagaaaattgcaccattagatcgtagtgggtccaaactatatcagtacttccggaatcaatcatatgcaatataaaactgtatctgtaaaaacaaaagctagaagttcttatcaaatctacttggagacgtagcgaaaattcactattagcacaataatttagacatttactgtctcatatgctcgcccatgcttagaccggccggtcaattttccacgtctcgcttagctgtctttgttaaaggcctatggataatgatatttgaaagtttacttcaaattcgccgtcactgttttaaaatcaccacctattccatggagactatatatggcccttctgaagaaacttaagatcatgagaaatatttggctgttagtcagcttctgagaatctggtgaatctgaatttttagtttattttatagattctctaactataacttcttataatctaaataaaaaaaactacactatttgagggagtttttgattctaagatatgatggagttgtcagaagctccctcaaataggctcttagcaattgtataactagtggatttttcatatctaattaggactgtatctaattttgaacactataatcttttagatacagagtgagtacaactagatttatgaaaattagaagctaacagttgtatatcatatctaattttaccttttagctctgtgattttgcacggaaaaatgctaattccaataacttcactaatattttgttgtatatataagtagtgtagtgacccatgcagattacacgactaacgtcattacacaattttctcatatgcataatagaaaatatacttccacaatttattgtcaaaaaaacaatattgaaagtataatcttgagctctggctcaacttggtcaaaagtatacgcatgatattccgactaacatcttactccctttgtcccaaaatataaaagattttaaagggatgtgatattttctaatactatgaaatgtcacatttctccaaaatcccttatattagggacggattgaataactttttatgtctataaaggaaatatggtgaacctttactattgccttaacgtctgatatttatttcatttcttccctccatcttttatctttaagtggtgtttagattagggactaaattttagtttacgtcacatcagatgtttagacactaattagaagtattaaacacaaattaataataaaactaattgcataaatgagatctaattcgcgagacaaatttttaaaagcctaattaatctataattagcacatgtttactgtagcaacatataggctaattatgaattaattaggctcaatagattcgtctcgtaaattagtctagggttatgaaatgagtttttatcattagtctatatttaatacttctaattagtgtccaaacgtctgatatgacagggactaaaatccaaacaaggccttagtctccttttatttctccgtcttttattttattgtagtagtttctcagtcagtgacattcttctaccttctaacgaagtcacggtatttgtgatagtatataacccattttaaacaagaaattattccttgttatcatttatcaatacttctttattagcaagatcacgtaggtataggtttgatgaaccgagaacaccaaccaagtaagaacacatgcgcatataattaacacatttttcttttgcgatcgcttaaaaaattgtaagaaggctccaacggtcaacaaagaaaaatcacatgcatatccaaaactagtacggagtactttttttaactaggccactaattatgctgtattgctgttcagcttcagcctcgcaaagttcaccgacctcttgcgaagatttacacgtgcattaagcttccaggctccagcaacagtgccctaatttcctgaacaccgctatatatatatgaggctgaacaccatccaggaaatgcacacacgattgtacacttcgccggacacgtaccacgtcggcctaattaagcagtccaagaacgtatatactcaccacttcaccagcacatttgattctgcacatgaagatcaccgtgcactcatccaaggccgtcaagccggcatacggccccggcgagttccccaccaccaccggcgacgtcgtcccgctcaaagtgttcgacaaggcgaactttgacacgtacatctcggtgatatacgcctaccgcccaccggctccggccaacgccgccctcgaggcggggctcgccaaggcgctgatcgagtaccgcgagtgggcagggcgcctcggcgtggacggcgacggcaaccgcgccatcctgctcaacgacgggggcgcgcggttcgtcgaggcgacggccgacgtgacgctggacagcgtgatgccgctgaagccgacggcggaggtgctgagcctgcacccgagcggcgacgacgcggtggagctgatgctcatccaggtcacgcggttcgcgtgcggctccctcgtcgtgggcttcaccacgcagcacatcgtggcagacggccgcgccaccaacaacttcttcctcgcgtggagccaggccacccgcggcgccgccttccaccctgtccccgtgcacgaccgcgtctccttcttcgcgccgcgcgacactcccaaggtcgagttcgagcaccgtggcgtggagttcaagccgtacgacgacgacgaggatgtccatgcgtccggcggcggcggcgacgacgacgaggtggtgataaacaaggtgcacttgagccgggaattcatctcgaagctcaagtcgcaggcgtcggctggcgcgcaccggccgtacagcacgctgcagtgcgtggtggcgcacctgtggcgatgcatgacgaaggcacgcgggctcgacgggcgcgagtccaccagcgtgtgcatcgccgtcgacgggcgcgcgcggatgagcccgccggtgccggacggctacacgggcaatgtcgtgctctgggcgcggccaaccgcgacggccggtgagctggtgaccaggccgctgaagcacgccgtggagctcatcaaccgggaggtgatccggatcaacgacggctacttcaagtcgttcatcgacttcgccaactccggtgcggtggaggaggagcggctggtggcgtcggccgacgcggcggagatggtgctgagcccgaacatcgaggtggacagctggctgcggatcccgttctacgacctcgacttcggcggcgggcggccattcttcttcatgcccagctacctgccggtggaaggtttgctcatcctgctgccgtctttcttcggcgacgggagcgttgacgcgtacgtgccactcttcagccgcgacatggacgtcttcaagaactgctgctactcattcgacaaagaccaaactactagccttgcatgaactatattattgaaaaacaagacatgcagttaatgctagatcacttgattgagactagttagctaattagtatttgtttgatgttgttgattcaattattatgaattgaattaattacgcgagatgttctgccgatgaaagttgaattgaataaataaagttatctgtaaaaaaaaacttgaaatattgtagtactactacgatcgatcggtagctttcaagcggttcattttatctgaaggaaaggaaaaccaaagtaaaaaattgcgccgttgtggccttgtgggtctaaaggaggatggattctaatatctcgggtggacgtgcacccgtttcttacataccacctaaataattataaaaaaaattacaagataggttaatatgtaatatattatttcacaaacatgcaaattcaaattcgacttatacaagttgtaacaaaaacaacaaattaaactctaactagtatacagatatttacagtcaaatttgttatttttgttacaatttatagaagtcgaatttgaacttgcatgcttgtgaagtgatatattaaaaattaacctatcatgttaattttttaaaaaaaaattcataactatttagatgacatgcaaaaaacgggtgtacgtttttcgggtttaaaacagtttttcgggtctaaagctgtgtataatgttagcctttgacctttatcttgcagtcttgcttgttgggctgggacttgggggctggggctgagatgtctgctcttggatatgctgtacgccagtacgtgtgctcatgctactttggcgtactcgtttcctgataagccgaggtgaacgtgccgcggccaaacaattctctattgtgaactcattcttttatccaaacttctccattttaatgactctcaaggcccttctggccaataacaaactcaatcctcttaatagacttatcacgacagggattggtacaaacgagtagatagccacctagatcgaacactactgtgatactatcagatggtttttttttctcttgagaacttatttggttaatccctcccacaaacaaattgagggagacttggaggggaactattcattcctctctgttcccctccaatcccttccccttgggatctaccgaacaaaactacatgtcgtttaaaaaaccatcgaaaaatttgaatttgaaaaaaaaataaagaatatagatcaatatgtgatatagcatttcataaacatagaagtttaaattcgatttatacttcagaaacagaaataataaatttaactgcgaattacaagttttatataaagtcaaaatttgttactccctgcgtcccaaaatataaacatttttagaataatgtcaagtcaaagatttttaactttgactattcatagcaataaaataaaaaaaggtcaatgatgtaaaactgatcttactatatttatcaataaacaaactatcataatatacgacttttattatttgaaacatcctacttttatagatattgttagtctatgtagcatcttgaagactgggccagagtctaaaaatgcttatattttgggacggatggagtatatttgtttctacttgcataagttaaatttaaacattgcatgtttctacaacgatataccacatattgatttcccactgataacgagtacggcagtaggcccaaacaattcaattgtagtagttgttgactcatacatatagttccggtaactgcgaaagctgtgaaaaatacaacaatgtactacttgaaagtacagttttaatattgcccatacataatcctttatatagaggctgatcggtagtgattgttgtcgcacccactgcagttgcgggagctccaaaagctactgccgctggcagccattttcaatggccacagccgctaccgctgcaacagccaacagaagcgaacaatctcatggacgtttaggtggatagacactaagatgaaatggactcgctaatatacctaatgtacccaccgcaaatatgaagaaaagctatttccatataacaaagggatcaaaactttctaaacccacgctggattttacggcttataatttttttagttcttacttattttttaaaaacttttatgattttttaagcgacatggaaaaacaagatgacatcccctagagaaatgaatagacgttttgaaagacacaataaaaaagatgggacacttcgtgcagtcaacgaccaagaccgccagcagaattagctgagttcagggagtacatagcagcagttcttgaaggtgtccatgtcgtggctgaagagtggcacgtaggcgtcgacgctgccgtcgccggagaaagatggcaggaggatgagaagaccctccaccggcaggtagctaggcgtgaacaggaatggctggccgctgccgaagtcaagctcgtagaacgggatccgcagccagctgtccacctcgatgttcgggctcagcaccatctccggcgggttggccgacgccaccagccg

SEQ ID NO: 47351 - DNA, 4682 bp, Oryza sativa
ggcgccgtcgtcgtcggcgctcgggtggaggctcgtcacccgaggcgtcggctccagcggcacgacgctgtccagcgtcacgtcggccgtcgcctcgacgaaccgcgcgcccgcgtcgttgagcaggatggcgcggtcgccgtcgccatccacgccgaggcggcccgcccactcgcggtactcggccagcgccttggcgaggcccgcctcgaggacggagttggccggagccggcgggcggaaggcgtatatgacggagacgtacgtgtcaaagttcgccctgtcgaacacactgagcggcacaacgtcggcggtgctcggagcggccacggcgtcgccgtacaccggcttcacggccttggatgaatgcaccgtgatcttcatagccgatcggtagatcaatctatccgtatggttaaaatgcaaagtaatttaagctagcaagatttttgaagtgtgtatatgtgttcttgaactactgaggcgggtgcgtgcgtacgtagtaattccgataaaaatggtagcagatgtgtgttgggtggtgtggcacaatgagctagtcgtagcgaatgctttatatagaggagagagggccgggacggatgtgcatacgagatagctaggcatgtgggtacacgaaagatctgatccccacaaccacaatttgtacaattgtactgtcaacgtccataactccatactgtaatcgcagcgttagaattttcgtcttctaagagagaaaaatcgatccaactaatgtgctgttgatggcggctgcaggattttgccgctatgtaaatcacaagaaaagttcacgcattttgtagtacaaggactagggttttctcgtacgtgtactttgaatgaattaaataatacgggaatttattaattgtggagcattaccctcactctagactctcaagtctcaacagataccggtcttaatgaggtgaaagctgccttaattagaataggtacaataaacctacgtcagtgagctatagtaattattacatcagatatttgtatactctcaactctcaaggcagacagcactgagccttccttctccggttctcctaggtgtgaactcctaccaaccaatcgtagatggtccaaaactgggaatgggaaaaaaaaagagaagatattaggagatagcttctcccagttgtgaacgctgttatatgtcttcctatcgaccaatcaatcatagaatcaaaaaatcgagaatagaaaattaaacgatgtcagtagatagcacgcagaaatacgtacacatgcagccaataagcggcaaacatgctgacgtggagccactggttatcgttactatattagctttgatcttatgtgactttacaaagggcttcttttatctctttgggttgcatacgttgatctttcatcctaactaggatttggtccggctgaacgaaatctatgccgttcattcgcgattcgacgatcccacggctgaaaaagggccgccaagttagacacgtggacggttagatggactctaccgtgagatcgaacggacgatgttggagggaaccggtatgtaattaacaaaaacacagggtatttttttgcaaaaatcgctgatgtggcgctcctaatcttcaagcgatcactcggcttttaagtaaacctatattattacatgcatgcacactagacatagaactacccgtctcatattatagctacttctaacatttaaatttttctcgtaatataactactttttaattaattacttgctttttttcatttcaactatctctcatttggtttcatcgtatatttttttatgtcaaccaatcacaaccatttttcacctgggatggaggtagtatatatatgatttcttctaccaaaattcttgggcaattaattcaagtgaatacccataaatcacatgggatccatgtcgttgattaactactgcattatctggctttctgtaaaagctgggcagctggccttttcttaaaaaaaaaaaaacctgcatgatctatccccagcctatgacatcccaaaatataaaggtgtccaaagtcaaactatatacaattttccctattaatatataccacattaaagaagtaattatgaaaatatatttcatgatagatctaatgatgttcatttgattgtaaatattagtattgtttaggatagtttgacttagtgctacatatagaatcctcgatactttgggatgaaggagtagtagttaaaatcttacattatctaaaatagtagttaaaagctatgaacgttaattttttttaaactaagagcaccttatatttttggaggaagaaagaactacccagataaataatgacaatggtggcagcttgcatgcttgtaaggcacggcattacctagcaacaagctgattataatttgcggctcaccccttcttctgataatagaggcattaggcatatatagagagctcgatgaatatacgtacggaggtaggtgagttgtcgtcacgcatgtcactgcaacactcaagaattcaatcgaaatatatataaaaaaaacagtttgaacacgtacggtaattggtgtcatttcgttcaacatcgtctggtagaaagtcagcttttgaactttggaagggtaatgtgacattttagaattgcaaatgcctatcccttcgttctaaaaaaaagttcttaatccaatctatgaagctagacatataagtatccaggttcgtaactaaattctgtttcatttgtttaagacagagtagtccagtataccaaataccatgtgaggatgaacacgaaccatcgagatcaaatcgatctatcggctcaaattggtgtggacccactttgattttttataggaataataattgcagctagtagattgcagcaatatttctagacatggagtatgcacaacaagaagtcagctagcaatgcaagttggagccctttttacgagtaaattgtatcaccggtacgcgaacttgtcaggtgggtgtaatctagtgcacaaacttgtaaaatgttcattttagtacatgaacgacttatctggtgcgtgcggaggaaggtgaaaaggatactacatggctagtctgattgattaggggctaattaggatactatgtaaatatatatctgaaaaggttgctatgagacatacacctcttcaataaaaaaaagaatcaaatatagtgatagtagaaaaagataaagaaaaaactgagcaatgatataagtgctacaaatatatgaaattcatcatttccatgatgaaagataaagtagatatcaaatttataaatattgcatatcttatacatactcactgcacgtatgcacgttatatcctaatcaacatcagcttcataaaattaacattgccaagttattttggttctcgttcgcccaaactagaaaagtttgtgtactaaaacgagcattttacaagtctatgtattaaattgcacgcggctaacaagtgtatgtatcaccaatgcaatttactccctttttatcctcttcctcgattcgccagtgatttggaacttggaagttggtgaactgcatcaacagaggaaaaacagtgctacacgttacatgttagaccaccagtaagctgatggataaaatatattatatataggtggtgtatactgtattaatgtattaatagtatgaacaattgtgcggataagagacattcgacctatctctaggtgtcgttttcgacaccacttggctactcgaaatataactttaatattaccactaacttttatattctaatataataaagaatatacaaaattatcatattatatttttccaatgtgaataaacacatgttatgtgtcaatttaatattataaatttcaaaaatgttgatatttatccttgtgggaagaaaatgtttaagactaacaggagctaaaatctctatattcagcagtatgaatccaccagttttgacaattgttagaaaatatttaatactgagatttgggtgcccctttttcgccttttgaaaacaacctataatgaacacaagaaaataaacgtctataccaaccagtactgatggagccacatgttgaccttactccacaaatccttaaaatttagtgctaacgttatccatatttgtagcaaaaacataaaaactcgaatacacgacactgtacaagttgtaataacgacactgtaccaggcatatcaatcaaattattggatttagtggcggagcttaggggaggccaacctggttgttggccccttcagggttggctgacaatgcaacacacatagacatatatataagttagcaaaacacctttgaaattatgaatttctttggtgagttggttagcatcatgtgaacctttcactctacaggtttgggttcggatcacacagagcccattttttcctccttttgaaaatattcctttgttttatactttttttcacttctgttctcaaaatttcctatagctcttataataaaaacttttgttttatattttcccctttatttagaacttgtagttcaattaattaatactccctccgtttcaaaatgtttgacaccgttgactttttagcacgtgtttgaccgttcgtcttattaaaaaaaattgtgaaatatgtaaaaccatatgt

SEQ ID NO: 47352 - DNA, 4059 bp, Oryza sativa
atctgcaaacacctgtcaatctgcagcgcctcgggtagatcctcctgtttttatttggaaaatatcatttgatgtaggccaaggataggttgcatgtctcaagctgttggttggtgaagcccataggccgtgacggttgaagaaaatgtttgtgttagtttgtcaaaatgttcttaacaccaaaatctaattaagttatagaagcattatcaatattttgtcaacatatacatatgtgatgtaggcaagtctggatagcaaggtacccttccgcccaataaaaaaaccaacatctataagggaggcctaatccgtttcctaaaagttaaattttgggaattaagggtaaaaccaacccttcaacgggttcccaaaggaggttccaatatttaggcacatccaaaatccaaccaaataggagctagttttgggtactctacgcactcccaattaaagaaaaatcaatttaggaggacccacagtgatgacatggaagattttaaagttttttttggactcacgtattgggatactcttggagatgagggtgattttttagcccgatatcttttgggatactcccaatacaagacatctcttggagatgctctaggattgtttttttttacagagtagaactaccttttctgtttcaaattactcatcgttctaagtttgtcttgagtcaaatattttaatctttgaccatccaaggcagtatagatggtagttttgtccccaaagcagtatagttggtagttttgtttgacgtgacagtttgacacagatcaacagtgttgagttagtgtgggtcccacatatcaaggcctcgtcacctatctcccttcctcccccttgttcccatctcaacggccaccacagtcccgttgttggaggagccggaggaggctgactgcggcgccaatggtggttgggacatctggcggtggggggttcatgataggcggaggtgatcatatcgtggttggagcatgaaagagatagcatctgtgaagtattcttgttggatcttcttggcttccttctcagtctagtccatcagtgagatttcgcactcggccttggagagcctctccagcaaccagctctccatatgagaatgcttcttcggcatgggagctcgacgaggctggttagtgtagagctcgagaaggtgctcgccacgccatccctaagccaccgccgttacttcgatggggaagatgcagaaaagggggagagtggttgtcacgcccagaaatttaacccaaatttccagactattttgcgtattaaatccctgtccaggaccagccagggtacacaaaatgacaagtaatatacagttccaaacgtaaataaagcgtaaaatacttacagaacaggcacttagtcctcacaccgaaacagaacgacagcagcggaaaaaggcgatcctagtgaggcttcagctccactccacaggcaaaactcaactggggtctgagccttggtcctctaactccatcttcagctcagaagcactacacttttgaaaagggggaataatagcaagactgagtacaaccaccgtactcagcaagccacaccaacaatgcagatgtgcaaggggatacaaggatggtttgtggctatttgcataaaggcagttgtaaaacattttattgagcaaaacagtaaaactgttgagtaattaaagtaacattaaatctccacttatcaacgctacaccacgttgaacaggtccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacatccccacgacacgtttccgtgcgccgacatgccaccacgacataccggaaagaggccgtgacaggacccttcgcataaccccctctagccaagcacaccacaccttaggttacacccccgtccccagcgggcaacgggcagtcccctctcgtgcctaggtgaatccggaagcgacagaggccgtcgcagggcccgccccgctccatcacgcccacccttgcctggatgcattgactagaggaaagctacactacaagcccagccgttgcccacgtggcttgtggtaagtacgataagttcttccagggcatcccgcgaaccagtccttaactggccatgggtgcgaccagcaaaaccatgcacccacagcccaccattcagtcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacacaaggtaggcgatttattacccatggttgtcaaaggacagatatcaagtaaacatggcacaagcgagcagataggtaaaaccctgaccccatgtaattagcaagacatgcatatttatttgcaaacagtaaaacatttgtaaattgggatcaacatgctcaaggggaatgtgtgacttgccttgcttcttcacttggattttctgaactcttttcctcgcgaccgcgatcttccaaaacgacggattctacacgctagcacgcaaaacgaggaaaaacctaataaaaacgaaggacacagtacctaaaaagtaaacaaacatgtagaactcaattttagatgaattttgcaatttaaatggcccaatttggagttcgaatgaattagatatgaattttagaagttttgagccactaaatgaatttctataattattaatgatttattgcgcaattattaaatattttcacaaaggaaaaggactgccgctaacgtcagcaagagagggggccggcgccgacaggcggggcccacatgtcagcgagacgaggtggcggtccaccgtggaccgggaccacaaggacggtccaccgccggtccacgggttggacggcccagatcggccaaggcagatcggacggctggggatggccgggcggcgcgcagacggccagacaaccggcggcggcggtggcgcaacgcggcgctggcacgggaggcggccggcgaagaggaaaaggaggagggaggcggctcaccgagaggcgcggcgacggagggagcggccgcggagggaggcggcggcgctccacggggcgaagacgacggcggcgattcggcggtctccaacgaaggtgaaggagcggccggggtacgggggagcgcggcgaacgcagtagaggcggtggtgtggcgcgaggtggcaaggaacagcggtaagaggcggccgaagacggcaaacgcggcgacgtcctcggcttcgcggtggagatggtgttgctgcggtggaacgggaaaacgaagcagaggccggggtgctacgtgatgcggcgaagccgacggtggcagtggcgtggcttggtggtggctagggcggcggtggcgcgctgccggagtcggcaaagtggcggtggagctcgggttcacggtggaatcggtgcccgggtggtttattgcggaagcggagcggtggacgggatgcggcaaagcgcggcgaggccggcgatgcaagcggcgcggcacggggacggcggtagcggcggcagcggccggctggagtccgccggtgagcggcggcgcttgggctcacggggaggagggggttccgggcatgggggagcttgggagagaggggaaaacagaggaggggagcacgagggtgctttatatagggctcggggatggagatcgtggccgggagaggcgggatcggccggtgacgtggggaggtgaagtggagctcgtggggaggtcaaaccggcgccgtttcttgcggggtgagtgggggaaaaggtggaggacgtggagggggttgtgtccacgtggttggatgcgagctcgggtgcgggagggcgccgcattttgcggcgacgtgggcggcaatggcggttggggt

SEQ ID NO: 47353 - DNA, 8617 bp, Oryza sativa
cagtggtgaggagaaggcccgcgatgggcggtgaggaggctggcggccgacggcgggtggtgaggaggacggtcggctggcggaatccaccaacagggatccagcgggacactggcgacagtgccttacccacacgcagcaactcccatcccaaggtccgccgctgcccaaggtcaggacgggacgaggggcggcgatgactgggtccaagatctacaccaaatcaggatgggaagttgctgcgtcgttattgtcctcctcacctccagatctacacacagataaagacgtccgacagcagcgcacggccgtggcgatgagggaaagaggaaggggttgccgtgagcctctacccgccaaccgccgtgagcctccttcgtcagccccaccgttctccccgctggctgccgccctcagccgtcgagcctgcacccgccgtgcacctctccaccgtcctctctcgacgaccgccgcgagcctctcccaccgaaatggttgctcgtcgccggccacctctcccgttggctaccaaggtggaggcctggagagaaatgagaagagagggaagacggtgaacttaattgatacgtgggccctacactgactcagcggcgctgacccaagtcaaattgccacgtcgtacaaaaccaccgactatactaccttaggagttaggacctatattgtattggttttggtatttcaaggaccgttgtatcaaaaacgtttttggttaaagaatgaaaatcggattcgttgtcaagttaaaggaccttagatgaacttgttcctttactacccgatttagatcgatgagcccatacattgcacccggtctcgccgtcccggtgaggattgacaggtcgccgaggcacgatcaatgctcgccatctccaacacaagtacacaacacatccttgcgattccgcctatcgatcaaacgcagccggcaacccaacacctatttgttatcctgttcccaattgaagtcactactcacagcaggccgctcgcgcgcgtccacctcatccgcgcccggtagaaacacactgcgtccaatcgatggctatttcctatcagaagttcagaatgaatggccatcgtgcatgctggagtaaacagagtactccctccgtttcaaaatatttgacgctgttaactttttatcacatgtttgatcgttcgtcttattcaaaaaatttaagtaattattaattcttttcctatcatttgattcattgttaaatatatttttatgtaggcatataattttatatatctcataaaagtttttgaataagacgaacggtcaaacatgtgctaaaaagtcaatagtgtcaaacatttcgaaatagagggagtactatagagcatatgccagcagctattactgcacttgagcagcacatacaggaccaccatacgaaatcagcccgtcgtctccagcattgacactagccgtcgcgagctcccatgcctccagcttggacaccttcaccgcatctgacgcattgttgaacacgtacaggtggctgctccccgttgctacatgttcagggtacactcgagccgtcatgcacgtccgccccccaccgccaaaactctccacgatcgaatgatcgatctgcccaattcgttaggtcgagcatgttatcagtgccaaatgtttgtcaggtgagcgctcaaaatgtgaagtgaactcaccagggttcgaagcgatatagccctgtccttctctatgtctatgtccacgaatcctccgtgggatggcttgtacacccctgctcttgaagttgacctgtacaaatagaaaattggcccaagaacagacatgagatctcgactaaacgtttcagccttcaggcggcctggcccaaaatacggggatttctcctagcccagcccgagtaagatgtcagtttttttacacttaccgtgtcaggtccgtgcacatgaggaccgtgtacccgtgcgagagcctgaacaccctgaagaaaacggcggtgcgctcgcgcaggtcgccggatgccatgacgagcagcccgaacgggccgattccgccgtgcaccgccgcgccattctccccgcacagcgcgtcggggtcacgcaaatggtcgggctcgaggcggtcggcgcccgcgaggctcgcgatctcgaacgctacctccacgtccgcctgcgagcccgcgatgccgccgatctcgcgcagcccgcccgcctccacctcgtttccgccgagcagaacgccgcgtttccgcctcagcgtctcgatctcctccaccggccactgcaccagctgcctcccgccctcgtccagccacaccgcccgcggaaacgactgcataaaacagatcgcacgatcgagccagtgagcactgagcacacagggttgcgattgcgttgccattgtatatgttgatcgtgacgggcgcgctgacctgaaggccggaccagcccttggtgacgtcgtcggcctcgctgtcggactcgttcacccacgcccacagcacgcgccgtttcttgcccgcgtcgtagaacgtcttggacgcgtacaggtggccgtggtcgatccgccgccaccgccggtagtcatcgccgtgggcttccaggtcctccggcggcacggtgaacgtgtcgtccgcgtcgtcgtaccgtccgaccatgtagtagtcctcgagggtgtccggcatgctgaccttgaggacgtgcctcacgccggcgccggcgccgccgatcgccgacgcgtcgaggtcgagcccgtcctcgccgtgctcggcgacggggaacaggtcggggcactcggccatgaccgcgtcccgcgaggcgtgcagcggcgccgcgttgcgctcccaccgcaggaagtcggcgctccggtacacgagcgtcgcgcccacgccgtcggccacggcggagatggcgaaccgccacaggccgtcgctgccgagccaggcggtggtggggtcccggaaattgtccggcgagacgtcggcggggacagggatgaccgggttgtacccgggcttggtccactcgcggaggagcgggtcgcgagggttcttggggaacgcgacgttctggacctgccggcggcgggcgtcgatgccggagtacatgacgacgggcacgccgtcggggaggatggtgactgaccccgacgcgcaaccattggcgtcgaatggcgctgtgggatcgagcgcgttgtcgagggcggcccagttcacgaggtcgccggagacggagtgcccccaggagaggttgccgacgtcccagagcgcgccgtgcgggttgtactggtagaagaggtggtacatgccattgtagtacacaggccctgatcatattaagaacaacctaatggtcactacgccctaattaaggtacaaattaccatggattgaagaagacagaaatatgagcagagtatcagtaaaaaaaacacgtaccattcggatctaattggtttcatccgttcccacatggttcagttcatccagatatatccaaatgaaaatacagtatacactatcagagaacgggaattgatagtatttttgggcaagaattcacagaaactcagagaggtaattgcatacgcaccgttctgccagttcttggcgggttggaagtggtacgccgttcggtcacggtggccgtttgcagggcaaaccggaggagaagaggaggaggagaaaacaaggcaaaaatggacagcgatggcaaagacggagaggggcaatccagccaacgccatggccgaacagtagagtgaagcagcagctagcaaaactatcaaacaaaacagtagagtttgcaaatttgagaagacttacaagtctccgagtttaatacatgttaattaagcacctgccaccatgtgcgcactaatgttttcttaatcgctgatgaccattaggtcatataaaatgcgacgatatttgtacgtaagcatgcggaccaacctgtgatcggtgctaatcagatcagctctgctgagtaattcaatatttgtttacttcggtgcatcaacctaccaccattgtcttttgactaaaccttggctgtcacaattcacaagagatccatttgcctctgctgcactcgatcgatcaagcggcttcttttgcaggtgattagaattttcagagccaaatgaaagattaacaattcttcgcttggcttatccttataaatagagtggtaagcctacggaaaaaactctgtatataacatctttttcctgtttttacgggtaagtatcctctctcctactatattcaatgaaattggtgttagtgtcggttcgtttaaaaacttaagagtaatataatctgcaatagcaacatccatcactgtgtgaacttgagaaccgatcaaacatttgtaacatacaacctttattttatcctgggaataaggcaataaacctccagacaggcaggctatggccttgaaggtcgtgtgactgatgaatgataaatgataaaatcgatcggccacagcacagtaaccattgatcgaattagccaagccatgcatactaagacgtttcagctacgcgttattgcgtccaatgcatctgcagagttcacggtcgccgtggccatctcccacgcctcgagcttggacacattcaccgtgcctgacccattgttgaacacgtacaggtgactgctgcttgttgctgcgtgctcagggtatacccgggttgtgatgcacgctcggccaccgcctccgaagctctcaatcatcgagtggtcaatctgaattttcgttcgatttcagttcatgcgcatggtttacgtactgaagaactaagattttagtgacagaattttaccagtgttctgagtgatatgctcttgtccttctgtatgtccacatcaacgaatcctccgtaagcgtccttgtacacatctgcttttgtcgatgacctacaagtatgcaatttcagcgaaaattgtgcaaaaattggtaatcgtttgggtcacaaattttaagttttaattggcttggaggagtttcaactttcaattaccttgtgaggtcagtgcacatgaagaccttgtactttccatggtgtttgaacactctgaagaagacggcggtttgctcctgcaggtcgccggaggccatgacgatgagcccgaacgggccgacgccgccgtgcgcggaggcggcgcccttgtccttgcacagcttgtggggatccagccagtcgggatcgaagctctcggcctcgtcctccaggttcgggatctcgaacaccacctcgacgtcggcctgggagctcgcgacgccgacgatctcgtgcaggccgccggccttcacctccgtgccctgcagcccgacacgcttcgtccttagcgtctcgatctcgtcgacgggccactgcagcagctgcttcccgtcgccgtccagccacaccttcctcgggaacgcctgcacggcagctcaagatattcagttcgtcgccgaatcagatcgatggcgacgtcgccggcgtgcatggtggcgagcgggaggtgacctggacgccggcccagcccttggcgacgtcgtcggccttgctgtcgtactcgttgacccacagccactgcacacgccgattcctgcgcgcgtcgaagaacgacttggcggcgtacgcctggccgtagtcgaggcagcgccatctccggcagttgtcgccgcggtcaggctcctccggcgagaaggtgtccccctcgtcgtcgtaccgccccaccatgtagaagtcctggtgcgtgtcgaactcgctgagcttgagcacgtgcttcacgccggtgccgccgccgttcgccgacgtgtcgaggccgtcgatgccgtgctccgccaccgggaagaagtccgggcactccaggacggggacggccgccgacgagtgcatcggcgcggcgttccgctcccagcggaggaagtcggcgctccggtacaccagggcggagccggcgccggcgacctcggcggcgacgaccatcctccacaggccatcccggccgagccacgctgtcgtcgggtcgcggaagttgttgttgatgacgtcggcggggaaggcgatgatcgggttgcagctgggcttctcccactcgcggaggagcgggtcgagcgggttcttggcgaaggacacgttctgcacctgcacgccgccggcgtccctgccggtgtagaggaaggcggggcggccgccgaggaggacggtggcggagcccgaccagcatccgttgacatcgaacgggtcggtggggtcgatcgccgtgccgaggaaggcccagttcacgaggtcgccggagacggagtggccccaggagagcttgccggtgtcccagagcgggccgtgcgggttgtactggtagaagaaatggtacaaaccgttgtggtacagaggccctgccatttcaatggaaaattactgccattactgggcaattatgctgatcatgaccaagacaacctgatgattggcaatgatcatccaaactttattgtgtatggtaaaatatgcttaattatgtggactaatacctttcgattacaggtttttaagctcacaagagtgaagagttcgtgcatggactcattctgaatgactgaatataatggaagaaaagaaaatgatggaggaggaagaaggggcatcgtaccatttggatctgttcagtttcgccagcggcagtgtccatccaaattcagagatccaaacacgatttgacaaacaagttatgaacttcgccatgattcaagcagacaatgatagaacaataagggcaaggtgtacattaccattctgccagaacttggcaggctggaagtggtaggcagttctgccatcgtgcagctgcagctttccgttcacagggcacattggagaagatgaacaggacgagactttgaagtttgaattgctatggacgaatgacgtttatatataggaaccaaaagttgcataaaacaatttttttattgaccaagttgcacgagactgcaaaattattgccgtccaggtcagtttaatacttttgtagaagactttgctttgtcaatatgatagcactccgtcttttctatttcgtgcttacaccttatcgattagatggcagctaatcagatgatattctgagcaactcgggagtagtttgcttcggaggaactcaacatctcgtatacttcgacgaaatttcaactgcagtaatcaacaaagaaatagttatctatgacgcagtgactcagctcttgtacacagtctaatggcctctatctgtaggcacaagatgtctattggaagtgtatacactatacagtcattgatttttttcttcttttgttctgaaaactgcgtatgcctaaatttgatcgtgtactacatttttgcatgatatttagctcattgtacaaggttttgttctgaagctaaatatcatgccaaccaaccatgatatcatgccaagaattgtttaactttggccgattccactcttccaaatgacttctttaggactttaggagtaacaaatgaacccaagttttccccatatatacggttagcaactccctgaaataaaaaatcatcttgcaagtgttgggctggattccggcccaaaacgagttgctgcacggcccaacgtctatagatatttctgcccattactgccgatgtggactctattcaggccaaagaaaaaagaaaaaaaaatccaaagccccgcaacgctgagcagagagaggaagaggaagaggaagaaggcatcatggcgacggcgaaggcagccacggcgccccccacccaccgcgcgtcgtcgccggcggcggcgtccccgccgtaccccagcgccgccaggatcgccgactccgactgcttcccccagtacaccgcctccctcaagtgtatgatgcatccgtcctaatcttgatctaactacccccatctcctcgccgcctccttgacccccttcgcagtcatcatactatgtggagagctcggattttcacgcgtgtgtggttgatctctgattctgttcgtgttggttcttcaggtttggaggccaaccaagacaagagcaagtgccagcagcagttcgacgactataaggagtgcaaaaagagagaggtattgctattatcctattttcccctaatctgtctaaagtaaatagtgatggtactgtatgatttacgaccccaatcgatcgtgcaagacaatatgttttgttttctgttcttgttgacggttttttgtctggccacatgccttaagcacttttggtggatcctaaattataacttttggcacagtttggccaaagatgaccctgattaccttaccagtggcattggcatattcaccatattgtcctgttcgtgtatgataattcccctctactgtcatcatgtcatgtggtgctaatattagtgactatatatgctcttcatgttcctacatgatcagtggcggagccagaataaaattatagtgggggctactcagccttttggaccttctaacaatctcagacaaggtctattttagcccccttgcaatagatatatggatttaaattttagggggtcttaatggggacactaatgattcattagggggtagggg

SEQ ID NO: 47354 - DNA, 2499 bp, Oryza sativa
cccccagcccccacgctgactccgccactgtacatgatattgaaaaaaacaaaactattcaggaaattgtgtagatgtagaatggctcggtatacagcaagaattaggatgtgcttacccaaagggcagcgcgacatggtgtgccacaccttcattcagttcaccaacaagtacattgttgagcgtccctgactccatgggtgtaccattgttaatccttcaaacaaacattagtagttattgtttcaccagaaaaacgcttggaaactgtttctgtttagagtttaattttatggccctcttttatcactgtgattgcttttgttcttatcctatcttaccaatgctcttgtctgttaattttcctccttccatgtgctgataaaaatccgaggccattatataagatttccatagactagtaagcactattgacttgatctacacttcctttctcctcaggtataaccaattgtttgcaccgtagaagtagatatttacagtagtcagttattgaacccattacgaactcaccataaaattattgcctctaggtggcctgaatattttgtcatcttatgcctgtctatctgaaccttcagtctctccatcttccccgtcttcctgagttaaacctttttttttctgattccaaagcgccctcaatgtgcaattttagtgcttgtataaaaaacatcactttcacctagaatttctctgtgatgtgttcttgtttgtgatggaatatttgccagaacacatgaacaacaatctgctacatcagaattgttagttgataattgaactcctgttacatctctctcaaacacattagctgattcagtagtaatatttgagtctgaaaaatacctatgtagagaagcgataatggcgtacaggtttaaatatttgatacataatcttgggcctcggcctctggtcccagtgcccatgacaaatctattcaagtaaaaactggtatatgatctttacgtgcaagttgcgagcaaagttaacttgactatatatcataaatatattcagatgctgggatgagctttatttgcaagaatgtttttatttatctggactaatgcctatcgaaatctttctttatatcataaacaagaatgaccaaggagttctatatatgcttgatcaatgatcacaacattttacttctcatactatttcctccagttgagtatgcttcatttcctttgtattttattattaacagagggaggctcggcttgaacgaaacaagggtcggtcattatttggttgagcagtacagaggaccgatgtgcgataagatgttagtctgaagcacgtgaacggatgacttttatttcctgatgttcctttagcttgtgaagttagaaacagtagagaattctctgcctctccgggttcagtgtgaaatgtaaggtttgagacgataatttactgtttggtcgtgaccaaatttcccaaataaatggtatttccagaacgattgcataatcctggatctttgacccacatattttgctgtatagtcacagaactccccaacacaccatacaatacatgtacagtgccaagcaagactgcgagagggtacagcaattgcttcttccgtagaatatttttgctgaatttatttttcacttccagaatttccctatgtgaatcatatttgcgtagttgcgtttaaccatggaatcaagcgatctgtttcaaatacgcatgctcactagtactccgtttcatattataagttgttcgattttttttcttgatctaagttttcttttaggtttgatgaagtttatagaaaaaatagcaatatctataatatcaaataagttttattaaatttaacattgaatatatttagataatatgtttgttttatattgaaagtgttactatatttttttctctaaaaacttgatcaaacttaaacaaatttaactaaaaaataattaaacgagctataatataaaacagagggaatacaactacaaatcactgtgcacgtggacgtgcggtacaaacgtacacgtagaactcgtttcattggaagccaaggaaatgaaagaaagctgcagcaaattcgtgtgcaaccactcaaaacgggttcaccgaacctactactatgcggatgctgctatacgcatccgtttgcgatgctgttatggcgcgagagagagcgagcaaaccacgtggaagaagtgcatcttctccacgagctccctcgcgtgcctcgccgcgcgccgctccagccgctcgaacagctgcgcgccgcggcgctcgccgatgtgcgcgtccacgagcaccccggccacggccttgcagctgttcgccatggcgcggccgacctccgccgcgtcgtccggccggtccaccaccagcggactccctcccctcaccagctcgagcctgtcgatcgcgaacgcgccgtccgcgcgcacgacgtcgcggaactcctgcaggctcggcgcgtacaccggg

SEQ ID NO: 47355 - DNA, 4579 bp, Oryza sativa
aggtgaacacgtcgatggactcgccggggaagaggcgcccgtagaacgtcccggggacgccggccgcgtggtacggccgcgtcgccgtcgccgcgccttcgcccgcggcgaggcactcctcgaggctgccggccaccggcgcgaggagcggcgggagcagctggaacagcgtgttgaagtcgttgctggggaggtcggagaagaagacctggaactcgggggcgtcgcggccgcgggactcgtacgcctcggagacgcggcggacgatgacgtcgacgatgaagaggctgttgctgccgcaggagcaacccaggtcggccgccgtgaagagcttgtcgctggacgaacgttccatcatcgcgtccagtgtctcctccagaaagtgaagcatgcgccgggcgtgcagagcctatttatagccagtttacagttaaaaactgacgctatcaattcttaacctgtattatagtaactaccatgcatttacttgtacagtaaagtaggactaaatattggatggctagctacatctgatatcttgtgcaggacaaaaacactcgtcgttttgcacacatcttcagaaaatttttgagtttttgtacttgtaaaaaaaattgttgcagtaactgaaagccatattcaatatattaaacacaagtgttagacgattgaaacatccacatgatcatttcatagagcacaagggttcagttcagatcctaactttttctttgctaaatgtatagttaagaggagtggattctaatacctcgaggggatatcctctcgtatacatttttcttccaaattcgatgctaatagttgtgaaaaattctaaaaaaaaaattgataatgtaaagtataatgatacctactagtccaccaaaattcatgttcaaattcgatctacacatcgagaaacaaaaaagacaaatttagatataaacagtacgctactattcatacgctgaatttgtcttttttatatctcgacgtgtgtgagttgagtttggacttttgtgaagttgtatatatgtgttgtatgaatgttgtcaaatttttttagaatttttcataaccgtttagatggtttttgagcaaacgagggaacatcccctcgagcgattagaatagtttccctagttaagatcccagtgattcatttcacaggatttgcccctgctttctgtaaagctcgtgtttggaaacgtcgtacgtacctgagcttgggagttgttgagatagctgccatcgccgttccctcccttcatgcaaagcatgctcgccagcttcttcatccgaggagctgctgctgcagatacagtgacgttctctcccttcattgacgccatggccattgtcatggtgattatggcgacttgtgtgcaaaaacagaattagtcaaacggattagttcttaactcaatgcagaggctctattcagaatagatggatatgggcagtgtgccagtgtggagtggagtgtgaagcatggtggtctccatgcatatttatacaggaagtttaacagttagtttgcttagtctgatcaagtatgggatgatgataagcatattgcatataaaaatggtgctatcagtaatgcgaccttttaacgatattcgaatgcgacaagtgactaacacgcattactttatgcccttgcacaattttcgattaattattaatcagagtccatgtgaccccaaaagtaacggccgattgtcattttgtccagtgaaaaggcaggagatactgattttgttaggtggctaagctatactgtttgtctcattgatgcatgatgcatgcttagctccttagtgtttggttgcaagggtgggatgggttggaacgaacccacttttagaggtgtttagtttagaggtgagtgggatgggttagtcccctggagaagaatatttctctcagatccgggaccaaccgatccagccaaatgtggcggatgaactcgtcccacctgggatgagcgaacggcgtgactcgcccttaggagacggcgggctcgagcgaagcaaacggctcgggcgatggcggcgggctcggcaatggtggcagcgggggcctcggcgatggtggatcccgtggtggggatggcggcggcggattcggcgatggggacgggtgcggcggcagatctggaggcgggggactcggtggcagcggatccgcccgcccgtccgtcgtcgcgctcctacgcccgcctacggggcctaacggcgacgcggccacaggaggcgaatgagagggagagggagccaagggaggagaggaggaggcgcttgccactggcggcggctgcggtggtggagagggaggtcagggcataggcggcgacggcggccatggttgctttgcctgctcacgcctctcctccgccttcttgttgccaggctatagtcgcgctccttcgcccggccggccgtcatcggtggttacaaacggtgtccatcccatccctctctcgtcccttcaaccaaataagaaaaaaactgggatcgtactattctacaaaccaaacacacgagtggaatcatcccaaccctaaaatcaaggatggtttcatcccatcccaaccctaatttcctgtagaagtctgataatcttttgcacatgggagaaaagaaaatgtagcttctaatcacatataagttgtgctcgtcaaaagagtgtaattaaattaatctttgatacgactataataacaaattttcataatgaatagatcatattaaaccttgattcacggtctaatagccggcctagctagcaagctagcgacgacatgaaaacgagcctagtagtgtatgcacaagcctaacatagctaggtcaagtcgttcccggaccccggtgccatgttgtgtagttctacaagtttgaagcccatgctacatgaaactgcgtgcagcttgcatgtgattacttgtactacgatcaagccctgagacctgaatatggcatccaataatatgtgtcgccagattgaccagcaagttagggaatcaaacaaggctcaaaatctgtttgattgaaccaatgacaccaatcacattacgaggcaagatatgtttttgcctgaacgcatcaggatttctatggacaataagcattcggtcggttggtgctcctgcacacctatatatagggaacatggagacattctttatcagcatgggtgactgacatctaattctctatgtacctgtatctttctgccttgactagcatctatttgatgaatcatagcttcgattcgtagcctggcccatttgtctagttctcgttcttttcactcttacagtctcaccatggcagcttaattaattgggttttttgttgttatccaattatatatcatgataagggcttcaagtcacaacagattggtcttgaccaagagaacgctgccttgcacatgcaccttagtaactgatcacttaagaaataaggatcattattggacctagcacacggcgctatataatggatagccatccaatctatctataggctgctaggatcaaattcggaaatctgtagcagcaatcgtatacagtttttaactagttatgtgcatttgttttgaggaattgttcccgcagatgaatagaccagatcatcatgcatactgctaggtggaaggaagagttgagatcagattactgtactatgtcatggtatgcgcatgcgcgttcgggactccagtgtttgtaggggagcatttcgtcgagcagctggtgagcggggagaggtaggggaggaatgacttaccgatgagtcggagagtcggaggtcgaggttaacggcacgcacgaagcggataccctgggagtgctcctccgccgtgcatagcgtggccggcgtggcgagaacgcggcagcggcaccgtctccggcaggagcgcggccgccacatgccgcctccggcggcggcgttctacgctcagagctgaccgtacgatcgcagttagacgggtcagatcggtccggaaaagaagtgccacgagaattttgcaaaagagaccctagcactgtgacttatgcccaaacgtgcaccaaatggtagggatccgattcaggtcgatcttaaaccgtccgatcggagttgggcggatcagatcgatgggagagatcctaaaattgggccttcttgggccgtttctgtttgacacgccgagccccatctcgcctcaagctaatctggaccgcgcaagacatgtcgaacggtcgtaacaggtccgacggggtcggggtttttaactccgaacgccacgttcgtagcaaaaacgccgccaccgcgtcatggctagcctcgccggagcgccgccgcgtgctcgccgtccccagctccccgctccttcctcctctttagccacgacgccactgcacgcaccaacggcagattccagatgaatcttcttccctttggccatcaccttctgacaagtaacaacaatggtggaagaggcaatttcatcgacacattatctaagagcatctccaacagcactatccatcccaccctttaagtcaaaatttagccattctaactaaaaa

SEQ ID NO: 47356 - DNA, 4412 bp, Oryza sativa
gggagaaagaagggagaggctgacatatgggtcccggtgtcatagagtcaaagtagagaggatagatggagagattgttgaagtgaatagctagtttgactagccagccaaattagatggagagttggctatatgggtatttagagagttctatttgtataggttgttggagatgatctaatgtagcccttgtctggactctggagataaaaaaaaaaaagtggatgaataattaattagatgcatcgtgatgtgaaccaagatgtcactatgtcaggaccaagttacctcgttgagatatgaactgcaccttttgagtgcagaagagcccacttcctgcagtgacaaggagactgatctcctggtgtcatctcgacttaaagcatgcattgagctgcatatgtctttgtacttactactaaaaaaatacgctgtctacccacaaacagatcagtttgctctggactgtggatcagtattagccaacattagtgtagtcacagcggattttgactctaacttcagttttgcaggcctcattctgattccatcagacagacggttttgtctactttcagttttgcaagcctcattctgactccatcagacagatggtcttgttttgaggactgatcaccacccgaagcaaacctccattcgcctctgcaccagcaaatcgggatgccatcagcgagttgtgaatttggatacaattctgatcgacatatcgtgagagtaaaacaattctgatatcacgtgacagcgtgagagcaaaacagcaatacagtactgcgtaacatgcgtgagcaactgcataggcccttcgtaggcttcaatttaggtgaccagacataaaaaaaaaggaaaaataaaaataagtttaatttcattttgataattgttggggttctccttatatagaaaatcccctcaaaaaattagagtatgctgctatttgcagcgagcacacggtattctttagtaaaaggcgaaagaatagttcgctctgtgcccactgcgcagctgcctgtttttaaacggcggccttggctcttgttttatactgttcccagtatcgttccgcatccaaggcagcggtatgggactaatcactggttgcgcgactctttcccgtggtgctgtgtgctatccgtggattcgggccaggcaagatacaaaacggcgcagcgtgcatggcccaggcagcccaacgatgctgggctggtgacgccgctgggcaagagagaggaataagttcacttagtgaccctcaaaagtgatcgaaatctaatccgtaaccctaaactacaaaaccggatatctcgaccctcaaactcttaaaaccggtgtaatttgactcccttggcggttttagaggacggttttgctgacgtggcacctatggggcggtattgaccgagtctcctttacacgtggcgttgacatggcgtttaggtggcatttagaattaaaaatatgtgtgggacctatttgtcattgaaacacaaaagaaattgtgggacccacgtgtcccttctctctctcccctccctccagttccttctcctcgccgctccctctctctctcaagcggcgacggcggcggcggcggtgagtagcgaaggtgcgggcatggcgcggccgcctgcgagcggcggaggcgcgggagtggcggcggcaagcactagagcggcgacggctgcggcatcagtacgccagccaggcggtggcaagcaacagccgtcatccgtgacccgacccactggcgaatccactgttggggctggtaggggctccagcccctgctctggctgccaagaatcgaccctagatatctatgcttagtgagtttacactgccagcaaaattgacagcaaaaagcaaagggccaagcagtgatggctctttggctagagaagttcagggtgaaagaaacgatgtgcacgaaaatttaatagatcatttgtaatcattaattatattgtggattatttttactcttgtgttccagtagctgttgcagtctgcagcccatgacctatatatatatcttccaatcaacttgctccctttattctttattccattttctttattctttattccattttctaccctcgcaggattttaaaatattgttgatatagttcaaagatactctcttcatttcatattataagactttctatcattatccacattcatatagatgatatgtctagtttcattaacatctatatgaatatagacaatgctagaaagtcttataatatgaaaggagggagtatatgattattttgtattatgactttaaatataaagcatcacctctattttcatcctagattcgccactgacccgaccaagccgcaccaagcaggatccgcggcgagcaagaggcagtgagcaagcccagcggcgtcgcccttgctggaccacaaggatgttttcttctcaattccaagcttgctctgctacttcgttggatccggcggtcatctacacgcagcggtaggccagtagctgtcgtcttgccaaatctttctgtcccacaaatacactgaatcttgcttgctgcaaatgggaggttttggtggatgcattgcatttggggatctctttcctttgttctctttccttttctcttttttatgcatgcgaatgatttgtccatggaaaggtgaggagtagattttggttttggatgaggggtgatgcaactatgctaagattagttttttttccagtaaatgtgcgagttagcagtaactatttgatgttaatacggatggcgatgaagcgaggaggtggagaaggaggtcgcgtgacggtgggcggcgacggtgacggtggatgacgtcgtgtcaaccgcaccgcgtgtgcctcccgctgtcgccgaccgccgtcctcctgctgctcgcaggccgccgcgccacgtccatgcctccgccgctcgccgcccgccgcgggagagagagagagggagcagcgaggagaaggaactggagggaggggagagagagaaaggacacgtgggtcccacaatttcttttgggtgtcaatgacaaatgggtcctgcatatatttttttaattctaaatgacatctaaacgccacgtcaatgccacgtgtagaggagacccggtcaataccgtcacgtaggcgccacgtcagcaaaatcgcccttcgaaactgccaagggagtcaaattacaccggttttaagagtttgggggttgggatatccggttttatagtttagggtcacggattagattttgattacttttgagagtcgctaagtgaacttattcccaagagagaagtgcaaaatgccaatattttccctcgctcgctagtgggctttgtcgcgtatccaacacatatagaagtctcgagaaaaacagaacgatcatttctccacgcagcgtttctacatcgagtaaaattaatcgaatacagggatgacacgtatgaattcgatagaacagtgttatgtctcatgcgacgaaaggtagccagcaattcccatcctacaacgaacaatacaactactaccacctggtgccatcttgagcacaacgtgctgaacctgaacccctgaagatcgaaggcctgaaccctgtctagatggtacataactacatacaagaaaaatgaagctaaccattatgtgcaactgttcagcgtttacacgtccaaaagaaataacacagagaagcccgattggaacgccaactctctaattccccaagaatcatagcgagaatattggaagattgagaagatacgtaaaacgagatgggccattagcgtatattgatataatattaattattttaaactttaaaaatggattcacattatctaatctagaagttgtcaattcacatccacaaaggctgtgttttgttcacatcaaaattagaagtttggttgaaattggaacagtgtgacggaaaagttggaagtttgtgtgtaggaaagttttgatctgatgaaaaagttgaaagtttgaaaaaaaaactttgtaactaaacacggcgaaaactggatgaaaaattagttgtacgcattgacttacacatgccaagatggaccaagctacctcattgaaatgtgaactgcaatcatctttccagagagagagagaagtgaactgcagctgtaggttgcagaagagccctgctacttggacacaggagaaacctgtgttgctatcttaactgaagcattgagctgcaaatttcagagtactaaaacctacaaccaatcaaatcggtttgctctagacctgtatgaaccagtatagcgaatacgtgtgaagtcacagcagattctgattctgattttagttttgcaacgtctctcattgcggttctatggaacagatcgccagcagcacatcggatt

SEQ ID NO: 47357 - DNA, 3417 bp, Oryza sativa
  unsure (1)..(3417): unsure at all n locations
agtgttctgcgcccaaagcagcggtatggtactaatcgcttctacctgccacgagagctcttcctcatattccgccacacaattttgggcctcgtttcggccgactgaagtgggccttgcccccactccgcctcaagataatgggcctccgtttagttggcgatgaagcccctgaataattttcggttaatctggggcgcagaagcctgatcgaacggtcgttagagatccaagggggctcggagtttaaaactccgactcccacactcgtctcaagaacgccgccacctcctcacggcgtgcctcgccggagcgccgccgcatcctggctgtcacttgcttcccgctccttcttcctccaagactcccggatgtcacacgcatccaagtatccaacaatcctggcagccttaggtgattgaccatcaccttctcctgacaacgatggggaagaagcgaatttgttagctcattgtccaatctagaactcgtctagagattcattcaccttcacaaaactggatgaacaactagttatatactcaacaaccgagaagccaggtccaagctacctcgttgagatgtgaactgaagcctagtgttggtgcagaagagccctgttcctgggggctggggcaaaggatacctcttgctgtcatctcagctaaagcatgcaaatcttggtggtgtttgaatgttctaaaaatgaagataaagattaagtatttcacgtaaaataaggtgttaataacatgttattaattgagttttaattattacaaacttgaaaaatggattaatctgatattttagaacaactttcatatagaaatttttcgcacgaaacacaccctttaaccgtttgaaaaacatgtcattttaatccaaaagtttatctcccaaaacgagtagggccgacagccgtccagagtactcaaagaacagatcagtttgctgaagtgtttttagcgtaacgtcacaaaggattctatcagcaacttgtggattttgacgaagtaaacaactgtatataagatggagaaagagtgtaagacgtcaattctctatttcatacataattgttgaggtttctccttagacaggaaaccccttgaaaaaaaatatcaaatttctatttcaaaattgttggggtttgtccttagataggaaatcccctcaaaaaattagagtatgctgctatttgcagcgtgcacacggtattctttagtaaaaggcgaaagaatagttcgctttgtgcccactgcgcagctgcctgcttctcaacggctgcctcggcacttcttttatactgtttgagggaagtattctgcacccaaagcagcggtatggtactaatcggtggctgctctgctacctttgccatcagcggcgatgggccaatatgggtgaagacattcactgccaggtagcccactggtgctgggccggatgacggatgttcaggcaaagctcatctgcgttcaaacataacagaaggatcatttctctagcatttctgcatcgagtaaaatcaagcgaatacaagttcgtccacacataaattcaacagaacattagaatggtgtcttgtacagagtaacaaagaagatacatggaatacaatacaacttcccgccccaaaatatcatctgcaccgcacaaagactgatcgaaacgtggtttttcttgataagcccccccccccccccccattcacagcaaggacgccgccagcgcatcatggcgtgcctcgccggcgcgccgcgcgcaccctggccgtcacttgcttcccgctcattactcatccaagcctcccgtctgtcatgggctcacggcgccgccgcacgcaacaataaactcggcagcgttgagcttgaaggtcaatcgtctcccctttggtcatcaccaccttctcttgccaacactatctaatctataaatcgtctagagatcaattcaccttcacaaatttggatgaacaactcgttatatgcatcgcttacctatgtcgagatcagatgtcaggaccaatctacctcattgagatatgaactgcagctgcactgtagagtagagtgcagaagagccctgttcctgggacaaaggaactctcctgttgtcatccaaactaaaatcatataaaggagctctcctgggacaaaggagctgctttcggttcaggggtgctaggccagagaggtcaaatcacggtgaaaatcatataaattagaaggtctaatttcaatttcagaattgttggggttctccaaatgctggaaatcccctcaaaaaattagagtatgctgctatttgcagcgagcacacggtattctttagtaaaaggcgaaagaatagttcgctttgtgcccactgcgcagctgcctgcctttcaacagctgccttggcacttgttttatactgttccgggagagcgttctgcatccgaatcagcggtatggtactaatcgctggtttctgtggctatggcttatgtatgggccagtgaagaaaacggcatggcctgacgcagcccagacgtgctgggccgggtaagcacacctgtggaagtcactgggtggaatagttcacgcctacgcctgtttggtagagctccaactgccagctccgcttattttgtgagagagctctacctagcttcgctcctattttagatgaagctgaaactctgagatgtaccaaacaggcccttcatctggcctctgggtatccaacaagaatgaataaatggatttctcaagacaccagagcgatcatgtagtcacgtggcgtctccgtatgagtaaaaatgcaagatcaatcaagtgcaaattcatccacatctacaactcaatagatttggccagcaagtcgcgcatacaacgaacaactaccaagtgtcgtcttgaacatacaataaaaattcgtgacggctgctgaactcctgaagacctcaacctcatctagatgatacacccaataaaagtgaagctaatcactatgtgtaactgttaagtgtttacatatccaaaaagaataacacatagaagcctgattggagcgccaactcagtaattccatgagaatctaaggtacacaaactactagttttcctattgaaccgtgttcaggaaaagagcctccgagaccaagtggcggcgggcgctggttgtaccgtcgccgctgccactgctttataggtgaggttcgctgccttttctttggcctccattattcttgcacccttgggatcggccaaaagggacttctgaaaggattgtggaaaccctgtggcaatgatcgtcacatgaatctcaccagtgtaccggtcatcaacaacagccccgaaaattatatttgcagaaggatcggcnnnnnnnnnnnnnnnnnnnnnnnnnnnnnnnnnnnnnnnnnnnnnnn

SEQ ID NO: 47358 - DNA, 30274 bp, Oryza sativa
aaactgtgatctgcagtacataaggaagacagggatcagagcaattcaatataagtccatgcaattcatatgcttatcaccttgtaattagtttttttaataatggtaatggtttacatatctggcttctgcctacaagcacacaaccaatgtgttttagaattgaaaatgaaaggaaaaaaaagagtgatgggacaagttcccaactcctctaaaaagatgattaccagaattaaaagctctataggtgctattccatccaaaatggtacaaaagactcttagctaccaatttcaacagtgtagcaccactgtacatagtattccgcttctcctgtgatagcatcaaacactaagtatagaaccaaccggtagacattaagataacatgtataggattagccattttttattataaaaactttatcatttcaacatcgccaaattaattaacatagagcattggtcccaaataaaccttttcttcggtacctgggcacccccataagcgaaaatataattagttagttttcaaacagatgatgaattaaaaatctaaaattaatccccttaataaaagaagggaaggcaaatgggaccatgctatttttcccagagtacagctaggagtactagatcactactactgcaagtgcaaatgcaattatgcaatgcaacataaattagctcatgacagagagtgtcatgaatatatatgatcatgcaggggagggttgcaaattgctatgacttggtaatttgataggagcagagcaactagagaggtcccacatggcagggagtagtgggcactgaacatgttgatatgatacagctaggtagggttcaatgggccatacatatactctgaaacacaagtgtgagattgagaatgagtgagagggttggatgttgatggaataaaaccttgtggcccccaatgattgagatgcactaccatttgctcaaccaaacagatcagtaagcaaggcatgcatctgcatatagcagctgaacagcattattttcccttcaaaatacggttattatattaattacatgtgtacctagtcatatgcataaactcgacgtcctgatcagctatgtgctttcatctctgaagcatgcagtctactccagcttgcagttgcagaagatctcagtgccatgctgctagcaagctacgccgtgtttagttccaaaataattcttcaaacttccaactttttcatcacattaaaacttttctacactcacaaacttccaacttttccgtcacatcgttccaatttcaaccaaacttccaattttagtgtgaactaaacacagccctaattgcaggggtcctgagcaaatatatgaaatgcaggagtggtggtgatctgtgctgtgtctcttgattgaagctgtggtcctagctaagataatcttcattcttcagctagctgtagacatgcatgcagtggcaaatttaacttcctaggaaattactgagcagaacatgcatgcagtgcccctgcttgatgagcttgcatgtatagtgttaagaaaaaaaatgatgacaaattaatcaaaatgggtcagattctgaataaatctagagctgatgagcggttagatgtatggaagtgcaacactctcagcaagttgatcagcattacattgcccaacccttagagccttggaaaattaaatgtgcttctatttttcataggacgaagtatatatgtttgtttggatgtccctgttcttttgtagaaatagatggattaacgggcacgtccataaagctcttaaatggcacggcttttttaagagaaaaatggcacgatttttacaacagaaaaactttttatatgttaatttcttaattaaaatattattttaaatctattttcaactttataacaattaattcattcatttataccctaaaatgctgatactagacatatataccaaacatatataccatcccttttgcatctccaaaactttgtgtttcccggtatatcaacatcagtacatacatagattttcctagttagttgtatctcttgtgatttaacttttaagtacatatatgtgatggcatgattttgaatgaatttaagtatgtgaaaatgcaaatgcaactactccatctatttcatgttacaaatcatttgactttttttcttagtctttaggtttgatcaagtttatagaaaaaaataacatctacaataccaaaatagttatattaaatttaacactaaatatattttgataatatatatgttttgtacttaaaaattattagcatatttttttacaaatctaaactaacttaaaaaagtttgacttaaaggctatgttcggcagtcacggttggaaactaatccttggtgcacgtaaaatggaacagctcattagcatatgattaatttaatattaactattttttaaaaataaattaatataatttctaaaataatttttgtatagaaaacttttataaaaaatatatcatttaatagcttgaaaaatgtgcgcataaaaagaagagagatgaactgggaaaggagagggaataactgagcaagtactctacaactgagcgtgtgcagccgcagtagtgacgggggagatgaaagtactccatccgtcccaaaaagacttaattcttggatttccatatccaatgtttgaccgttcgtcttatataatttttttttatgattagtatttttattattgttggatgataaaacatgaataatgcattatgcatgatttatctgtttattttttttatatattttttaaaataagacggatggtcaaacgttaaacacagaaatataggaattgagttttttttaacggagggagtaggcagcatcgcggctatttagactgacgggtgggcccagccgactcattcgtttccccgaaacgtgcacgtgtgtagtgtgaacccgtcctccccacctaacctaggccaccactgactccactcccatctccatcaaggcatctgcccgagccttccgcttccgaccgtttataaaccccaagcgcagcgatcgagagcgaccgctccgaccgccgccgccgccgccgctctcaggtgatcctctcctctcctctcctctccgctcgtctcttccccctcccgtcaccgccgccgccgccgcaggctagctcgatctagctttcgatcgatcgaccaccagccggcgcacggcgacgacgtgcgtacgtacgtcgaagccacacgccgcggggcggcgccgccggccgtacgtcgcagcgaagctaggcgggcgtcacggctgcttgctgctgtgtccgatccccgccgcagtcgatcgatcgatcgccggcggtgaggtcgtcgtcgttgccagctggtgccacaccggccggggcgccatcgatctgatcgagacgatcgaaaccctagctagctccatatagccgtagcatcgccggatctgtggttggttgccgggtatacgttgaggatgagtttttttactttttttttgtttttgatgcaacaaatcaacaaatggaggtgcatcgatctcatttttacgatgagttgtagtatatatacataactagtacggactatggagtaggctagtatatatgggtgaactaagaattataggcgttatgcgcaaactagtttgatttcacgcgtgtgcgaggttatttgaaagggtgattttactatccttgaaaaaaataaacccaggagatactgcatttcataaatttgataccacaaagtaataagtatcttaaatactgtaaaattgatctatttgaaatagaatcgtacctttatgtgtctctaaaggttcatacgagggacggactacgtaatagttgacagagagtaaattgaaatcttagacaccttagatatagaatcatagataacgacaaaaagttaacgatgccatcgattgggagttacgaaaaatattaatcatctgacacgtagcaatcctgttaatacaatttgtatttgctatatatatgttgtagctatcattctatgccgctctaataaatatgcttccattccatcatgatggacacatatatctctcttttctctctgatcaacggttggtgggtgataacagggcatatatgctggacctttttgtggctttcaaaaattatattctgccatttatttaactcaacgtgaaaaatatttatgcgcgctgcatgtgaaggggaataattgatgtggaatttaactcgagtaattcaataatatctaggtttattttgggatgcgatcggacccttataaggtgcgatgagattcctatgacgtctcttgcgtgggccattgtgaacctgttggttatgtggctaacatatgagctaagttagaggattcagttcttataagggtaattttaccattctagtgtaaaattcgatatctctagatactgagtatcttgaggtaccaaaaaaatttagtttaaaatttaggtagctcagatacttttttttaagaactataaaatttctcttcttataatatgacctttatgcagctgatgactcatggagttaactgttccttgcaggtttagtagggttttaagtttcgatggcaccctcatcccgtcgaaaattccgtcggaagaaaccttcacaaaaggtcgactccataggccttcagacaccgcgctcttcggccttggaaaaccaagaacccttgctgagttctgaatattcaggacacaattctgccatacagaatgtcagttccagatcacagacattgcctcttctctagcaattgctatgaaaatagatgatgagtagtttatcaccatcgatgacgcctctaatttgcatctcatttttcattctcagatccctgaagatttgaccgtctgggatgttgtcaaaggcgacgtcgccattgttgccagcaaaatgaaatccatgacagagcggctgctggaagaactcaagatcgcgctccggttgctcatggaggacatcgatgatcagagccatgtagagcaactcgttcgtcttcagaagcatgtcgaaatcaggcctgacctgacatcggcaacgcttctgacggctcaccatgtgcagttggagatgtttgttgccctcaagatggggatcccggcatatctgcacgaaaatgtcagcgtgccacggagccgtctcgcggagatcttcgcctacgagagatgcaagaacatctcctgccagagtgttctcccagctgaggagtgcgactgcgatgtctgctgctgcaggagaggcttctgcaacctctgcatgtgtgtggtctgcaacgggttcgatttcgatgtcaacacatgccgctggattgggtgtgacggctgctctcactggacccacgctggctgcgcaattcgtgaggagcagatcaagactgtgattacggttgaagatggagttgcccactatgtgacagtgttcttctgcaaggcctgccatgggacatctgagctgctggggtgggtcaggaatgtgttccagcattgtgccaagatctggggcacggatgcgttggcgcgagagctcgagtatgttcaggaggtgttcagtgttagcgaggattcgaaagggaagaaattgttcgagaaatgtactgatctgatcgaaagactgaaggttgttcaagctgaatcgatgggtcctgaagttctgcttcaggcgctccaaggtatgtgtactaatttttgtcttctcatcttattattatgctgatttactcagtgcttgtgtttggttcttagcactgactatgttacggaatctatgctttactttttctttatttatagaaggatcatcacataatcagatagaattatcctgatgtgatgggtaattgatttcatttctaacttttttttaggagacatttccaacttttccaattgaaagcaattgcatatcttcaattgtaagctgattgattgtccactgcagtttagttttatgcatactgttttacttgtcagaacagctacagttttgaagccaattttttacaaattaaaaatatgtggggcattggaatcaacaacaatatgtttgatggctatttctcatgattgaatgaaattccagaaagtttatcttctaacgtgtcatatgcttactgtcattgatatctgacatggaattaaattaaatttgagctattacacactgacattttccatatttcccagagattgagctagatgatgctccagagatcactgaaaacgaaaaacaggtgcagcagaacactgatccccatgaaacctgcaacaatcaactctctgaatatgtccaagaaactgcaatgacgaacaagaaggttcgcctctctgtcgatgccatcaccgacggcgaggtggagaaggccaaggaggccgagcagcagctgcagcccatggcggcggagcaggaggaggtcccgccaccgccggcgagcagcagcggcggcgtggcggcgccgacgacgcagaacgcgatgctgtgcaagatactcgacgcgctgagcggcatgccgtcgccgccgtcgtccgagtccgccgccgcggtgtccaaggtgcatgagctgctgcgcgaggccctgagcatgccgcgcagctccggccgcgccaccgccgccgccgtcgacgacgacgacgtggcgcagaacgggagagacagaaatgacggcgacgacccgcggcagatgatgatgctgaaggagatctatgacatggtgatcggcatgacgaagacgatgacgaaatgatcatccgacgaacatgtttgtcacctcacatgtgtgtgatcagtgatccagatccattgctagctcgatccatccatccatccatgcatgaatggtaaccaatctctctgcactctgcaccgtgaacacaaaaaacattcagaatccatggtaaaatggtaagtggatctgtgtagtgttttaccaaatttacctgtatgtactgcagccagggtttgaagtttcgaaattaggatttctactgcatgtgggcgatagaaccgaaatttcagatttttttcgtacgatttttttaaaaattttgactgattttgaatgtatttgaataaaatctgaccaaattcacaaaaatttgcaaaaaactaaaagtttgggggtgagatatgagcatttcggtgaccgaaatttcaaaccttgactgcagctcatcgatcagccaaacacccaaccttgtttttttttagtatttttttactgttttactgatattgcattagttagttgttcaattgttgtattagagagatttatccatgtcgagataaggtgagctggatgcatgcacgggtgcgtgcccgtgggcgctgtcacgggtgcgccgtgcgcgcgctggcgtgcgcgtgcacggccggtcgatcgctcgaccgcgacagatcgcgacgccgggagcgcgcccggcgcgccgcggcgacgtggatctggtcggcggcgtggcgtgccaaagtcgtcgccgtgaacaagtcaacgggggcatcgtggaaacgaagacacaggaggaggaagagcacgccaagtcaaaacctgacagctcaatctaatacctcgtcagtgcaccatgcccatgaatcgaggcctgtatgcacgaatctcgaggggatttggacggatgggatcatcccggtgcagggatcggggtcgtggactcggaccacacctccctcccacggttggttcacgcgggagaagagagagggagagagcgcgcgaatttttctataaaagcccctctgcttgtcccaaatcaccacgcctcaacagctgctgcttcaactctctctctctctctctctttctccggcgagatcaccggcggcggcaggccacgcgacccgcggagatggtaagcgagcctgaatccctcaacacttctcttggaggcgtactactgtagctccctctcctgttgggtggaagggcgcgggtacggatcgggatctgggtgaggaaagggtctcgcctttatcgtcgagttgaggaaaaattttggtacaaagagatgctggctttcgcggatccgtgcggttgatgtgttgctttcgccagatctggtggttttttcgggtattctgttgatgtttgattgctggggttacagaatttgttgagatttgtagtcgagataggcagttttttttttctttttgtgaatcagtcttaaattggagtagtgattagcaaatattttctttccattctccaattgatccttcctttgtgaaaaatagagcagtagttagttctgattgtttctgacagacataattaatacttaaaatttaaaatttataagcttctatgttcttgtattctagtgtcgatatcgatgattctccagttagaaattatttttaggttacataacagaatagctttcgtacttgagtttggagtggtaatcattaggagcatggttaggcatgttagtatcatcaaggattggtcttagcctcttacgtagagcgaggtaaattgcataggttctttagcaaaatatgggtgatccatgtttgacttgtggttttaacaatgttcactgggaaagtagggaggcatctacccattgaatatggcttttttacatttaacaactaaaataatccaaagagtcagtctgagtcagagttgacttggtctagaaaggaaccgtgtttcaaaaacctgtagttgcaacttgttatctgattcatggtaggtttttatacactatttgggagttgaaagtgcttcttgtggaatattctgaatggtgtctgaaccgccgttgcatggtttaagttgtgcttttaggagaggtgtaggtcaaggttaagttttgccaacttttatgtctacctttttttttgcactaagctgcattgcaaccaatgttctggtttccattattttaattttacaacttttaggcataaatcggatataggaagaatagtgaatatttgatgtttaaagtaatgaatagtaatatctaaactggtagctgagcagcatttggttcagttagagcatgatgtgatacagattttgcacttttctggattatgacttggcatagtaaggtccattaactacttataaattctataaaaaagtgatcttctctttctttgatggaccatgagtggtctccaacttgttagtacatggatctgccatttttttacacctggcagatgtaaagtagttagaaaactgagtatgaatatttgtgtatgctgaatggttgggttgttttgcacgaccagactacttcaaggcgccttgctgacaggaagactgcaaagttccagaagaatatcaccaagaggggttcagtgcctgaaactactgtgaagaaggggaacgactatccagttggacctcttgtgcttggattcttcatatttgtggtcattggatcatgtatgccttccaaccttatctttatcctctgttgattttatttcactgacacttgtgctgtgttactttagaatgcgctgatgcatagcttattattgtctcttcttttgctttcaaaagataatgacaaatgaattccatcacattagctttaagtcttcatgacaaagcactcttaggttttgaattgatactagaggaattaaaatgctgagtgtcactctgctacaaattcatgataacctaatgaaatagagctggctatgtcactagaaatttaagactgctattgtgcgtgttttatgagtgatttggtgaattcttaattagttattacaactcaaattctaggttatttttatctctgttgtatactataccaacaaatctagctcttcagtgcatgcaagtaggtcatgttttgatcttctgttgtgtagccatgcaactttcttgcctatctatatggaacttacagttcggatgttctctaggccaccttgctatgtttcttctgctattattgcgcttttaacaccatacatttttgtgcatctgcagctttgtttcagataatcaggacagcaactagcggcgggatggcctaaaaacagagctgattcaagagatttgtgatacattgcatccaatgcaagtggcagcggcagctaaaatgtttggtgttgtcagtgttttgtatgcatttacatttctgaagcatcgagttgaagtacaatgtaacagaattacctgtcttacaatgttgaatggattagtataatattataccgttcatctccagttaacatctgctgttggaaaaggtccctgcttgtgcttgtgaattttgtcggtctggaattatgaattgctggacatgcagacctcatcttgttatcttcatgcgagcaaattgtatgcaaagaagtatgttgattcactgccattctcatcagcttaattgacagacaaacaaaagataaccataagcaagcaccgtcagcactaggcactattatatcaaagagagtgatttgatcgtttcaccttgaactctatgctatggttaatattatttagtttggataagaaccaaccaacagatctaacactgcagtttacttgctctaaacctttgtgagtatcatgttcagtttcttcagagtattcttgcttttaacactatacactttttacttctccgcagttctttttatttcacataatcaggcatggattagatatatcttattttcaagagattttcacataatatatgtattaactgtcatgaaatactgaatttcagctaatgtctgaagaactgtaaacagaattactagtcttacaatgtgatttgtgaatttgtcactccacatatttcagatcaacaaagaaacatttgacaagaggttgaaacttcatcagcatgaacaagtgaagcaacaaagtcacttgtggagtccttgtcaggaaggaccctcatgttaggtggtaataatcactgccattctcaccaggtagctaactgacaaaaagaaagctactaatcatgctaccctcactgataatcactgtcattctcatgactaatcaactccactaaggcactaactcaccactaatcttgcaaacttcgtatctcacttggctttgcatgcttgtcaccatcttcagagctgttcattctgatcacctgctgccacctgaagattggaacaagaacaacatctgcttcttagtagttgtttcgatcatattatacgctgttaatcttggtgatttttattttgtagagaatttcgtacgacagagatcgttctgtcctcatcggcggcggcgggcgacgcgccatggcgagcggtggcgacgacgcggcagcgccgctcctcgcctcgaagcacggcggcgagcctcgccggaacacgttcgcgttcgcctgcgccacgctcgcctccatgaccaccatcctcatgggctacagtacgtctccgagcttgctgcttcgagtgtcgcgtcgtggcacgcgatcatgccgtcgccgtcgttgatgtcgtcttgctgtttcttgtagatctcgcgctgatgagcggagccgagctgttcatccgggaggacctggggctcgccgacgagcaggtggaggtgctgtccgggtcgatgaacgtgttcatgctcgcgtccatcctcgccgccggcacggtggcggacgccgccggccgccgcggcacgctcgtgctggcgaacgcgctgctcatggccggcgcgctcgccatgtcgctgggcggcagctacgcggcgctcatggcggcgcgcttcgtcaccagcgtcggcgtcgggttcgccgtcgtcgtggcgccggtgtacgccgtcgagatctccccggcgtcctcgcgcggggtgctgtcctccctgccggagatattcatcaacgccgggatcctcctcagctacgtctccaactacgccctcgccggcctcccgctgcgcctcggctggcgcgtcatgttcgccgcgggcgtcgtgccgcccgtgttcctcgccgcgggcgtgctcgccatgccggagtcgccccggtggctcgccatgcgcgggcgcgacgccgaggcgcgcgccgtctcgcgcgcacctcggatacccccgcggaggcggacctccgcctcgaggagatcacgcgggccgtcgcggcgcaggccggcgtggccggcggcgtctggaggcagctgctcgtccggccaacgccgacggtgcggcggatcatgaccaacgtgctgtccctccacttcttccagcaagcgtccggcatcgacgtcatcgtgctctacagcccgctggtgttcaagcaggccggcatggcgtcgaacacctccgtgctggccgccaccgtcgccgtgggcgtcgtcaagacgtgctccatcctcgtcgccacgctcctctccgaccgcgtcggccgccgcccgctgctgctgtggagcgcggcggggatggccgtggcgctggcctcgctggcgctgacgctctgcgtcggcgccggcgcgccgtccccggcgcgcgcggcggcgggcgtggcgtcggcggcggcgtacgtggcggcgttctcggtggggctcgggccgctggcgccgtcgtacggcagcgagatcatgccgctgtggctgcgggcgcagggcgcgggcgtcggcgtggcggtgaaccgggtgacgtgcggcgtgctgagcatgacgttcatctcggtcgccggcggcatcaccatggccgggtgcttcttcgtgtacgctggcgcggcggtggcggcgtgggtgttcgtgtacgtgcggctgccggagacgaggggccggagcttggaggacatggacgtgctcttcaccaagtgaagatggctttatttgggcgatctcggccgtgtttctttcttggcctagcggccggtccggtgctagccttttcctagttctatgcgttggcgctgtcgatgtgtgggtaatgatatattttttttcctagttacgacctttcaattttttctccctctatcaatagaatttcgcactgtcttatgtgagtcattaaaaaaataaagatggctttatttgtggtattattggttgtgttgctacgattgtccgcagttctaacttgaaagagatgaagaaatcatttctaggcagtagaaggacaaaatggaaatgttaagcttggaaatattaatgtaataatctccatgatggtagactcagaagtactttcttgaatgtagactcaaaactcagaagtgcactcagttcaccatgaacaatgacaataccgaaagataatagaacgaaacataccgaaagatacttatttttttttaataatagaacgaaacatttcagcctttactcaagagttacagctaattagtaccgaaagatactagctagctacctgaaattaaccgtaatcaatatcaagatcattgtctttaccataattcaagagtacacaaattaacaatgttacgatgatgtattgacatggttaattatggttcaagagtcccatgtcctaactgaatattagaatatgtaaacaatgtctacatgtagcatttcttggggatcaggagcggtccacagattaaacttgaaagagtgaatgaggagaataaatcatttccatgcattgctacctatacgggcccctttgaatcgcagggtagaaaagaacagaggaatagaaaaaatacaagattctgacagaaattgaagtgtaaaacataggattgcaaaacacaggaaaaacaaatgaatggtcgtttgattggagcgcaggaaaaacataggaatcggatgagagagatagacaaaggaaattttctaagaggttggagctcttactaaattttctccaaaatccacatgcaatgtgccattccataggaatttcataggatttggaaagcttcaatcctttgaatcaaagggccaaataggaaaatttcctataggatttaaatcctatgaaatttctacgtaaatcttttgattcaaagtggcactacatatggtgcaattaaagggatattatcctacatgtcaagccatccatgcaacctgccgatcagttaaacagacaggccggccggcaaaaggacacagaaattacgcaggaagtaatggaatattcatccaatcgaccatcttcataaagcattcaggagtaccagaaagttcacaaatacatacattcagtttctcatatataggtgataccatcatacttaagataaaaacaaggatcaatgacgatatacacaaccagatatgtaccaaaagatacttcctccatttcatatcataagactttctagcattacccatattcatatatgaatctaaacatatatgtgcctagattcattagcatctatatgaatgtggacaatgctataaagtcttatagcctgaaattgaaatggaggtagtaatagctaagctacttcaaaccgcaatcaactaattaactgatcaccacattactcgcagtacactacagtagtaggaactgatcatcacattactagtagtagactgatagaagaaataagatatgattcaaccaaattaaggtgatcgactgtagttaccacgcatagttaatcagagtagtatagtcatcatctaacagatcgatcagcataacggccgtagacttggttaattataatagtagtagtaatcgtagtaatcatcctcttcactgggcggcagcttgagcgtcctgatcctcgcgcacttggcaagcagctgggcgtcgtcgtcgacacacaaatcccagcagctgcacacatcgagaagctccaggcgagggcagccatcgacgatggccgtgagctcgtcgttgctgacgccgatgccctggacagtgagccgccgcaggtggcgcagctccgccaccgcgagcgcgagccgcggcagcgggggacggcgatggccgccgctgctgaggacgatctcctctaggagagggcacttcctcgtcagctcggcgaatccttccgtggacatcctggtttcgtcggagcaccaaacggaaataaccttcagagaaggcgacctgtacttgcaaagttgcaagtttgtaaattagatgaataccgctgcgggaaattaagttgtataatatatacaaataagatgaagtatgaatattaaaactaaaaaaattgatacttatgaattttgaggcctaaaaatgattaaaattacttggtgttatgagagaagaaaaaaagagacaatttgaaccatagatctatcatccaatggctagaaataattggggtgacgtggcttcatgagagaagagataaatagcattaactacacttagtggggatgaactatataagtatattggattaaaagcatttttttattagcatcgatatatatctcgcctgttgtgagtggttcaattataagctgatcgattggcgcaggctcatgctttgaaatttcggcctccaccgactaacacaaatctccccgaaattttcgggttttttcaaatgtgtaaatttggtcaaaatttattcatattcagtcaaaatatgttaaaaattttaaataatcttaatccgaaaaacccaaaaatcacgaaaattttaaatttccggcaaccaccaaattttcggtggcaactgaaattgcaaaccctagcgcgcgcagaggccaaaactttttttttaaagaaaaaaacacttcacggtgctagtatattactcctatatacggctagtacgagtgattcgggatataaattaatttatcttcccacttaaatggtttataatttaaaactgtaaaattattatgtattagcatatagtgttcttttttttaacagtatatgctaccgatacattatactccatccgtcccaaaatatagcaacattatatcacatcaagtataaggttgtaatattttgggacgaagtgagtaatgtacttatatagttatataggcttctataaaattaaaaaaaatacttacctgtctccaatatactcgagcagctcatcgctaacaaaatcctcccccttgaacacctcgagccggccgccggagcggtcgacggcgaccttcgccatggcgcacatcaggtccctgtcctgcccgaggtggaggcaccggaccgcgccgcgcagcatgtccacggctcgccacagctcgggcaccctcgccgcgtcgagccacgagcggcacgcgaggcccgcgccggcgaggacctcgacggcgcccaccttggcgaacaccaccgacagcacgtccgccggcagctccgaccagtccctccccgccggcgccgtcgtctccggcgccggcaacggcggcaggaggaggacatccattgttgttattcgttggtggctgaaaacaaaaatggatagttagatatatgcatgtatgtgtttgccattgatttgatttgatttgatggtcagattgggatgagaagttggaaacttgtagtgttataatccatgcattacctttgctgatggtgaagaagaacacagtgcagttcttgcgctgatgtgaggacggccggcgagatttataggagagatatggggatggagattgatcgttttttttttttcatctcggtgcaaatgcaaacctcgcgttctacgccggtggcattgatgaggcgctggaattcaggcgcgagtgcgattggctaaagtgagcggcagctactagtagcaagcaagcaaccaacatgctgtgcgacgcgacagtgtgcgtatttactccctccttccattactcttcagattataagttatttaaactttaattaaagttaaattgctttaaatttaatttgtaaaaaaaaagtagtaatagggcctcatcagcaagctagtatatccttagggcacccacaatagttatctataagctctctacaagagatccatgtcagcatattttcctacttggaatatattaaatgaagagagagagcaaagctatctactaacttagagatagtctatagagaaaaacgaggcaatgtatgagagagctatagatacccatgtagacatactattgaggtggtttaatattaatctagtctattgttgagatgtacatgttttatagagaacaccttactttaccattgcgggtgctcttaggctgatcagccaaataagcctttttcaattcaggcaaatccattgcattgattggcttaattagttaattggctggacatacaagggatcttctatttgtgtgtttagttcacactaaaattagaagtttggttgaaattggaacgatgtgatggaaaagttagaagtttgttagtattgggatttttattttttgtgcatggccactagagagttcacataattagccttcactgatgatccaacttccttacgggtctcactctgtttggctgaaaagcttcggcccaagcctcagccaaacaagccagacacaaatatattataaaaatatatttaattatagatttaataaaattaatttggtattataaatattatattatatttgcctataatcttaatcaatcttatagtagtttgactttgatcaaaatgtttgtttctgtggttcgctcatataatattagactacttaggccccgttctaaagtggcgggttaatatgatgttaccatccaatgcactattcacacagctaccaactaaagtggcaagttaatgtgctgctatctactccatccattccaaaaaaaaattcaatcctaggtttaaatttggacgtacattatgtctagatcaacccaggattggttttttctgacagagggagtattatttagactgctaccaattcagctcaacgtagccaaatctgcgcattagaatggagcctaaaataaatgtttgcttccaagtccaacccaactagtcagcttcctcttctttcatgttaacaaacaaagcccgaatccctatcaaccaccttactttcttttccatgggatttttgttgagcccgcagcttccataattgaattgggcctcagctcatcccatcaactggtttttgctggtccaaccaatccagtttaattaaaaaccggttcaattgatttttattcctgttcgattgcacacacgtttattttagttaaccagataggccaaggccattttgtaggttttttaggtaggaccatcggtacgatcctaataagtactatgaaatttgtaagattcaaattatataagaaaattttcatatatgaccatttggaacaaaggattaattgtggcttttggagggggagagagagagtgtgtgagtgagaaaggttagtgagacatgtaaaaaaaaatgaatctattgaatctgacagtggctaactagaggatggcttatgggatgccattatatagggattcaaagtttagattttggttgaaattgaagatgatgtgagtgaaaagttgtatgtatatgataggttgatgtgatggaaaaggactgaagtttggatccaaattttggatctaaacacatccattgttggtctttaaaaaaccaggacttgtaccatccaacttctatgcttggatcgtcctacatgaacaacagatgaacatgcagcaggtagcatctttaatctgcagcactcgtgttaggtgataaccaattgtcattacacgagaaaaaaagcagaggacaaaaacaaaagctaaccactggtttagtacacatctgatgataatctcactaacaagtgatcgacaagacaaccaagtgattggccttcatggtcgtcgccttgcaaacagacatatctcacctcgacattgtccgtgtggatctgttagcatcatggaatcgatctacctgcatctctgatctgagatactttttgctcgtgtagagatcgccggttcaaacgttttcttccggtaagtttggatgggtgatttccttcaactttacataaaacatgagaattttggaataatttttttttggttgagtggaagataagaattatagatagtattgatgtacatgtggcctcagaaaataaaaggttctaatgtttttttttagaccttgaaaactgcttgggctttgcctatgtaatgaaataataccctctttagccaaaagaacaagttgttttatatcccaaaaaacaagttgttttaaattatgtgcaattacacgagttaactttgagcataaataggattttggtatatgaaaatggcaaaaagaaaaatcgccaacacgcaaaagtcttaggggaaggtgagagatatgacacgcaagaacttgctaaaccaggtgtgactcctaaggggaagatgagagatgtgaaactaagccaagctatgtgcctaataacaacccgataggattggccatggtctcaacccattgccttccttcttgcccaattcactccaccatactgttggcacctatgatagaacattgtcgaagacgcgggtgttcctttattttcataagtgctaggcaacatgagtgcaagggagtcgaaacctcttcctgtcttgcttgtgcaggcgacatcgcgaggtttgccaccaatcttggagcatcaataaacatagtttccatagcattacacttttgtaactattattgttttgaaaaaattataccaaagaactatatgcagccaaaactgtataatctgactttgaaaaatccaaaaacggttttactttttaccgaaggaagcatatacaattgaaatactttccttagaaacatatacttgagtaacctccattttaaataatcaataggtgatatttatattcaacatacctccaataattttaaccaccataaaacacctcaaaacaaactggttgttccccgggaaatttttagatttttttaaatatttgtgaatttggtaataatttattcaaattcaatataaatgtgttaaattttcaaaaaaaatcgttcgatatttcggtgccaccgaaattttcctgcttaccgaaatggaaaacactggttgtcccagcaatggaagcctttaaaagccagcaatttacactatagggctgtgtttgcatccccatgttcccaacacttctccctcgttttccgtgtgcacgtttttcaaactactaaacgatgcgtttttttgtaaaaagtttatatacgaaagttgctttaaaaaatcaaattaatccattttttgaaaaaaaaattagctaatacttaattaatcacgcgctaatagaccgctccgtttccgtgcgggagggattagttcccatcgctggaatccgaacacagcccaagtcacaactcgaccgtgttcgccgagaaaccaagccacggtcaccatggcgcacgccggcgatgccacggcgccgctcctctcctcgccggccaagcccggcgacgagccccgccgcaacatgtacgccttcggctgcgccaccctcgcctccatgaccaccatcctcatgggctacagtacgtgtgcaagttcttgagcacgacgcacgcatcaatggagcaagctcatcgtgttttgtgtgctttgcagatctcgcgctgatgagcggcgcgcagctgttcgtccgggaggacgtggggctgagcgacgcgcagatcgaggtgctcgccgggtcgatgaacgtgttcatgctcgtgtccatcctcgccgccggctgggcggccgacgtgctcggccgccgcggcacgctcgtgctggcgaacgcgtacctcatggccggcgcgctcgccatgtcgctcggcgccacctacgccgcgctcatggccgcgcgcttcgtcaccagcgtcggcgtcggcttctccctcgtcgtcgcgcccgtgtacaacgccgagatctcgccggcctccgcccgcggcgtcctctcctcgctgctcgatgtaacgctcgcatcatagctctagtagtgtttgatttgggtcgctctgatcgatgctccgcttgcgtgtgtcagatgttcgtcaacgtcgggatcttgctgagctacgtgtcgaactacgcgttggccggattgccggtgcacgtcgggtggcgcgtcatgtacggcatcggcgtgctcccgccggtgttcctcgccgcgggcgtgctcgccatgccggagtcgccgcgctggctcgccatgcgcggtcgccacgccgacgcgcgcgcggtgctcgtgcgcacctccgactccgtcgaggaggccgagctccgcctcgaggagatcaagcgagccgtcgaggcgccgcaggagtccgccggcgtcggcgtgtggcgggagctcctcctgcggccgtcggcgatggtccggcggatcgtcacctgcgttgtcggcctccacttcttccagcaagcgtccggcatcgacgccatcgtgctgtacagcccgctggtgttcaagaaggcaggcatggcgtcgaacacctccgtcctgggcgccacggtcgccgtcggcgtcgtcaagacgtgcttcatcctcgtcgccacgctcctctccgaccgcctcggccgccgcccgctcctgctcgccagcaccggcggcgtggccgtcaccctcacctcgctcgccctcgccctccgcgtcgcgtcgccgtccacggcgagcgccgcggcgtgcgtggcgtccgtgatggcgttcgtggcggcgttctccgtcgggttcgggccgatgacggcgacgtacaccgccgagatcatgccgctgcggctgcgcgcgcagggcgcgagcctcggcatggccgtgaaccggctgacgtgcggcgtggtgagcatgactttcatctcgctcgccggcgggatcaccatggccgggtgcttcttcctctacgccggcgtggcggcggtggcgtgcgtgttcgtgtacgtgcggctgccggagacgagggggcggagcttggaggacatggacgtgctcttcgccaagtgatcaacgtactatttcattactacattttttatggaagagtatgaagaatttatttattcttaactttgattttctccatccaagaagggacgatgtaacatttagcaaccaaaatgcattggaggtgttatcagttacttcgtatagatggacaaatgggccgcctgacacgacctggcctgggcacaactagagcatggcatggcccaacatacttttcgtgtcgtttcgggctagctcacaggttgtacctgcgacccaggcacgacccgtgtcttattgggctgtccattgtgctcaccttgaaataagtctattttgcctctctcatttctttgggccatgtcttatattcctagataagtccattttgagtcccttacttatttaggtcgtatctatatggttggaaaaagtctcttttccctctctgattgttcggccgaactgacccgttgtaccgaagaagaggcccaggcacaacctattggtcgggccgggccgacacgggaccgacaacagtcaggccttgctgtgccttggtcgggccaaatctccatgctgtgggccagaccgtcgagctatgggccttttggccaactatataggttagcattccgcatctataagagtctcaaacacaaccaacctatatgcatgcgtaaatacatgggcaaccttcgtagttcactataaaatgcccatctatttgttggtcacgtaataatttcacaaaatcttaacaattattcgatgtcgtgagtttgtcgatttgtctccttccctgagctaatgctggcccatggtcatcctcctcttttgtggccaaggggccacaacaagcctactcctccgtcctccctctaaaaccacttccttgacctaaccctctccaaccatcttcgccccaagcacctggatcttagggtaaagacaactccgggctaatctgacaatcatggagttgatgatagagatggagagaagtattctcaaatgcctaattttggagtgacatttagactgtgctagttgaagctcaccttttgcttgaacatggctagctggccaatttttttgcataaccagatgtaacaagagaagatatttatttgagtgtgttagggggcgtatttgcgggtgatgagtatggtgttgtgtgtatgagtgtgtgcatatgcgtgtgccgtgtaatcgaaaaaatgtttatttaagaatagttatgcaaatctaatatcgaacacggaagaattttccagttcatgtagaagtcatactttttaaaaaaattaaaagtttatgtgaaaatcatgtaaaattaatgcatgcctttcaaaagaatcataagtgtttagcactcatgtacttctagcttgaattattattaattagtatatatatcacaaattttttctttaagaaaattctttcattggtcttatcactattgaagtattgattgagtagatttgggattgtactgttgacctgccttcggtgcttttggatcctatattcctactcctacaagaacaaaagacacagcattagcagaacattaatctttgccggcacaagtacgaatagtactactgtttggtgataagattcacttgtcatgagctcatagacaaacaaaggttagccacccatcaggcattcaggccatcagttgacaccaaaattctcaaaataaaaacaattacttacgccaatatagaagggaaaacccaacaactgagttaacagcttttaactctacatgcctcactgatgggccaggctgctaatagtctcactttggacatccgttatgtggatcatttggagcatgagcatccatgcatccctaatgatattcattattgttgttattgtagataactttagaggcatgattaattattttatgattcagcgacatgtacctgtgatgattgattagacaggtactcacttaacaatgtaagtactatctgtccaaaaaaaacttaatctaagaggggtcacaacgaatccagttgatttttagaaaatatagaggaactagatttttcaagattatcagaaaatgtccttggaaaataagattactggaaaatggaagtgtcataaacatgtctgcgtttttctttttgtcgaacagattacatttttggattttattaaccaaataacttgttgctctcaagtggaagatatatttaaccatcaaagatggatgaactgattgaacgttgatgtttccgccattgctgcttttaatttggtaaatggagtaaaaatattttattttacacaacttcgtgatggttaattaagattgtttttggtcaaccattaagctggacacactaatggttctcatggattgaaattcctgattccatttaacaggaagagtttcccaccgcattgctagctgacagcatgtgatctgccttcctcacacctaagctcccccagtctccaactcaaatgtatcattaggaatttaggatttcccctttgtttttattttcttctgtgttggctgctagccttctacggattgttgtggaatcagggagccctatagctgtgtgtctgatgtgtactctattttgtaatcttattgacttcgagtgcgggttttggaatctgtaacaggtagcttctgatgtctaaatttgcagaatctcgcaactgatttgtaataggagttaagtagagttgaaattttgatttcattcttgctcccaaaggtagaaactgtgccatggaagatgtgtacctttgagcaagtggtcctttctcgcctttggtgagaagtgcctaattctaactattgtacttgtacaacaatacaacatatacaattcaataaagtgtaacaataaaagatcagttgataagttatagtgagattgggggatcataggagtatggtccttcacagtttgcttagctttctgtacatcctacctgttcatttgacaagttgcgctgtcattgttatgaactggtttcaaatcagtagatatattacatattttcatcattataacttataaatcaacctggcaacattttgcagtggtcttacatgtaaatccaatgattgaaaatagtgggtccgccgtatttaacgtaaaatcaatggttagatatatattttagtattattggaaattcatctaatttatttgagcaacttatgagcgtcatttggtgatttagaagcgtttgtagaaatcatacgtggtggtttgagagtgtttgtagaaagtttaatggactttactatacaatagatagatgatcatgtcaattaattactaatattgaccaacttaccagccaaattttcaccctattaattgtccggagtattagatgataaataattgaaaattgagttatatttgctacttcatatttactctctgattccattgcaaattatcaccatatcctttttgtcaatcatcatgtcctcccgttgatccttagatttctctcttgcaactacttcgtcagttcgtctcagttattgaatgatgtgctggaaatgagatacgacagttatagcttgatttggtcaaatatgagcaaagcttgctaaatcatgtttccgttaggactgtagttggattacggattcatcatggtcacgctaaacaatcacttatttcatccgttttatattgtagtaagtttttttattttttttaagtcaaacttcttaaaaatttgattaaatttatagaatagcaacatttatagcattattttagtcttattaaatctaatattaaatatattttaatagtttctttgtttatgttgaaaatattgttatatttttctataaacttaactaaagttaaagttgtttgacttttaaaaaatcaaagcgacctataaatctttgattttatatgtactagaaaaatgaccgtgccctgtaacaggcgaatgctattttaatcttattattgtcatatggtttagctagaatgaaatttactgtgttaaattcgcttagatgtatatctgttagaaaatcgtaagctgcaattaggaattcgatcgtcccaagttagaatgcgagtttttttaatgagatttcttatacgattctccttttgtatttaaaaaagtgaacgaacttaaaaactgactcaaatacagaattgtgtttctaaaagtgaacgaatttaaaaaccaacttatacacggataacgtaccaaaataccagtaaaaatatcttcaacttttataatagtagagatatacttctgcatcatatcataatgtgattcatatctctgccttccagtctacggcagtaaaagtgaatggaaattactttccaataatcggaggttgcccaccatgatgatgtaggtcactgttgtcagtatgtcgccctgcttttaatcccattcgcttcacaccacacacacagcttagctctcgcccaaaccaaacctcgccatggcgagcgacggcgacgccgccgcgccgctcctcacgccgtccggcgacaacgacgacgagccccggcgccgccgcaacatgttcgccttcggctgcgccacgctcgcctccatgaccaccatcctcatgggctacagtacgtgcactcatcgagttcttggcaacacatccatggaggtagttcgatcgtgttgtgtgtgcttgcagatctcgcgctgatgagcggcgcgcagctgttcgtccgggaggacatggggctgagcgacgccgagatcgaggtgctcgccgggtccatgaacgtgttcatgctggcgtccatcctcgccgccggctgggcggcggacacgctgggccgccgcggcacgatcgtgctggcgaacgcgttcctcatggccggcgcgctcgccatgtcgctcggcgccacctacgccgcgctcatggcggcgcggttcgtgaccagcgtcggcgtcgggttcgcccgcgtcgtcgcgcccgtgtacaacgccgagatctcgccggcgtcgactcgcggcgtcttgacctcgttgcttgacgtacgtatatatgcgtccgtcgatctggccatgtagaatctgtcgtcgtccttccagtgtcgaacaccttgttaggcctccattgatcgatctcgctctcgcctcgtgcagatgttcatcaacgtcggcatcctgctcagctacgtgtcgaactacgccttcgccggcctgccggtgcacctcggctggcgcgtcatgttcgccatcggagcggtcccgcccgtgttcctcgccgcggccgtgctcgccatgccggagtcgccgcgctggctcgccatgcgcggtcgccacgccgacgcgcgcgtcgtgctcgcacgcacctccgactccgccgaggaggccgacctccgcctcgaggagatcaagcacgccgtcgcggagccgcacgatgcgggcggcggcgtgtggcgggagctgctcttccggccgtcggccatggtccggcgcatcctcgccaccgtcatcgggttacagttcttccagcaagcgtccggcatcgacgccatcgtgctgtacagcccgctggtgttcaagaaggcaggcatggcgtcgaacacctccgtcctgggcgccaccatcgccatcggcgtcgtcaagacgtgcttcatcctcgtcgccacgctcctctccgaccgcctcggccgccgcccgctcctgctcgccagcacgggcggcatggccgtcaccctgacctcgctcgccctcacgctccgcgtcgcgtcgccgccgtccacggcgagctccgcggcgtgcgtggcgtccgtggtggcgttcgtggcggcgttctccgtcgggctcgggccgacgacggcgacgtacacggcggaggtgatgccgctgcggctgcgcgcgcagggcacggggctcggcgtggcggtgaaccggctggcatgcggcgcggtgaccatgacgttcatatcgctcgccgacgggatcaccatggccgggtgcttcttcctctacgccggcgtggcggcggcggcgtgcgtgttcgtctacgtgtggctgccggagacgagggggagaagcttggagaacatggacatggtcttctccaagtgattgagctcttgctttttgcaccaaaatttttttagacaaaactcaatttgtctccaaatgatttgaggtctcatatgaagcaaacattatttcagcaaataaaagaaaaatccaggtagcagaagactctgaagaatgatgtattagctttgcttttattatctaaaaaaaaattagctttgcttttaggtagcagaagactctgaagaatgactctcacagtcatatttgtttttttttaacttatagaagttaaatttaaacttgtatgtttatggagtggtatcacatactaatctatattgtcatttttttgaatttttttcataattatttggattacatgtaaagaacgagaggatgtcctctcgagggattaaaagagtttgcccatactgttctactccctccggttccataattctttacgttctagacagtgacacagttttcaaaatatatctttgactatgttttttattataatatataattaataaataaatattttttattatagtgctttaaagataaatctatatatggttgtcctcaaccttatttaaaactaacttgagggagtaacatttaggaaccaaaatatttttttgccccccaaacttttagatatgtggccattgccttgttatccaagcaagaatggcctcgagattcatgcaagaagcgaaaaaaaaaatcaaatcgaccatgtgcaagtaggagtcaagctccaaaccacttgtatggagattacgttgctagccaaccaaaaaacagagtagttttgactatagaatacaagttatatagtagtagttgtaatgtaattatactgttacatttatttttcacctaaaaactatcgaatattatatcgaatattatatagctacttcctatgggactagctgtatctatggcatattttccacgaaaaacagtcaattgttttctcataatatattagattcagttacactttaattacattacattataatttctgaaacttccacaacaatatccattacttacatccattacttacgttgtaatttttctagtacgcagttattgaaaaatgagatattaataaacctatttactctcttcctcttttaatatataatgttgttgacttgtttgacgttttatcttattaaaaaattatataattaccatttactttgttgtaatttgttctatcattaaaaaatactttaagtatatttttcatatttgcgtaatttttttgtcaaacatatgtaaaaaatcaattatgccatataaaagagaagtagcaatcacatttggaaataattaaccaaaatcaagttcacatttttagcataccactaaaatcatctaagagcgttggctggtgcagggccagagtaccctagccagccatttgatgttcttcaagccaccatagtccaatattcacacttttggttgttcagtttgtcaccacttttgactttattaaattttacattataaagttttagtaagataataaactaaacatttctcctctcattgacaccctataaaaattgtcatttctgacaattccctcttataaaaaataccaaatttgggtaagactacaaactaaacaaaccgcatgctatagatatttgtaacgctaaaatgtgacaaatttttgataagattgattttgacactaaactagataaacccgtgtttccttagctatcgcaacctccacgattttattagctagcgtgtgtgtgttctaggctataaaaaatttctggatctactgctgtatataataattgggctaaccattttactgagatgggtaaagtttgaggtttgacatggagcacggtggttaaatgaggcttcgtccagagtgtgggagaacgtccttttatgactcgtgtaactcgtgttaggtgatactaataacttgtgatgatctgattttcttattattttttgagatatggaagaatggaaaatgattaattgtgatcatgagctgatgaacgaacaaacaaagcctagtcactcatcaaatacaccaaatctttggaaacgaaaacaaaagttagggggtgtttagatccacgggtgtaaagttttggcgtgtcacatcggatatacggacacgcatttaaagtattaaacgtagtctaataacaaaacaaattacagaatccg

SEQ ID NO: 47359 - DNA, 10423 bp, Oryza sativa
aaccaccgatgtaactgcttagacccagtttagttctccaaaaacttttcgcaaaaacatcacatcgaatctttcacacatgtatggagcattaaatatagataaaaagataaactaattgcacagtttgcatgtaaatcgcgagacaaatcttttgagcctaattagttcatgattagccataagtgctacagtaacctacatgtgttaatgacggcttaattaggctcaaaagattcgtctcgcggtttccaggcgagttatgaaattagttttttcattcgtgtccgaaaaccccttccgacatctggtcaaacgtccgatgtgacacccaaaaattttcatttcaccaactaacatgcccttattaactcttatacgcctcaacctcagggatcggagatacaagagtctgacggctcatcaatcatgctcatcgtcttggttccacatagatacaatagttacctaaaaatatatactgcattattgatacttggttccacatatcatacgcacattgtatcttgtagttcgtgctagctgcagctgactataaatctgtagcccactgttcatatatctagtcttttatcttctcgatatatgtttacagctgttttatattctgctattttacatgcttgcaatatgcgaatagccaaatacaatgtggacgatctgttgcagcatatgtatgcatctctgttcatctactactatatttaatatttattgttgtttgctgttgtaggcaactttggagacatgattaattctctgactcatatatagacatgtacgtatgacacagttagtacagccactgttactaaacaatactccctccgtcccaaaaaaaggacaaacggtttccgtacccaatttttgaccgtccgtcttatttgaaaaaattaagaaaaaaaaaagacaagtcacgcacaaagtattaatcatgttttatcatctaaccacaataaaaatacgaattataaaaaaatttcatataagacggacagacaaagttggacacgtaaatctagggtttgcctttttttttaggacggagggagtactattaattatctatgtctgtagtttttcttcttcttttttattcgtgtgtccaccggagtttatgtgtgcaaaaacaacacacacaataaacattctcaaatttaatgtggtaccaaagatgtagtagtaagatacacatcttattattgtttctaaaaatggtccgcccatgtcgatgcgcctaattaatacactatctaattttgaggttatactagaccatcttcagtcataggatccccattttaaagcctgtaaaactaagggtatctatgtttatgatcacgggtagcattgaggtgacctcttcttatgcaatgtggcgaattctaacccttgactgtggatatgcatgacacttctattttaccactacatgttagataaggggcaaaatttgctaaattaaaccacacatatgattttatatgacatgattatttatgtacggttagatgcacctttgcacatgtcatgttacatatgcacctttgtacttgctccatcttataaaaaataaatctagaataggatgtgaaacatactttaatactataaatctggataaagaatttatcgatattcgttgtagtaaaatatatcgtatctggtcttagttttgtttttttagggacggagggagtatatatcacgaattttttttagtcttttttatttttattaatagatcattcaaaaagtattttcgaaatctaaatcttttggccacgcaagaggctggcgtggccaaataacgctaccacgctaactgcgcgtggcgtgacagagttatttggccaggtttacatctgtaaatactttttagaatggtctattaataaaattaaaaataaaaagtctaaaaaataaaaaaaaatcatatatcacctgcattcgacacagttgcaacatgacctatgggaagtaaatgtgaaatcaatttaatccgacacacctacaacttgctctgagtggttagtccaagacttaaaccccatgctagctaggctccagtatgaaaccttaagcaagccatggcgcacgacggcgccgccgccgccgctacgctcctcgcatcgtccggcgacaacgacgacaagccccgacgccgccgcaacatgtacgccttcggctgcgccaccctcgcctccatgaccaccatcctcatgggctacagtacgtgcactcatcgatgttcttggcaatggttagagcttcttggcaacacatccatggaggtagttcgtgttgtgtgcttgcagatctcgcgctgatgagcggcgggcagctgttcgtccgggaggacatggcgctgagagacgccgagatcgaggtgctgacgggttcgatgaacgtgttcatgctcgtgtctatcctcgccgccggctgggcggctgatgttctcggccgccgcggcacgctcgtgctggcgaacgcgttcctcatggccggcgcactcgccatgtcgctcggcgccacctacgccgcactcatggcggcgcgcttcgtcaccagcgtcggcgtcgggttctccctcgtcgtcgcgcccgtttacaacgccgagatttcgccggcgtccgcccgcggcgtcgtgtccacgctgttcgagatgttcgtcaacgttgggatcctgctcggctacgtgtcgaactacgccctgtccggcctgcccgcgtgcacctcggctggcgcgtcatgttcggcgtcggcgcggtccctccagtgctcctcgccgcgggcgtgctcgccatgccggagtcgccgcgctggctcgccatgcgcggtcgccacgccgacgcgcgcgcggtgctcgtgcgcacctccgactccgtcgaggaggccgagctccgcctcgaggagatcaagcacgccgccgaggcgccaccgcaggaggatggcggcggcgtgtggcgggagctgctcttgcggccgacggcgatggtccgccggatcctcacgtgcgtggtcggcctacagttcttccagcaagcgtcgggcgtcaacgtggtcgtgctctacagcccggtggtgttcaagaaggccggcatggcgtcgaacacctccgtcctgggcgccaccgtcgccgtcggggtcgccaagacgtgctccatcctcgtcgccacgctcttctccgaccgcctcggctgccgcccgctcctgctggccagcacgggcggcatggccgtcaccctgacctcgctcgccctcacgctccgcgtcgcgccgccgtccgcggcgagcgccgcggcgtgcgtggcgtcagtggtggcgttcgtcgcggcgttctcggcggggctcgggccgatgacggcggcgtacaccgcggaggtgttgccgctgcggctgcgcgcgcagggcgcgagcctcggcatcgtcgtgaaccggctgacgtgcggcgtgatgagcatgacgttcatctcggtcgccggcgggatcaccatggtcgggttcttcttcctctacgccggcgtggcggcggcggcgtgcgtgttcgtgcacgcgcggctgccggagacgcgagggcgaagcttggaggacatggacgcgctgttccacaagtgatcgtgtcggacgactcgttgtgaacaccatttgatctcggtttgaaatctcgttcgaatatttaacatcaattcgtttggaaacaacaacactcgcatgaccgatttgaacataatcgtgaatattgttatgtatatgggccgtatgagtcaggcctttaccgggccgcgttgcagccgagtggcctaaattgtggccttgtgtgggattcgaacccaaatacgcatcgaattctggacttctattggatactctgatgcggaaacgcaaaaatcaaaacgaaacccgatgttttttttttctcttgaacaaagcacgaattcaaccgacttaaactcaaaacacgacttcgcgacggttgcagacgccgccaccgccaccgcctccaaaaaccgacgtggctctcacccgagtcccgggccccacacgtcagtgtcctttctctatataaaccgacccgttcccctcgcgtgctctcccacctcgcgcccgccgcctccaccgctcgagccaccgaaccctagaaatcccgccgccgccgcccgcccactccgtcgcgccgatggcggagcacgaggagcagccctacgagggcaacgggaacggcggcgacccggcccccgcctccgcgtacgctgagtaccctgcgcccgaggggtccccgcccgccgccgccgccaagcccaccggcttctccgatggcgccaccgacggcggccgttctcaggtgcgcgcgtcgcggatctgtagggggggaatttggcccatgttttgggatggggggcggtttggttttgggattgtttcatgggttgggtgcaaggggatttcatctggttgcctgagatttagggatttaggtggtttactttgcttgcaatgttatgctctccaaatcgatggaactattaggttgttaggttgattgtaattgctttgtgctgttttaatttcctctggagaccacgattcaaataaaacatagaactaggaaatttttaggcgattttcggattagatctgtttgaatttaattgttgtgcaaatttcaacattcaccttatgctgattgtatcaccttggactcttagagagtagtttctggtcgttgacagcttattggggctaaacaataattgaatcttctcttttgaagataagaggactgactgataactcttgttcttttattcagcacgagacacagccacatgatggcaggtcctcaaagtctagagagagggaaagagaacgggacaaggacaaggaacgcgacagagaccgtgatagagaccgaagggaccgcgaccgtggtgacaaggacagggaccgtgatcgccacagggagcaccgcgatagaagcgaaagaagggaacaccacgatcgtgaacgttctgatgaccgtgatcgacgccggggccatgattctgaaaggtacaggttatttttccgtatgttaatggatatgctatgattcctctgccatttgtttgcttcatgccacgttttattgtgggaatctgatttacactttattaatgcaggagaagagaccgtgacagagatggtcaccgcaggcatcgatctcgctcccgctccccttcaaagggtcgtgatcgcagatctagatctcgctcacgctctcgatctaggtatgtgattgaatgcccttgtatgcttattatatgcattggttcctgatgttgatgatgggccaagtttgcctgttcttattagcttacaaaagtcacatgttcttttgatacctcttaagtcttaacagtgatgcaattttcagaatgttagtaacttagtatttcttcttatcttcaaaagattgacactcttaaaacatgcagtgaactgtgtttcttttcaattttttttcaatggtacattcatatgtctttactagtttacttaatgtaatccatttatgcgcttgattttgttctttgtcatgtaccttcttaggtggctttaattctatttgcttatgtaattcttttggtctagttattaatttggcttttgttaaaacagcaagcgcgtgagtggatttgaccagggaccacaagcagccattcctgcgcttgctgctggagcagccccaggtatgttagcacccaatataatttgagagtttattttgctctgctgaatttatctatttatacttgaaactaccacaaattgctgtagctttatcattaacttgtctacatcacaaaacataaggctcaagtaacattaatgcaaagaccaagaaagagttattagcacctccttgtttggatcgccccaataaatacaatacatgcacccaatgagatgagagatcttgaagatggatgattttaaaaaaatggttttagggtagggagaggtgctagttaattgcatgcatacgtgccctgaattatgaagcctcggaaaaaaaattagttgctccaatattttgggatggagggagtgacaaccaagttttttcaactagttgaccttgtaactcctttggtcctttttttattttcagcaatgctagcacttataaattacgaacatctctagttcccaatgaagtacatattcaaaatttctatatttgttttgcctgagggtcgagaaaagactatttactggtctctttctgacactgctgtcttaccactggatgccttgaaggcatggtaatcattattttgtacttatatagttgatatttcatgtagaaaattaattttattttatcataactggtttggaactaagtgattttctctttttttgttggtgtttgtttgttttgtgtgcatatcggtaggaaagcaatcttgggccactttgtccaactgctgcaatgggagacactgtagcttaattgtacgaggaggaaacaatctggtttgatatcctgttcgtcttccaatagcagctagtattacattatgttagtttaataattgttaacttcagtcctcactgggcaggcagatgccatccattcatctatgttgaattttgaaaaacaggacctatattagattatcagtagtagttgggttgttctaaatggttttgttaatgatagatcacaagtaaaaacattgattatttttctgatgaattctttgctggtatttgcaggtcaggtacctgttgtggcccctgctatttctgggatgcttccgaacatgttcaatttgactcaaaccccggtgagtattatgttgttttgaactttaggaatgaaccccctgtgagctatgatacttcagttatttgttataaagacacagtcctaattttctcttgtttttgtatcagttcactccgcttgttattcagccacaagctatgacacaacaggctactcgacatgctaggcgtgtttatgttggtggacttcctccaactgctaatgagcatgtaagaaatcatcctcttttctccacatttctcactttctgtggcttgtacttttgtgtgttttatactgatgtctggtcttcttttacagactgttgctgtatacttcaatcaagttatggctgctgttggtggaaatacagctggtccaggtgatgctgttcttaatgtctacataaaccatgataagaaatttgcatttgtggagatgaggtctgtggaggaagcaagcaatgcaatggccttggatggtataatgtttgagggagcacctgtgaaggttagaaggccaacagactataatccttccctagcagctgcattgggtccaagccagccaaaccccaacctcaatcttgctgctgttggcttaacacctggctcagctggaggtttagaaggtcctgaccgcattttgtgggtgggctgccctattacttcacagaagctcaagtcagggagttgctcgaatcctttggacctctgcgtggttttgatcttgtgaaggacagagaaactggaaactcgaagggctatgctttctgtgtataccaggatcttaatgtcacggacattgcctgtgctgctcttaatggtatcaagatgggagacaagaccctcactgttaggcgagctaaccaaggagcttctcaacctaggccagagcaagaaagcatgctcctgcatgtacaacaacaggcgcaaatgcaggtatgtgctgtgttcttaaacacattattttacggagcacaaatcagtttaaacactagccttccaatttctgactgttgtttcttggacagaaactcatgttccaagttggagggggagcactgcctacaaaggtggtatgcctgacccaagtggtttcaccagatgaactgagggatgatgaggagtatgaggacatcgtgcaagacatgagggaagaagggtgcagatacggtaagcaacaatgaactcgcacattctcgcttcctgtgcaccaatcactctgattcagtttcataattgatttttgcctttgctcagttactgaactagtttccttttgtgtgtttgtctttttgtgtgtcttttttgtagtcccacatagtgccattgcagagtcttttatagtccgaccttatgcaatattggcagtcgggcatagcctacagaagacacacaattccaattttactttgctttatcagctttatgattatgatataatatgatgccatgcttttttctatttgtctatgttctcactgacgcttgttcaggtaacctggtgaaagttgtgatcccgcgacctgatcccagcggtgctcctgttgctggagttgggagggtgagtgctcctcttgctcttttgccaatttaatacaaataataacatcatgggttatgaattttgaaactgttctgaagcatgagagtgcattgcaggtgtttttggaatttgcagatgtagagagctcgaccaaggcgaagaatgggatgcacgggaggaagtttgccaacaaccaggtggtggctgtcttctaccctgaggacaagttcgctgaagggcaatacgacggttgaacatcgaagtcgccctcttattgtttctaacgcctataaggcggaatctatttacgtttaccttagttttgcaatttttacatctagttttttttttctgtgttagttgaaattttattagtagtccagagattggtgcagaatcatgtgtactttgggtatgttcttatggttctgacttgaaaagcaatagtggctggttgtgcctacgttctgtatttctggtcatgaagcaggccatggcaacattcgatcgtgcgtgttgtcagccgtgtctaattcattcggtcgcgacccgggcgccttgccaacgtgaaaagacaaaaaaaaaaaatccaaattggagaacatttatgacatattagcccagggcttccatgcgggctttgtctgttttcttttctcaggctttgggccgaacaaacaaagccttacccgaacccaacaaaaaatatttacatacataaaaagtttgtacatagaaactttatgtataaaacttaattttagatacattgaaatttctattgaaattcttgctaaaatttaatattttccattgtgttttctttttccacgtgtggagctcaagccaagctatgtcccgcatgcagggtttcccttaccggcggtaaccgcggttaccgggcttaccgcgggggtacggtaatataaataccgcggtaacctccttaaattcaaataaatttaaaaaataatttaaatttttgataaattttgcacagtttctcgcagtttttcacggttaccgcggtaaccgcgcggtaaccgtgcttaccgccggggcgtggtaaccccggccccggcggtttgggaaaccctgcccgcatgtggctccagggttcatggttataatcggtacattaaaaccaacagatacttagcaacatacctttaatttgttcttaggctaaatattgaagcacatttctaatgctgctcaataacgatgtattcctaatgccgctcaatcctactgtgacatggcttacaattcttgcgatatgctgatagttttatggtaaactaggagatgagaaggaaaatatgcaagcgggctagtaggaagaaaaatatggacacagaaatagcattgacaatcctggttaactaagagcaattcgatactaggaacacttaaatgcttgcttgtaggacaccacggacacatattgatggcctggtgcaatttcaccggatcatctgactatatgagaaccaggaatcagatgctcccaggattaatgagcatttgctttacctccagtgaagtgttctattcctcatgccacacattcctattgcgatgttcatgctttgaggttgaacttgcaaagaaagatagataaatacacaactgtgtatacaagaaccaccatgttaacaaatgtattatatatagtccagagaagagtaataattggtacagtctagtagctgtgtgatgttctcttacaacttaatagctaagtacatgggtgtgtacaagttcagcaggttcacgttctgcaaaagaaaaaaaaaagggactgtctactcatcatttggtagaaaaccctcctaatatcttgcaaatttttgaccattggattgatttgagattcgtgcaaaccccaacaaaccctaaccacttttccttcccctcctcccagccgccgcaaaaattgctcgatcctcctctcgacaccgcacgcattctgcgccgccgccgccgccgccccaccatgccgccaccccggctggccaaaaggtgtcaacggcg

SEQ ID NO: 47360 - DNA, 712 bp, Oryza sativa
aaaaagatgttttctataaaattaaactgtttttttttattttgacttgttgagcatggaccaacagactttgagctaacccaaaaatattcacagttggtacagctgcaaatactgccactagctagccatgctcactgaaatttgtcttctgctcactccaaattgcccctcacactatgcatctccagttgtgagcaaatatatcacaaccatggtcaaaagggccatttctatgtttttatttgcctgttcacactcagaccgtactggtatgtctgcacactgccattagccctaggttctaacctagagactatcttttatgcaattaagtaaaatgctccggtattgagattttaccagcaatgattttactgggcggccaattggtctaatctcctcatcaaaagtgcctgtcgccaaatgcttatccagtaatgcatcctgtagttaagaataaaggaacatacaacatttacttcagaattaattgatcgaccaatgcatttggcattttaactgtaagatgtctaaataaaaaatatatatagctcagcacctttgctacaaagatgtctttgcaccattttgaaacatcgtcttctgactttggcatctcactcattgcatgacgtttcatgcgaacatgtacctagagaaacagtggagtggaaatttgtttcaaatcaaatcaatttattatgactgg

SEQ ID NO: 47361 - DNA, 1014 bp, Oryza sativa
ttactttcgcgcgaaacggacaatacaccgcgcgttacacgtcagagtacgtggagaatgtgggagtggaggagaaaagctatgagcatgaaacaataccgtgagcatcgaaggaaaacaatgtggtgagatggcatgagtaatagcgtagaaaacaagccacattacacgagaagaacatttgcagctcggaaaaagaccaaaaggaacaattgattcgatttgcagcttatttttaaataaactgcaccatgaagataggaaaaaaaatctaaattttcaatttaaaacaatgcaaagtatttcgacatcatagttaagggctaaggtacattaaaaatataaatatgacaatcctagcgacaagtagatattaaatcaatagagatcgaatcaaaatcgcattattcacaaaatatcatcataacttaaatcataaaatacacaatataacctgataagaaagatacatgagaaataaatgtatcaacatcaacgatcacaaacgttacacgaagccaaacaccaaacagaaaaaaataaataaaggaaaataagtccaaaaaaaagaacacaacacacagctatatactataaagctctgcaggacatggaaggagaagaaaaaaaaagaaaagaaaagcagaggagagagtagcagagagaaagaaaagaaaagaaaataaataaataataaaaagcaaaggaagggaaggaaggagagagagatagaatagagagagacacacaaacacctacaacaccaacaacaacaagagaaagagagaaagaagagaaggaaaggagaggaagaagaggtggtggtggtggtggtggtggtgtgtggcctccttcccctccctcctctcgcgaggttgccatgcctcccccaagatcctagaacgcatccccacaacctcacctcgctcgcaagaatcttcttcccaccatcgccctccctcgggatcgatccaacccgatcatcaatcggtaaaattcatttcgttcgttcgt

SEQ ID NO: 47362 - DNA, 3488 bp, Oryza sativa
tctgggtctcaaagaataataatgctacattatattctaattcattttgaggctttctaaggctatatattatttgtatgtaccctgctggaacatctgtacattctgatgctctttgcaatttgcctttgtgctgcttttgcatcttctcttctgggtctgtctagtggtcagtgggtgatgcctggttcttctaccatgcataatttaccttgtataatgttgctattgtaccatctcttcatgtgccttttgatggctgggctacatggatgatggctctgcaggctgcagccatgcttgaggattgtgatgttaacatataataatatcttcatcttgtgatgtacagtaaattaccagctttttttttaaaaaccccaaatgcaagggattcggtaattgatatgtcaatcactattccttctgataagctccagaattttgtaggagagtcatagacagttgagtttgtgatttgtgaatagattagaaattaagtagttgaagttattaatagattagaaaatcagcaacctgtcatgagaattaggaactactcccctcgtctcaaaatataagcattttttactctaacacggtctccgagatgctactttgaccaacaatatctataaaactaagatgttttaaataaaaaaagttgcatattatgatattttgtttaatgataaatctagtaaaatcaattttacatgattgatcttttttataattttgttattaatagttaaaattaaaaatgtttgacttgtcactatgctaaaaatgcttatattttggaatagatggagtacctgtttactccgtatgtgataggtgcctgatcttttactcttaattattgattttcatatgcagcccaacctaatttttcatgcttaatcaacggtttggtatcagctttcaattcttctagtgttaatgaagttgcttcaactgatgagcagttaaaaaaaattatgaacaatttcttacagcagaattctccatagatcgcttactgaatgtagcttgtcagaatgaaaacagtcacttagctcttgcatgatgtgaaacagcgtgctcgccaaagaagttttacaaattcagagtgaagcagttgaaaagaagttatgccccaatgcaagtttcctttttttttaaaaaaaaaaatcatggcccattagagaactacatcttttccataattccaaccaacttgaaaaggcattttgcaaattcaattgctccatttgaaaaggaagattaccccaagtttttttaaacaaaaatacatgacccaagacagaattgtgtcgtcataattcatttgcccatagaggtagagaattaggtggtagatttttttttttggggtgtagaaatcgatccatgcaagcaaaacaaaggtgctttcctaactggaccactgctattaatagacaattctttagaaattatatagcaatctgatttttaatagttgatgctattgatttttcgatatacattttgaccactcatcttattaaaaaaaattactacctccgtctcaaaacatattgtgccaaaacataacatggggcagaggcagcatgtaattgtcatttattttattgtgacttgatttatcattaaaactactttaaccataacttgcattttacatatttgtataaatttttaaataagataaataatcaaatgtatagataaccgtcaataacatcttctattaaagcaaaggaagtaattgttatgatgggaagaaactgtcacttagggtcctttgaatcaaacaatttatgaaggaatttgataagatttaaattttattaaaaaatatatttggtcctttgatataaaggattggagctttccaaatcctataaaatcctattgaatggctcatcacatctagattttggtgaaaaattagcaaaaactccaacatcttagaaaacttcctttgaggcttatctctttcatcctattctttttttccccttatccgatcaaacaattattcatgtattctctttttacagaatcatatgtcttttctacgttttttctattctgtttttccattcaggttagaaaagggccaagcaagtaatcattttcatgtctcgatcccaatgcctttatgattctactctggttccataattcgtgacgttttagacattgacacagtctccaaaatatatctgactatgtttttctattataatatatgcaataaataatttttcattttattataatacttagtaaaacgaatctatatacgttgttctagctgtctttaaattaaaaattagattaaattagaacatattgataggtaaagttttaaaagtttggcctcaacgttatccgaagcagtctagaattatagaaccgaccgaaccaaagaattgaattatgaatccaaagggagttcagttaaattgaaccacctaaccctttcatacttaaagggaactaactaaatctgtttaggtctgacagataaagtgctaaatttgtttagctctgacagataaaggaagacatgatcatggcattctttctaccgtgaatgatcatggttgtgactttttgagaaatcatgcaaatggtggagacaggatataagtttcactgatacataaatcactaaaggtcttctgaacaaatccagactgatgtagaagttccaataaatacaagtagtacaattcctgttctgccaaaaaaaaacattctctgaaaatacagcacaacagagctcagagttgctagttcaccaaatctcctagaatctctctattcaggcattcagttctgtaagaacccttttggtgcattatacaggaaagattaggccctcaattttgttgcctacatgaattcaatacccaattaattggtagctcccattgataagctgcagactctatcttcatctctttcaatctttcttgacacggttccgagccgccttggctgagctcgatcgctctgactgcgagaacatgatgaagacatgcatgaccgccgtcaccagtgcgagcccaaggcccgtaaacccgactcctttccatgtcgacaggagttgagtccataggaagagcttgacggcgccatataaaaggagacatgaccaaaacaaagtcacctgttacataagcagaattagaaagtcagtaactaaccaaacactagtagcatatacatacaagacgtcctatggaagttgctacagtaattgtattggaccaaacaaggaacagttctatgcaggcttgcagcaagtacttgagttttgcatttctatcaccaacagtgtgttcttacggtagtcccagcaaaacacctcccctgatcctctgacttggccctgacaaaggaaggggcttcgacccaagttttcagtttcagaccagacaaaccccaaacagcctgatttcgaattttaaaaaagatgttttctataa

SEQ ID NO: 47363 - DNA, 12207 bp, Oryza sativa
atcataaatagctggacaaaatcccgcataatagttacagctgatacaaatccctggaaattttcatttttttcacaagaggtatcagtaaatagatttaatgctgcaatacgaaataactacatggccaaatgcatgacataaccatgtattcttaataactgtaaggagctgatcactcagccactccataaacagattaaagaagtaactgttgtactgaaagtattacagtcatatattataaaaaaatgctgtttcaaattgtcattttagaacttcaattaagctttaattttactggaagtattacagttatatctttcagttagttgcttttgtttatttctttaaaacaatttgtgaatgtccaattgaccagtaaaaatctttttcatataagttcaagaatttatcttgaaatttagcgtattaggtattctttttcaggaaggtaataaacaggcaggcatcatcatattactatgttgaaacacctgtacacatgtttatttcggaatagaaaccatcagccagtacaaaagaattttcagagttcccctatttctcttttgtactcttatccataatccatcaatattacgagtagtagtgtctgacatctcagtcttcaatgcatgattttggctatggtggttttcatcattatgaaattactcattgtctcgttctataaactacattttaactatcaaagtttgaaaaggttgacctcatgtcaatcaaaatctaaaaacataacactgcataccggatagcaactataggtacaaattaggcaggcaacagacattacatgtaaattttggcagtagagcacaggacccacattgttacacgaggcaagttgttacacatgtatcttacattcgagtgtttcgaccttctttgtattgttctaagagatttcaaacacaagtaacatttatctacgtttgaaggacagattctgcatcctaatcacctatgaagttgcgtatgtttaatagatacacactgtgaacatatgcaacagaaatactctaatttaaccgtagcacagaatatgcagttctcgatatgtgaagattattacatttagaattacccatctgaaatctgtagtttactagtgtctagtgtatataatatgatgttttcatttctttcatatcagaactattacaagggtaaaacttgggagaagagatttatatttgtgaattctgatgcaagaatacaggaataccagatacaagaaatcatttcagctagaaaaaataacatacctttgtacgtggaatcaatacatttctgggtgctggcaaaccctgtgaaacagcatactcctgagctgctagaagctttgctggagtaaagcgagtgccctcaacaaaaagggctagccaaaatggtctggggaagtccttcaacctttggaggccccactataagcatagcaagaccactaagttaaagaacaaacaatagaattatgtgtgtactgtgtagatgaggtaaaaaagttactttcaatgtcttttcatcctttgcccagctcctttccaaaaagaggtattctgcaaaccacatggaccagccaataacctgcaaaatgcaatcacaacattgagcatgtctgcatgcaatcaaaaccgctaagtactatatcagaagatagataactgaatgcttcgcatgtctgtgtgtctgcatcactgagatactagtgcacattacattaggttatggatctccagtaattacaaagaactgaacccgataggctgcttctccatcagatttctagcaaaagcagaacacatcttttctgatcttagttgatggacatcaaattttcttcaagattgcttcataccattccattccacattgtacagcttccataaaagttggttgcacgcatattttcatgtgtaacagagagtttgaacaactatagctatgttaccagaaacacaatgtatgttctactactagttcttagacattttgggtactgaacatttaactgccaacctactctgctacttattgctacaacctgaatgacatccacttgactgaatacaaagttcaagcatatcaattttagccacccttagattaatatacttagcggttggagtggtggaatctcaagtgtaacatatcatctaacggtattatatcaaatttgcttcaaacaaattcaccatcaacaatcatagagctctgatgagaaggaacatatgacataataatgcaatatgttatcttatcataattttagtcccaagagcaagtttaatattttattaccttctttacattttttttcaataatagctttatgcacataacttaaaagtcagcggcactagtctataagggactgaactgcaaaacaaatgttccagtaaaatgtacatgagctagctaactcactggaaggaatttcgatgatttcttcataacagcaagtgtacttccaaggcatcctgagcgctgaccacatgacaaaaaaaagttttggatgatttattatatattacagacaaatctgtatatactgaacttctaacaaaatattgcagtgtaactgatgtttcaacaactagagaatgagacctgtgccaaaatccacccaataagccaatcgatatcgctccgatgatttgatatgacaagtgcatgctcattccctacaaagattcttcagataagtttgtaacaaaataaatgacatggtgaacattgtaagcactatcaactgtgctataaaactgattcctcacccattgccttgtaagtttcgtcatcagcatgcagttgtatctgcagaacatgggttgaaattattttaggggaaaggcgaaatggcaaaaattaaaattgtttgcttcattaacatcaaatcaaacatttaatcttaagcagaatgctcaagtggcaagccggtaaattctattgtaatctgaattgctgtacacatggatcattcgcataatgtacagttagttaattagccaccagaatttgattgattatgctgtactctaattttactgccataatgaagagaaaaatgcagttggatttcaattttagctccacgggccaaattcaatcacaacagtggcagtattaacatggctgtttttccagactcacagcatatgcagctaaaccctataaaaaaaatgtccaggcatgaggcgtccagaaccatcaaaagagagagtccacattcaaacttttctcactgctcacaactcaaataatgagctctattaaattgtaacatgcacggcatacacataaatgcaataacagttaatttctgatctgaaggttctggttgccgattcggttatactgtcctaatgtgacaaaaggaagctatttcacacggatgatttgcattgcacaacggttccaaaataaactttagaacattgcgtgtacatcaaatgtgggtattttaacattttagcagaacaggtaaatcttgatacgaagtgcatatcagaaagatgctttgtcactgaccatatcaacataccttaactcctgcccaccaatccacaagccagaccagctgaagccacagcagctcggccaagaacctgttgatccgccggtacaagctcttcgagaacggccttatcgagagaaacaggacggcctgcagtttttcacgagcatacgagcagatcaggtaatgccgcatgctgatcttgctgcgtagttgcgcgcagattagcagatcaaatgaagcaaagtttgatgattctcgttacagtttcgcgcagtgacagacaatttttttttaaagtgaaaataatttagtaatcctaaatctttgcctaaaacagtacaaaattaacccagaaatcctagctacaataatttagtaatccaagaaagaggctacaaacaatcgacgaaatgatttgcgcaaacagaatacaaaaaaaagaaaaagaaaccaaatctcgcgccacggccgcatcagatcgcctgagatacacaagggaagaacagaaaagaaaagatttcgccaccaatctagctgaggattcgggcgcacctggatggcgttgatgatgaggccggagaggaggaagaggaggccgagcgggagcacgacgagcacgagtgggaccgccatggcccctgccgccctgccctgccctcacttccaatctcgcggggccgagatgcgaagaggaggcaacgggccgaggtggctggatgctcacccccgagggagcgccctctcctcgtcctcctcctccggcggcggcggcggaggcggcggcgaatccaccggcgacgagaagagacgagacgaggaggaagaggtgaggtggggtgttggatttggagattttatagggggttggatggaaaaagacgcagtgaagcgtgtgcgcccatggttccccctcaccaggagaagaagaggatggatggtgtgacacctcggataatgattgctttttttcttcccaattttttcgaagctactcttacaatggtgtttgagatagatttaacttaatatgatgattgatgatgaaataaaggtatgaaaaactagaaaccctattagtataattaattatgttttcgttattaaaaaaaattaaaattagatttatacggtattccctccatttcaggttataagacattttaagtttggtcaaaattaaattatttcaagtttgactaagtttatagataaatatagtaatatttagagtgaatttcagaaaccccgggttttggggcacctataacacaaaacctcaggtattacgatttgttttaaagaaccctaagttttgggtcaaaatgtttcaagaaaccacatgtttaagcttatatcatcgtttttggctaatatatttatgcataataattacaaaaataataatacgagatatttttgagtatatataaatgttagcctcattttaatgaatataggtcattggtagtatgtttgtttatacctgtaaataataggttaatgtgttattattaatgaggttatgttgcgtttttatcatttgtgcaactcaagagtgagaaaaagataaattacataggatgggatgtgtttttgaaacctactaatgtaaacatatactaaataatcatatataatatttaaattatgagtatttgagtaaatatggggtctcttgaaatattttgctccaaaacatggggtttcttgaaacaaatagtagaacttggggttttgtgttacgagcacctcaaaacctggggttttgtgaaattcactttaatatttatactactaaattagtttcatcaaattaataatagaatatattttcataacaaatttgtcttgggttgaaaatgttattacttttttctacaaacttatcaaacttaaaacagtttgactttaaccaaaatcaaaatgtcttataacctaaaacggagggagtattttaaattaacttctatataaaaagattttgcacgaaatacaccatttagcaattaaaaaatatgctaacggaaccgaggtataatttatatatgaatttatatcttaatcagaaacggatggggaaatatgcaccagtaaataaaatcatacatcttgtgtatattgtgcatcttcggttataaatcatatcgtgcatcttgtgtattcagaaaatattgcaattgtaaataatagagtgcatctcgtatatttaaataagggtttacaatatcgtttggccagtaaaattcgagacccggcaagacatcgatttttcttcagtaacccttgggcatagttcgatacattttgaaagaaaatcaacaaattttgaaccaatagcccgaaatgcactgcaagacctgaatttcgagcaatatctcgtgaaattgtgaacctgaatcaaaccaatttatttaattaaatactatccagaaaaagtgggcgagtggtatgagaacatgagaaactttgtggtagcaagtgtgagaaacatgttacgttacactcgttgtatggttggaaaaaggaaagcagcaaatggattagtgtttcccacaatttggtcaaacaattctcagatgagacgtctaaaactctcaaatttgcgggcatcgttcgtttaggggtgatgggggagattggctctcgtttttcgcgcgcacgcttttcaaactactaaacggtgtgttttttgcaaaaaatttctataggaaagttgctttaaaaaatcatattaatccatttttaaaatttaaaatagttaatactcaattaatcatgagctaatggctcacctcgttttacgtatcttcccaatctcctcaatccccttctcctcaaacactccgctgcgttctttcggggagatagggggattgtccctcgttttccgcgcgcacgcttttcaaactactatacggtgcgtttttcgcaaaaattttctataggaaagttactttaaaaaatcatattaatccatttttgaagtttaaaatagttaatactcaattaatcatgcgctaatggctcacctcgttttacgtatctttccaatcttctctatttccttctcctcaaacacagccttagtaatcaaagacaccgttacgtgttatgctaatcattgggtttccaagcaaacttacgtgtaagctgatctacgatgtgaaaacgacactaacagaaagcaaaatacaagcaacatatatactgcagtttctcaactttactagttcacctttttaaacgttatttgcatgatgtcagtatttttagttttgcctcgcaaaaaaaaagtttctttagttttgttttagttatacatatgttacatttagttgtgagtaagatataaaagtggcattacaatggacaagaagaccacatgatacgcttggatcataataaaaaacaatattaacttgagctcacatgaagaacacctctagaatgtgttccctgttgacagtgagtctttttctccgattcatatgcatatactccctccgtttatttaatatatgatgccttaacttttatcctaacatttgactattcgttttactaaaataaagtatataggtattatttattttgttatgacttatgttatcatcaaataaatttcaatatgactgtttttttatacatacacgtttaaataagataaatgatctaatgccatgctaaaaactaacgtcgtcgtctgtaaaaataataatagtatatatcattggttaaaacagttcatatgaagtacattttctcacatcagtaacatgctagaggatttcagattcttttttttaccaagataaaagaaaaacagttgtcaaagtacatgaatgcccaagggggaacaatgctattagtcatcacctatgtagaggacaaaaaggttgcttttagatgtgagtgaatttaatgtcgcttttatctctccataaattaggtgtaggtatttgttggtgagcccaaaaattgagctgctaggagtatctactttggcatctcacattaaaatcacacaaggtgaattaaacaaggttctttgtgcaaatgttccttgaatgtggcatttgcaaaagggctctcatgcacgtttgttgctatcaatcagtatcaggtggttcaactaagagcttactgattgtgtcaaccaaggtcatattccaagacatgacctaccaaagatgttccattaatcagtgaatcactatttgatggtgtcatagaactgaggtttaaccaccactttgacttttacgatatgtttgatggcaacggaaactagagaaatacaaagaatgttttgtaggtttggcttttattttcttttttttattggaggcttttttttctagaacatggtttcttttttttttaaggttgttcttttactttgaaaagtgcgatgatggaggaggataactgtacctttacattactactatttcagtatgtaccaatatattataatgggccaggtccatatgggctaagaaatggtgattaataaggatataaagtattcgatatgatggttatgttacacggaccgtagtgtacaaatgctttgtgcgcggtgagaggagggttgaaaggagaccgaatgtctgacacagagatatcatcatttgatggtaccatgcactgtatcataattgtggatggatccataattaacccaaatctcaaaccaactgaaaagaatttaatccctagtacatagtaaagaaaaaatattcatcctaatgagcctctggtcatatactttatgcaacgatccaaatagccttgaggttcgggtccacccctagtcatagcagcatagtttttgggttcaaagttcaaatgttggggccgtgtttagttgcaaaagttttcttcgaacttccatcttttccatcacatcaaaacttttctacacacaaaatttcaatttttccatcacattgtttcaatttcaacccaactttcaattttgatgtgaactaaacacacctccaatctcctaacttcaagcacatcaatcttgaaatgctgcatacttgcattgacaaatttgtttatctttaaacatgtgcgaaataatcaaacacaacggacctcatcttttcgcatatacttgtgtttatcaaccaaaatttaaatttttaaccttaaatttgaagctgattttatctttttatcaaggcttattttttagcttttatttttatatcgctaaggacgcgtaaataaaaattttattctctcacctgaccggtgggtcccacctgtcagcctcacatccctccaggccgttactacccccatcatcaccaccaccaccactccactcctctcccctccttatccccttcgtctcccgcctccgctcccccgcgcggccacggcggccatggccaccacctccacctcgtcgctgctgcctctcctcccctccaggaccccgaccccgacccctcgccgccgcctcccgttcgccgccgccgccgccgccgcagcggcgccacctcgccccttcctcgtctcctcccctccgcctccgcccgcgccccgcgcccgcctcgcccgccgcgccgcagcggggggcctgtacggtggtggtggtggggaggaagagggagacggggaggatggggagatggaggaggagtattatgatgatggggacgaggagggggattgggaggatgatgatgcggaggagggggaggagatggacgtcgaggcgatggaggaggaggccctcggcgccgtcgccgacctctccgagcggctcagccgcgagctccgcatcggtgagtggggggtttcagcttcgattcgctacctccgacatggccaggaaagtaggaaactagttagtgcttgtgaagagatagtagcatttagcctaaagtgcataatctagtgtagtagaacaatcctgtgtggaattttgagtcaatccgtagttccgtactctggtcgtggcggggatgttcgtataagatcagatggatatgctgcttgttgatgatgaactgattgttgtgccgagaatcatgatgatgcagatcaattgatactttgccttggagcatgatgtatgagtttgggaattgcagttccctgtatttctatatttgaaagtttagttgttagtgcctagcgtcgcaaagtttttcaagtacagtatttcttcggttttctcctttagaagcctgttacatacttacattgactttgtttagttcatgggctaaatgcgttgtgtcttcagatgacgatgttcgggataaaagaagaatcatcagggataagacatcagcatctaaacatgtaattatatcttcgtattcttgtaaattgtaaccctagttgacaggctggttaagaaagtgcaaatgtaaacaacttctattttctttactattgggtccgtgattcagataccggataatcttcttccaagggtggcaataattggaaggcccaatgttggtaaatctgcattattcaatcgtcttgttggggtaagctatttacagctacaaatattacttgagcgaagagtcagcattgtgtgtaatttttagctgaatgcagaggctgctatggtgtattgaattctggtgtctcacagggcaacagggctattgttgttgatgaacctggtgtgactagagatcgtttgtatggacgatcttactggggggatcgagagtttatggttattgacactgggggagtgattactctatcaaaatctcaagcaggtgtgatggaagagcttgctattacaactactgttggtatggatgggattcctcttgcctctagagaagctgctattgctaggatgccatcaatgattgaaaagcaagcagttgctgctgttgacgaagcagctgtgatactattcatcgtggatggtcaggcaggttcagacaattaccctttttttaatttgatcatttcattttctggattcttctgttatatttggtagttctgatttttagcaacactttctactgcaatagttttttcaggaatacacaaaagttttgcgtatcattgcctttctactgtaatatgaaggaatcaattttagcacctggtcctgccaagtgatggactgttgattacatactaaaatccaccacatttacaattgctccaataatgtcttgtagtatggtagtttttgtacatgtggtaaacaaaggcatctagagaaaaatattagatattcctgttagcatgtttcttgtctcattctctttgtgtgatttctgtctgaatcttctattgggtattgaagcattccttttccaacttctgcatgctgatctattaaactttttaagcttctggttattttctacctggaagcagacttacgtatatggattcttatttaacctagctcatacgtagaaagattgaatgtgtgtttatagttgctagatttgataaacctcctggtgctgaaatttttgttttgtctagtgcctttgttgcttcatgcccctgactaagttcattcttacatggatttgcattacttgtagctgtaattccctattgttgtttttcggtactgttgattgaattagtgttatgtagtgtcttatctaacggaatgggtatcaaaaatctttcaggatggccttgtggcagctgatatagaaattgctgattggttacgtcgcaactactctgacaagcatattatacttgctgtaaacaagtgcgagtctccacggaaagggcaaatgcaagctttagatttttggtcattagggtaagttcaacacgcagtgaccccttgctgtaattaccaacactcagttcatttgcaattaataaatattaaatgatgttctgttgatttttctttttttacattttacgtacagtttgtattaggtctgacatattcttgtgctgattaaatgtgagaggccacagacttgatgatattaggtaaaaacgttactaaagcccattgttagatgcgaaatataaataatggacaactagtttctgagcttttagtggttccacatgcaagatctctaaactcatttcactagcatcgctacaagttaaatgtgcttttagtatacataatctgcattctgcaatgctttacttgtgctctgactctgaaacaacccaatttgttaacgattacctcatttcttttattgttcaccactcaacttcataagaacagaatgcctattggctgctcaactcatcgttctgttgcttccttctagattttctcctctgccaatatctgccattactggcactggaactggagagctccttgatatggtgtgttcagagctaagtaattttgaggtactgaacttgcttagtttgcccagaggccagggaatgtttaattgtgtatgtctatatgcatgcttgatacccttttctgtttatggttggtaatggaatcattattataattttttgttgcaacactaaaatgttactcttggctgcggaaacaactcaagtattgcttctgacaaatggatatgctaacttagtggaatatttcactctctttcctccagtcctacaaacctagatgaatactgctagaaacacgtggtgtggtgacaccttgtatatccagcctacccattgagctt

SEQ ID NO: 47364 - DNA, 2753 bp, Oryza sativa
  unsure (1)..(2753): unsure at all n locations
ttagtgggacaacccgtgatgcatagataccgagttcaccacagaagatgggcaggtttgttcagaatgcttatgaaagtttaagtgaccaagagcagcatcattatttcattattgaccctagctatgtccacttttcatgcatctttcatctttgtagcaaaacacaatttgaattggaagaaagaaatttacatctcataggaaagtaattctaatttgctgatattgcaatatgctgcagaagtacaaactcattgacaccgctggcatccgacgaagggcagcagttgcttctgctggcagcacaacggaaacactttcagtaaaacgtgcatttcgtgcaatccgccggtctgatgtggttgcccttgttgttgaagcaatggcctgcattacggagcaggtatctctaccccatcacatgcacatgtgcacccccaaacaattcaaagagatgttgtcttaccaatcttttctaacatggtgaatttctgtggtaccaaggactataaaatagcagaaagaattgagaaagaaggaaaagcatgtgtaattgttgtgaacaaatgggacacaatcccaaacaagaaccatcagagtacaacatattatgagcaagatgtaagagagaagcttcgcatactcgactgggctcctattgtttattgttctgcaacacatggcagcagcgttgacaagttaatcccttaactttattttttactccgcaataagcatttggtacttcactactatagcatttgatggtttaagctaggctatttgtagcttgtcggtgttattgtctattttcctgcataccagacctgaaatttaagctgatgtcattaaggcattaactaatgtttcatgctgaatcttcatgttcctctgttatctcccaatttcttgtaatccaactaattgcattgcatgtaggagattgttaacttcactagatatgtttttctgtattggcattgtaattattctttatacacaaatattcctcaggataatttctgctgctgcactagttgaaaaggaaaggtctagaagacttggtacgtctattcttaatcaagttgttagagaagctatagcattcaaaccaccaccacgaacaagaggtggtaaaagaggtcgtgtttattacacaacacaggtagcttctaacttcttattgaaccattctgtttattcctcttaagccaacaagtttatggtctcacctttcaagtaagtcgtaaaggtcactagcgttctcttgatctctactacaactaaattttcacttccttgtatgtcaagtgaagtccttaaatcaaatacagctccttaattcatttttaagtatctgaagatatatgattgattgaaactggatcccttaaagaagtatttcaaagtcagcaaaggatccactggttacccacttcaaagtatatttgatacactcactgtcctaagatagagtagtaatatgcattctgcaatattatcagggccctttgaaatccgtactgcttttagatttgtaaagttcaccttggggaaatgttttcatgctttccttttattttcgcaccaaaggaagcttattcttaacctgcaggctgccattcgtccgccaacgtttgttttctttgttaacgatgcaaaacttttccccgagacattccgtcgttacatggaaaagaagcttcgctctgatgctggattcccaggaacccctattcgtttattgtggcgtagcaggaagagaccagataaaaaaggtgagtcgatatcaaagtgcccacttgcataatctcaatgattttaactgaataatttttctactatcatacctgcatgcatagaattagaaaagattattttgtgattgaatcattgaaacagacagaacgacaatgctagataagtgaaaaaacacagaaggaacaaatattgtgctatcagcaagagagatttttgcagtcccattatatttgatttcaccaatttctatgatatatgtaggtgtaccgtgcacatgataggttaaggaccttggtccttgtattagaacaaatataatgctaatatctgctgaggcttgtagcatcaaggtagttgaccaaagtaataagaatacaaaatatcatgtgatgatagaacatatagaaaaactatttaattgatctgggtatatccaacaccgctatgaatttcatattaggagtaatgttttgtgctctaccatacctgctgttataagtcatatgatgatgaggttaaatagaattgtcatactaattactccatctgttcttggcaggtaaatctgcagacaacagcttgcagagctcagtaatcccaagcagaatggcgttagccacatgagttacacatgcttttcctttcttgagagcggaaaaagggagagaatacagaatgctttgcctgcattttttcccaagaggtcaagactgccggtaaaaaaagagtacaaattgtatatgtagtggacgagtactaggactggaggtcatctactaggtgttgtgactacatggtgctagtataagttctgtatccttggatgtctaggannnnnnnnnnnnnnnnnnnnnnnnnnntctgacatttgcttgtgccttggacgaatactgaatagtactctctccgtttcaatttcaggttataagaagttttgactttgatcaaaatcaaactacttgactaaatttatatacaaatatagtaat

SEQ ID NO: 47365 - DNA, 3873 bp, Oryza sativa
  unsure (1)..(3873): unsure at all n locations
cccagagttcatattcatattgatagagtaagaaaaaaagaaaaataacccacacccatgcaccgacagctccaacccaacaaacctaggagaaaaggctagcaccgaactggttgtcgctatgcatgaccagtcgctgctaggccaacaaaggaactatatccgagaatgtccaaatctaaccctaacaactgacaccaagcccactctagccacctcttgagattgagggagagagggggtgagagagaatgttggaatgctttcccccctagcccttcgtcatgtccaccttgcataagctagagcgccgacacaaggggacatgcatctagagcaagcttacaccagttgtctggaaggattcggcaaggggctgcctagataatgtctccaaggagaggagcaaaggatacaccgctgtcgtcgtccattaaagtctcaaagagagccgagactgggttttcactcggcagccccactggaggtgaaggggcggcacgataacgccctcaaaaggtagagacgttagggtttagaaattcatttcaattgatttaatttacctttttatttggaaatatttaaatattcacctcgaatactccagtgaccgcttcgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctctcccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgggttacgaaggcatcaagctgggggaggagccctccctcaaaccggcgatggtgggcgcgcccgagattaagatgatcgagatagcagaggcctcctctgttgcccagtgggacttgttggcggggacggaggattgcagccctgagattaacccgaagattgtcgacctccagcagcagcagcaggaggcctctctccttcctgatgaggtcatctctgaggcagacgcgtcaatcttggcgcagtattcatcggtgacaaagaaagacgatgatgctgagttcttgatttgtcggccaaactttggttttgttacacgaccacagcaacacactcccaagaaacggcaccccaagaacaagcgggctatggggattaacttggtaagatgtttaaagccaacactatttgtatctgtctgccttctttttggacatggaatttatactgatttcattattgatgtttcaggctaagtcttcttgttcttactgttttcacttatatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaatatttatttttgttttctctgttttcttaggttactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatggtggctctgaaataaaactaacacaagacaatcttgtaacaaatatagttcgtgcatgctttgccatattattgtagggattaaattccatcagagcttttactggttgattaatactgtcaatagtattgtatataaacagtgaagattaaggcaagtaggcaactgattttgttgatttaaattcactgagctttgcttttctgatgtttatatgtgctgccttgtgcccatgtctttttgctagtcctggacactgcttgctttggcacaatgcattcatacggcccaatggtgcagtcatacctttcccttgttgttaggcttagttcttaatccctcaacgtttgttgtacaggtttcgagccaaataaatgtttgcttgttgaatatgccttgaataattttgtactattattaaataatgagtcatcttttggttaatctgcgtttgtttgtattagatgtgtttgtacatattattgatattcagttattgcgtccaaaaacatgatattcagttaatctgaatttatttggttcatctgttttactatgggattgattaccattcatcgtgaaactaatgtttgatcttttgtttttcagttggatcgagagggaaatatctgcagtgatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47366 - DNA, 6944 bp, Oryza sativa
tacctgcttccctacagcttaacaagtgcagcaagaggagtcgacggagtcccgggattaggtcctgatctggatggagatgaggcaaggattgactgcagcttcagctctggacttggagcaaatccacaggcgctgcagccacagatcgacgcggcaacatcttcgagtccaccattggagcaaaccctagccacaggagagcagcaatatgaaggggattcgaggggagaaacctacatgggtggatttgaatgatttggagtggggaagaggaagaggctggatggatttgaaggatttggagtggggaagaggaagaggctggatggatttgaaagatttggagtaagaggaagaggaggctggaggggatgagaagaggagaaggattagatagaagtgaagaggcttctggacagggtggtgaatgaagtggttttttctctctctcttttttatgtgtgcccgcaaaacaccaatatttttggcgctctatccatccatctggcgccaaagcgaaaatagctacccacctaactcccaccaaaacctattattttcacttactgctccattcacgtcagaaaaatcgcattattgtgacaggttgtgaatcctcgtcaagaaaattctatttttctgacgttagtacaggctcgtcaggaaaattagatttttcgcgataggagccattgtacacgtcagttaaataattggccgtcaggcctagtccggtttctggtagtgatatactttcataataggattcaagttctcatattaggtgacattaaagaatcatacatacattgtgtgttggcttggacaacacatatgtagtcacgttaaaccattaattagagtaggtacaataatatggactccgatcaatgatgatataaaaaaaaaacccacgtaggctcgaacattaatgacttgacagagtggagggatgattattttacatattgactctaaggttagttgtggatgacgtaaaaacatttagagccaacagtgaatttatctttgcatgcatgcattattgttactaccaatatataaacattaatcagtcttggagagttatatcaactattggcctgctcctaatatgacatgtcctattgacatttattattaccacaattattcacatatactaggctgcacaaccattaacatggttatatcttatatgctttttgtttgttggtctaactcatatccctccatgtttctctatatatataactagaagtacatctaatttttgtcggccacatagagataaaaaagaatatagggaggcgcgagaagagatgcaatcttttgagtgaactactcatgggtccatatccttgttcacatccttaattagttttttcttcaaaaaaaaaaactttcctatttgagggggagggggggactatctggcttgctaatttcgtaagaaagaggcaaattaaccacaccgcttacttccaatataggaatgaggggaatctgtgaaagagcacatagagattattcgactgccaattacgagttcgacaaaagaaggtgatccaatcttgtattgactttcttgttaggcaaattttgctatacaataacgtgactttgtggttttatctctaggacacgtcaaaagtcaatcttcaggggaaatgcactctcaaaaaaatgtggttatttgctaatggacaccgcaaatattaatttccgactgaataggagagataaacagtgtgaaaggtcaaaaatacccttgaacccacttataaaattcttccccaacatctcactctcgaccctcctcgcttgatcctatgactccgccactcgtttctgttcttcagaaacaagtaaaaaagagcatttgactaattctatcatctatagtatgctttcatccatatgtacaagatatattgagcatgccgacaaattttagttcatgtgttaagagtgctctggtctaatatttgatatgcagcagtagaagttagttagggcgttaggctagagcttcaaagaattcgagcatgccaatgatggtatacggccttccttttaagagtttcgacaattaattaatactccctccatccacagaagttacttttgacaccaagaccacggagaaattaaatcaccttggatgttacaaaatcaaggaatgaatgtaagcatgcaaccaatgagtattttagatgactctttgggttctaataaaacatttaatttatctcttcatttaagtcttgaatgtacaaagactataaatatgaataacttatttgaaaaaactcgaatgtgaaataggtgcaacttttgtggatggagggagtatgtcttgtagatgatcgacctggcctgtaaatgctcagacaatattttttttaatttaaaagaaggcaaaatttgctacaggacaccaaaagattgtggcatttgctgtgagacacctgaagattgtgtatttgctcatggacactgaaaaaagtggtaattagctgctggacactcctcccattattttattatttccggtcaaaatggagagagaaactttggttaaagacaagtttgcccatgggcccacttgtcaatctctctttatctgttcttcttcctttctttgtctgttcatctctttctcattgcgccgccgccgagctccgctctggccgagccatcgtgcgtcgtcaccgtcggcagtgaactccggctctagtgtcgaccaaaccgagcatcgtgctcctgctgcaccacctcctcgccgtcgacgatgggagcagatcatcacgtgctctagcctgagaagcttcaacgagctgctcacgggagagctgaacacacggctgcaattgagccccgacgcgtccgtgctgtcgtcattgtcacttcactccccagcagcagtaatggcggcgcacccggcatcgacgtcgacgctcaactactatgcgacgttgttcgacggcctgcagcagagcacgacggcgccggcggagcgcgtgctgctcgggatggagatccgcagcgtggtggcatgcgagggggcggagcgggtggagcggcacgagtgggcgtgacagtggtcagcgcggatggaggcagccgggctggagcgggtggggctgtgctacagtggcaccatggaggcgaggaagctttgccgaccaaacattgcagacctcatccgtgctccaggatgccgccgtgcgtcattgccgtcagcggccccagcgatgcgctgccgccgccgccaccaccccgccgtggccgagccctcctggctcaggccggccgccgacgcgaggagaaatggggaaaagaaaagaagagagagaggaagaacagtacgtgtccaggggcattttggtacttacacagctctttctctctccattttgaccggaaataataaaataataggaggagtgtccaacagctaattaccacttttttacagtgtccacgagtaaatacatgattttcgggtgtctcacagcaaaggccgcaatctttcagtgtcctgtagcaaattttgtcttaaaagaatgacaggaactcaggaattaatggtcgacttatattggttgcctgaccacatatatacaccatttcgctcgctaaagataaattttctatcaattaactgccacagcccacacttcattcgatcttgcaccagcaaattgaggtgtaactaactccaaatttaagaaaggctcatatatatacatgttctagtttcccctgggtactacatttagtagatgcatgtttgctcgatacagactttttaattagtttctaaaagttttttattggtgcaaatttcgtgttacatgttcagcctgttgtaccaaattttattttatttttcaaacagaagggtggcactgggaatgagaggcagatggaaaaatgttggctgatgctgtgacatttagaggagcagcatggcagaaagagtaagtggagtgtgtcgaccaccggccttcagagcagatcagcttgcagaatttgccgcagtagcagctacacgactgcagttcctcgtgcgctctcacatcatatgatgtatcaactgtgatggatgtactttgagtgatggactctccataccacaaggtgacaactagctagctgcatgctggttcgattatgagccctagcaaactgttgatgatcacctctctaattaatctgccgcattagacaggagagaacgtccaatatgatattacatatgtcccaatataagtgcagtcgtggttttcgtgttaaacatttgaccgtttgttatgaaaaaatttaatgaaaaaataaaaaaaatcagtctcacataaagtattattcatgttttatcatgtattaataaaaaaatactaatcataaatttcaaataagataaaaggtcaaacgttggaaacgaaaacccacatctttacttatattggaacggaggcagtaagaataattgtgttgttccgcattaaatatctcaaggaataagttaacaaaattaagaagaatattagttttgttatgttggccgaccatgtttatcctgtgaaccaaagtaatttttgttagcttatttcttcagatattcaatgcggagcaacacaatcaaggactataaaattcctcaaggaatataaaattgctctataaattaagttctattgggtgagcaaagtcaattcactagctcttgaattatacactggcaaagtcagtagtccttccacaaattatatatatatatatatatatatatatatgcaatcattatttcactctaaaatattaactagaaatgattatatatccatatgggtgcaagagagaaaacagtgtaggagctgttgggggaatggctccagatttacggagctagcctccggttcagagccacccctaccctggagaagcaaccaagtcatttgagtctctcggggctgttaaacatccagaggctaatgggcttccagaggcatgatgagcctccggaggacagccagccgccgtagggtcacggagcccctccggaggccacatggtctccagggccccacggagtctctggaggccatcgatccgctggaggccaacaaggactccgaggatatcaagccattaagggccaatcgactttcggcaaacaacggaactccggaggccatcccggactccggagttggttaggatcatggatggccgggaaggccatgtgccagaagccattgtagatccttgaagtgtaatgaggagtaataaatacgcactacatatccaccaaccacctctggcgccatggcagggacgggcttgcataggccactacctgggaaacgcggctttacccgtgcggtggtcagagtttttgggggcgccgctgtaacgctccacttttcgtgagacgttaaaaactaattcggcaaaatcctaattgcgaaaatttttgttctttgtgtgcgagtctaagtcgtgccaagatctcatttcaaatcccgttgttccctctcatcgacatcaaatcctcctcctcaaaatttctcttccagttcaagtctccaaatcaaattccgaaaattcaatccctctctttgaatccttgccaaatatttgccctgactccaaaaataaccaaattcctattttgaactccttcccccaaattcaaattctctccaaatctatctccttaaaaaagtctacttgacctccctatttttggatagaccggttttcctcccctggcccatctcccctcccagcccatcatcttcccccctcgcacgtgcgttgcacgcatgcgagccgagagagagccgtcgctcgctctctctgtttctctcgctctctcgtcttcttcctctctctctctgtttctctctctctctctcgttcgatctctctctctcccatgccagcgctgccgccatcgccgatttttcccgctgccgccattcgattttcggccgtgccgctcgttcccgcgcgcgcgctcgctcgaggccagccgctcggtcgccgccgcgtcagcctgacgccgcccgtgactacgcgtcgcccagccccgcctgtgcgcatgcgtccaagggagggaggcagagccctcggcctcgctccctctccctttcctttatcccgaaacaggaaggagcagagctccctttcttctccacctttttccttttgcccgaccaccatcggcgtcaccgcctgccaccaccttgaccacgccagctcgtcgtccttgcatccttgaccgcctatgtcggttccccctcccaaaccgcctcttctccatctataaagcccaggccgagcctccccatctcattctctctcggcatctctcttccaccgccgccgcgcctttgttgccaccttgcagctgtcgacctcgcctcccttcgccgtcgcgcgtgctggtgaagccggcgtgtgcgcgaggagccgaagaggactccggccacccttcttcttccccttccccagcccaaggccggagaactcgccccgcgccttcgaccgcccatcactgcccgcccggctctatagtgcctcctcccgttccccttcctcgctctccgtcgccccctctagtctgcgtgatagctcagtggcactcccgaacacgcgtagacgccgcccctagacccgccgccgcccagcatggcctcgccgccgttgccgcccgctcccggaggccgccgctcgtcgccagccctccttggtgctcttctgccccatcggacgccggaaacggactccttgaaccccggagatgcttccaccgcctctaattgaatcctcgtcgcccctccgccgtttgccccttttctcaccgccggcgagcgccgccgcgattcgtcgtcgccggtctcccttcggtgaatccgagcggggtgcag

SEQ ID NO: 47367 - DNA, 15976 bp, Oryza sativa
gcgtaggcgccacgtcggtgccaactcggctagaccgagtcaaaccggccagcctcgcttccccctacgtgcgtgcgcagaccacggtgagccatgcggctacacgtgggcccatcgcgcctcgctccacccggcgcacgcgcccaaaccgcgtccaccaaaccctatcgccgcccctcccgtgagcccttccctcagtgaacctagtcaccgacaagcgggccccacccgggaccccgcgaggtgcacccggtccaccggtcggcctccccctcccgcgcgcccctaatgggccgaccacccgcgcccgcgccggcccaatggcctgaccgcgctgcgcatgaccccttgggccgcgcctaagccgcccgagtaagtctaaatgacatccctccttccttttcttttccaaaggatttgataaatccttttcctttagacagaaaatccaaataatcttaggaaatccatatctcctcaaccgctcgtccgattgactccattcctcttccagtaattccgtaaattgagatctatttaatggcactattatttagtctaaatagggtctttttcttggtcttttgtctaggttttcgattgtttgcgtatagttgcggttaccggattttcgtcgatcgtggatttctcgaagattcgagaagctcagtgaagactttgagcaaggcaagtcaccctttgtccaattgctcctataattggaaaatcattattattttgtttgcaacttgcattattagaatcacacacttaatttgcttggcctcggtttgtgtgccaaaccgacggacctacccagtagtcgcactaattcttgtaggctgtactatcctgattccttgtcgctccacccttgtggtacttcggtatccgtgctctctgagcgcgtatacctaatatcccacatacaccgttgattatcgaaaacttgggaaatgggtttgtgaagccttcaaaatctgacatgtggtgtcggtgtgtttgaaaataaaatgaattgtgaaaactcgcgatgcgggggttgtgcctatgtggcactgtcctgtattcgcatataaggaccgattcctgtgggaaactcatcgaacataatcaaagtgcaaccacaagatggaatgggacaccctggctaagtaactagtcggttcagggaaacctcgcatgccaatagttgggaacgccggggcggggtcaggacaaaccgagttcctggtaaggcaaggacgagaagcttgctctcttaccgatcaaggtggttggagttgatttgtgaatgcctaaaatggtctatatttatctgaggatttgatccttctatgtggcatgaggtaaccctgggtcggcttgggaaaggctttgtcacgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaagagttgttgtggattgggaatcgtaaccagaattagcctatgtggcagatggatgacctgagtggtcagaaacgaatctgtgtgattcgggatgtctgcgggcatcatagactaggctgaccgagtggaagcggattgctttgctgctgggcagctggactctgggagtctgcaaaaatgaaaaaggctctggcagccgcctaatcagatgaaaaaggatctgggagccgcttaatcaagtgaaatggctctgggagccgataagtaatgatctgacccgggaggtcggtacattaccatttgagttgttgaaaagcatctcttaagtcgaatcgagacgcaagtctccttttcgacccaaacttaaaaagaaataaatcacttagtgatttcaaaaatgatttcaaacaaaggatttgcaaaacaaccttgtctctcttccaagcttgcattaaacacctaagttcccgtgacttgctgagtacgaaagtactcacccttgctctatataaatatatatagttcctccgtcctgaagctaaagatgaagtgaattgaagaatagggtttcgtcctggttcccagccgtcgcctgtagtgttgggtgttagaccgttggttccgctgttgttgctgttgctggtgtttcctcgtctgtgtcttcgtttgtattctcaggctgtcctgagctgcaacctaagttaaggtaaataagtcctctatttattttaaggatttgcaatgattcatatttgtcaccgtgggtaccagcactatgtcctgggactggtactgtgatcgcggtttcgtaggaagcggttcacgccgtttttcctacgacacgctcctgtcaggtgccgttgtacgagcacagccgtccctgtcacggaggatattactaggagcccgagggctggcccaccgggcagccaccttagattagtccaagagataggggcaaaaatataatttcctcttgtatacctagtataaatgcataacactgctcacgattaagggcagaattcgcgttgaatgcactagttggaatttgtcccaacaggagcagagaattgactagtaaacttggcaagtgagttgctaataatttcacatatatatgaactaatacttagatggctatagctaggagcaatttctaattaacaggttagtacgaagctagtaggtaagggcaaatggaaatgggaggcatctcggagaaatgaaggactatggcacggtcgatgcctcggtggcaaccaactcatagactcttgatgtgtgttgagttatcaggatgcagttgagttggggaaaatgtgcaacttatatctactccctccgtttcgaaatgtttgacaccgttaactttttagcacatgtttgaccgttcgtcttatttaaaaacttttgtgaaatatgtaaaattatatacctacataaaaatatatttaacaatgaatcaaatgataggaaaataattagtaattacttaaattttttgaataaaacgaacggtcaaacatatttaaaaaagtcaacggcgtcaaacatttcgaaatggagggagtagtagagaacctagatccatcaaattttactcccggctaggatgggactctatctgggttggctgaagagaacaaaattagagttagtttagtcttaccaatccaacaggctgatcagcacagtgtttgcactttcgtttttgaataaaatttcacaatttcggggtcccgaaaattcaggatgttcaaaacttttttggacaaaattatttgaaaatttaacattgttataatatccaatattgaacactcaaatgtgctagagtatagtacaattaatacatattgcgttaatcaggcacaactaattaatttgcacggtatgtggcacagggtatttttttacagtgtgctgaagtaccgggtgaattgcaatacacagcatgtaaaatacaagacactcatttttgcaccagagcctctgtaattttttatttattattttttctttggttttcacactgttatactacatcttcctcgaaaaaaagtacactccatctaattgaaatctcgtggaacacgatcgaaatttatgatgtagctttcatgattcaaacctgaagaaagaaaaaggaatgttttttcacataacctattgcaacgtgcgtgatgcatgtcagagcaaaaaaagaagctgatctgcccggttagcagcgctgacatctttcaattatcagtgacaccagatacacctactgatatgcaaaagttgttattgcctctactacaccttctcctttaaatacattttatttattttcgtgcaatgttccattgcattctgagaaattaatatcagaactgtttttgtcatacatacttcctcctttccccctcgtttctcaaattgagcagtgtcatgaatcatgataggaatgggtggcatcaggaacacaacatttacaggatactcgatgtactcgatcgatgcagtccagcaacggtgcgtaaggtagcatgcgaccttgctaattccacccactgtatctctttcgtacggttgaatacactacactcattcaaaatttacaaatttgcagtttttcatgttttgatcatgaaaattaaatctagcataccatccctcgatgctcgagaagtttttgatgcaaactgttcagataaaaaatggttgcgtgggtagattgggccaatttgatccctttgtaactacatctgtacatgtacatgcatggacagaacatcactatgtgattctccttagttataaagttatcagtcccatttttccattaatttgcattaaacaagcttcaagaaaacacctgctctgattagctatagcttctttcaattatgagtgacaccagacacacctactggtattcaaaaaatgttattgcctccactagctaccttctcctttaactattttatatattttcccccaacgttccatttcattctggtcttccatatcttctatctttttaggcagtgagaaataacctcatgttcctatcttacttcaaccctttgtcacttagttcctctgatgttgatcagtgtcaggataagaatgagaggcatcagcaacacatcatttacaacatcattcacagactctgtcgacgcagtagtctagctaccaacaattcatgcactgctggggaactcatcttttagtcatgtttgtaaccccctttagtcctgggttgtaaactgggaccccgataccgggatgtctcagttgaaataaccgggactaaagattcatttttagtcccgattggtgttaccaactaggttttttctttttttttatttttattttactgcttgcatattgatttccccaaatcaagtgctcgctacataacaaatcacagattcatagatcaaatacatcacaaattctaaaaaaaaatacatcacatatcaaatacattgcaaattctcaaaaaaaatcatcacaaattctcaaaaaataaattcttcccccgcatgttgcatggccgcatcgtcaccatcaagctcccgtcgctccaccgctgccgcccgaccgcggccatcaccgctgcttctcccggccggctgctgtgggagagagagatatgcgagagaggcgagaagaccagagcgagcgagagaggaatttcatttattcgacgtgtgtggagatcaatagaggacaaggacgtgggagagagatatttagtcccgaaatatatgatctttagtcccggttggtgataccaaccaggactaaagattgttggggggcttgacacgggctgacagctattgaatcgggactaacaatgatctttagtcttggttggtaacagcaaccgggattaaagattataaagtgccattgagcttttgaactggcgctatagatattcgaaccgggactaatgtgatatcccttctccagtagtgttggtattaggtattccaattttgttttgggccaaaatgattttgaggcactgaaatttctgaaatttactctttttttgcacgaaattatttgaaaatttgactatatttaaataaactttgatcaaatccacaaaaagttgggaaaaaaaaccctgaaagtttcagccagtatattttgccagaatggggcgaaattaccaaaccgaaaatgtaaaccatcctcgatcctcagtatagaatgcttacatccctgtcccacccagtctaaggcatgaactcgaatgacccttaacgcggcaccatcatcatatttcctatggcagcatgccccaacactgccaaattcatatgggaattaaactagcagggagtaggcaactcgattttttgatggcattggtacagcgcagtgccagtgttggtaactatcgcggtggatatctactacactgcgtatgtttgcaaccaccttgctgcgagtatgctaatccacggagatggctcaattggactgcggaagcgcactggagacagcatcggcgcctgccgatgaagagatagtactatatatgatacttacacacctttctcgagttcgctggttcgattaataataactacagatcaaaaatctctaggcaatgggaattaattatgtaaggaacttacaagtttgcaatggtacataccgcaatcttcttcaatgatcacaaatcttgcaaagatctaagcattgaaattccacgtacatgtgagagaggcatcaaaagtgcagctagctaggttaattattagtgaaagggtatgtagtctaatagttacagtaacttgagtagtatccaaggtgttgagttcaaatctctataggagcgaatttcagattgggttatttgaggagctaagttcccaacttaaaaatgagttcaaatctccatagaagcgactttcagattggattgtttgagaggctaagctccccaacttaaaaatgctgcatgtatccagttagatgcagagaccagattaattaggttgcctacaaactgtcaaggttaatgcttcagcttcactttgtcataatggtcattatggttttgaacatgcaaatactgccaactagtacttccacatgcaaaaatcaatgtgtgatatcactaatttaccccttgtactcccaacatttccatttgcctccagtcaaaaaaaaaaacatttccatttgcccaacatggtcctgtgtatcaatgataagcccctatatccatttggtgcaatagaagaaaatattttttttctatgtgaaatagcacgagaggcttctattacaccatattataaaaaaaaataggaacagggctagagcagaagattggctagtgaactttgccaagtgactttctaataattttgctagctatatatatgctgaagtaatgtagattgctagctaggagcatccatgtttaattatgtacgaatttctaatggacatgagaggtatataggaaaaatgaagtaattcgattggtctcttcattgcacactggaggattctggtgaaaccgatggacatgccaaggctgcagtgcttgatctcgtcgttcttgatgagattggaagttttcaccctccaagtccccacgtaggcgatggctgatgctggtcaagctggtgatctgaaggagctagaggaggctggagtggaccgtagtgtttgttccagcccactgtctttgccttggaatacgtatattttgcttctcttatatctttgggctgtgctatatatgactggaataaatctattttatcttcctccactctttgggtcggcgaccgatgggctatggcctataggggcgggggatcgatgttggcctgtggttgtgctgatcgttgggccgtgtcgtgctgggccagcacgtcgtgccgaggaagaggcccaaacacggcttaacagttaggacgggccggcacgagcctgataacagttgggccgtcctgtgcctgggccaggcaagatctccatgccgtggaccgggccatcagactacgggctttttggccaactatactcaggacaatggctcaccatctcaaagaaaaaaaaaagctcatatttgtactgccctgggtactacatatatagtagatgcttgttgcttgacacagaccttttaagttctacaggttctctattggagcaaattaggtcttacatgtccagccctttgtatatcaattttgttcagaaagggaatgacactgagaatgagaggcatctggaaaactataggttgttgccctggagatcatagcagcagcatgtcttacctagtacatgaggtgagtcgatcacagccgttgagagcagatcagtttgcagtgatgggcagtgtggcacccatgacttccattgatcgtgagctctacacatcatatggtgtaacagctgccagcagcgtctccatggacacacagccgagttgagtcatgaaatctcaatgcccggataggaggtgtcagctagcgatctggatcatgatcagccacaacatattgttgttgttgagcactaattaagctgcacaattacacaagagaggatgattggtatgcataactgtgtatactaattgttgataattagcccatgcatgcattcatatggatgcaagagagaaacaggggaggaactgagaatagggtagcgaattttgcaagtgacttgctaaaaatttgctatatcctgaagtaatagtgcttagatgactatgagcatccaggtttaagttggatttactagttaacaagctagtactacctccgtcccaaaataattgcaattctatgttgtttagcatatattaaggtttgagaagaaagactatggtgccactcattaaatggtgtttatgtgagagtgagaagacggttgagggtaaaatagggagaaatttgaatgagatatgattgatggggcaattagtactctagaattataattattttgggacgaattttaaatcctagaaatgcaattattttgggacggaggtaatagttgaaaatgagaggcctataggaaaaatgaagtgccggacaaggtaatatgtccttcaatttcaagacatcttgtaagcaaattaattgtaacaaggttagctgctacaaattaaagcttgacgagtgtacaacttgtttctaccagagcatgcatttagatccatcaaattttattcccggctaggattgtggatcaaattatgtcatcatcagacacactggaaactcaaatgaaaatacacgtgctagactgctagtgtatggtacaattaatacgtattgcagtctatctaggaacataaatatcgcacaactattgcttgctatttaatttgcacggtatatggcacgggatatttttgttgcagtgtgctgaattactgggtgaattgcatgacaggtaaaattcaagaccctcatttgtactagactgcctctgtaaattttttttttttggttttgaccctgttatatagtccttctaaagaaatacagagtataataaagctgtaccaatgctgtatttgtgttttttttacactacatataaagagcaattttatgatccttaaggaggtaccatgaaatactattttttctagagcaattctacagtccttgaggaggtaccatgaggtaagaaccgtagaattgctcacatataaaagcatcagagtagtgcgaagaggagtgctttccttccctcgttcctctctagactctagtgtcgagcagtgtcacgataagaatgagtggcatcagtaacacaacatttacaacatattcccagcagctgatgcagtctagcgacggtgatcactgtagcacgcttgcttacatgatccacccaccatctctctttcctatggctgaaccagaaccggcaactagcaggcggcacgcaggtcgcctttccaccgttgttactgaggcgctatgttaacctgcttcactgatgcaagaaacttgacaaattggcgatgatgcatattgtatttggatgtaggtgggcaaacccgctaccaccccacataaaaattcacttaaaagattttagaattattatataggtggggcaaaaaactcgctttcccgcctccacttggaacctaacactgcactcttctttagtctcgcaaatctttcaatatttaagcatgtgaattaaatccactctatcatctttcaagatatttttaaggggagctttcggtggttgtaattttcaatgatcaatgtttgatccacatgaataaattaaaagccaaaaattaaaggccggaatttcacctccgggaccatccaatcagcccatgaataagataatcgaataatacctactaacaagagatattttataattcttaaaaggcaccaagagatattaaaaacttttagtgtaaatttatgcaccttctagtgctggaggtatcgagggatgccaaattttacactataaaatatggtatgtacctgtcagtacctcctccacaactgtaaaatcactcatataacaaaccatatgtggccaaaaacaacttctcggttgatctacactagctaaattggttgcaacttgcaaaaaaagcaaatacacatgcacgagagctacctaagctagcatgctagtgaacagcccagcaatgaaattttagcttcaattatgcagttagctagctcgatcgtgagaaatagttaagtgactcaccatctcaaaatctagctctatagaaccaattttttttaaaaaaaaagagtaaagtgtacgggcactccttaaacttgtaggggtatgccatctagatccctaaactctcaaaatgcatatttaagtcctaaaatttgtcatagtgtgtcatctagatcccaaatcgccacaaccccttcaggatcctacgtggcgctgatgtgacatgccacacggacatgatgtggcatcattttgactgacaaatgtgacccatttaatatttttccttcttttttttcttctctttgttccctttcttctcttttctctgtgacccgagcagaagaaaggaaaaaaaagaagaatgagaagaaaacgaaaaagaaaaagaaaagaagaagaaaaaagaaaatgacatgtcacgtccatgtggcatgccacatcaacgccacgtaggatcctagaggggatgtgtcgatttgggatctagatggtatactttgacaagttctgtaatttggatatgcattttgagagtttatggacttaaatgacacaatactacaagtttactaaaagaaaatggtacgattggctcagctttttagtaccctgagtacaatatgtcaatatatagtagacacatgtttcagcccgtttgtttacaattttggttatacaacttcttttgaaacaaatttagttctacatattcagcccgtttgtttacattttatttgtaagaaaagaatgacagtactggggaatgagaggcatctggaagaatgcaagccgtgacattggagactagaggagcaccttggaataaagaggccgtgtagggagtcgatcgtcgccgtttaagtccaatcggcttgcggcgctgaatacagcagcagctacgtctccggttcttcctgtgatcccatgtgatgtgtcagctgcctctgacgtctcgttgcgtggatggcttcagctcaggaattttctacacatacatggtggtgaaaactaactgaatgatcagtcgtaactgagaggggagatgctgccagtggcctcttgcagatgcatctattctccaaaactgattcgatcgagcaatccatggatagctagagagaattcaatcccctttagttacagaagcacatacacatggacacaacatagcacattgagatgctttccagcaagaagggacgacggtaccaaatcaggagcgttcattggatcgaatgacagagcttggttaccatcatactttgttggttactttatataagatagatccaaaggttataactaatagttcatcgatttaaaatgcataggagtattcaaatatgtagcttaaattatggttgtttaaatatctaacgttattgcgaagtgagcgcaactcaactggttagatttcttgtggtgaaacttgcccacatgggttcaagtcatagacttgacataggtgctcgtatttacagctaattattctttcagtggtatgtggcgtacccgtcgacaacaggacgctcacggtgacttcatcaatctcaaaatgtgccatctcaatcttttgaaggtactctaagggctagggtgtacgcgtgttgagtttctaaaaaaatatccaatattattgattgtttctattttagtttaacaactaaaaaatagcgaggggatagcaaaatatatttgaattttttcttaaaaatgtattgattagtgaataatagctagtccgtagaatatatatgatccaaagtaatatttttttaataatatagttaacttggttctttaattttaaattttgtaataaatatttaatttatcccctacttaggctacatttgatctcattggttgagcttatgtagggcacgcaaaatgatgtaggtcatcaattcaatattaattacagtattatattaaaacatgaaaatagcattttttttaaaaaaatgtatagaaagtatttgcaaattgaacacgacggtttagttgttcggagaacatggtcaagataaataagggagagccaatctgataagcattttagaacacaatattaaatttattacttatgtacttatatattgattaacttcattatatatatatacatatatatatatatatatatatatatatatatatatatatatatttatatattcaacatcgccatcaccatggttcattgaacaataattccttggtctagtactactatatagcccaagagagaacggccatctactatatagctagctcatatgagaatttgcctctcttgttgaagtagtgggtactatatagaagatgcatatgttgcttgatagatacagatggtactatgaatgagaggcatcagaaagcatacgaggtgtctttgtgtagactagaggacaaccattagagggaaatggctatggagcaagtccatgtcgcctttagacctgatcagctcagcttgccgtctccacatgatgatcccagtcaattgccactggcatcttcttaagtcgacggcatcagatcagggtttcgtcacaccctattgtgccacaacatatatatatatatgtatgttgatgagctcttgaggccacccaagtggatatgacaatcagtgaatgcatggctgtattattccagtcttccaaatagaaaatgaagaaagtaaaatgccaaaatgaaaatgaatgttgttatattggagactatgcccaagtagttgtcgcaatagtgacattggagattagaggagcaccttggactaagagcacctttaccatccttgaaaagaaagaagggataaatcagggccgtccatctaattagatccaacggtggttcagactttggtaccttctagtatcgtctctccatctgcaccaggtacaaacctctaccccaatctccggcgagcccgtgccatctgtgcctcctttgcatgctcgtaacctccctttcagtgtcgaactccactgcatgccttgcccctcctccatttcccccatccgaaggcccccaaagcaacacctttatcttaatcaggacaaggcagcttaggggcgctcgacgtagaaaggatggtgcaaggaaaaaggataatgggtagggaagaacatgcgagcaaggtttacacaaattcgatgttaccaatcttaccccatgtcaatggatggcaaggtcttcctagctctattttttgcgagttccattacaatttgaacgtttgcctttgcgacgctccaactatgggggtattagagatatagagttatagacatgttttgtatcttgtcctagtcggtttccctaattctctcctgattctgattcatgtagagattaggaaccgcctctatatttactcgtggtccgtaattaatcaaattatcacattgactcaattgcgctttcactttgagccagagcctttgaagagagagaccctcttacaaaccaaggatgaccgaccctaaagacaattgaagatggaagcagagatgctacaatggggaaaatttattctccccgaatgctgtagacaactggaattcagcaagaaatttacatgtttgcaatgatacacgagttcacaaaggaaaaaaaaaagaaagatctataattacagttatatagatgcaggaaataaagggtactgtttccttaattagtattttatttgcttcacaccataagaaattttggattttgaatatatccacgcatgtgcttaatgaatctaaacgagggattgagaggctaaaatatcttataatgtaaaatatagggagtacaaatattacaaatcaggatttttttttatcctcccagcctgccttcacacattattttcagcttggacttcctactgcatctatataactactagtttgcatccaacattgcattagaatcaatgctttgtctttcagacatttccttgaaacgcatatcttcattctttgcatcctgaccagttcatcgaaaattggaatgagtggcaatggaatacaacctattatacctctgctttcaacggttcttatcctgcaatacattgagttcactcgttggagggctcttgcaacttgggaggcatttgcacctgcaaagcatgattaagttttgttctgaggagtaaactctccagcaaaaattcttgaagacgggagtatgtctgtctaggaaggattcacttgaacatctgaacttcgaagcttctcaaaccaaggttcaagttcctcgtgaagagaacactatcctcttactatgtgacatcatgtctctgagcaagaatatctaattatgtaccaatcgggaattggagaaagaagtactaaataaaattttgccgtctccacggagagcagggaaaacaacaatgctttcaaaatatctttgttgggtgcaattgtgcatagcccaggtttagcatctttgttgggttctatttatttccagcataattctgaccatgggatcacatttcagcatcacaaattggtccacacaagagttggataaatactttgcaccggaacattttttctagaaaaacattatgaatttaactaaaaaaatcacagaaatcttgatcgggttggggaaattgtataaatagaacaaccctatcgtacgtggaaatagacaccacttggatgagaagttagtatagctcaattggttagactcctggtcgtggaacctgcacaccttcatttatgtcctagactttagacgggcgctcgtatttacgtttaactattcttttatggcaggcaacatatctatccacagcgaaaccacggtggtgacttcataaatctgaaaatgtgctggcccatttttcggacgtgctcataagggtgcgtgtgtatgttcctaggggtgagggtgcatgtgtatgtgtgtaaaaaaaagcacacccagttggcctgcaggatcgttaattgttctgtcgctttcacctttatatactaacatctaattttacaattttccatttaaacttccgtattttccagtatcttttttagctaaagagaaatggtcacctgttcttgtcttacaccttcccttgccccttgccaaaaaaaaacaataatcacaatgttgagaattcgagataggaatgggtgacatggggaacacaacctttactggatactgctgatgaaacatgcctttatctattcatctacaagattcctggaaacaatgccttctttgtctcaatcccctgctcctacttgagaccaagagagaactcacaaaatcggaatgagtgacgtcacgaatgccatacatagtctgcgagtaaaaacaagtcaaaattatatatgttcctaagggcctgccataccagacacagttatagttagtctacatgctgatcatcgaatgagcttttgttacaggcaccgacaattccattttctcactgaacgatgagaattgaattacaatattatgtgattattcttcctatatatagttcccacttagacacatcatcaccatcattattgctagttggtgagctttctttggtattgctctagttgttgttggtcatatgaaattcgtgcttttttttggacccgcctaattttttggatgcgctcactactacatgtggcccatgttgccgaagtgaatggggatgag

SEQ ID NO: 47368 - DNA, 5458 bp, Oryza sativa
gacagccttcaactaaaacaaaaaaaaaacaaaactataaaagtgttaagaccatttaccaggcatactttcatgtcaaaataagacacaattatcgatatatatatatatatatatatatctttgtttgtatttgtggtaatgctacaatgtgtattagggtattagctgtctgtttggtcatggagatggatgaatttgaactatactttactttcttctggctaatatgtggttgtccatatttatcttttctgttttgacattcaatttgcaagaaacaagttacaaaaaaaaacacctatgccaataattagcagtacaataactgttattgcgtccccccagcttctcctctataaattttgctatccattcaattgaatccccaccttttcacatttcaattcccctatgaaatgaaaaggaaactaactcgaacctgatgtcaagcattgtggcgataagaatgagtggcttcaggaagaagatgcgtactacccaaaagaagcagacaatctgtggacaagttccagtaggcatgttcagtacagaaggtgtttgacatcgttctgaagagttctgttcatgaacacacgaacccatcatattgcatctacgtcgttgtgatggctttctcgccacagttggcatggcgcgttgccagcatcgccaccgtgctcaacggccttcaaggtggaggcgggacagtgaccatggacaacaagagatgagagcatcgctccaagaggcattgcgcgattatgcgtatgtgcgtgctccttcgtgacagtttgctacgagaagagcgatagcaccttacagtacagtaatgtcgttgtcgtggctgtagactgatgattaacataataatcgagcagtccactatagtttacatgttagtgggagggcatgatggacaatgtttgaccgtcggatggcatttcgatgtccgagatgctggagtatgtgtccgaatatgtatttaaagttaggtgtaaattaggacttggagttataatatatgttaggatagaagtaaagttaggcttttatcataggctctcgcttaaattcctcccacatctatataactagttgcatgcaagtagaagagatgctttttcttttattcttttccttgccatgaatatcttcatgctttgcttcctgacccatgcatggaaattggaatgagtggcactaggaatataacccattataattgtgcttgcaacagttcttcttgaagtgaattgagatcacgcgctagatggctcttgcaatacaagaaacctgcaagacatgattttggttttttccatggaggaaactctcccacaacaatccctgaagactagagtacatttgtggcctggcaagatttggatgtatttctttactaaacatttactaatttgcaatctatttgagtttctgacattcaaacatagaagtctgtctgtctgtccctttatcgatcatcacatgtaacaatttaagtcaataacatttttttacccctcagctaaggctggcatgagttgtgtacacattacagcgtcgatcctcatatgtgagttgtgtattctttcatctacaaggttcctctaaattaatacctagtgccatcttcgtagtttagttcatgggaggcaacacgatcacaaattggaatgagagacatcaggaatcccacacttagcaagagctgaataattaatcagttaaccccttacgttatagttttttcagttcgcccgtactgatcatgtgcaacgaaaaaacacggatgatcatgttgttttcttaatatgacatcctgtactgataattttgtttgtttctgggaggctagtaataggagactggcgagaggattcagacattttcatcgttgctcttattcctttcagttcagtgactctagattcagaactactagattgttaatggacatagtagttgcatcatattttgcctagctcagttaacagaagatgtgctaattgatttttgttttgttttgtgaaatcacgctgtccggtctctctttctatcttgtgttgactctgttagtttgcaacttttcatagtggcacatactagcagatcatctaacccggcttaaactgtaataaaccatgctccttataatttgttactgctttctggcttgtccacaagaaaacaacatgtcatgaatccaacacgcactttggacctgattcagaggttgccatggacaggggcgggcccagtgtatattcaagggtattcagatgtatacccaagatttttggacaaaaaataggtatatatactctatatttcgtatatgtatttaaaaaattaaaaaagaaaccttaaactgctcatattggaccttatttcaccatttcttctctattgggcctaaacttcccactcccctccccctttcctctcagcccgcggtctaattgggccgttgtcaaccttgcatctcagcccatttcgacatatccccaattcccctcccatctaaccctaattcgcctccccatccatcccgacagttgcgcaggcgtgcggctggcggcgcgccgccgagcaggcggggcttgtggcgccggcccggccgcgcgactcgtgtcctcgtgctcgtggtcgtgggatgtggggcgccgcgccgggcgcagggcggtaggcggctgcgccactgagggctgccggcacctggcctggccggctgaccggctcagccgcgcagggcaggaccgcagaagcaggagcaggacagcaacagcaagccgcgcaggacaggagcagcacaacagtgacaacacagtgagtgactaaatctgtacatgcacaaaatttgaataaatgtagtgaagattttaggattgggagctgcaattcactgatttagtgagtacacaaatttgaataaatgtagtgaaaattttaggattgggagctgcaattcactgatttagtgagagtgtacttgcttgcttagtttgtagtggtctagtggacactggacggtagttcatagttcataccatattatcaaatttgtttaattttcagaactgaaacatgaagacgaagaagggccagctgttgatttaaactcttttttggagaaacaagatggggcttcattaaaaaaaattcaatttgcaagctaaggacaaggacatcatcgattattttcaaaatatcaagcgtcgaaaagttaatctctaaattgtaagatttcttcctaatttatcattttctttcatttttgtatttcatatgttattatgttggcactttgatatgtttaggcttttaggtgtatgaacaattttttttaccccttctcatttcgaatacacaagttcaaaaacctgggcccgccactgcccatggactcctacgcatactattgagcaatttggccttcaaaggaaagggtcatgctgacgaagccgatgtaaatctttgagcattgatccgttttttctcagtcttagctgcattttagttagtctagccttgcatatgtaggcaatactgaaaatagtccaggagtactagaattcagttgagcaatttccatttctttctttatgttgttgaccgatctaggagctatatcgtgggatggcgcggtttttgcgatcctgtacgctcggccattagatgcatgtaacaaactcccaggagaggagaataaaaggagaagatgaacccagaaaagctgtgcaagtttcaagcagcgcatactctatctcagctagctgctctgttttctgaatttcttcagtctactgtagcgaaacctacaaccgtcagataacacagcaccggtgagattgagagtgaaattgaatgtggtggagcatatttcctgacaggtcattgatccaaaatgtatattgcttacatctgcttgcaatccttcttcacgagcttaccatttgcttcagaggtttacatctatttatttgaagggtgagggagggtttttgcttccctccccatgtttttctcctctcttaatgaaatgtttcagcaatcctcttatgtattcaacaaaaaaaatgtttgatgtaattttacacttttatgacacgttgtgaaaatcttcaaggaaggaaatagagctagctagccatgcatgctaggataatgcactgcatcattttctaagtcaaatcaatatacttaactaacaatccaacaattttgtagggaggggtatatcctcaattcccatataagaagatgttatatgaccaattgtctcatcaaataattcttcatcctcagatatagcagaacttctgtatgatgaatggatatatccttaatacccagctgactggtttaatattatccactggatatattaatttctcacacgtgttttgaaatttattacgccaatatatggtgaagtgccaaaaggcgcaattggtcaggccacatgactgtttatgtacccatacagctgctttttgccaagctcacctaatgtgctcataatttcctccataaattatattttaggcagtaataataatgatatattgcttcttcttgatgctatccataccaagctcatcttgataatatcctaccttctttcacactatatatatagcagaacatcttgcagtagagaacttgcacacattttgctcctgcatgccttcttgctagcaagttcccattgtggccaggcttccgccgctggcctcaatggccagggcataattcttgacgaactccgcggggttggagtctccccggtacttagagagcttaggtggtcggaagcctggtgggtacagctcctcttgtagctgccacatcagtggggactcgaggtttacggcgatggggggtcccttcggaggctagcttccctcgatccggagatactcccccaacacccgcaattttgaagcatctgacaagaccaaggaatggtactgctccataatttgcatttacaggctggtctgtactctgcacacgttattttccagcttcaacttcctactagatctatataactagttgcactgcaaagtttcattagaatcgacgatttgtctttcattcttttccttgccattcataccttcatgctttacatcctgacctgtgcatcgaaatcggaatgagtggcgctaggaatacaacgcagtataactctgcttgccactattatgaaactacagtatattgagatcactcgctggatgtctcctgcaccagggaaaaattttgcacctggaaagcatgattttgttctgttccaaggaggaaactctcccacaaggccacaacgattgccaaataatggagtgcatctgttcatgcaggattgacttggacatcagcctcaaagagtggtacatgttccctgcagtgaaccttgtcactttactatcttagaatgtcaatgtattgg

SEQ ID NO: 47369 - DNA, 1877 bp, Oryza sativa
gaccgcctccgcgagtacttctacaagtacggcgaggtggtggacgccgtcatcatgcgccaccgcgccaccggccgcgcccggggattcggctacatcgtcttcgctgaccctgccgtcgccgagcgggtcattatggagaagcacatgatcgatggccgcatggtaattaaaatcaactttgtttgcttacatcaacatgtttgtgttaagattcatgatgatgatgatggtgtgctagatccatccatggtggtatgtaatggtggtttgtaggtgttactgattgttgtcgtttcgaggaattcagaatgttttttgggattttttgttttgttttgttttaggtggaggcgaagaaagctgttcccagggacgatcagcacgctcttagcaagagcggcgggagcgctcatggatcgccggggcccagccgcaccaagaagatattcgttggggggctagcgtccaccgtgacggaggcggacttcaggaagtactttgagcagttcgggacgatcaccgatgtcgtggtgatgtatgatcacaacacgcagcgtcccagaggttttgggttcattacgtacgattcggaggatgctgtggacaaggcattgttcaagaccttccatgaactgaacggtaagatggttgaggtcaagcgcgcggttcctaaggaactatcacctgggcctagcatgcgttctcctgtcggtggattcaattatgctgtgaacagagccaataatttcttcaatggatacactcagggttataatccgagcccagtcggtggctatggaatgaggatggatgcaaggtttgggtttctatcgggtggccgtagtagttatctttcttttggtggtggttatggagtcggtatgaattttgatccagggatgaaccttgctattgggggaagctcaagcttcaacaacagtctccagtatggaaggcagcttaatccatactacagtggaaattctggtagatacaatagcaatgttagctatggtggagtcaatgacagtactgggtcagtgttcaactcgctggctcgtaatttatggggtaattcaggtcttagttactcttccaactctgcaagctctaattccttcatgtcatctgccaatgggggctttggtggaattgggaacaacaatgtgaattggggaaaccctcctgtgcctgcacaaggtgctaatgctggcccaggctatggcagtgggaacttcggttatggatccagtgaaaccaactttggtctcggtaccaatgcttatggaaggaatgctggatctggtgttgttaatacattcaatcaatcaaccaatgggtatggaaggaactttggagattcatcaggaggaggtggcggtggtggcggtggctccatctatggagacacaacttggagatccggatcttctgagcttgatggaaccagcccatttggctatgggcttgggaatgcagcttcagatgttacagcaaagaactcagcaggttacatggggcattaacaaatagaggttagatatattcttaatgcttatgttctgtttatctaaagttccattttgttgctggctagtgtttcaaccattaccttcatgtggtgccgctatgatggtagcaatgtgaaaacagtgtctttaaatattgaatattcattctgctgaaacaatatcgctagatgaacccatgcatattcaatgcttatataggaaatgtttttaccattgcaaatataatgctagtgttagttgtcctaggaaaatactggatgacactgatcattcaagcgtggtaacaccacttggcagtttggccttttatagaaaaacaagtgtgtgttttttactgcttct

SEQ ID NO: 47370 - DNA, 732 bp, Oryza sativa
attcctgcagccctgatacaaaagatgcacaatacttctgtgcattctcaaaaaaatcccatgtcgtgtactcgtgtggtttggcatcgcgctgcttctgaaactgttgcagatgtggataatggatgtggagcccaatcaattggcaaagagctgattatgtgttaatggcttagtaacgaattattattattattattattattattattattattatgtataaaatatttatatatgtgtccttggcaacttacaaattaatactgaaaaaactacaggcctatttagattgacgacgttttcaatcatacaattatttggtaaaattgataattatgtggctacgtttagtttgttaggcaatgtgtatagaattttgacaacattattaagccaatcctaccaaaattttgacaatgctatcaatttatcaaaattttggcatcatcaaattttgataatgctcattttggtaccaatccgaacagatcctacattgaaaataatttagcttgaaaattaatttttgaaatttaaattttgacagtcgtaggacaaacaataaggctacactggacgggtttcatttccatcttctcgcccctcgcatcgaactgccgttttctcaattatacggaagacgcgcacatgccaccacgcatgcacaaaagcatgtaccgcgattttgatgggagcgctagccatggattccaatttcatacccacaca

SEQ ID NO: 47371 - DNA, 23937 bp, Oryza sativa
  unsure (1)..(23937): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaactgggtttgactgaaattatatcagttattaggtaatcagccaacggaattttttttatttgaaaaataaattactatgcagacaaagagaaggctaatgaattgcctctagaacttgctgttctacagttcttccttctactcctgatcgcccacctaagtgtgccagatatctcataagcatctttgttgtttcggtcttgccagcaccactttcaccactgaccaatatagagttgcttttcccttcatttatcattgctctggttgctcgcattaataggtcatatcagggaaatgtaggtatataaaaagtacaatctgctgacaggatcatatatatggcaatatcaatattatacaacagttcacctgtaagcaacatctgcaactgcgaagacatgaggactcagctccccaaaatctgcacctttgtattgttccatcatatgggtatcatagagatgtggcaatctttgaaatgggtttaccgcaatcaaaatgctgccagtgtaagtctgggaatgcaacagaatgataatcatgcgctagtcatgtagtgcatctaaagtaagattttgggcagaaatgataaggcactcacatatatttcatttagctcataacgggtagcaagattctgtagaacaccaggttcatgtaagtatgataatcttgtcatatcgtccactcctcctggtggagcttccatatccttggggaaaacttttgatttatttgtcttaacctgtgcaaaagcattacttgtgatgaaactcgtaatccattttatgtcaaaatgatacaatccatggttacaatgaagccacatataaataactaaacaaacagtattgcgaagttctccttgtacattaaaacagagcaaaatagatccattgaaggattttaaggaaatactaagaactagaaagagatgatctgcagaatgcaagataagaaactgcaaactgtacctttttcccatttgaagtctgcacatgaacttcattgtcttttatgctaacaacctctccatctatccaggctagaattgggtcctcgacccaaacatgagaaccaacaataatattaacaggagtcccctgcaaaacacatggtgcagtaatcaaacagatgcctagataaaacagaactaagaataatttaaggctttgatggatgatctaatactcctccctcattctcatgcagagggttgtgttacatcttgcgaaattgtcatatataactgacaactgagaatatgcataagtatgttggacatgacagaggataaaaaggagacgtccatgacgtatcgctgccaactttaccaagcatcagacactcagggttgacgaatacgtcatatgacatatcattaaaaggcttttcaagaaatagggattttagccgaaaggtaaacacaggatttgctttagtggaatgagtgattcgatgtcctcttctttttttttcctccaacgtgtaggtcataggtggattcatagtagatctcgcaggtgaattttagttaacaattcctccaatgattgtatcctatacttacatagttgcctcccactaactgtagtaagtgctaattctctcatctctcatgtagacacattacctcaattgttttcatagtattttaggtgattgtctaaggtacaaattgtctctcttttccacaccatgcatatcaattatgtatagcctttggagaaatgattaaaggttcttatcgtacaaagcacatgaaataaaccatttggtaacaagaaaattccgacttcgctcattatgcctaccattttatcatgcaattttcccacagcaaaaacacggggtctcatctagaagattgataagattcaaaaatcagagcactaaaacatcaggctaacattcactccactagtccacttaccatgcaatatgtcaaaatcagttttgtgatgtgcaaacttgttaaggcttgaaaaccttagtatttgtcttttgcggtatcagagtatcatgaattcatgatataaaaaccttggtatttaagttttgcaaagtataatagtgtttccttactagttctttcaaaacctcagtatttataagttttgcaaagtataatagcatttccttactagttgcttcaaaaccttagtatttaagttttgcagagtttcagtaatatttaagcttaatcctagctagttggttcaaaaacatgaaaatatcagtctcctcaaattgttttagttagagcttttcgaataaatattcgagttcagaaagttgtgtcaggactcgggacctaaaaactgctcataatgcatatgaaagggcacggttccatttcaaacatcacctagcaaacttcaacaagcacaccaaaagtaaaacacaataccatgcttcacacgaagctataagcaaacatcttattccgcgtccttcacattattgcacaatcaatttctccgcaaataatagctaaccattgttgtcatccatgtcactcgcaggagccatttcacctaccaagttactactatccaaagctccaaaccaagttgctctatcccaattttgcatgagtccaggtttctcgtaaggtggcaaactaggcagctaaacaatttgtaactacactacagtgagagcaatgaaaaattgtgtagtagtaccaagtaatgatggaactactatgagcaatttcagttgaacccctaactttttgttttggggaaaaaatgctgttttcgtactaaagttaagacaaatagaaaacctagcttccagtcccagatctagaagagaagatatggataacgcgaattcgagaaaagtgtgcgtagaacgagatggagatgagaaaggaagaggatgcgcgtcggtacggggtgctcaccatgacgacggcggcggcaccgctgctcgcgatggatggagatcggcgcaggcggcgggcagacgagctcgcgaggagacgggagccgcggggccgaggggaatcagacgctcagagcacgcggcggaagcagcagcgggacgcccccggcgccgctgctcgccggtggcgatggagatcggcgcgacggcgcaggcggcggggccaagggctagctcccgagggcaccgcgcgcgcccgccgccccggtctcctcccgctacccccgctgctttgccaccaccacctacccacccctagctgttggttgctgcccccaacttctctcttcctcctatgcgattcgacgcggctgcttgttggttcgattgcttcgagcgcgccgccgtgtggctctgtgtcggcttcgtcgtcggcgacggcggcgatgacggcggcggcggcggcggcggcggcggcggagtcgtggaggggaggggaaagggacagaaatggtaattacaggttgtttcgtttttagttcccttgcgttttgaaagaaccgaggaattctgctctcttggagcaaggcagctaaaatacctgcgcttttcgcttcaagggcttgtacttctcggaatttcactttttttcctcttggcattttcgttttagtccttatgattgaaaagaaaataaataaagggtgtcaatcggaaggttactaaacatttttgtaggtatgtacttcttcttcaaataggagggggatgtataatataatatgtgatggtgattaaaaagagagggattaacagttaaaacattgtatgtgaaaatagtttttattgatggcttaagcgttacttcctcggaacaacgtttgcccgctcacaaaacactagcatgtgaagagaaaaagatgcactcgatattaatgttatgttaagcacaaaatataggtttgtgtagaattcaaagtgatgttccaatattttgttctctttttttaactctatatatattagtattgcccttctagtctttttcattatccatataaaattcaaaatcataaagatgaccggtcagtaatgatgactctgaacttcaataactatatcaagtttcactcccctggtattggtcctcaagaaaaaatggttattttctcctacactgaaaatgttctgtgcccgacatttcaataacataggttgccataaaaagtaatttaagtccccttttgaaacacaggtgaaaaaacacataggaacagaaaaaacatttgaattaaaataatacttcctccctttcatattactataagactttctaacattgctcatattcatatactccctccgtcccataatataagggattttgagtttttgcttgaatgtttgaccactcgtcttattcaaaaaaatttgaaattattatttattttatttgtgacttactttattatctacagtattttaagcataactttttgttttttatatttggagaaaaaaatttgaataagacgagtggttaaatgttgcaagcaaaaactcaaaatcccttatattgtgggacggaaggagtagatgttaattaatctagacatacgaatgagaataatgctagaaagtcttataatataaaacggaggaagtatgttttataatcctatagtaattgagaacacaataatcggaaagatgagccagttgattgtaccatagaaaaaaatcaaccaaataaaaatatcacaagaggtctagtcacttgctcatttccctaaagaattggtgaaaacaatcctacgaaaattttcatatcatcttcctatgaatcaaaggattttattaaaaaaatccttagaaaaataaatcctctaaaattattttgacaatccttccatttcaaagagggccataggatcttggggttgtgtggaacttaaacaaaacatacgaaattataggaaacctcattatttttttaatgggcttcctgcatggtttctaacgttctcaaggattatgggcctattcggctgcacttaactttattgttgtgcagccaacccaaacagtaagttgagtctgctgctgtagcagcaacagctacgtacagtggctgtaccagacagccgaacaggccctttatcccacattaccacatgcacctgcatgtctacgccacaggagtacgagcacagcttcataggaccagggtgtcaagactcttcttattttttccatataggagggtgtcaggactcatgacagcaaatgaaacgcagaaaaaaggaagaaaaaggaaaaacggttagagatgggaggactcaagttgcaattttttcttgtgtgaccaactgaccatcaaccaccagaaagctcaaagcagagcatatagtttctttttttttcctcctcctcccctattgtaatatggctatttgcccgtgtggccggcacgctttcggccacaccaccagccgccgtcagcaaccggctatagtctatatagcgtgcagcgttggtttttcgcggcgtgacgcgcgagagcgcaccgcccgtccaccgagtggacgagactgcccctccggtccgcggcatcgtgtggcggagctcgtgtggccagccgctgcctgccgtcccagtccagccacacgagagccgcatcacgctcggaactttctttctttttgaaatagtacatctttaatggaagattataaaaataaatgtttattaactaaaatcataaatttaacaccttatcgaataaccgtgtcaaacaaacattgttcgatagagtttaaaaaaatagagaattcgatgtgtgtgcatgcatgcgtgtgggctgtgggtcctatcgagttcggtagaccaccctaacctgttgaacaatcgttgtttgataaatacaaatcgaataatgattgttcaatagatattgattatttgataaggtgctaaatttgtgtttttttaatcaatcaaaatgtatttttatattttttttattaaagttatgttattttaaaattctcgctcgcgcacggtagagcggatgagagactggggagggggggagctgcttttgaggtcaggccaggatgtctcgcggccttctacttctaggctggatgtgggggccacgccacgccaccttgttgccccccgaaacacacccgatcctctgtgccggggaagacttcaaggttcccctgcctgcgtctgtccaaatagtaccaggatccgtgcaagaaaacacaatctcagcagttcaaaaaaaaaaaagaagagagaagttgaaggaaacacttgcttggaactagctcaacccttgtcgattgcgttacccgagtgctgactgctgactctggattttttttattcgagaccttttgcggaaactcatttgacaggagcacgcgagcaggggtgagccgtcggcggccacggcggtgtccaaccagcctccatccgccgtcggcctccaatgtcagcagcatgcgtgatgttccttctccaatcctcctagaatcccaacgacagcattggatggggatttcgtttcagatctgtacatgttctttcagtagacatttttttcatgtgagcaagaattagtttgtgatgtgtgcaagtaatttgtgatgagatgattaattagtgcttgagcatgatatggcaacatatttatctttttgttaaatttttggggctgctacgaatgtattttttgtgtgagagtttattaaatttttgtaggtgctaaaaatatattgttcatgtgagaagtaacctcaccaattctagttgaggaagtatttttatccagatatcccaccttatccctctatccaaacaggtgatgggaccattccatctcactccatccctctaacaaaacaaaaaatagggtgcgctccatccctctaaccaaacaaaaaatagaaccatcatattccagaaaatagggatgaacccaacacatcccacttcgtccccaaaccaaacacatgcttattatataaattgatcaaaacttggcactgagtctttagggtgtgttcacacgaacatgttctcaacacaaacagtaaacacggaaaacagagcggtccattaaaatatgattaattaagtatttgctattttttttaaaaaatagataatatgattttttaagcaactttcgtatataaactttttttaaaaaaatataccgtttagcagtttgaaaagcgtgcgcgcggaaaacgagagtagggagttgggaacaaacctactgtaagagcaggtacaatagcaggctataagctagctataaacatattttcaagagataaaggaagagagagaagatcagcgggctacagatctgtagccagctgcagcacagactccaagacataatgtgtgtatgataggtgggactagatattaatagtatagtgagtaactattgtatgaattggctattacattggctatagatgatttgtagctagtagtgggctatattattaaacttgctctaagcttatatggaggagagataaaaaaatcaaaggtgttggctctaatgcaagagctagcttaacacaaactccaagacaaatacaataaatgtataagtaaaagatagagatgggagaagaaaattgtagccaatcttatagctaatctattatatatattggttttaagattggctaataataagccgtcagatctattgttatccttgctcttaaactttggagccaatttgcatggcgccgacccccatcatccggtctacacactccattcaagtcttaggctgtgttcgttactgggttagtaacccatctcctctgtacggaaaacagactagttctttggcgcgtgattaattaagtattactatttttttaaaaatagattaatttgattttttaagcaatcttcgtatagaaacttttttttaaaaaatacactgtttagcggtttgaaaatcatgtacgtggaaaacgagggagagagattagtaacaggctgaaacaaacgcagcctccaaaaactaaaaacaaatcacagaaattaaatcataaaatgttactgctgaatcaacgtataaaggggaagtggaagattgaatcaacatctgaaggggaagaggaagggacccacgccatcatcccagattattggttttataaattaataaagaaatataattaacaagcgtccaaatctagaaaacgtcatcgacaagtgtgagttccaaaaaataccatcgtacatacgactttatcctaaaaataccatcaccgttagggttccatccaatccacgtcgttaaatgcattgttcatcctatagtatttaacggcgcggaatgaacggaacctaacggcgatggcatttttagacaaagtcgtttgtacgatagcatatcttaaaacttacacttgtcaatgatatttcttggatttggatgtttgtcaatgatatttcttggattatctcaaaaataaattagcaaaagaatcataataactggtattgaagtttcatgaaattgacaagtaacattaacttgctggtctatatatgtgaaaatcatggatgctacgtttagctcagaaaatctgttctatagtttctacacgtgcggaatcatgtacatggatccaccaatgtgtgtccttggtgcatgtcatgaaatccaaatcatggcgtagttaggtggtgtttggatctaggaattaaattttagtcgctgtcacatcgaatgtttaaatactaattagaagtataataataaaattatataaatgagagctaattcgcgagataaattttttaagcctaattaatccatagccaacacatgtttactgtagtattacataggctaatcatagattaattaggcttaatagattcgtctcgcgaattagtcctgggttttatcattagtatatgtttaatatttttaattagtgttaagcattcgatgtgccctgatccaaacagggtcgtagtctatcagtctcacagaacgaaaggctcaaagttttgcttgacctgttctaattaaaagggctaagctgcacagaaggaaaatccgagaaatccaaaccgccttttacacttcgctatcatcgtttcaactccaaactaaactactgggccacaccaagctaagcaaattgctatcctgtttgacttgttatcgtcaccgcttcgttatttcttgttaagtcgagggtgaaaataagaaataaataatttttacaaaaccccagtattatgctttaagggcagttttgaattgctaccaaaatttgttctactattggttaatttggattgaagccaatacttttggtagcacccatactaattttggtagcagtctagaactttcttcactataaactaaatacaaaattacccaatcaaacaattggtagtgccaaacttgcctatgtttaatttggtactacccaacacttgacggtagtcatacaaacaaaccttaagttgcaaaaaaccataggagtagggatggcaatcgggtgcgacgggcacgggcagtgcctacccatacccttgcccgtaggtatgcccgttactacatgacgggcaaagattgttgcccatgcccatcgctcgcgggcgtgcccgtttaccggctacaacaaaatcagtgaaacaaaagtctacaagcttctaagtttgaatcgaactgaaaacattaaatattctctgccttggtgtggggtctctcctctggcggtgatagaggaagtgggagaaaaataataagggaaataaaaagaaaaccacataaaacaaagaacgtagcttatgcactacttaaaaaaacatttatgctggcggtaaaaagaggtttgtgctggcggctgagcagccccgccagtaagtaaaggccagagaatcattggttttcacaagcggtcataataccgcttgcgaaaatcaatttttgcaagcgcgttcttaagagggccacctgcgaaaaccaattttttaagggcgttattaaaagagccgcctacgaaaatcaatttttcgcaagcgcgttcttaagaaggccgcctgcgaaaaccaattttcacaggcgcattcttaagaggatcgcctgcgaaaatattctccggtgcaaaaatacaaaaactcaaattcaaaccgattcagatatgccctcaattacaaattcaagcatcctcttcttctcaccaaatcacaaatacaagtccacaatcacaaattcaagcatcgattcaaatatgttggcctcacagtgcaatttcaccatcacaaaaatcaaaattaattttgccaaccatgctgtcgatcctgcggaacaaaaaaaatgtttcaatcccagcatgcatcacccattgcctcaccacgagaagaacagcagcggttgctgaacccaaggctccgagctcccggcagcggctcgatgcgaaggaaggagctccacggcggtggaggacggagctccacggcggcagctcgtcacggaggaaggagctccacgccgtcgtcgatccgaggacttggggctgccggattgcctaatggcttgccgatggagaacttgccaatgcaggacttgaacgagtcgccgccggatccgccatctgcctcccgcaccgagctctgctgctcgcacgtctctccgcccgtgcaccgccgaccaccgctgacacccgtgcactgccgagcaccgccgccgcccgacagatccagagctctcgtgtacccccgtcgctgatcggcacaccccaccctttcctccaccgcgcctccccttcatcctcttcctccaccgcgtcatcacctcctctgcgccaaccactcccttccagctagatctgggagaaggagagggtacagagggaggggaggagcctccggatcctgagttggcggtggatccgctctctcggccggcgtcgtcgtcgtggtcgccgagtgtcgacggcgcgcggtggtggcgggtgggagcggagtgcaggaggaagggcacgcggtggcggcgacgggtgggagtggagcggaggaggaaagggcgcgcggtggtgggcgagagaggagcggaggaggaagagcgcgcggtggcggcggcggaaaggagaggagcggaggaggaagggctcacggagacagagatgggtaggagcgatgggatggggatgggagaggagcggataaggttggggagaagtgtgaggttgggagcgattttaagttaactcggccgctagtgaaaatctattttcgctggtggtacttagcccctcacccctcaatatatttttaatggcggtttatgcgtatggccgccagagaaaaaaatagagtgacgccatgaaaaattgattttgtagtagtgatgtattctagtggattttgcttctagcctacaatataagttagatttcacgggtaaatgggcaaagcgggcatacgtagtgttacccatacctgtcgacgggggatacccgtagaccggatatagagggtattggggtacgctggtacgaggatctacgtagtacgacatcaagcaaacaggaaacaaggattatactggttcaggctccttaataggtaatagccctaatccagttgatatgggattatataatggaatccacagattacaaatggaatagcagaactcgatgataccgacgagaccgtagtcgagttggttcgactagatcacccggcaacttggctcttgtaggctccgacttcgtaggctgtggtggatgtgttggcagtaagattcaatgccttaggtcctcccggggggtcacttttataccgcaggtcagttggtctctaagtagaactcggagacatcggaccccacacgatacaggaacgacccagttctgtccgagtaggactccttctatctgtggattccgcatctatcttgtgatgaatttccttaatgtacacgggaaatatccgtatacgcgcgggtataccgtatcagtatacaacgtatatctaagggtagagggtataccctatccgtaaccctgacaatacctatgcccatttacccatcggacatagcctttgacccaataaaaaacccatgggtataaaatagcgaacaaaaccaaccctaatagggtttttacccacggataaacgggcaaacgggcacaattaccatccctacataggaggttaggcatgttcgtataatcatgggtattttggtcataaggttttatagaaccacaatgttaaccatatcttaattttgtaaaaaataaaaaacaataacttaaaattactacggttgaattaataaaacatatgttttggatataatttgcaggatatcatatgcatgcatggtgtatctctactactttttaaaattctgtagtggtgacagtcactccaaccctagcagacacgcgacttattaaccgtgggattggcagatcggacggtgctgaggatcccatcgcacgcactcctcccctccgcgaatcacacttttctcccccacaggccggatcgcgctcgctatccaaccgtcgacgccgctcccctcatccttcgccgcgcccccaccacgccttcaccgaccgccactcctgctcgcccgaatcgacgccgccgtcgtcgcgggtcgacatcgccgctcctcctatcgcactcctccccgccggcactgcctccatccatccgccgcgtctcgccgccggtcgcaccaccgatccattcctcctctgccgcctgctctcccggtccctcccgccctatcgccccaacactcccccccccggcaccgcctccatccatccgccgcgtctcgccgtcggccgcacccccgcttccatccatccactgcagatcgccatcgcacgcctccgcctctcaaggtcacacgctcgtcgccaccgctcgtcgcccgacaccccgccgattggggaccggacgctgaccctgcatcgacgccacaacagccgacagatgggagatgttgaagacctcactccaacgacggctgcgcgcggtgacactaccaggcgttgagggagagaatgaagtgcaaggtgcgacggggttgttcgtccttgcccagatcaacgccgccgccgatccctcactcgcccctcgcccaggtcggtgccaagggcgaggttcgccaatctgcttcccagccgcctcgcccgctccatgggagaggtgacacctgtgcccgcctccagcgctccatgcccccggtaccatccgagcacgatccctccggcagaacttctgccggagaagggacgcatggttaattggttcgttctctttacgttgcaacccattcatttgtcaagaatcatcactgtgagtgtcgagggttattacagattgcaggatcactaatgctcttttttgcccaaaaggtgttcaacgaaatgctgcttagccaatgtattaccagaaattgatttctctgtaagtgagaatgtcatattgtcatgtcccctatgttgttatttatactaatgattgcaggattctctctgttgttatttatgctaatgtaatgaaatatccaattactatgtatagactctagggctatgaactgctgggaagttgagagtgttgctaccaagcagaaagattcaaattatatgttggagcaaactaatttggatcttgcagtctcaaaactaatctggtccttgattgtttcagagtggatgaaaataaaaaatggaacgatgcagtgaagattatgtaagcaatgttcgtgatatatcgatcctgaaattctcatagatggccattgcacaaatacaaaaatttgcaggttattaattagtgaactacatctctgtaaatctgcataacatatgttaaagctagcccaagaattaatatgttgtaaatctgctctacagttgacactgcttacattttctactattaataaccctcagttgtgatagatctgataccttcttaaaaatttgaactgagttttcatacctagcagtaggactaacattttatggttgtattgttcagctcaagatgaacaaccacaccaaccccaagatcaccaactaagcctatcctgcttcatgattgttgctgcatactccaacatgcttgctgctggtgcaatctgagccggctggtggcagatgggagcctgccctatgttgttagcagctttcttcactccaagtcatgcttgctgcctgtggtcttggtagtttcttttttgtgttgtcaatttaattattaggatttcccatgtgctcggttattggtgttcttgtatctgtttgtttcagggtgtcattactatggagtagatcatattttttttcttattttttccaatgccttgtaaaataaccaactagcagggatgttcataaatttcccccttttgtttggtttttttcagacatatatataatgaaggcatatatacacaaaaggaggagctgtttgagggtctaaaggacaatagctcaattgactgggaagttgttgtcatatgtcgagagcaatctgctaaatgttaaagaggtgcatctaacttttgtacccagtgaactgcaaatctgcaccttctcttttttgattaatagtttctttggattcagatcaaaatagctcaacatgggaatttttctagcagaggatgggcaattctcggaaaatactatatatttcttgtcgttgaatgtgatcatgtcccattattctggcacttgctgccttgattttgttgcctgtgccagccctttagctagctctctatcacacacgaatgcgtgacccttgatggttgtatgcagttgggatattttggtgagttcatcccccttccccaccccaccctctcccctctctctctctctctctctctctctctctctctaaaccatcatttatcttcactattgacttacaatttcacttctagctgatgatgatcaatcaaagctagctcatacgtattagtgagtttatgaaaaaaaggatcagatattcaataacagagttagctccttcagaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtacatactctcatatttggaagtgaataccaaacgtgtctgaaatagtgcatgcgatttaatctattctctcttggtcatttattcgcaaatgcaaagatttctgtaatttggtcgtagcttagattatggcaaccttggctttgtggtttgccatgtcatgtactgatatatgaatgtgatgctttaattaacgttgaaaagccatgaattatgtattcgaacaaattgattggatgtgtcctgaaattggttcagactttcgttctttggttactggcgtgagacgtgggagaaagacgctgaagacatcaagcataacatggagttgataaaacatcgtcgactgaatcatggaccttgtcttggatgtagtttctttggctgctggtttattacactatagtaaaactaaggaccttgtaataggctctttgtgctggtctgacgtgaagtgaaaaccttcttaatgtaacttcgctaaaattagcgttttgtctgtttaagcagtatttatggtataaagaattgcatattgcattatattgtgacaaagagtattttctgaaattttgacaatttgaccattttgaaaattttatttgaagaatagatcgtgctaaaatcttattgcaaaaatggaccgaaacttattgcaataagtttagcgtggtctattctttaaaagaattgcgtattatattatattttgacaaagagcttctgtactcagctcattaaacctgcctgcttgaactatctgatacttaagtcttaattaatgtcttgaatatatactttgtcatggttatggataccacatacttaatagaagttgactaaatctcggcaggacccaccacatatcatgtcctatacggaaacaaccttcagatataggaggagttccggtaaggaaagacaaccagagttctacatggaaacgacaaggactactcggattgtatccatattggtttccctagttctacttggataatggaacatctatgggtataaatacaagaccccctaggaagggaagagacacggccacctcaatcaacatagaagcctacatacgccaagacaagccgtcggatatcgacatcagagatacgcctggatcgaccctatccggtaccttcagaggccggccgtagggatctagcactgtctctgattccgtcgggcacgagctcgaggaggaaggctaccctgttgtcaactacgagtcagaccttcagaccgccatgtcgacaatagttagataggctaccccacatattgtattggtgtgattatggtgaataaaaagcaacatcggctccggccaacaggatgtagggctattacctgatagctcaggggcctgaacctgtataaaaatccctgtcaccatctcttttacctcagtctcgcatatatcctagcaccaacgatccccatactgtccaaatactgtagtcgtgacatcaaacgtcgacatacttaatagccaatcttatgattgtttcatttacgatataaatcgtcaccatagcgctagcgcgggcttgtaactatattttataattataaatatttaacatgtccaggatggtgacgagctaaggcaattttttttttgctaaatctactgatgtaccaacaaaatgagtgtgaaagcaacaccctagcggtgcacgggattttttaagtgtatcgcaagtgcacaacattagaatagttatttacctatatgtagtaatttaattttgaggtgatcatccataagaaagtcttctatctatgttgtctttttataatttaataaacaccatgagattgttttatatatgtggcagaaagtttgcactatacttctataatgataacatatttcttgctttgaaagtaatctatagaacaattatgatttgtagtttttttggattgccagattttttttccgtgttcaataaattttcactcaatgattatttaatatcttttcacttaatataatttgaaattgatatatagcatttcccgttgcaacgcacgggcaccttactagtcaaagaaaaaatgtttaatgttgtggtttatgactctataaggttataatggttataaaacaaattggactactccctccatcctaaattataggatgtcctatttctttttaggaagatcaaacttggtagtttttgactaataagcatattaaccatatatttatgctaaatattatgtatgttatatcactagattcatagtttaactttcagtaaaaaactagattcatattttaaagtgctttaatgtgatgttaattttatatctgctaggaatataaaatataataaattattggttaaagtatgtcattaaaacatgtgtaaaaatttatacattgtaatttaggacgaagggagtataatatatgagttttgtgaaaattgcttaaaagtaaatgggatgtcgggttcggtgttgggcacgtgctgcaggagaattagccagcaaaatggctgtcttttgttaattggattggttagcaaccccagatctaatgcttagatttctatagtactagcatatatgcaattaaacctccacatgaccttgaaattaatatctggtccaaaagatttactattggagtggtttatatattggatggtacgatatgttgcatagtactactaataaataattgacatcgttaattttagagacacatttaactatttgttatacttaaaagattaattaattaatttttaaaatttgtttttatcactataaagtataaacacttcaagcatgattttttgcattcgcacaggatataaaagtgtgtgagcatgcataacgagggaaaacatcagccaattcctttttttttccgagtgccaaacaagactgggagaataaagacggtttacaccatgtgtagcatatgatttttatttaaagtaattttgtgcacatagaaactagatcgtgctatactcatcatgtgttctaaaggcctgttcactttggtgccattttcaaccttactaaattttagtaaagttgctaaaaaaagtggctacatttagtttgttgccaaattttggtaactatataagaaatcttgccaacatttttggtaaggttttttttggcagcaaagtgaacaggccctaaaatctaaatgcgcctaaacacgacatgcatgttaatatctacaaagtcgttatatatataaagagtcatcaggagtacacgttagacatgcaaattccttatattttaggataaaattcgaatccttcatgaatggaaacggaggaatccttttgtcctaaacaaaaaagaaacaaaaaagaggataaaatttttatattgaagctaagagtagcgggcctcatggcccaggaggccatttcaccaagcccagtcctcgagcccgcgtaactgcaaaaggccatctcgccgccggcgccgccgccgccgtcgtcgtccttccccccggccaccgcgtgcgcccgcgcgctcgcgatgcccctcgcttcctatgccccgccccgccgtaagcggagcgacctcgaaaggcggcgtgcgtcgtcgtgcttgcgccgcgccgcgcgcgctacccggcatttcccgccgccggccgtgagctccggatcgcgtcccccctcgccgccgaagccgagaatggaagtgtgagtgtttctctttctctacttgacctcgattgcctagccctcgatccaggtctgaccgttcgaccgatccctgtggcagggcagggcaggggggcggcgtcggcgtcggcgccggggaaggtgctcgtcgcgggaggtttcctaggtgctggagcgccccaacgccggcctcgtcctcatcaccaccgctcgcttctacgccgtcgtcctcccgccccgcgaccagctcacccacgacgaatcctgggcatgggtgagcccccgaaaccccagattatttctcacacaatttagtagccatcaccatcagggagaactaatccttactctgtgtggtacctgtcccatatggtaaattgctactaggcgtggacgaatgtgaaagtgacatctcctcagctctcccgggaggccacctacaagctctccccgaagaaatcgacgtcctcaaggtaagtagtccatgatcatttgctgggattgtaccatttgcgcagcagaactctgctctgtagttgtcattggagacttggacctcatgtaatcatgtttggtgatagtggttaatgacttgatgttgcagggaatctgcaaacccttttgtggaacaagacagtgcaattctcggtggcagctgcggaagtgacagtcgctgacaaagaggggaaggatgcactggacaagctttgcttttgcaaggttttgcgattttagtctcaagttttgctcctgtccgaatcattttgaataccacgctataatttgatttcgtatcgttgttaaattctcatctctattttttgtaggttgcaacgattttttattcctatagagaacaggtaaagcttcttttctgaattagcttgcgttgtcacgcatttgctttcctttagccaagagcttaactcaccaatcccaggttagaatttaacaaagaagtgtgacttaatctgaacgtggccctagttgattctttcagctttgctgaccacctaatcttgaacatatattttcttcgcatcccacgaaaagcactaacaaacacggttgccacttgccagtgcctaattaaggatttaagaaaaagccttctattctttccctcctgacaatctgtagtaattttcagctgatttttttttcctggatagatgtctgaacaaaacttttggtaatttttcatgactactcggataatttactgaaaaggggtggctcaggcagaaccataagggagaagatatgctttatgctttgtaataagtattttctctctgtatatctgatacctggtgatgttagattctctgctaattgaattatcattccattggcaaatgtttacatttcacctatctgtaactgcaataaattgaacacgattggttataatgtaatggcattgctttgaggtctatcctttctcttatgtactttataaagttgaaaagtttttgtattgtactctgtgtggtcatgatatgatatcctctattgtgtccacaaataaatattcaatggaactgtgaaggatgaaccagctgcaaaaataaaaattaaaaatcaatgcggatgggttgcatggttttataaactgcaaatatactctctttccatgattaacttatgtctgaatataactcacttttggagcattgtgccgctgttaaataattaacttgtctttttccaccgtttctccagattgaagcacgtggcctccctctaactccagaccagaagtattgctttcgctgcctccattctgtccaattacatttaattcagaagttgctaatggaattatggaacaatgactggagcaaacctgaagttgccaaaactggacttgggtcatcagctgccatgacgacatcaatagttgcagctcttcttcactatcttggagctgttagccttttatgtttgggtgaactttctagtgacagtgcagctgcacgagatcttgacttgctgcatgcagttttgatgcagtttcctcattgattttgggtgatgcaagtgattctgtatccaaagcttggagctcagctggtgtcctccctcttctcgttcgagaagatccccgtggtgacccaggaacaaggggtgtgtcaaccgatgtatcatcatacagattaactgatactgttgcggaattccgttatatttaaattcatgatgtgttcgtttggtgtctctattcatgtagcactagccaaacatgatacgttaaagaggctacacatctagtaaatggttataaatcctgcgcacgcaacaagatttggcatgtttgtggcagatggattattgtttagtcacttaaatgggaaaccgcctgtagttatggaaatattataggatatgtctacttaaattcaagatacgggatatggtgcctttgattcggaactactgcaatagcttcccttttttttttttgttagaaccgaagctgccgtaaaagtttcagattttcggaatgtcttgacaagggttgttttttcagattttcgaggtcatattagaacttaacattcttctatacttgcatcccatttgttggataaacatttgttgacatggttaatattgttgcagccgctgacattcattcaaccaacagcaggaaatcatttggacatgatggccagagacgatgtgctcgcggaagatgatgttaacatgtcatctaatggtagtcgaagtcattgtcactggcaatcggatccacatgtcaatgatcacgcctctctaacttgaagtcagaggatctcaatccatatatatgcaggtacgccttcaaaatctgtgtatcgacaatttggcacggcgtactctcgcagcatgaactatattgaactaaagcatgcgaaggtaaggaaaatcccaggttggcttggcaaggagtagccgtctctcaaatcggcccgaggaaaaagtccagcttaaattttggcaaaattttgaaatggaagaactgcttaatgatgaacggagaatccgatggtaacattgaaccgcagctgtctacaccccatgccatcactcataaactcaaaatttaattttgctgtttgtttgctcatcaaccatccagctcacacaatcagttcagtggaaataacttcatggcctctcatgcatccagtaaccagtaaccgtctcgaccaacgatgaaataattggcaccggctatcctccatagctgtgattttccagctttctctattctctcttcagcccataataacaaaacggaagtgtctgcctcttggcctttttgtcatatgctcctcactgtcaaagctgtcaccgttttctgcttgaacgaattgcgtggcaatccaatcagacaagccgcggagaatgttgaatatcatcggagatgtgcatttttatgctcactgaaaaatttctcaaatgtttacgataagttatcaacgaatcgatgatgtgaggttgatgttgtcctatatttgtcgggcgtacgatgacaaggatgtgagaggtatggacatacccataggtgtttgtgtctatctctcggatatagcaaccacccgtgttccctttcacatgtcacaaatgagccttttcaatgtagtccaaatcaatttcgaaatgaaatcttttttactacactattatattttctccatcaacgctatttacattcacacaactggaacaaaacaacccaacaatacaaatttgcacgtcatgtcattaaattacaaacacaggcagttctatttattaccatcaccagttcaccaccgacatcatttttcattgccatagtcaccgccatcaccatatttagctcaatcaaatagacacggattctctaccatgatgccaggtgactctagatcacttacacataaatcataataaataaaccatatattagtgactcaaatccaaataatgtagcatatatgatctcgttccctatcaaaatagggagagaacgccacgatggcacattgtacagtctcctccatatccacaaaatcccaagtcgcatcaaaggaccaaccatcagtcacatgctccttgtttgcgcatatctactctgttactactactccctccgtcccattttaaatctgtgtatttctaaatccaacgttctactgtccgtcttatttgaaaaatttatgaaaaagtttaaaatttaagtaatgtactccctctgtcccaaaatataacaacctatgactagatgagacatcatctagtacgatgtatctggacataagtcgtactaggtgatgtcctatctagtcataggtcgtactaggtgatgtcccatctagtcataggttgctatatttcgggacggagggagtataaagtattattcatattttttatctgataataatgataatattaaaataagatgaacggtcaaacattaaacaaataaattcacggctgcacttaaaatgagacggatagagttgtacaatagcaggcataaacgcaggctactagctgtagccacctgagcaggtcgcggtgctaaggttgcaaattgccaaattgggatctgcactctgcagtgcagaaaggtccaagaagggaggagcaacaggggttgggttgcccagggccccatgcgtcagagggatcgctcgccagtcgccagtcgccactggtggcagcagtggctggccgtctcgctccccccctcctccttatctttctcgtgtcgtcgcctcccc

SEQ ID NO: 47372 - DNA, 15560 bp, Oryza sativa
ggctggctctcgctcgggtggtcctccggtggcgcggaggcaggcagggcctcctcgtcggtcggcgtgcaccctgactaccctcccgaggcgggggcggcggcggcggcggggggcgcctccgacctagcgcagggagccgtgtgggcgtcgtccaggtggggttttgctattcccttctactggggtattttcttccttgcccccctctcccgtatgaattccagctgaaattcccgtgcgtttcagggaggcggaagcttcgccgtccgggcgccagccggagacggaggaggaggagacgtgggtttctgctcggcatcgttgctctgtttgctcccttggggtgttcgtttcttcctgattgtgttcgtttgcttgcgcggtggtttgcagggagacgaaatttgggactgggttggacgggatgcttaccaggctgcagagggaaagggagagggtccggccgccgctcccacggagcagcgatggagcgggaggggaacgcgacaatgttggtgcgttgggttttcaattcccagcatattcttcagaaacatcaattgttttcaattgtgcatcatatatacttgcttcgcaaaaatagttttacgtgtccctagggaagcattaatctgactacatttgagatgatagcattgatctgactacatttgagatgatagcattaatctgactacatttgagatgattagtccgtgtatcagtgcacttgttgccccatggttacagcttgtggaatcgtggctggctcctattcagtgcagtactgcagttccttgctggcaaaaagaggcattcatgtcagtttatccaagccgtctgatttttgcggatgacggtcttgtccacaaaccttccctacttctgcctccagtagggaatttcctaaatcaaccattacaattcttcactcttgagtactccctccgtactcataaaggaagtcgtttaggacaatgtttaagttaaaccttgggaatataaatcataaataattctcaagttgttgagtttgaaaatctaaaaattatatgaatagatttgtcttgaaaaatactttcataaaagtatacatatatcacttttcaataaatatttttatagaaacaagacgtcaaagttgtgttttgtagaccgtgtcgctgtcctaaacgacttcctttatgagtatggagggagtacctagtaaaatagttgcttatcagttgtccacatatagctgcacagggggccaaaagttgcctttttcacagtgatgtgtctttctgattttaacaccagttacaatcaagagtaatagtaaaacaaacatcatatgattaaacttcaaatgtagtgtgtgcatgtatgttatattctaagattgaccatgttttaggtattttatcgattatcgcacattcatggtagtcttagttcacttttagtatcatcgaacgacagttatgtcacccactagaaacttataaataggagaagtgaaattgaatgtttgactactgatatcactgattaaatcatgcattgtaattggcaatattgtaaatgaagtaaaacgaaatatgaagtgattatacaccccacaatttacaatattattaatgaacttttggtttgtcgttattggataacttgtttgtacatatttgtggtgttccttttggatgtattatctacttccttttctagtttgtatttgcatataatgtgtataactgaaatcatccttctgtgttgcatatatgcagctttaatgggtcagagtggagcacccagtcactctgcaactggtggcaggtacactccaaaggtacctgataatggaaatatacatagttatcatcctcaaaatggagcactagaacataacaaaagctcaaagagtttgactaatgatgcatggcgaacatggtcccttgacaagggtggtttttcagattttcaaggtcatatgactaactttcttccgtactgcatcccatttgtttgatgattatttgttgacaaggtcaattgttgcagctgctgaaatccattcaactaacagcaggaaatcatttagacatgatggcctagacattcttgcacaagatgacgtgcacgggccatctaatggtgtggctgtacatgattatgatattaatgatgtagactctgaaagagacgatatacatgcacgccttcaaaatttggagttggatcttactgccgctcttcatacattaagatcaagattcgacaaggttatatcagatatggtgtgtatatttcccctaacatcatcaattttgctttcatttgttgtgaattactagtggactataattttttgtgcacgaagtgttttttctgcatctgtaaagctgttagttttacgtaaaaattctgctgccacacaaacaaaagaagaaagatagttccatttatttaattaaacttttgtatgtctaatactccatctgctttatgctctcgggaagtgtgcaataaaaaaatgtattttgagtttttaacttgcagtttcctgattaaaatgcagattagagacgtggaaatgatatgacttgattttccattgaaatttcgttcataatattgtaatttttaactataatgtatatttagcaacacttccatctggcagctacttttgtattgcaatatggcagttacagggcatacaaatacatgaaacactagtggatgaagttgtgctttgtgcctctcaccttgatcttgccagaggcactgtactcattgttctaagcatccaactttgttgtttttttccagtccgaaggtgacggagcaaaagcaccaaatgggctctccgacgattgggaatttgaagagaccaaagtaatgcaagctcaggaagagctgcggtcaatccgtgcaaaaatagcagtattagaaggaaagatggcactggagataatgtatgtccacctaatatctgattacctatgctttaaattttgtatgttcccttttagtaattgtataccatgtcatcagtgagaagaacaaaataattgaagagaaacaaagaaggcttgatgaagctgagaaggccttgagtgagctccgtactgtttatattgtgtggtctaatcctgcttcagaggttctattgactggatcttttgatggctggacaagccaggtgaacatttcaaccagctctcgattacctttcgtaatatttgaacttcgctaaggcttaggatgattgttctgccatgtggtgctaattttgaaagataatatgaaaaataactatcatgcgtctatgtggctagtaggtttagaatcctcatatggatatcattgattttgcccatttaagtatttgaagttcagtgggaatggcttgaacaattcagattgtcctgcacttgcttaaagtagatttggtccagaaggcataactgcatcatacctgactggttctggttttgaatcgtaattggcaattcgatgtaacaagcacttgtatttcatataatataattttaatgttaatgaagccaatctgacactctacatagctctgtacttccatgcttgataacattcgcattgttaccttgttatgcttattattatggggcaattgcaaatttaccactactttgaatcattattgcaaaactgccactagaaaattgcaaaaatgccactagaactgtcattcgagtggtatccttgcaatattcaaaaaaccggtggcaaatttgcaaatgcccctattattatatgttcaaattggaaagttttttaaataagtgttgtgtgtacatttttttatcatctgaaatctgatgataatctaattccataacattgttgactttgtgcagagaagaatggaaagatcagaaagaggcaccttttccttaaacctgaggttgtatcctggtagatatgaggtaatggtctgtcttattatgcttccaggcattattattttcatctcatctgatagcccctctgcctattctccagattaaatttattgttgatggtgtttggaggaatgatcctctgcgcccccttgtgagcaataacgggcatgaaaacaaccttctgactgtcacttgacttgaagctccatttgtcaatcctggtagcatttttgtagattgttatctagatctttatcaacatgattaggccaatccatccagaatggaaacaaaaaaaatgagtgagctggttagctctgttccaccctgtaattatctgcttcgccttaagtcgtcgttctttttctttggtagagattcttacaatttaaacagtgtaagggtgttgtcagaatgcctcaccctgttagataggagaagagaatagttgtgtattcttttcttccccgtcttttgcccggagaagtatagttgtgtgatgggtatccaggtgtctggttgtacaccttcatggaatgtggttgtacatctcttttgtggtgacaaaaactccccccgccggtaactttgcacttgcagaagctttaggttttaaaggtggtcgcctcacttgcgagttgttactacgccttaattacgcaatcttcttatgccagcacagaggatctgatatcacagaggattgaattgtgtgctatgcaagaagagagctctgttgaaattgtgattttctgacgctttgagtatgaaattattgtatctgagaccaggttgaactctgatggagtgtggctgcatgaagaggaaaaggcaaacaaagtcatacaagtgcaaacagcaaacctgaaggttcattcaaaactatttcatttacttccttgtgaatcagtcaaacagcaagtagcgatttactaggattgaagattcatttatctttgaattttaaccacttacaagaaaccaacccttttgtttctttccttctctttcctcacccacttaatcctatagattttataattcaagacaccacagatacaaaaatacaagagagaaatgatgaggcagaaaaaaaaaacccagctaaaagcactccaccaattaattatctgccattgacataattaattaaccacccaaacgaacaaacttcacttcacttgcatctcagttggcggctgcccccttgaacctgtaccacttggcgcagatcatgaagtagatgatgttgaagatgccgatgccggcgatcatccagtagaagaggtcgagcctccccttgttgaggtcctgcgccagccagttgctcccggcgccggtggtccggtgcacgatggtgacgaggaacccactgaggtagttccccagcgccaggttgcagaaggcgagcgcgccggccacgctccgcatgtgctccgggatctccttgtagtagaactcgatctggctgatgaggttgaacgcctccgagagccccagcaccatgagctgcggcaccatccacaggctggacatggccgagatggcgcccccggtgatggtcgtccccagcgtcggctgcgtcagcgcgatgtgccgcctccggtcctccaccacggccgacatcaccatcgccaccgtcgacagcgcgatcccgatcccctgccgctgcaggagggtgaggccctcgtccttgcccgtgaccctgcggaggcgcggcacgaggaggcggtcgtagatggggatccacagcgtctgcgccagcatggcgaacaccgtgaacgacgccgcggggatctggaagctccggccgaggtgtcggtcggactgcagcgcggacaacaccacgtaggtcgactgctgcacgacggcgacgtagtagatgatccccgtggaccagacgggcacgatgcggatgaggcacttcacctcctccacctgctgcacgctgcacagcctccacgggttcgacggcgcggcgcccccggcgcgcacgtcgtcggggccggacacgatggccgccttgtcgaggcaccggaactggtccgtgtgcgccagcttggtgacgatggcgctggtgtgcggcgggtcgaacaggtcctgcttggggtccttgggctgcttgagcgaccgcttcctcgccgcggcggcgaacacctggacgatgctggtgaagggggagccctcgggggtgacgcggacgtagagcctggtgcccatgaagaagaggacgcaggcgaggagcatgagcgcggtggggatgccgaggccgatgggccagctgacgttgctctggacgtagatgatgacggtggcggagacgagcatggcggaggtgaaggtgaagtagtaccagttgaagaagctgttgatgccgcgcttgccggactccgtgtgggggtcgaactggtcggcgccgaacggcatgctgcacggccggatccccgccgaccccagcaccaggaacgcgaacgacatgaacagcaccgcgaactgccccgacgtcgccttcgagcacgtctcccccaccccgcactccgccgggtgcagcccgtccgcggcggccgtcatcgtcagcaagaacatgccctgtccgtccatcattggaaggaaaccatgcgttagtacattggagccatcgttattttgcaaacgaaaagtaatttgtgaataaaacttttatatacttgttcttagcgatttaaaagcaaaggttgaaaaataaacttcgatgagaaaacctcaaaatcagcttcaaatttaagattgaaaattcaaattttagttgataagttataagcataagcgaaaaacgagggcctttgaattggatgattatgggctttgagtttcgtgtaataacccatgtgaacttaaatgggccattagttgggccgagttctgtctgcacaaccagtcggcccaaaacaacagatgcatgcgagcacagcacacaaaccgggaaaactgtttaaattaaatttgtaatctgatgatttgaacactcttatggctgattatcagctgtgtgatcctttttttacttaaataataacataaaatttgaaaaaattatccaatataaaattatgttaccgttccaatagaagtgaccttcagaatcaagcagctggcccaccgcccccacgagcaccagcggcgcaagcatcattcgtcagaagtggctctcgctatcaaaccatactattacacgcttagtactactacctaaatggggctcatgattacactacgtcattagtactagtacgtggttggtgatagtcaggttggttatggttagggaggtggtgtgacattgatgccgcgacgtgggcagctcactagtcaattcctggagctttggatggcagcactgactctcacttgggagcatatcgttttcgtgcgagcaagtgcgagaaactaattgatttttttgtacaggtgtaccgaaatgcaagcgcagctaagtactaatggtgtacagtaatgctgatatattccaggaattgggggtgagctagctagctggtcaatgtcgatggccacaccaggacactaccccacttgcgcagttagttggcagtcacctccatacagattgtccggataagatggccggatccccaacctcacttcagcctcaatggctgccactgttcatcatctcattgcactttgcacttggcagcacagcacagagcagaaagttcttatgcttagcctaggccccccaagattctagcacttgtactcctactagatgaaccgtacaaaattactgcaaatccaaacaaaacgcaagagatttccccgttctaactaatagtgtcttgatagtctaatcaggtactattatcagtgtgaaaacatgacataatgtaaccaggttggatcttgggatttcagtgctacggccttccagagtttggccttagaaaaagacaccgttcaagtcaaaacacaactacaaattgaactggacagtggacactgcatctcaccaaccaagcccctgtactacgtagtactattattgttgaacagagttaattaaaacttgaaaattatccgtgttgcatgcctggcaagccaaggcaccgtttggtccccatgttatttttgtactgaaattaatacaggcgaaaggttaaacaaactgaggagaggaagcgagtccacttcaggattcagcacagatcgagatgatccactaacccaatccaaatgctcaacaagttcccttacaaacacagtttcctatgtttaaaacttaaaattagcgacgtgagatccacaaataatacagacccagccaactgcctcgactcctaaataatgcattttttttgcaaaagttcttttttagaaaaagagctttaaaaatcatattattccttttttagaaaaatactaataaatcatatgctaataactaataaaaagagttaacttaactaatcatatgctaataaaccactctgttttccgtgcacgggagattaactctcaaccccatctaacgaacacaacctaagtgactatttggtagagctcaaacttataaatttagcttcaggagttgggtctgaagtggagttgtggatcggtctaaacccagctccacttctttagatcattttgtgagagcgctctacccaaccccactcctattttagatggagctgaaactttagctgggctccaactacaatagaggtgtagctgaagctattcaaaacagaactaggtgtactactcctatatatttgtacatataattgtaaatatgtccacgtcaaataggccataccttttttcttttacaagaaaactagggtgagcatgcaacaactactagcttagactgatgatgtgttgttgttgtacatgggttatcagaaaaagaaaaccagctgctagtgtgggcagaattaatactgctgcccacaaagatagataaaagtggattatagggcatataatacggattagaagagcgctaatcatgagccactgcgccgctgcaaagtgccgctttggcaaaaggggagcagataatgcagggcacgaggctaaccgatgtaggccgccgcctctttgggaaagctactactagtattggcagattaacccattatttccagcaaaaatttggatataaatttcaccacagaactaaattatactaatgtcgtttcaatttaccgcccaaataattaaggattgaactcttctaatccacattcgccgtgaattaattaattaaaaataatcacgagcgcacaagcgcacgtggttcctcgctcactttgccgcccatttccatcgcagagaaaagaaaaataaaaataagaataacaaaaaagaggccaactcgaaagtccaacacccaaccgagctactgacaagccagaggccaccaactcccgattttctttttttttttaaaaaaaaaaacaaatctgaatccgagaagcgaaatcgcgccgcccccaaatcgcagcgacatccgcctcaaaattcgaagcccggcctcgaattgggaggcgaatgcgtggcggcggcggcggaggaggaggggaggtgggcttacgatgagggaggcgacggaggcgatggcgagggcgaggtagcggccgaggtaggcgtcggagaggaaggcgccgatgatgggggcgaggctggtggtgccgttgaggccgttgagcagcgtcgccgcgtccacgctccgcatgtggaacacctgcgtcaggtacaccagcaggttcgccgacgtccccagcgtccccagcttctcgaacgtctcgttccctgcacacccaaaccccccacacctccatcagccgccgatcgccgctcgccggcgccgccggagggggaaaacgatcgaatcggcgatctcgccgtacctatgatgaagggcatggccctccagccgtggtacttgagggcgggcttgtcgccgccgttctccagcttgtcgacgtccatgctcttcagcttctggccggcctcctcgccgccgccgccgccgccgccgccgccgccgcgcatcctctctcaccaaccaccacctctgctctcctccagtagaagcgaagcgaccgacgcgggggaggagacagagtgagagtatactgactgcctcgccgagccgagttgccggtttataaaagggaaggaggaggagacgcgcgattcgtactagtcgtcagtcgtcacggggggaagggccttttttttgcttcaaacaacctagacttttcgtttattgcaacaaggtccctgctgccaaacttttttcttctttcttctttgctagttagttaatgctctcccttcacactgcgtcatgatatttttgctatatcttcgtcgccactgacttgcacgcgctttttttgttgagacaaaatgtcttaagggcacgtttgcgaagggtgaaaacggagcgaattcgaacggatagtggtcatactatatcctaacccatattttttttgagtggattcggagcagatgcaaataatgtacggatgcggatgcggagcggattgtttcagatgtcagaaatggtgcggagtcagtgtggaatcagttcggaaacagattaaatttatcggatgctacgtgtatatgcgatcaatgcaacatccagttagaaatccaaggaacaacgatacaataatcaataaatgatccatcgtaataattatatgattaagtgctaaacaacataaacacatgatgttcataatataaaaaatatagctacgtgagtgtgacatgagacgataaaaaccttagactaaaaaatctttgttaattgatgaattagggtattggatgtaccaacttatgttatatgcaatagatagagtggttatatatgttgataatttcggattattcggcaaacagcttattggataatccgataaaaatgtcggataatccgcatccgccggattttagagatatcatatccgcatccatatccgccggatttctaaaagcccatactatatcctcgtttcggacggattcgatatccgccggatttctaaaagcccatactatatcctcgtttcggacggattcgatatccgccggatttctaaaagcccatactatatcctcgtttcggacggattcgaagcggatcagatcagatattatccgaatcgttttcaccgctaacgtttgccatgtacaagttttgtacgatctttttgttttatgaattggttcattttaggcctggtgccaaaaggtttgaaatttggttcaaaagttcaatgttgttgaaggttgagatttatggctatatctattgtactaaaaaataatctagctttatataatgcaagttaaatttttacctcaaaatatctgctcctacatctatatagaagtttctttaaaaaattaaataaatacaattttaatgttataatatttaattaatcatgtactattgactcaaatcgttttttataatgtctatcatctcagccaaactactgaatcgaacgaaaccgtaatgttggaggacagagctgaaaccgatggaaatcactagttccaagtcaattgggtgacttcgcatggttgaaaaatttgaaaatggacaaatggaatgatcttgagctacctaactcaaggtcctaaagcatctccaacagcctccacatcccactcttcaagccaaattttagttattctagcttaaaaagcgctccaacagcctctccaaccagatggctaagccttccagctggccaaaaccctccttccactagccaaatttgaccactctatttggctagccaatggtgggcccacacagccaatctcctccatccccacacggcaaccgaggagaggcacgggaggagcacgagcatgaggacgagcacggcgaccgccggcctcttttcgccgccgcaccaagccagtcgccagcctccacgtggcgccgcctgccgccttcgctcgccacggccgccggcctccacgcggcgccacccgccgcctccgcgcggcgaggctcggcgccaccgccgctcgctgttctccgtcggcccgtcgtcgcttcacgtgcccgctgtccgccgtcgccgtatcaaagaagatgatgtggggatgatgcaatagtccagtaggaggaagggaaatatatgtgtggggaaaatgggttggaagaggaggaagaagagtagtagagactgacatatgggtcctatttgtaatagacttgtaatagagagggtagatggagagactgttgaagtgaataactagtttaactagccaaatcagatggagagttgactatatgagtgtttggagagtttgatttggagagactattggagatgctcttactactaccacactccctcactcaatcttcctaaaacaccctatccatcatccatattacatatttcgtaacttatatctctctttttcacgcgcatattttccaaactgctaaacggattttatttcaaaaaagttctatacaaaagttacttaaaaaaattatattaatccacttttttaaataatagctaatatttatattaatcatatgtgcaaatgaattactccgttttgcgtttgcaagaggttagttctcaaactcaataaaaaaaactcagcctgataaactgtaacaattatttaaaaacgaagacggcgttttctgacaacacgataaacatcggggagtcaagtagtttaggagctagctggccgtggtcctcccctgagatcgctgtcgagttaggacggactaattgaacgaacgaacgaacgatcgatcgatcgagttttgcctttgagtccaccgcacggcggcattccggtgagcagtgcaagctgctgctgtctctgtcgccgtcgttgcctgccgcgacaaagtccattgctgttggacccttgtgcaaaaatttccaagcgagtctgttcagtgatgcacacagctcgtgtcctcttcctttgtgtgtatcgatctctagtgatctgataacgtagcgtcgtcgttgagtccgagtttgtttttacacccgaaaacctgccaaatttcagctgaatcttgcactccatgctaattagcgtcatcgtctgtccctactacatctttttccaattttgttaaagtttctgaggttacaatagtaattgctggattatctggttttattttttaggttatttgagggttttaacgaatgaattaacagtttgtacgaaatattttatgaaagcattgataaacagtttggaaaacatgtgaacgaaaaaccataatcatgaaagtacagggccttggagtagtacctaaatgatgtgctaaaccaaccggttggcctctcttaattagctttccggtgagacgtgaggggcatgttgaaacgtttgacctttccagctgctagtccaagaaatgagaagcagaaacagagccgagcagaaagagtgatggttaggtcagttaggtgcccttgagagaagagaagaccaagaagatcagtgcaggacaggatcagcgtgtggtatttgggggggttgttgaggggtgcttaaaccgattgataattgcattgtttagctaccaaagcatgcatcatccatcgatcaagagttgttagcatggcagcatcccggtgactagtacgctactgtcatcgagtgagtgagtgagtgagtgagagcaaaatgcaaacctcctccttttcctctctctctctctctctctctctctctctctctctagctttgccatgtttgcaatggccaattggccattattgagctcatgaggttccttaccacatgcacaacaacacgcaaagcgacgccattttctttctttccttccttcctcctttctttcttcccttttgggcccatggccatggccaatggatgatgtatggggcatgcacatcaacatcgaatgacacacaaaactttctcctttctgttactagggtgcttgtagtgtgcaattgattgttgtgtccaatgtgtgacctacgttagggacggacatgggagaggaatccgagttgccagtcctaggattgcctgcccttgtgtatgcatacaaggtccttttgctttgaaatggtaaaggaaagtaacatgtactataatttgtaaaagtaacactccctctgttcctctttacttgtcaccattgaccaatcatgtagaacactaatctttctaagcatttataattaaatattttttgcccaaaagacgatctttcaatgtttaattataaattgtatatggtgacaggtacatataaaaagaatgagtatttttttataataaaaaaggtaattttatcataaggtaccaggagatactatatttttttataaaatttgataccttcaactaattaagtacctcgagatgcctagcgtaaaattttgatacctactaacactttcttaatgatcctgaaatttacatcttcagtctccaccatttagatacatagccagagttgtttgcatctttatttacctgtcattgttgtttagttgactggcatctgtcattggtccgttttgttaatcacgctgtggaatgcaagcaattgacctctcatctgaatctcgttagctctcaggaattccttatttcaaaattcatttttttctctgtccagagatgcatccttttctattgtgcatgatgcatgaaccattttggttaactgatgattggtcgcctcaaaaaagtttctcaaagattcgtcaaaatgagtgggcgtgtccgtccttttgcatcgcattggattttaaacaagtgaaccaaacaaaacactaccactactgtacctaccttgatcgatcgatcacatggttgttcactaactaaataataattcaaaaatgattcttcacatgcacgaagcttcagctatgcttgaaattatatttatatacaggccgtgtacatccattcatgtatgcatgatgcattttgttaattgctagttggtgcttgcttttggtcgttatggatcgacctacccactaaatatctgtattattagtactaatctgtaaactaaatcaaggaaaatatattattggtatacatggttgtctcctggatctaagggtgtgagtgtgtgactgatatgtgtggagaagcaaggttgactagctggaagctggttaactgtaccagtattagatagactatgggcatgttcactttgatgttatttttaactttaccaaattttggtaaagttgccaaaaaaagtggctacatttagtttgttactaatttttggtaactatataagaaatcatgtcaaaattttggcacaactatactaatatcaaaatttagtaaggtttttttttttgccattaaagtgaataggccctatcatactctagtaccatgcatgcaacatcatgaacagtggttgagaacaatgcaatgcagtgcaatgcaatggcttgaagaattaattgagacaagatagtctctgacgtggacttggtttggattaattgtagtactaacaatacttgatcagtcagggtttgggggtgaaaccatgtattatgggttgaa

SEQ ID NO: 47373 - DNA, 3199 bp, Oryza sativa
tgttggatcgttccgttccaacgcgtccggagtaacaaaagttggttggttggttgggttgggttgggttagttagttgacaagtagtagtactaatttgatttagacgtgaaacgattatatatatattggtggttcgttggttgcctgggtcgtggaggccatgaattcagaagcttaattagcagctgcgtttaattattattagcggatgcaacactggtggattcgctagtctctccttactatatatacatacatatgatctactgttctaagtatatatatacacgacctaactactttgctcggccgctatcatctctgtttttttttcttttcactctgcatatcatttccaaactccaattctgcttcatttgtttttttcagcttgattctgccggcttcatgttggttagttatagtatcttattaggggctaattttaaagtagaatggggcttttgagtccaccaaattaacacctcttttccttcggtagtcaaacctcgcttggatgggccgtccgtctgcagcccacggggatcacctgctacagcaccaaaccagagcaatgtggatacaacatgttcgtctcgtcgaaatggggctgattgatgcttgcttcgttttaccaaagttctatagctaaagtgtggcataccgcaatttatgtggctacgaaattcttggccataagttagacaaatgttggcaaagatatgtgactatgacaaatagggtcacaaaatcaaaaagtgtgacatgacaaagatgtggcaactaagcaaacactaggctaagttggccaaaatagcttgccaaagttgtggcaaagtatggtcaccatccaaacaaccccggaatgcttcaactggaacagcctttttatggccatttgctgttatgagattatgacctcaataacatgggctgtgtttagttcgcgtgccaaattttttgaaactatacggacacacatttgaagtattaaacgtacaaaacaaattacagattccacctgtaaactgtgagacgaatttattaagcctaattaatctatcattagtaaatatttactgtagcgtcacattgtcaaatcatggtgtaattaggctcaaaagattcgtcttgcgattatatgcaaactgtgcaattggtttttttcgtccacatttaatgctctatgcatgtgtccaaacatttgatgtgacgaaaaaattagaagtttgaagaaaaatttttgaatctaaacacggccatgttttcagggtgtgtttagtttatgttaaaattaaaagtttgattaaaattgaaatgattgatggagaagttgaaaatttatatgtgtagaaaaattttagtgtgatgaaaaagttaaaagtctaaagaaaaagttacgaactaaacctggcctcggttagattgctgagaattcatttcacgaaatgtcacagccaaccctaagctcaatcatgtacagagaccgaagaggattttaactcttgcacgcaataaaaccttgtgccatctcagtcaaagtctacttcctaattggacacatcatataaattaaataccttctgttctgtactgtgtgtcctactccctccgtatcattttaagtgcaaccataaattttcatagccaactttgatattccgtcttattttttaaaaaatatgattagtatttttattgttattagatgataaaacatgaataatattttatgcgtgacttatacttttattttttttaataaaacaaactattaaagttagacacgaaaaattatgactatacttaaattaggaccgagggagtgctttagattcagttgagctagctcgatcacatccacgatgaccagttaatcagagtccacttaatttcaaggtcagcatgtggccatgggctccattgattcttctactcctaccttgtcaacatgagattgagacttgacttgagagagtgtgtaaagtgacgacatgaacccccaaaaaaaaaacaacaacaaaaaaaaaactgtagttgaaacagagaggaaagagtgtggactgaaatggacagaaggccaggaatctaggcaaacgtatgtacggcttatggatagatagcaagaccgacacttgtaatggcgtcgaaactattcaccgtccttttctgacctgtcgagtagcaaaattaatttgtgtggactgttgttagcgcatccccatcaagagccgtcagtgttctatctttgtgtgatgaatgccaacagcttagaaaaacaatgagtagaacgagattttaaaggggaactaacattgttagtttagtaaaatatgcaaagcatccggatgcatatatatgaattgaacttcatggttatagctaagtaccaatatatatagtacatgaagttgctaaatgctaagtgaggagcatttcagaatggaggtagcaagactaacctttgttattcaactggttattagcaacactctagtcggtatcatcaaacgttccatctttcaatccggcaaatctgcaaattttgggttactatcaaggatgggcctatgtggttgccctgtttttggttgggctagtggacaactttgctccatccatctttctctgtcggctgagcccatgcaaccttcgcctcctcctctgttcaacttcgtttataaccatcttgccttctactaatctgcacttctgcagttaacaggtcaaaaatagcactccctccagttccatgattcttgtcattttgtacaatatcacgatctcttcatcaaagttctaatagtttaaccacaactttatccaaaacaagaagaattacagaaccggagagagtattaatcaagtcgattacatcataaatacaagaggggcaaacaaaaaatgttcagcaacatagagcctttctcatggcaaaactgttgtataagtgcacgcaatgctttatttccgaggtatacaagcatcgtgagagatgtggcacattgcatctccctatctatacggctatatatggtccaccagattctacaaacatgcaggttagtagtggcacccagcaccaatgaccaaacacatcggtgtgttggatttggataccatgcaacggatatggggcaaatttacaatttacaggttgccccaaaaatgccgccagctccagcctccttaagct

SEQ ID NO: 47374 - DNA, 1209 bp, Oryza sativa
atgccttatattatggaacatctaaaaaaaaagtggttgtgccttatattatggaatggagggagtaatgattagcaagatacaattgaagacatgggagaatgaagacgtgtggtgtctaggaaactgaacttttgaaagaacgacacgagttaaagccaaaaatatttaactttttatggtaccatgtcaacgattagacctattttctttattttcgtctattcggattttagttaccgcttgaagcactgaacatcttcaattcaccacatatagatcttgcacaccttccttttgatctaacttgatataactcacctacaatcacgcacaatcactatgtaaataaatttctatgggtaatgcacttgtgcagcactccagctttacggcattctaattaacttgatagctggcaaaacctgacagaaatttactcatcacttcaacataatgatgtttgatatctagtaagctgaattgtaaaaacttaagtgaacagaaaaaaaaaactgctgatagccattgctaaataagtctcaacataacgtattgaagttaagtttatcctgaaaggtttcctttaaaaaaaaaaaacttggacaccaaaccttgattttcattattttaagaagcaacagtattccatcccacgactgcccctgccaactgcgctagcactgttctcatcctgaaagcttcattgtaacgtaacatctgatgatcccaggcaagcaagttgcagaattagcaacttggaattgatactagtcaaatcagtactgtaaagataagtgcatcttacaaagtttcaccagatgcacatgcccagatatgaagtgtctgaactaatgccctcgtcactttttgtgcaactataatctattgcatcacaccatgtaatgagagaaatgaagatgaaaaacttacctgaagagttcttatgggaaccatgtccacagcatggctagggtaagcagcagctatgacaagagaaatttcataatcacaattaattgagatccactgtaaaaccaacagtaagtatgcgtagattcaaattggataacatgctgaaatagtattgcagtaagacaatcattggattctattacaggcttagagctacaatatctcaagtcagaagagcgagaaatcgtaaggatgcacagaaagaacaaaaaaacagatacctgtatcgaacaa

SEQ ID NO: 47375 - DNA, 1848 bp, Oryza sativa
ttcctgcagccccgggatcgccggagaccgcgaggaggaccccgaaggcgaaggctagcttaagctagccctcgcacagctctggtcgtgtggctgggctcacctaggatggaggcgaggtggggaggaagcaagcaagcggggggaggaatataagctgccgggaggtcgccgtcgccggcgtcgtggtcgtcgtcgtcggcgtcgcggggagtggaggaagtgaagcgagagccgagagaagagggtgatgaggggataggggtggacacgaacacacgacccgctcatccgctggcgttgacacggcttccatagttgcatatgggatgctcacattgaagccaaaaattaggtaacatttgattataaggtctatattttcaatacggttttcagatttttattttattctatgatcctaataaatatgaaattagtatcacatgaaagtgcttcaatgtatgaatctagtgatatagcatgcataatacttagtatagatatagttagtatgattattagtcaaaagctacccagtttgattttccttaaaaaagggcgtcctataatttgggagtaatgtttttaaaattttgacaggatttcctatatatttattaaaatttgaaaaaaaaaactaaatggatgcgcaaatttagcaactctaccaaaagtgatatgatttaaagtggcatcattctgaacaagcccataggttttgtatgtctgttgaaaagccgcagctaattttcaacctttttttaaaaaaaacaaaatttagcgtgtttatggtttttacccttgctttttaaaatatagaataaaaattttagattatttgttttcatcggatctaattttctacttcctccatctcagaatgtaaccatttttttaggtacgcacgtgtattaagaaagtaggtagaaatgattggaagagggttgtgattggtggagaagagaaagtagacgaagagaatggttgtgatgggttgagaggagagggtaggtgaagaaatagctttattttaggacaagttactatgctagaaatagctatattttggacggggtagtatatatttccaatcagtctggcccaccaatcatgaatcactcgagtcatcttgggtgtgctctttcacaggtttaaccttatgatgtgaccattgtcagggttatggatactacatacctaatattagttgattaaatttcgacagaatccaccacataccatgtcttatacagatacaatcctcggatataggaggagttccggataaggaaagacaaccagagttctatatgaaaacgacaatgactactcggattgtatccatattgatttctctagttctacttagacaaggaggcatctatggatataaatacaaggccccctaggaggagaggggacacaatcaacatacacgaaacaatagatcaagatagaagatcaacatagaagccaacatacaccaagataagacaccggatatcgacttcagagataggcatggctagtccccgacggtgtctccggatactgataggagagacattgcgatgtctctgatctcgccggcacgaactcgaggaggaagactaccctgttgtcgactacgagtcagacctttagactgccatgtcaacaacagttagataggctaccccaaatattgtactggtgtgattatggtgaataagagcaataccggcttcggccaacaggatgtagggttattaactaacaattcaggggcccgaacctgtataaaaatcctcgtcactgtctcttttacctcagtctcgtatatatcctagtaccaacgatccccat

SEQ ID NO: 47376 - DNA, 2478 bp, Oryza sativa
tagaatccaattcggccaactgcagcaacgttgacttcaaacggccgccaaatatgcatacgatcttcgtttccgatccatgagtacttgatgaaaaactctcgaagtcctctttccaaaggatccagcctcatcaccaaattacatgttagtcatttgcaattgaagaaataaggtgatgcctacctatcttgggccattaggcttgaacttcatttgggatcccggcccaactaggacccatgtagggtgcgcccaaacctaatggagcacgaccctacggaccctttggttgtccccccaccttcttaaatagctaggtaccatttagggtttttcgggttttgtatagattaaagtttagtcattgttactttcttacatcgcgcatgtcggctagtccgtttgtttgtcttcggaacccaacttatcatttgttttcaattcctatttgcaattcagattgcttttatcttgttattgcttgtttcttcgatttgcttgtagcaataaggttgatctgcatcggtgtatcaatcactaagacgcaacgcaacaacacctcgtacggctgtagttgggtcatcaacgtttctctcaaatcatagttatcttcaactcatcgaaaaatcgggccaatcatagccatgagtgtctcgagtggagcacagggtttgttaatgttatatcaatagcaactatgatcacatcaccttactagttaacagtttttaacaatgtacatatcaaagatactagtatgactgtatggatgcctctaatatccattatcaacatgagataaaactatgagctctctttctatcccaatccatgttctctgcagtactacttattggctgtagatccaaatatctgtggggtccacatatcagtgtgcagtaccgtggaggaccatcactctttccatccgtccgttggtaatgtacgggggacacatgtcacacatctacggttgttacacttacacacccacatagccggtcgtcggtcggtactactccattggaagcgtcagattccatagtgctaaactattacacatacacatgttttctttttgcttggagttgcatgcttcatgtctggaaaagaaggtgctcttcctccaggatcactatttggcttttttcaagatttgttttcttatgggaggggtcttcctctcattatttgcatgttattcaaatagttatgaaaatttttttaaaaaaattaagaagatatattaatatgtgatatatcactccacaaacatgcaagttcaaatttaatttctacatctcgcaacgaaaaaaataaattaaactacaatcaaatttgttttttccgttgcgagatgtaaaagttgaatttgtacttgcatgtttacagaatgacatatcacatgttaatacatcttctcaaatttttttaataaccatttaagtgacatataaacaataagtggatatcccctatagggatgtaaatagtttcccttttcttatttgttactcctacttatctgaacatgctacaatgggattccagtttcccttcgctgtttctctacaaccgaatgctgtataggacctgagctcctgcacagcattgggttgtatgctaaacatcataagttgtttgaagttcgacataccactctctaaaatcattttgtttcaaatattcatcaacctacttagttttattacaaaaagcatcccaatgcacacatgtttaaccaaatcaatatattttcataaagtgtgagctgttaatgtaatctttaccaaaattaaatactttgtattatcttgacaatttttttagatttcataaataaaattgatgataagaacttaaatgttatcacattcactaaatgagaaaaaaaaattcaatcaaacataaaaaaaaataaatctaattcaaacatttgaacaacattaattgactcaactaacttagtctgtggtgactttacatcaacgataacggactaatttggttaagcacgtgagcaaaaagatgatttttgcaacaaaattaagtaggggtgtatgtcggtaataaaataacctatatgatgaaattttaaactttaaatgatttatgggatgcttttttccttgcaatttctcatacttcgtgatattgaactgacgacacgcatcataaacacagtacagctgaatagctgatctgctgttcgagttgagaaattgcacgcaagtcgttaaccataacttattgcacggtcttgttcttttctatcaagatgctaaatatagtgtgtttcgtatgaaaactttttatataaaagttattttagaataaaaaaaatatcttctaaatttataataagagtaaattttagaggactgggtcttttgcgacacacgcatcattttgctgcaagtttggcgagatgttgcacgtggctgcagcaatggcacgagaaatgcggatgaaact

SEQ ID NO: 47377 - DNA, 1947 bp, Oryza sativa
tgctattgttgcagcaaactgaaatatgtcgctaatgttgcagtaaactgatagttttatcactaaacttgcagttttctaaaatttactcttataataattaaactcaattaataatatgctaatacttttttatttttgcgtgtcgtaatctaatcttcatgttcttcagattagcaccgcaacgtttagtaatgttgttcccgccaagtttcgattagagctcagcacggcacatcgccggaatggagccgtcgcccagcagcagctgccggaacgtccacccgacgacggcgagcgcctcctccgcgctgccgatgctggcgcgctccctcagctcgccggcgaacggcccgccgccccactcgccggtccgcctccaccgcttcagctcctcccacatggcgtcccagtgctcgatgtacggcaggtgctcggcggcgacgcgcgcccctcgcccccgcgtcaggatggtctccaggatcgggtggagccgctgcccctcgcagatcaccgccgccagcgtcgccagcgcccgcttcaccgccgccgcctcgccgccgccgccgccgtcgtagccggagagcaccacggtggcgtagctcgtgaagggcgaccccagggggaggccgagcaggttgttgacgccgccgacgaggtcgccgtagctgctgccgaaagggagaggggtcgccacgaggtcgccgcggaacaggtggtcgttgcctcgcagggcgtgccagtggccggtccggttggcgaagccggcgacggagaagacgtcgggcctcacggcgagcgtccccacgccgctgccgtagtcctggaggtccaccaagatcaggtcgcgctcgactcgcacctcgccgagaacggccgccgggaggttcccggcgagggggagaagcaggagcggcgccgggaggaggaggaggaggaggaagaaggagagcgcggcggccatggcgtcgtacgtgcaacaaacctggagagctagctagccagtggcccggttcttccacgatggcgacgattttgtagccggcggcgcgcggtcgagtgggttggcaggtgagcggcgattttgtcgccggagaccggaggcgggcgcggccggcgtgcgtgatcggcgtgcccggaatctctattgacagcgctgtaaaaactaaaaaaaaaaaagtcaaatatactcctccattttggattacaagtcatttttttactttgtcaaagataaattgttttaagtttgattaaatttatagaaaaaacatgaacattttttacctaagacaaatatgttatgaaaatatattcgatcattgaattttgattattgatttaatgaaactaatttgttgttgtaaatatgattgtatttaggaaaaagtacgaaataccccctgaactatcgcggtcgaccgaattaccctcctaaattcaaataacggatattttacaccataaactatacataccggacaaacgacccctaacaccgttctgggcggttttgatttcagctatcacacgtgccgccaatgtggcagcctaatcagaaaaaaaattaaaaaaatccctgggcccatctgtcatccaacttctcccagctcccttgcgctctctctctctctcgtgcgcgtactcgggctaggggcggaggcgagccagttcccccaaatccagccgccgccgccgccctcttcttccctttggccgcccgcggaggaggcagccggagctcatggtggacggcggcgcggggatgggaagatggcgacggcacggggacgggaggtgtgcggggtcggcgacggcgaacttcttcgcgccgccctgggaggaacgaggcggaggcccagccgccgccggtgaggaacgaggccggaggcggaggcggcggagaggaagaccggcgtcgtgtggtggcgagcacgaaaggggcgg

SEQ ID NO: 47378 - DNA, 12492 bp, Oryza sativa
  unsure (1)..(12492): unsure at all n locations
ccagccttcgcgcgccgacccccgcgccgctcgaccagggaccgcgcggccgccacctaggcgccacccgtcaccggccctcgcgcgccgacccccgcgccgcttgacctggaaccgcgcggccgccacctcaacgccgctcgtccgatgctttgtggatagccgactggcgccttcgccgccggccaatccggcgacccctcccgccgcctgccggaacccgaaccggtagttggcgttcatctggctggcgagcagctcggtggcggagggccccgttggacgcggcgatgggaagtttaacatctccgagaacgcgcacgatccatgcccggccggcgcctctgcgtggtcgtacatggcggcaggctgggcgtgctcatcgccgtcgatgcggagcaagccatggcctcccctctcacccggccggcgggtcgaagccctgctgcaccctcaggcctcagcttgtcgaggcggctctgctgcgccaagtgatgttgctgctgctcgtgctgtttggtcttagctggagccagggaagtcgaaggcctgttgctgctgctgttcctatgccggcgatggtcatttggccaacaagttcctcttatttctctgcagctacctgagctcatcaccacaagaaaccggatggcaagctgccggcggcgagcgcccatcgcctcgcccgtccccccgcgccactgcccacggcgcgtccccgcgcaccgccgcccaccgcccgtccgcagccgcgtgcatgggagagagagagagcgcgcgaccgaggagagggagaccgggaaggaagagagatgaaatgtgggcccaagaagtctttttctgactagattgccgcgttggcgccacgtgtacaagctcaagtcaaaaccgctcaaaatagtatcgatgggggtaattcatccggtattaaaagtttagggtgcgttatgtctggtttcgggttcagaaggtaattcagccaaccgtgatagttcagggtaatccatactttttccttgtatttatgtataaacttagtcttgaagtaattttacttttatcataatctggtggtagtagatattgctgcattttgtgagtggtgacatctgcatttgactgcatgttgaacgaattgtgttgttgctgtgcagaatgtgatgtgaagcacgtaggtgcgtgaactgtcaaaggtgtaacttaattcgtcaaatttgattgctgattttgaattgacaatggtagttcgtgtttttctttaaggtgatggaataaatggtttacgtctctgacatataccgacaggcacatatccaataagttttgttgttggaagaaaaaaaaggcaacacagggtgatgccgatttggatcaaataaactacggagttgctagaaatatggcgccatatgctacagtcgattttttttcagccacttacacagtagttacacctcatttacaacccacttacatatgtaattagtatgtaattttcgaatttacatatgtaattttagtacttacatatgtaattttgagacttacattgtaaatacactaaaattacatatgtaatttagggacttacaatgtaaatacataccgactattctttgatgaaaaatatggcgccataaatatagctacacccatcaaacggttctcattgtaacaagcgcgtgatatgatctggaaaacgaccaccacaataggacttaaatcaaacacactgaaatttaagatcatcccattcagaaagggaacaacgaacacagacatcacggtgacacacgaactgacactagagcatagagagcaacgttttattcagagaaacagcacccgtgcaaatgcagaatatactccatataagtatcaggcgctgtggctgtgatcctgcagcagctgcacgaagctgcggttcgcgagcagcttggcaatggcgagcgcctcgccggcgctgcggatgccggcgcgcctcctcagcacctcggtgaagggcccgtcccactcgccggtgcgcctccaccggaggacctcgaacgacatggtgtcccagtgctcgatgtacggcaggtgctccgccgccacgcgcgcctcgccgctctcccacccgctcgacaccgtctccctgatcggctccagccgcagggcctgggtgaacatcaccgacagcgccgccaccgcccgcttcaccgccgccgtcccctcctcggcgtcggggtcgtaggaggcgagcaccccggcggcccgcgccgcggccgctttcccgagcggcaggccggggacgtggtggaggccgccgatgaggtcgcggtaggtgttgcggaacgggaggcgcctggcgttggggatggcgtcctcgtcgccgcggaagacgtgccagtggtggctcccgttggtgaagccggcgaaggagatgtcgtggcggtgcatggccaggacggtgccgtcgccgtcgccgctacgcagtttgagaaagaccaggtcgtcgccgggtgggtcttgctgctgcgccgccgagaccgagagaacctctccgcggtggccggcgagattgaggaggaagcggaggaggaggaggagcagcgcggcctggaagttcgccatggtgagatcgagctagctagctccctaagctttgatgctctcctcagcaaagcaaagctatatatgcgcagtgtgtagtgatgaatcctcgcaatttgcgttgggcaactgcaccaggagggtgaactggttgaatgctgatagagctgtttacacctaaagttggcatttaggtttaaaattgaagagaattgtcaagatttgataaagttactggttttctctacaaggctggtctaaccgccgtgtattggccggtcagaccgttgcttgcgggccggtctgatcggcgtgccaacaagagcctagctcgtctacaatattttggtcgcgccatgaaaaaagcgtgtccctcctagcgttaggcagctagagaaagggaagaaaaactctcgcaattttcacacgtatgctcctagactgctaaacatcatgcattttttgaaaagaaaaaactagaaatattgccgcgcctgaccatgatgctgctgaattgagtatacacaattgctcaaactggttcaagagaattaacaattgaacattgtatcaaacataattatctcaacatattgaagagacttatttaccattatctcgtacacacgacaggaggtcgtttgcaagtttgctttggcacataaatctgaaagtagagaaatcaacacatcgtgtaccgataaactattgtgtcacttgattgtgaaggatcagaccagctttgtattgcatcagtgttaagcagtgataagaagcgaatactacttcccagtagtctttcaatgcaaaggaaaggatattaaggaacgatcatatcaatgcttaccaatcatcaatgcttgccaatgacagtaatttcaaattgatagattaagatacttaaatatcacacatcgatacaaaattacaacacttttgagtagttttgtaatttctctcccatatcaactctggtgaaaagaaatactatactaaaaaggctagacagttgtgatactatataaaactttgcttgttcgtattctggaaatgctccacacaaatatttccattttaggtaagaaatgaatgagtgtatagttggattggaaattttgacctgaactctgcatatacaacacaattaattttgtagtgctaaaaaaagctagcaatatgctaaagtgggtgagaatacttgatgtgtctaaactggctttaactcaatgcaaaataggatgtagtgattggagaagctttctgggatggatcaacatggtggagaaaaaccacttttatcctgccgtcactccttggtggactatagaaagtcacctatgttttcagttgcaaatattttggcattgtgaggttacagattactaattcagatttagaagatagacaaatgcatagaaaggaagaagctcacttcagatataatggctataatataataacattaccttaaaccacggtacaaccaactgtcctgaagggtatagggttaaaaaaggtggggagcaacaaaccaatagggaaaattagcgtttcatgggaagaaacaaaagaatttatatgtttgcattaagcacctagatatttaagtacagaccacatagactgtgagtaataacattatgtgaatatctttttctaaatatgcaaccacttttcagtttgttaagctagttaagctaggaaataagtattgatctggcttgcttgttcgaagaagaaaccacccccaataactgcagtcaccttgcctagcttagaaaagaagaaaagcaattctctcacgcaaaaatattgttttgaactggtcgaacgctgatagcacacaccataatcacgaaaacgtaacaacacagcattttttccgcgttcgttcaatcaggatcccaacctccactccctcgcttttcgcgcgcacacttttcaaactgttaagcggtgtatttttttttaaaaaaaaatttaatatgaaagttacttaaaaaatcaaattaatcatttttttaaaaaataactaatacttaattaatcgcgcgctaataaacggttccgtttttcgtgcagaggggatggtttccaaccccaacaatcgaacacaggcgcaagctaatctgctgctggaaattgtggactcacacacatacacaaatgaacgagaacttgtcgctaatggaaacgttattactactactctacaactaactttaacagtttatcatagaggtcagtagactcagtgcggcacatcgccgccgccgagccgtcgccgagcagcttttgccgactgccggaacgtccagccgacgacggcgagcgcctcctccgcgctgccgatgttggcgcgctccctcagcacgccggtgaacggcccgccccactcgccgcgccgcctccacctcccgagctcgtgccacatggcgtcccagtgctcgatgtacggcaggtgctcgtcggcgatccgggcctgctccccggcgggcgccctccccatccggctggcctccagcacggcccgcgcgatcggccggagcagcaggggccgtgctcgctggtggtggtggtcgccgcggtggaacaggtggtcgctgccgcgcagggcgtgccagtggccgctccggttggcgaagccggcgacgaacatggtgtcgaccctcaccgccagcgccccggcgccgctcccgaagtcgagcaggtccaccatggacagcttgcccctcaggctcgtgggggacagctcgacgtgccccctgcgctgagagagacgagcgggaggaggaggaggacgaagaggaatggtgcggcggccatggtgaggagtgaggaatgcgtgcaaaccttgggcaagcgggcggcgatttatccgccggcccggcaagagggcggcgtgagatctcggcggagtggcaggtgtgcggcgagtttgttgccggaggcggcggtggctcgccgcgcgcgatcggcgtgagcgaaactcttgaccgcgaaggcgaaaagtagagccgctgacaggtgcaggggtgggcattccgtctaaccgaaaaaatcggttcggtttttcggtcttttaaaaaattcggtttttagaatcactcggtcttcaagaaaactcaggaccgagcgattcggtcttcggtttgttcggttcggtctcggtcataaaccgaactaaccgtaacactaactgtggtttgaacggcagaaaaaaataatcacaaaaatagtactcgtaaaagatcgatgaatcaaatcaactcagatcgaatcaaagcagctcggatgaacgacaggtcgacagcaatatgatgatcccacgagcaagtagcaggtagagcacgactcagagaaaagaagcaaatcaagcaaattaatcctactgtgacttggatcccgtcgatctccatcgcccctccgaaagctccatatctcatccatctcgtctcccatcgtcgttgttcccggctacccgcggctgccatcgctttaatcacaagctcacggccggcgtcctccgccagcgaggtctcttccaccaccgtccaccagggtgcagctgggcgaccgggctagagtgcgtcgggttgggaagggatcgccacagccgcacgaccttcttgggaggcgctcctccgtcgggcggcgttgggcggtgctgcaccgtcgggcatcgggactgggagttgcagaggataagatcgtggcttcgtgagcagggactaggtggttgttgctcacgtgatgaggtattgggcctagtgggctgagatgtcacatgtggtattgggcctctgatatatttcggttttttcggtcaattcagttaaccgagcctcaagaccgaattgaccgaactaaattcggttagttgaaagtgcataccgaatttatgaccgaatttctcggtctcggttagttcggttttggtctcggtcatttcggttcggtttttttctgtccacccctagacaggtggggcatgagtatacaagattttttgcgcatgatctggtggcacacacattggaacgtattttgtgtgaatttgaatcatccgatgatccgtgcagccatttgcattggcagaaggaaaacggagaaatttgtttggacgcttctgtttgatcatttcagaagcgtgtggccggcctagaatgagtttggctaatgcccagatcctcgtgccttgctctgatctagaatgagtttggcaaatgtcccaaatcctcatgaactgaacaaggagtatcaagcctgtgccgaagaacaggtccagtaaaagaagtatccccattcggtccaacactttggcacttggaattgacgctcgtgctgatcgattgtgttttcaaacagtatatgcaactagaagtgtaacagaatcattggcggccgcttaacttgcagacggtgaaagaagaaatctgttaccactgtacatatccaacagttcttttttttcgtaggagccatattcttttttttgacagtatgttcaacaatgcttgcagctgttaatttgctgtagatgtgatgtgtcaacactctcaaaggtgcagttagattcatgaaattttgatgctgaatttaatttggattaaccatcacaataccaatctgtatgaaacggaactcccatcagtaaacagcactgaggcacaaaacatttactgcataataatcgtcagaggcggctcaccaaattaagttctaaacactttgatctgaaaacacaaaacacaacatcacaacacacaacaatatttttattcagcgagcagccgcgcgtgagacgatgaagcaagcaagcactgcaagctgcagtgatcagatgccgtgagcaagctgcagctcctccaggtcgcgatcgatcagcacgccggcgacggcgcccgcctcctccgcgccgccgatgccggcgtccttcctcagcagctcggtgaacgggccgtcccacctcccggtgcgcctcaagcggaggagctcgaacgacatggtgtcccagtgctcgatgtacggcaggtgctcggcggcgacgcgggcctccccccccccncnnnnnnnannngntnganacggnntnnnngatcggcttcacccgcgccgcctcgctgatcatcaccgtcaccgccgccagcgcccgcccgagctcctccacctcgttcccctcggcggcgaacgccgccgggtcgtaggaggagagcacgcgggcggcgcgcaccatggcgtcgcggccgagggggacgccggggaggttctggatgccgccgatgaggtcgcggtaggtgtcgccgccgaaggggaggacgctggccgcggacgggacgaggccctcgcggccgcggaaggcgtgccagtggcgcgtccggttggcgaagccggcgagggagaggtcgtggccctggagcgccacggcggctagctcgtcggcgtcgaggcctccggtgaggccgacgacgaagaggccgtcggagggcggctcgaggtcggagacggagaggacgtcgctgcggtagccgccgaggtcgaggaggaagtagaggaagaaggcggcttggaaatgcatggccaaatcgatcaatcgatcagcttgcacccctacttctcccaatctctctagctatagcttcgttctgagcaagtgtgatactggaatataaatacgagagagatattagctcgatcgcttttagcacgtcaaaagagcgtgtcctctctacctctccggagaaaggggatgacaggtggggccaggaccccgggcactgttgggagaaactaattgtatgactccgctggttcagtatgaattttattttttttatatactccctccatcccctaaatgtttgacgccgttgactttttaaaatatatttgaccgttcgtcttattcaaaaaatttaagcaattattaattctttttctaccatttgatttattgttaaatatacttttatgtatacatatagtttacatatttcacaaaagttcttgaataagacgaacgatcaaacatgtttaaaaaagtcgacggcgtcaaacatttagggaatgaggtagtaactatttaaaccacatgcatactcctagatatgatagcatccatatgtagaaaatactttccaagatccatctctactttcaagctttccatgtcgtgaggaggaagagggtgcagactccttttttttcgtttgtcccttaccgattgctagtgctgtccatcattcataaaccattgtggttacactccatttcgacgatttgagatgttcgtaggtcgtctaattagataagatatctcagtttttctcgtgtatctatatttcactaataagttaaaggacatatctagtgtgtggtgataaagcacgcggtatgtgttgtttggccaaccatgcatttcgctaggaggtggaagcacatatctagtgtgtggtgggtatgcgttgtttggccattcacaggttaccaatttatcgaagcacaaactattttttgcacaactattcaagaaaagagcttgcatttttttttcgagatctatggttttcaggtcaatattttttcgaggtatatggtttccaggactccaggtcaatatcttagtacttcctccgtttcacaatgtaagtctgttaacagtgaaatttggtaatcagcaaagacgtcatcggcttagagtcattatcggctgcagcatctcgggatcagccgatgggagttatcaagtcgccaatagtcaaattcctgctatattcggctaaggaaatcaatctactaacggaagcttatccataagtgaccgagtttaaaaagaatgcggcatggcaagttatctattaaatagaaatagtttgttagtttccttttatctttagaaaaatgtgtttagtgtcctataaggactttatctgttccttttatctttaggaaggtttctttcttgtccgacaaagacttgtatcaacccatgggtataaatatgtacaccctgggtcattgtaatctatcctcacgatcaatacaattcggcgcatcgccaccttttaccttttctactttattttatcgtccggtaggatttggcacctgacgcggggctgcatcggtgttcgatctctgacgaaggggtaagtccaatgttccgtcggcccaggcaattgtatcgtttacgtcggcgtcgttcaaggctgcatcagtacattcgacctcttggattgctctggtttggatgatatatttgcctacctatttatcatgtctctgttaatctagtcttagcatatcaatttagctctatcagctgtctctcgctttagggtttctgccggtatcggctaaatcgcattgctagattagattagcctaggcatctaccaccctgaaaatcagtcaacggcttgattgtctagatattgtgtttgatctactaagtcgtgcttagaaccataatctctagcctgcctcttgattgccaataagggtttcatcgaggtttcagccggtgagttatctggacgttgcatcggctcataaggattgcatatacataaaagttggatttagccgatgacaacaaaggtttcactgtttaatctaatcttgtggatttcatgatatcagacctctagccgatgtgtgctttaaccctcggatcgatgcttatttatcatatcattgctagccgattggtttatacaggactatattgttattttattatatcatcatcaaccgattgcttaaaccctatcgctatcggctgatatcggcatcagctgttatcggctggaattactccatcggcttgtcagccgatcggctgttttgatctactatttgcatatcttgtcagttgcaggatcaaactgactggcacgcccgcatctcatcaatctttggacctgcacaggagctaagcagatctctcaggccggtgcgttcgattttttcgtcaacaaagtcattctagtattttttatatttatagtgatattaatgaatctacttacattgtgaaatggagggagtagtttgtgttgattgaccctaggaaccgcataccttgtaagctgatccggccgtatattcttcgtggtctgtaagcttttattttttatttcgtatgctgccgcttcatacgtatacgttatgaatggtgttcatggcttgatgcattcatattgatgaaaaacttgtgactagcagcctccattaaggtgtgaagctgtagggttaattcatgaaatttcatttccgggcagttcctattgaaaaattgaaacacgatgtgatgcaaatgcacatgaagatggaaatggtcagttggtgaataatggaacaacattgaggcgcacacggcacacacatcttcatataataaatcactaccagaccttctagtctacactggccgaagatgttgggggtcttccggctagctttacaagatggagggctagatgacttgggttcgaaacctcactccttttaattatttgatattaggtcatttcttaatattaacgtcttttttacacttgccaaaaaccatcgggaaaaatatgaattactgttagaaaatatttctgtgtggtacacaccatatacctataggaatagcgaccaccatatacctataggaatagccgagaccacagagaaatgtggtttttccgtcagtttgccgaaagaaattatttaagttatttccccgtgatctcaaaacaaccacacagtcaaacaaactggtgttagaaaacgaaacacatcacatgtatacgttggattgagatcctctattattgaagtcaccgtgcctttaatacttacatgtgggtccaaaatattctatcctattcacgtgccagcgacaaagtcatgtaatttcgaaactcgagattcctgaccggaatgatatatactcaactcaattactcaaatagttaaacagcacgcgcgatgcggtcatgctagcaagcagtagaaaagagagaggttgcaattttgcatcaggtggtggagtgagccaggatcagctgcgccaaggtggcaatggcgagcgcctcgccggcgctgcggatgccggcgcgcctcctcagcagctcggtgaacggccccgtcccacctcccggtgcgcctccaccggaggacctcgaacgacatggtgtcccagtgctcgatgtacggcaggtgctcggcggccgccacgcacgcgcctcgccgctctcccgccacccgttcgacacgggtctccccgatcggcttcagccgcatatggcttccacgagcatcaccgacaggcgccgccacgccccgcctgagcgccgccgccgccgcctcctcctcgccggcggcgtccgcgtcgtacgacgcgatcgcctcggtggcctccgccgcggccgctctccccagcggcaggctggggccgatgaggtcgcggtaggtgctgcggaacgggaggcggcgcctgcaggcgttcgggatggcgccctcgtcgccgcggaagacgtgccagtggccgctccggttggcgaagccggcgaaggagaggtcgtggcggtgcgccgccagcgtggcctcgccgccgtccaggtcgatgaggaacacgtcgtcgccggagatgccggcctgtcgcgccgccgagcgagccgccgccgctgccactgatcctcctcctccccggaggcgccggccgccgccgcggccggccgagaggtcgaggagatagacggcgagggcgaagaagaggaggaggaggagtccggagcgagagctctttcttcttcctcttcgccggcacgccgccgcgggatgatgagagctcgacttggacttggatagtggaatcgtcgtcgtcgatcgagcgacacgatcgagagc

SEQ ID NO: 47379 - DNA, 5731 bp, Oryza sativa
cgtcgttgcgaccggcaagtacagcacgcacgcacgcacgggtgggagagaaaatggtaggtcacttgtttgattgaggcgggcatcgagctgcgtcgatacgaaatttcggaacttaaatttggatctatgcatttgtgtaccgtggggaaaatcgatctgctccgagatggattctaatagctcgagtggacatccacccgtttattacatgtcaactagatggttacgaaaaattttcaaaaaatttgataagatgtatccatatgtaatatatcactccacaaacatgcaagttaaattcaacttttacaatttgtaaaaaaataacaaatttaattgtaaatatacatattgtaatttgagttttgtttcttatttttgtaacaacttgtagaagttgaattttaacttacatgtttgcggattgatatattacatattgatctatcttgttcatatttttttaatttttttcataatcatttagatgacatgcaataaacgggtggacgtccactcgagctgttaaaacagtttccccgatctgctttgctcgcaacctttcttcttcgattgcgcgtgctggaaatgtgcgtgcagtgagcagtgttgcgacttgccatacggtcatcgcaatcgcaagtggtggcgtaaatgcgtaatacgttggaaaaagtacatcgaaggtccctcaacttgtcatcgagttacaaaatcgtcctccaaccacaaaaccagatatgatacatctgtcgtcccttaactaatcaaaactggttacaataagtccttaagtggttttgacaccggttttgtcctacgtggcaactaagtcaacgtgggacccacgtggaccacgcatatcaggatgccacgtcatctctcttacccctcctctctctctcgctcttctcttctatgggcaagccggctggcggttggggaggaggccactggggcgaggcgggagaggaggaggcggcgtggctagctcgtgccgcatcccgtccttaaagttcccgtcgctgtgggaatcgaagaggcagcgcggtggtgtcagaagttgcgcggtggagcggaaggcggcgttgatcgcgttgggagccgtgatggcgtcggagagggagcgcggcggcggcggggtggtgttgttgccggaggaggcgaggaggggcgccaacctgccgctgccgcatcctaacatgtggggtccatgtgggtcccacgctgactcagccgtcacgtagtacaaaaccggtgtcaaaaccaccaaaggatctattgtgaccggttttgattagttaagggacgccagatatctggttttgcgtggggggggggtgattttgtaacttgatgacaagttgagggaccttcagtatactttttcctaatatgttgggctcacgaatctttaaaggcccatgacttgtgggccttagtgggcttggcctaaaaatgcggcaacgcgtcttcctcgatgccagccgtctctgctcccggcggtcttttttttttttttaaaaccacttccatcggctgtttgtaatcagacatcagctgaccgcagacgccgccggccgccggccgccggcgaagtagaagccatttacagcgctggaagtggtaaaaatagcagataatttacgctttgtgcgtcaagaggagtaatgtattattgtatttctttccaacgaactgtctggtttttacttgttagtagagagtaacatccatttgcaaattactgcacttgttttttctaaacaaaagttataatactacgtatcttctctatctctactatattataaaaataaaaaatatttttgtcagtattttggtacgttatccgtatttgaatcggtttttagatttgttctttttggaaatacaaatccgtgtttgaatcggattttaagtttgattgcttaggagtcatataataaatctttttttttaaaaaaactcacatgctaatttaggatgaaagtcggactcctaattatagctcatgattttcttaaaaaaatatccaagcgaattccaatggtgaatttcaccctacctataccgtataacaataatataattaaaataatatttttctagtgtgtatatatatccaggagcattccctccataaaaaaactcaatttctagagtttaaatattgtccaaaaaaacaacttctacaatcctacagtcctacctaccctcagcaggtaaaacgagaagttttattatcacgtttactaatatattttttttcaataattaaagatattttagtcattctcactctccactaattccaccttagattgttaggaatggattttttttgacggaacgagtaacaaactcctacagtatgctcttgtttagatccaaactttttcttcaaacatctaacttttctatcccatcaaaacttttctacacacaaactttcaacttttccatcacattatttcaatttcaatgtgaagtaaacacacccaatatttgagaggaagtacttcaacacaaaggaagaaggctctagaacaaaggcccagggtgggtccaaagtccaagcggcacaccaccggtgaggaagtagcgagaggcggcaatggcaacaccgcttgaagattcgtgcaagccaatccgcccaaccagatgccctacccggcggcctctctctcctctcccccataaatctctctctcccacggcctccacccatcgcctcccacccgtctcgccgctccatctccaagcccgaatccccaaaaccctagcccaccccctgccgccatggccgcctcccccaccggctcctcctcctcggcccccgccgccgcggcggcggcggcggccgaggccaccgacgggccgaccctcagcgtcgtctcgaagcggctccgcgcgctgcggaagaagcacaaccggatcctccagatggaggagtcgctcgccggcgggaggaagctcaacaaggagcaggagggggtgctccgatccaagcccgccgtcgtcgcgctcatcgacgagctcgagcggatgcgcgcccctctcgccgccgccctcgccgaggagctctcctcccgccccgccccctcctcctccgccgcgccgccgccccccgcatcctcctccgccgcaggcgccgcggattcgtccgtcgtcgaggatctcctcgcgctcatctacttcggcaccctcttcgacctcaagccgcagaccgagttcgtcgccaccatggtcgcgcgcgcgcaggagcgggactgctgcatcacatacgactacgtcacggaggacgccgccgacctgctgcaccagtccgatctcgacaaggtgtctgctctggccgccctcgccgcctcgcgccctgccgcggcggtgggcgtctcgcaccgcgacgcgctccagtcctgcgcgcagcacgcccgcctctggcttcgccgtgccgatgagccaatccaccccgaatccagcatcacttgtaagtataggggttttgtttataatgttgtttgatttgggggatttgcaattatgacactgcaaacattaacttttgctataatgacactggacccacatttcatagacacagatggatccatttgtcatccacgcggagtgtcaaaacagcgaagccaccatgtttgcagtcctaatattgcaattttctcgtttgattttagctgctgattggatgatttatatatatccgtgatgctttatttggttacagatgcagcggttagggcgaagttggacaagatcatggcttcagactactacacagcgcaaccggagatgccggagatgggggctgcggtcgatttgtcggctgctgtgcaggagagcatggttgtgtcaccagaggcgccggctgtggaagagagccaggctgagggacacaaggtgaaaaaaatatttgttcttttcttgccaattaactttacttggcgtggcccaatgattgttgtcctgctaactttatcatgctgtggattgatgatggatttgatgcagtacaatatgttattattgctgctgcttgtactattatatctggtctgattttgttgtctagtgctattattatgatcaactgtggataattacttcatttgggggtagagattgtaaggcagatccgaattgtgtttatcaaaagcttgaagttagataacttgcatatggtttatttgatgacaaatgacagttagtgcctgtgtgtgagaattatgctggaaaaggttcatgtatcccatttaacttgccactctttgtttgtactacaccatgatatttgtattattctgggtctgatgtcacatatatctgaagtaaaaagcatgagtattccactatataggtgccaatgattttgccgctgttggaaattgatatgtttaacaatagtgtatctctaatcgattattttgtagtagacaaatatactactatgtttctcttgcctgctatcattttgaaagcatgatataagatgctgagggttcaaaattacaacttccatgaactttttatgcttaagatttttttatacggtccttaaaagatctattttttctgtacatgttcttctttttcgaccagttaagcctcatggatggatttgatctgcaaaatattctccttttcaatttgtgtaacttaagttttatatgctttgtctgcaataatatactccttatatattgttatgctgaagtattgcttctctgatgccttaatggcttaatgcatatattttcaagttttagacgtactcagtttttattttactgctttttgactctgaatatattatctattgtacagccatgcattcttgacaagcattttttaccaatttgcttggtgcctgcaatttgcatcttaaactttgagttgcctacttaatcttttataggttcatccaaaaacccaccgataaccactaacaagtactgacaatggtgattatatttattctaaaatcattataaggtgatgtaattcaatatggatatgtttataattgttttcatttgctctcagtcatgtgcaactaggtttacagtctactgatctagttcgcatgaatatcctgttctgatggatattatgaacacaccaaattgcatctgtgtctatatgatgtattcagatcaatttaatttactacataggattgctgattgctttctgtatgacccagttttccatgctgaacatgtgcccattattagctagtgctgctttcccatttacatattgttctgtctagagctcttgtttcgtcatatctgaagtcaccatcaacaaataaagactagaacttatcgcagacaacagtcataccatattagatttatcttattgtgatagttctggagttctgctatgaattttaggtagatttcttatgagcacatgttcaatgttcattgctgaaaaatgcttagataatattgaaccactgtgcaaatttattatagcaactaccattatggagttcattttgtccaaagaaaatactattaactcccttccggcagtatacaggcatgccaactcctttaatgggtgtctgtcatacatgttttcattcttcgagttgataacacctaagtgaagcaattagagaaaaggtagtgcatttataaaatggaaaaaaaatgctttgcacctaaaagttgtgtgtatcattgtcattcctatttgt

SEQ ID NO: 47380 - DNA, 1081 bp, Oryza sativa
tgtgaatgatcatggcgaactgaagctctgttctttatggatgattgaacagattatagacaatcgtccatagggatggattaaccaaaagattagcttagaactagttatttaagcaatgttgatgtagaaagtttttcgagagattgtgttttgagaactgtggtactcataatccatattccataatgcatgacataacttgattgtgtctttttaaattaggaacagcaataacaaatggaggtctagagaaggataaagattagattattttgacgactacagactttgtacatgcgatttgtcgatgttgctagttaatatcagttcgtaggaagcaacaaaatgaaggatatattttcatcattgctaagactttgctttattatttcttacattattaatgcttatgcatcgatatccttttagtatgaccaaagtcgtgcctttaatgggcacttaacccaaaactgtctggctagccatatgtgtggatattttttttactgtgcctgtgtaatatagtactgttgaaattgctggcatattgagctcattatatattattatttgtagtatttgctagaagagtctgataaaagtttgtgatgtttgcaacatcttcggcattctaaagccaaatcttttggtttacgtgtgtatagactgagcaatatttagatagaacacactatattgtgaggttagaattgtgtccattatcgattgtgatggattttgtgtgggcataattgctccaaattgtcattatcttattttgcatctagtgcactgtagaggcatttctacaagagagatttttagtttggatgtgatttgacttaggaaacttgaaggtctattatcctgtgggcaaatgttgtgatcaatttgttttgttggcgtagtttgtttgttgcctagtcagttcttttgaggcacgggttatatcttgtttactgatatcttatattttgtttgttgacaggatgagaaggaggcttcggaggctacagaaatctacaacgataatcagcctaatgtagctgatgctcagaatgtggtatttaccaatggg

SEQ ID NO: 47381 - DNA, 4360 bp, Oryza sativa
taaagataaaacatatatatttattctaggagtgtacgtaatcagagaataaagatcatgtgttttactgagcgcaagagaagacactatgaatgccatggaaatacctcatatacttttctgcggtcgtgaagtaggtgttgtggctccaattcattcactaaaaaaggcctgacatttatagaggataagactgctgttacaaaatgcaagacaactgggagatatgggcaaactaaaatcaccaaatgtaacagaaaaggtaacctctattcacttcaaggaaaaaaaaaatcaccctcaataaggtgagctggtgagggtgtgaggcggttcttactttaacattttatttaaagtaattaacagcaaagaaattccagtggttgtaagaaacagtaaaagttttccactttctcaatgctctcttgatcaactcatgtccagtgagatatctggtatactacacagatcaatagcaatgttccaatatctagatgcatataagaagcttgttgataagagttggtgatggaagatggtgatgatgtgcagtgtgctccacactacactgattttctgtggatgggtctttgcaggcaagggtgaacctttctagggttgtagaaaataattgcatcgtgtacacatgtgtatatatggatgaatagtccatatggttgtatttagtttacatttaaatataactatttgggcattttttgaatgagaatgcatgacatttatatgaaaaccagtgcaacgtatggtactacactagcaaaagcttaaaataagacgtaagataatattgaagaggaacaaacagaacttcaaaaataaaaggaacacttccttgacgccggcctagttgtctaaatgttgtataagaatcatcatgtacattccaagaaaaatgatacgacaaattataataaaaattttgagaagtgctctataaatcattttagaaacagggatgtatttgctaaatcataatagaatttatgccaacataacaatgtagaaggaaacagttcataccttcgtaaagcagcataagcctcagcttttttaagagggaaaccagatgaatagaaggcaatcaagcaatcgcattttggccaactggacataaaatgcagataagtgagacattactcgtaaacttacagccaagcatgcactacatttatgccataaaaaaatactacagaagtagtgtggataaacctatacttgaaaagaacaatgattaagttatcaataacctgagttgtcattacatacatctcaataggatcctcgagaataactttatccccaaatattataatctgcaagacaaataaataatgctgaatgacaattgatctgaaacatttcaactttctgcacataacttaaacatcaattaataaaatgaagttcagatagagtaattaataatgagattaagtatgcctgagataaaaaatagagaaatttgaagcgtaaaataataagtacagtccaggtttatcaacaggtttgataaaatatatgaagtatggaacataaaacaaaagaagcaacatgatgaattaatggaagcaaggagtaattagtgacatgtgatgtagctcgaactacggtaatgcataaagaatgacgaagtggtcagtggtcccgagtagaatgcaaagaacaacatgcaaatggattaatatatgcatgccgtggaccaaatccgatgccttatcgtctgcagaaagttaagatttccattgcatttcacaccattgtttaattgatagggaatcccggttcatattaaagcaccgctcaatagcttatatacttaaaaggagtcaacattggtgcataaaaaatgggggatatggagtactcaagtgctaacattcaaatatttaattgacaatagtggctaaattatcggtaaagcaaagtaggcgaacttaagtccacccaaaaagaatattgcaaagaaactgagagatcactcgtgtccagtacagattaagggacctagttgctataagacaaaacatttggggacaaaccgcaaaagcaaccacatgatggggacctcagtactggtatccacaaagaaaagatgcagaataaattggtatccacaaagattcacggatgtctcgccataaaatatttcgaaaaagcaattttttttaccaaaaagaagaaaatttatcgtatgcaattccatccacccatccactgatccacatgacaagcttcaatcgcacacccgtttccacttttgcaaattgatcgaacaaagaaagagaaacggcttggaaaaaaaaatctcgcgtacctcgaattctccaaatgcacggagcctctcaagaatctgctccataggagagcagaacacctgcagagaaaaacaaaaaaaaaatcaagagattgattagaccatatcataatcatagtcaagaaccagcggcgcgactagaaacctcattcctcaagaaccggccaaatcaatcaataggcagccgcagtaacggcaacaaggcgaatcaaatcaagaaccagaaacgcacggcaacagcacgaatcgatcaaggaaccagagacgtccaaaagaaagaacagataagtgattagtgaacacaggagagatcgaaaaggaaaaaaaacgaaaggaaaaccaaatcaaacagccatatccatgcgttcgcggatcacgtgaaccacccaaaaaaaaagaagagaagaagaagaaaaagaaaagaaaacgagagtcctagaaccaaagggcggcaagatccccccgaccttcttctccatgacgcagacgccaatggtgatcgagtcggcgcggccattcccctccaccaccattacgtccccctccccgctcccgatccgcgtccacggagcgtgcgcgcgaatctggaaagattcccacgcggacgcggggggcctgactcgagaggccaagatttgatctcctcctcgggtggaaactttggaagagaccggagacgctctccacctctccgtgttccacacagctttctcctctccgccgccgccgccgccgccgggttggtagccgcgggctcccgctcgcagtcgcaggaaggaggaaggaggagaaggccgaggctggctcttatcggttgcacagtggagggtggaggcggtgctgtgggggattgccttggttttaatgctgtggccacccccgttaggttaatgaatcccgtttgctttcaaaaggacgtgactattcagagaccgcaatctatactgtcttaactgagactcatcttgcctactaggacactaaataatacatgtattttttcttcttcttacagatttttcttttaaattatttatctgatttataatccgattacactattatgttcgttgcaattaaatctttataacaagatattacatgactatattttaataaaagaaatatctatgttataaattacttttattataggaaaaagtacgaattacccacatgaactatcgcggtcgtccgaattaccccctgaaccacaaaaccggacattcttcaccctcagttatataaaccggacgaattacccctccttacccaatccacggtagttttggtctacgtggcgtacacatggcagttcagtcagcattatatatatgtatatatatatatatatatatatatatatatatatatatatatatatatataattgtaggacccacctgtcatacactcttcctctctctctcactcttcccctctctctctcacggtcatctgcaggctggggcggcagcctcggcacggagctacggcggcgtcggacggtgacacggaggcggcgactgagggaggcggcctccgcgcggagctgcgacggcggtggtgacgcggaggcggaggcggcggcctcggcgcggagctgcgcgttggcgaggcggacgaggcccgcgcggccgcgggcggcgtgccgtcctcagcctcagcgcggagctacgcgttggcgagctcgcagttgcagcgcttccagccgccgccctctctctcctccctttggcgcgccctctctctcctccctccccttgctgcagttgtaggggttggccgggaaccggggagccttgaagaggtcctcgtctttctctgcttgtgtggcaaacaacaaaggcaacgaaatgcatagcatatatctccatgaccgacctccataacacggtgacagaaaagaatcagatcgcgaggagacgaagaagacgattgatgaccaactatttcaggagacaggagagagagggcgcgccaaagggaggagagagagagggagggaggagagagagggtg

SEQ ID NO: 47382 - DNA, 7490 bp, Oryza sativa
gcgtgtcactgcattaagatgaataaagtttggtacaacaaaaaacaaaaaggaggcagaacccaggaggacataagcctaatctagcgacattaggcagctaacctagcgacattaagctggcgtaagctggagcagcgcggcaccagctgcactccagagtgccgcctcttccgccattgatctaggcctgtagcatcctggtgccaagggagaaggttgtgatgtagacattgttaattagtacttctttccttccagattgagaagacccagtactgtgatggtacgtgtagagaactcttctaagctgtttaggcagttttaatctactttcacagtgccacaggggagagctgagggagggggaaaagatgcttcacctctttggttggtccacacgtctgtccttttacgtcctcccacaatttttgcaggtcgtgcctaaaaagttgatttttacaagcggggtcttaattaagagccctgcttgcaaaaatagaggtattttcgtaagtggatctaccagcgaaaataaaacccagtgttatgaaaaatcatttattaaatatgaagctgcagtgacatccttacaagtcttttttagattttcctcatgaactcattggctgccacatgcaatccaacaaagtaactccactcttgttagttcatggaaataaattgtacccacaacttctgtaaagctagcgcccacatattgactctgatcttttcggcttccccgaattgctaaagtcatctatggttttgctgtgtctaactattgttgaagaaccactaggattatctccactatgttgacacattatctattggtacattgtagtttggttcccatacctgaaaaatgatatatgtgaagtccacaaaataggacactgaacagatatattaaaactcagttggtttaaggaaaacacacacacgaaattttgaaagagaagaactaattttataatcatgtgtgttaatcgatttagcagctagcacgaagtgaaattctagaagaaaaaatgtcgtagagatgatcacctacgaacacaacttctacgtctgcattccttgctctcgatgtctctgattctcatggacacactagttcagatagcaaaactaaagaaaacatagaatacattttccagagctactactcgctatctactcctacatctcatttttgctcttctttaaacacaactgattcgatttgtctttattttttctcttcctggtttctatatatatatatatatatatatatatatatatatatatatatatatatatatatatatatatatatatatatatatataatactgactggactgccacgcgtacgccatgtagaccaaaactactacggattgggtcgaggggggtaattcgtccggtttgtatagttgggggtgaagaatgtcggttttatggttcagggggtaattcggacgaccgtgatagtttaggggggtaattcgtactttttcctttattatatatctaagttacttttatcatatatataaattactttttcgagttgattaaattacttattatacattcataatatttttgagttgtttattttattatcatttttagtcaattccattatttgtgttgattaaatttaatttctagatatactcacgcttttacctccataacggatctacttttaatgtcatgacaaagttacttcctttttgttttaagttacttctataatatatgtaaattaattttaagctttactgaaattacttttatatgtttaagaagtagtttagtgaaatctaaaagtaatttagatatactataaaagtaatttgtaatttttcatcaaaatataatcatatgagatcttgttagaaagatttaattcttacgaacataaccgtgtaatcggatgagtagtttaagagaaaattttatttgaaacataggtgataggaatatattttctatttacttgatgagaactagtactacagttaaagtatctagatagagactcgttagcactaaaacgagaggcctacacgtgaacagttacagacgaatgtcgtgcatgaatacacgtcatgctagagtattagaaacgcaaacgtttcccatgcatgcacgtaaattggttggagttcacgtcacaactaaaagttatactataacggagacatgcaacggtctaattctaccgccattagttattatagcacgatagggctaacataaatgcgattgttgtcatgtatgtacgtggaagatgagaagggctaatcacctgtcgacgaatttttatttcgctatttgtagcccgctagctctaaatttgttaagacaaacttactatatagttctcatgggacaatgtatttgtttaattatatatatttttatagtggtttactgttatcattaaaacaatactattttaaaagggtgtgccaactatgtattttcatatgtttttttcaatggtaataaagctgtggtacaagaatattgtttggttctgtccaaatagcaaggttatccacgtttgtctatcatgacgcgtgctaccagtaccaactaatgacttgctgctatataccgatcgggtttatttgatcgttctcgagtgattttaaattcaaaaataataatcaattattggagctaatttaacataaggtagacataatcatagccgatcatatactttttatattgaactagctggacactcctagtagttgctttttatggaactagctagacgctcctaattgatgaattgctttggacaggggatggaacaagaaatactggagttgttacattgaaagttgcttaattgcttcaaggcaggttttgagatgctttgatcagattagcgtaatcaacgctcctgatttcatccttagccaaccagcaatgcatcataatctccgaaatttaaaatgagaaaacgaaattacatgagtcattttgtagctactactacaaagcagagggcttggataataaccattgattccatttcataagtaaatactacttttgtgtcgtaataattctatttctgtgatttaaatttgtactaaaataattgtcacaatagaatactaatggtcctattaatcacatatcattcaaatgtctccatattttaccctcaactacctttttactcttacctatacatcatttaataaggggtatcatattttttttctttttaaatcttaatgtgtactaaataacttagaatcacaattattttatgacagaggtagtattaggtaatctacatacacatcactaattttctcttacaaatttagagagagaaaaaaaaagacaactcaacatgtatcccaccgccaacaccacctcacatacttgtttttttaaactgctataatgtggatagaagtattgaaacggctagttcgttaacatttttttactattttggtttactcggatttaacatactcgaatatagggatagcaatttcccccacagggccggggccgggtgaggtttttaccccgcagggagtcggggccggggccccgcaattaggcgagtgaggggccgggggaggcattccacccgcggggctccggaggaggtatatcggacttttaaatatagcgtcaatcctaaatatagcccattagacccaacccgacttgagaaaaaccctacccataacacaaccccaccacccatcactcatggcgtactctccccctcctcacctagccgccaccgccacgccactgcgccggcgcgcccctctatctcgccctctcccctccggccatcctctttccctccgcctccagtcgcacgcgggccgcagccacacgcccttctccctcctgtttccaggcaacggcgcgcgggttggcggcacaagggcggcgcatgggcggcaaacgaggagcgaacaagcgacgcgcgggctggcggtgggcggagcgagggcgacacgcgggcaacgcacagccacggcaagcccgacgactgacaagcaggcgacgcacgcgagcctcttcctccgccagtcctcccctggtgactgcgggtccccagtcgggttgcggggccccgtaggggccggggccgagggttgatttggccccgcaactccactcggggctagggccgggtggaggccggggtcgttccagcccaacccggccctgacccaccctattgccaaccctactcaaatgaattggttacttttcttagttactcctagttattgctaaaaaaacaggtggctaattatcgtaatcatctatcaacgaagaagaaagcaagtaaaacgctacaaaattacacatatttatatatatttttaagaaaagtctaattagacattgacaataaataacatttattcagcgtttgccttttcaattgagaagttttttaggtcttgtgtaactcacggagctgatcgaccatcagttctcggggactcgtagcagtttaacatatatttactggtatgatatatggttggatggcaacaggtggagcccaggtgaatgtgagatccgggatcgtagctttagttacattatctccatgtgggcccagaaggtctcttccatactccatccgtcctataatatattaatctattatcagatatgatatattctaatattatgaatctggataaagctttaggttgattttttatagcacaaaaggaatagcatattgttgacttattttagtctttgaattgtaaactagagaggtaatattcagtagtaatcactatggtctattcgctatgattcgggggttaagcactattttttttcacgaactcgtaaaaagattgtatgtcaatatattagaaaaaagagtgtttgtttacacaatgcaatcaaccataccggcttatgccaagggaaatgagaaaagacaaaaaaaaaacaaggaaaaatgaagagactgctacgacggctggacacagctccaatcagcggggagggggcagagccacactaccctctaaaaaaacccgaaagaagcaacgccagctaacgatcatagatggccctcagtgaggatggactctagaaccactgagaccgaagagagagtaaagtcgaaaaccctaaagtttcgttccttctacagttgccaagaaaccaggagggccagagagtcgaagccggcacagagatgatcaggtaagcatgtcctaaaagatggccaccaattctggagccaattgccacgaggaggagagagggcagcccaatcacaaggcgacaacaacggaaccaagacctgccaagcgaacacgcagtcaaggaggatgtggttcaccgtctcaagctcctgagcgtaaaagagatagattgagtggcgctgctgaaatacaaatcaaaggaataacttgcatttagcatcttcacgtggggggtaagcactaccattgttgatttgatccctttcacaataatcccactgtacaaaggaaataattaatacaggttccatctgtgaataatagtatatgcaacccttgtttttagggggatatatgccacccttaaaaaaaaaaaaggaagatgtacttatgcagtactactagattatactggtgcagtacagttatttccacatgagatcgttatagttgacttcttgtctataacctcagctccgtcataaaatatgtttaaatttatagttacaaattactatattttacaaaacagggagtagtatatgttcgtcccgaattcctcatggaatagaatatcttgaaacgaaagcaaaataaccttcacctaccctggctaaattgtaaaaccatcgtaatatcatactccctccgtcccataatataagggattttgagtttttttcttgcattgattgacactcgtcttattcaaaaaattttggaattatttttttgacttactttattatccaaaatactttaagcacaacttttcgttttttatatttgcacaaatttttttaataagacgagtggtcaaacaatacaaacgaaaaatcaaaatatcttatattatgggacggagggagtaatatataccaatgctgctattgtatatgtaactgatgtttcaaaaaagatgtttttagtaatgcctaaactagcacgattaaattaatgagcttgatattgatatgacttttgctcctgcaattttttggtcgcatgcgtaatctacatggaagtcaacaaaagatcaggtcaaaagtcacgcttttgtcaagtagaagtaaaactttccagtagagacttcacaagttgacatcaaagttttgtttagtactactgttaaagcgtcaatgaactaaaactaacagcgaccaaaccatttaccatctgtctgtaaagccaaactggcaaaattaatcacatcacgcagtgtgctggagtttggttccattccataaaagaagaagaggaaaattgaaaagaaaagaataattgcagggatcagtcatcactgtcctcgtttaattttggctgtgctgacatatactgatctttatcctcgatctgatggcgatcagatggttagagtactttctcaattattgggagaattaaatcgattttcctcgcagaaaattatatcggtttgtaagagaagccaaagcgaaagcgatgacacacacaaaacgatatatatgcacccgtggcgatcggtaggcatgcagttccatctcaatctctaagtgcgttatatataacggttagcattagctagttagctgtactaattaaaaaggtataagttactagcacattattacttaagtatttttgaagatgattacttaagtgttgtctattgtaaacttgaaaaataaatttattaaatattttagataaacttatatttagtatgaagcatacttatttaacagtttgtgctcgtgataaacgaggaattagtttagctcaaatccactttaactagaacacaacttaagacatgtttcgaaactttttctcatttaaattttctctaaaattttttacttccgatataatccagactctcatttaaactattttaagattacatatatagctataagtatagagaataagtagaactcacaagctaaaaaaaagatcatttttaaaaaataaatcttatgagctggttgctttctcgtaatctcacgagctcccagacatgacacaagctcgaacagctcgagcattctcggcgaccgtagctactactagtcggcagagagaaacaggcggttgtaaataaaacaagcaaacgacgtcggaaaagaacaaggctttgacgacagccaaactgttggtttctctgggcaatgtacagcagaaaacgccaagaaagctacgactactgctagcgtggagtcaggtagagcaagcagccagagaaactgacgtgccgccgccgcgtgt

SEQ ID NO: 47383 - DNA, 9200 bp, Oryza sativa
  unsure (1)..(9200): unsure at all n locations
atccctcgacggttttgatccggtttgtccgatgtagcagctgactcagcgtgggacccacacggggcctgcatgtcagcctctcattcccctcccttctccacctctcttcctctctgctcttcttttctctcactgggcactggcagcgcagccgacgggaggaggaggcntggtgggggaggcgggagtccgacggcaaggaggcggcggtggaagcggccgcgcgacgaggcgacgacgcggaagcaggagagcctcccccatgctgccgccaccgccgccgccgacggcacgggcgccagatcccgccgccgcgggtgaccatgccgtcgccgtggaggccttccgcgccatggtccggcgaaggcgcgctcctgaatgcctgcacctacactgtcgtcatcgagcacctcgcctccgcgggattcgtggaccaggtggtcgacgactcgatgtgttccgcctcctcctgtcgctgcgcgcgcggcggaccacccggcagtacaacgtgctcgccgtggcgcttgcatcggcggggaagttttagctgctccggtggctcgttcgcgagatgaggtaaggggaataagaggttgacatgtgggatccacgtgtgtcccgcactgagtcagctgccacatcggataaaatcagagttaaaaaccaccaggagatctagtttgcactggttttgtaagttgagagatacgttgtatctggttttgtggttcaaggacgattttgtaactcgatgacaagttgagggaccttcggtgtactttttcctctcttatatggctgaaaataagtctattttgtatcctcgtctctgtcggccatgtcttgaatgggaacatggcgtgatctcaaaaacaacagggactcgaacacagtaaaattaagatatcgtctgttcggaatggaaacacgaaacacacacgaagtcagtaaccgaacgctgagacactactactagtacagtcagggcggaacttgagcatacgaaggggtgccgagtgaccaggttttttttaacctatagctagtatattttgtacatccactcaatacaaacttaaacatccgtaccagtttaaacaagatccatgataaagtaaattaaacaagtaacacactcctcaatttcattctagctccgcaccggatacactactacactagagatacgtttattcagagaaacagcaggtatgcagcaacgcagccacgcaccacgatcaataaagcaaagcaaagcagcaaccagagtaatttcgagaatcctaattctcgcgcgcgccggtagcgtgcactcccggcccacgcggcacgcgcgcgcaattttttcttcggtaaccaccgccgttttccttttttttcgctttctttttttccgtgattttttttcgctttcctttttttttttgcgttttttcctgattactttttaatcttccagcagcaagtgtttttaattttttttaaagtttttaattcttaacttgaaaatttttaaatcttaatttaaaaattctcaaatctcgaattgaaagttttcaaattttgagttgaaagtttttaatcccgagttgaaagttttcaatcttgagttgaaagttttcaaatctcgagttgaaagtttttaaaaccgagttgaaagtttttaaatccgagttaaaagttttcaaatctaggttgaaagttttcaaatttgacttaaaaaatttaaatttcgagttgaaagttttcaaatctaggtttaaaattttgaaactgtaacttcacatgtagatttctttttaatttgttagttaaaaaaatctcacagaaaaaataaaatcttatctactaccatcattatcctaaactgttattatctaatatactaatagattagtataactacttagctcgaaaaaacgagcaccgccgacgctcacgcgccagctagcgatgcccgagtaatttagcatcaggcgccgtggctgtgagcccgcagcagctgcacgaagctcttgttcgcgatcacacggaccacggcgagcgcctcgccggcacgcctcctcagcagctcagtgaacgggctgtcccacctcccggtgcgcctccaccagaggacctcgaacgacatggtgtaccagtgctcgatgtacggcaggtgctccgccgccacgcgcgcctcaccgctctcccacctgctcgacacggtctccccgactggccttagccgcagggcttgggtcagcaccatcgacagtgttgccacgccacgcctcatcgcctcctcgccggtggcaccggcgtcgtaggaggacagtgccccgatggcgcgcagcgaggccgccctcctgagcggcaggccggggatgttctcgaggccgccaataaggtcgcggtaggtgttgcggaacgggagacgcctggcgttgtcggggaggacgtcctcattaccggggaagacgtgccaatggccgcttcggttggcgaagccagcgaaggagtagtcgtgtttgtgcacggccaggtgcacggtgcaccacgtcgccgtcggcgcctttcatgctgacaccgtacttctccaccaccaggtggtggtctcgcccggccacggccgagaggaggaagaagaggaggaggagagcggcatggaagctcgccgccatggtgaaccaggacgccgagcaaaaacaaagctacgtgcaatgcaagaatattagtggtggatctagcatttaggatatgggtggtccgacctaatttttttttctaaacacagtaaatctaacgatactaatatatacaatgcaagtatagataatagaatagaccaaattgtaaaaaaattaccatgatatatcacaatgcataagagtttaataagattttaaaactaaaaattgaaaaacgtatacacatagaaaacctaaaattgttgccttgttggcgcgggcggctgatcagctcgacgacggctcctcgcggcggcacacgcacagcaggtcagcaccaatgtagtgccagccagacgcagcacagcagcggccaaggcggcagagtgcgggactcgcgcgtggcggcgtggccgtgggggcgccgggcgcgggcgctggccgctgggtcgcgcgtgccggcgtgggctggccgctggcgccgtggccctgccctgtgattggttgtctggctgctgatcgcgtcgcgtcacgtctgacgtggagtgatcagatgagatcgcggcgaagggcgaggaggactcgcgtcgcgtgatcgcgtgtgggcctgtgggcgccgcgagtcgggactcgggaacgacgggaggaagaggattagatcgctttttttccttttcaaaaatcgctattttcatttttcttaatatatacgggtccatcgccgtttttccccggaccaccctctatatccgcctacgatgaatatgaaacttcgcactgtcttgtgtgtggtcgttaaaaaaaaaaagctatgtgcagcgtgatattatagtgaaactgtccaacgaggagattatttcggcggcgccatgaaaaaagagcgtgtcctccctaccgccgacgagaaaagctgacaagagattttgtgtgaataacctgatgtttcatatgcatattagtacagatcatcacaatgaatttgctgtaaatttgcttgattaccaccgttaccacataattacacccgacgcaatttcaaacacgtacaacgaatgctgaaacaatcccagcgttcactaacacatcctacacaaagaaggttcagatagacgaccgatcgatctacagtagattgtacaaaagaaaaattggacgaaatggaaaacccaaattcaaattcgaatgaagtatgcatcaaaaaaaaaaaattcgagcattgcatcgacctcatattctcaatgaattctcaagcctgaatcgactgaattcgtcgagctagctagcgcgccatggtgatcgagccgtccttgatgaggctgttgctgagcgtcttgaaccgctccctcgagtattgccgcgacgccttcctccaatccgtcccggatttcatcatcgccacgaactcctcgtagctgatccgcccatcctgcatgcaaattcagagattgatcagtttcagagtttatttgggagagctctaacgcctaaatttaactccgagagccgagtttgaagtggagttgtggaggaggctaaacccagttacatttctccagttcattttgtaagagcgcttcaactaatttcactctaattctgagtggagttcaaactatctggctaggcttcaaaagagatagagctgaattgaagaacatttttgttgcaaatggagtagtggaagggaagcgtgtgtgtttaccttgtcggtgtcgacttctctaaggatgtggtcgagcacggcgtcgtcggcgtggccggagtcgtcggcgagggcgtcggcgagctcggcgcggtcgatgtagccgctgccgtccttgtcgaagaagaggaaggccgtgcggaggtggttgtcgttggagaggcgctgcaggtggatggtcaccgccacgaactcgccgtagtccaggtacccattgccatccacatccgcctgccaatgcaaaatcaagaactcgccattgccgccattgctatcttgaagaagggtaaagaagcttacggcctccatgagaagctccatctcgggctcggcgagcttggagccgaccttggtgaggccgtccttgagctcctggagcgtgaccctgccgttgttgtcggtgtccatgagcgcgaacatgtccttgatcacctccacctcctctaccgacaggtgttccgcgatcacctgcgtgcatcgctgggcggtcagacacagaaacgggctcgccgtcgccggagacgacatcaagagcagagcacgcacgccacgtacccgcatggccttcttcttgaggcggttcatgagggagaactgcttgaggcgggcgcggacgacgtcgccgagggggacgttgggggcgcgggcggcgtggtggagccaggggtggtcgagcacctgctgcgccgtggggcggcggcgcgggtccacgtcgagcatctggcggacgagggacttggcggcgcgggagatgcgcggccatggctcccggtcgaagtcggcggcgccgcggaggatggcgcgcgccacgccctgctccgtctcggcccagaacggcgggacgccgcacaggaggatgtagaggatgacgccggcggaccagatgtccacctccgggccgtagtctcgccggagcacctccggcgccatgtagtacgggctccccacgatctccctgaacctctcccctgtttcctttcacttgccaagtcagttttttttctcttttttttctgtatatttatcggcaaattttctcataaaaatttaacaaatgtaaatatgtgtaatcacacatgtaactataatgtaatttgtacgtaactttcacatacttttaaaccgttcgattttgctttaaaattcatgcaaggtagataagaaaaaatcacattgcacacgcatgtaagggaattcggttccattacctccatttcatggaaataacatgtcgcctattgatttttgaaagttacttacaagttacatgatactaaattataatatagttacaacacaattgtgctataattacatctttgacaacaaatgtataactagttttttggtgaggttgaagaaaaggctggatttgaaacatgggccgtatgaaatctactgggcctatctgcacagattgcatgtaggccggcccatctcagagtcacactctcactaggctctatctcgtcacaaatattgtactgtggttagtacaaatttatccacaaatgtatacttaaccccatattttgatgctttagatatgcatttagacttaaggtataaataaaaatccattttaaacgttcaagatggataagcaaaatacactggaattttatcactgtatatattatgatgcaaagtgatggtcaatattatgtttgaaagatcatgtcaatgtgcaaaatgtcttttttttttgcttgaacatgaatgtgcaaaatggagagcctctgtttataacaaaggacttgtcaaggagttttgtagaattcaaatctttccatttatttgaggaaaggattggagatctaaaaatctcatgaaattcctttggactgctcaatgcattaatattttggagtaaggttaaaacaacccccgtctctctgatccaattcttgtacttcttttattatacggatcctttgttatgcaaatgtatttatattaaaactctgcttatttgctattcatatgttttaccaccattcttacattccaagcaataacggtacgagttgactgtattctgaaatgatctgtccagctcaatctattcggccatgcaacatcaaagaggaacaataattaagaacaagagtgacagtttttttctcccctgaggactcaacaagagcgagtcgtctattatcgtaagatccttgacaccgatcttgcttatcttaattaagatcttgacagcaatctgctgccgaccacgacctcttaacagtctggacgcaactatggaaaaaaaaaactcggcgtgtggtggtgattttgttctcttttttaatcactgtttttcgtggctgcgtatattcggtctagatataaacacatggttttccaatccattttttttcaaaataaaaatattcaggttatacttttatattcttttctactatcgttaattaaaaaagaaattcagctttgtggtaggttgacgaactcactgaccgagtaagctaaacacaggggacggcgtgatgcgtgtctgcagagaggagtagcatcatctgatgacccagcatccacagactttttctctgaaaatttcgggcagaattggctcggtttttcggctcaccgtcacgatcagctgccatttcaaatgcagactgttcttaatttcttccaccggtgaaagtgaaattcaggcgcaagagggcaccgaaacgccgacctgttctattttcactgcacaccaaatttactaagggagggggtcaaatttgggttggttagccgaccaactatgggttcacattttgttagaaataatgtgttcttattgatgtttatgattcttttttaatacgagtgattttgcggttttttatgaggcatcgtattttcggtatctctctctgcaaaatttgattctccctccctcgcggttcatttatatttgacgttaacagaattacgattggttcttccaacgtcaagtacaaatgattggagagagcacctcttttaagtaccataaaatttctcttaaagatatgtttttcatatataaaaacataaaaggctctactgaggttttatatgtactcccacctacccattgatcatttgggggtgttttgtgctttatgatttggcacccgtgaaaagataacgtgtttaagaaatgggataaaatttcaccttttataacagaaggatcttttgaaaagttgtagcaggggactaattaactattcccaactgtgcttatagtattataattctcaaagaatccacgtgcaacccaaaaaaacaactgcaaaactagtttgagcatttctggaaaatctctgttttcatgcaattagatcttttgacattgtgaaggaaaaaatatcctcttttttttgcaatttcatctttgatattttgaaaaagctcccaatttatttacatttcaatctttgagattgtgaaaaattattgtgaaaagctccaaatttatttgcagatcaatttttcatatagtgaaaatctccaaaatttcttgcaatgggattttttgaggtactgaaaatctctaaaaaaattctttgaatgggatttttgagaatatctactaccactaaaaaattttgagaatatgttctaaaaaaattaaatggggaagagaggcaaaaaaaaaaaagttttgttcaagcgtgcatgcattgcagaggaagaagaagggaagaagctgaccaggtcggaagaagacggagaggccgaaatcgatggccttgagctgcgcgtcctcggccttgccggcgtaaaggaagttctccggcttgaggtcgcggtgcatcacgccgtgggcgtggcacgcgcgcaccacctccgccaccgtccgcgccgcggcggccgcggcgcgctccgtgtaccggcccctcgccacgatccggtcgaacagctcgccgccgtcgcagagctccatcaccaggtgcaccgcgtcggcgtcctcgtaggcggcgcggaggcgcaccagcgccgggtggtccgggagcgacgccatgatggccacctcgcgccgcacgtcggcgacgtccacggcggtgcggaggcggcgcttcgggatggacttgcacgccagccgctcccgcgtcgcgcggtccgtggcgaggtgcgtcaccccgaactcgccgcgccccagctcgcggccgagctggtacttgtccgtgacgcgcagccgcgggtggtgcggcaccacgccctccagcacgcgcaccgcggacgcggcggcgccgcccctcgccggcagcacccgcggcggcgcccagtcgtacgggttgggcttcgccctcgccctgggcttgggcttgggcttgggttcttggccatgcctctgcctcgtcgccgtcgtcgtcgtcgccgacggcgccggcgacttcttggccgcgtgatgatgatctcgcggcggcgcgcccacctcatcggtggtagccggagcgacgcagcacgtgttgcccatggcgatcttctagaaccttctggaaacttcctcaccacagctatatatctacctctctagctagcttaattctatctacttctacatctctcgcccatctcagctcagctcagcttagcttggatgaacaagaagcataaagaaacaagggaaattaagccgcaaaatatatatatatatatagtgtgaatcaaatggtggagagagacgggcgggaggaagagaggagggataagaagaggtcgatgtcttgaagtggtctactacgcaattgcaatgagatcaaatcgacagagaaagagagaagaaaaaaatgagacaggaatcaatcaaatatagttttttgatgaat

SEQ ID NO: 47384 - DNA, 1357 bp, Oryza sativa
tcccatacctttctgttgctgtcgaagtgtcgagttgctgctgcctcttgcattgcgtcggtccattgagttggtctcccggtgtaggcgtgtatagctaggtgcctttggctcaaatgcagaatttggcctcgtatcgtatatactcgctacgtctcaaaataaatcgatcttgtacgatcgtaccagatataaacatttattgtactacaacatatccagcctcaacgtttggcatattttttgaatatttgcaaacaaaaattaatttgtgaataaaatttttatatatgtgttcttagcgatctaaaagcaaaggctgaaaaataaacttcaatgaaaaaaccccaaaatcagctccaaatttaacgttgaaaatttaaattttggcttataagcatatgaatatgccaaacgatgaggcccgtcatatccgatatgagattggtttattttaggacggatggagtatgcagctagtcagctgatctattagcctgcggtttgtgcatgcttaatttagcttttctgtgtgttgttccctgatctgtttgttgttcatcatgccgcgcagctggggtcgatctagctgatgccgtgtggattccagcacaaagggtacaaaacgacctgggcttcaggcatgcaagtgtctgtggtttcttcgaaaaaagttaagaatttattcggttatttaaaaatatacaagtgggcaatactattgctcgtacaaagacccatttaaatattttatatcctaaaaattttagaagaaaaaataaactagaattataataatcagggaaaaaaactgcttgtctactccactggcatccctagcgctacctgaagacggatgcgcgtagagcttaagccgtatttgttttgttcctacaacaaagcgagaaaaaatatatcatttttcatgcgcacactttccgaactgttaaatggtacgttttttattgaaaaaaagagaaaaaaaaattactttagaaaccatattaattatttttagaatttaaaatagctaatactcaattaaacatgtgctaatagattaacttgttttacctatataatttttccttcccacctctcaacaacacacccactacaaaatgaatggatgaaaaatgagctgttgtgtgagctaccccccttaattgcatcgctagtaatgcgtcccaatccctcagatatagctaagctagctactaccgtttgtttgtttgttgcgatcaagacacaattgaaatgtggacacgtcttctgaccaagtgaccagacgtacgtgtgcacaatgttttgttcgtgatcaattcatatgacatgacacatatccaactcccaacat

SEQ ID NO: 47385 - DNA, 2182 bp, Oryza sativa
  unsure (1)..(2182): unsure at all n locations
nnnnnnnnnnnnnnnnnnnnnnnnnnnnnnnnnnnnnnnnnnnnatataatttggacaaattcaatttagaaaaaaaatgtttttttgaaaaacaacgtatgagtagtatataatatctagtgctagttgcttaaaaaaagtttgtaaaaaaatgaagctaacatcatattttgcaaccaaaccgaaatcgaaactaaaaatagaaaaataggctagggcaacagtgagcactatccataaaacccatttaggcttgcttgaggggaaaatggatttggcaaaatttgttaaacgacatccaaaaaacatgtaattagcatatggacaccgcaagaacgtgaatttgctgtcagataccaccaaaaactggtaattagctggcagataatcgtggtcttattttattatttccggaggaattatacataaagcatttcatagtttgatagaactggatgtaatgtagatttgatctgtcctaattctgcttctcttcgacctgctgatattctttgctactaattttctcgtatcgtctaccaatttgttttctctcccttgtcacccattgtcacacacgtagaggaactgaggaatgttggaaacaaaatgtcatgattcagctagctatttctcaatcttttacgcgaaatcctgatgggtatagagccttgctttgtctattttccaccactcacggctctgtttgataagcctgaaagggtatacgaaaataaacatgttacaagatcagatgtacacaaatgaagtagagtaagtaatccgctaatttgactgactaaagaactcggtatggtgcacatagagtttcttacaatgaggttccagatttctgtgcttcttttccctgatgcttcccatcctcacgatcactccaaaattcggacggattctccaaaattcataaacgttctcgcgttcttgacttctttccaccctactgttttggatgtttgtataatgaagatggtgatgagaaactgggagagagatgaggtagatgctgcaacgactgattcccaatgattcccatccttacgcataggggcggagctagagcgaaacagagggtggtgccacttacttaatttactctactatagatcaaatttaagctgatacgggtgcctaaatttgtattgaggggtgtatacatggtgaaaatagatgaggtatagctaaaaaaaaatttttttgaccgggttcctaggcatccccctaacatatactagccccgccccttacacacacatatttagaaacgaacatagcctatggcaccagatagactctacagcgctagttgaaatattcagacggattctccgaagtcacaaatgttctctcctttgctttgtgctatgttcttaatttcttctgttttgatttggaagtttatataaggaagatggtgaggcactgcaactctgtaagggagatgatgtaggtgttgcattgatcaggttgttaattagtacgtagcagctaccgttgcagattataggacaagaagaaatcaggcaaacgaattagatatggaaataataaggctcttccttgctagataatagttgggagaatagctactgtagtccataaagtttctatgtaaaattagtttagtccctaacctttttaatagtctaaacaaattcttaaactttgtcataaggcttagaataattcttgggtccaccaaaatcgtcatatggatatgccatgtaatcattcatgcaaaatctatgatgaaaatgtaagagtgaattagacataaccataggaaaaaatacttttcctttttttcaccctttgatgtatatttttgctcttacatataccatacttttttttaacttttttcattttgccttttatttttctatgatatatgtaagggtaaattggacaaattatatagattttacataggagggtgacatgacttgtccatggagcgattttggtgggaccaaggacaatattagcccatgtgacaaatttaaagaatttgtttggataatatgaaagattaagaactaaaatgatccaggagtgaaactttagggaccattttggctattctcccataatagttggtgcatgcaattaataagttattgatttttgggtaatatggctaattgatgcagttcaatgtag

SEQ ID NO: 47386 - DNA, 4598 bp, Oryza sativa
  unsure (1)..(4598): unsure at all n locations
accatggcctatacataatttttattaagatctctagtaaattattaaggagcgtgttgtgtatgcatggcactatggcccaaatataataaatcgtgaagacatgaattaattgaggggatatatataagcttcttttgtatatacggacgttctaatatattgacgtgcaatcctttggcgcgttcgaaaaaaagtatatacatatgtttcttcacttatccaatagtggcattctcctcgttttctatatgctctctcatgaaattcattgcctgctgacacatgcattcgtagtttcctactccctctggtatcaaatatatggatgtttgagggttgtgctctttggatgcaaattattgacgttttggtatttgattgccactttggactgctatacctttgcatgcatgtaatgcttgtcttcagtagctcatcaactgtagcaggctcccaacttcccaagcaacgacgcattaactccagctttgaaactaaaggccatagccacacaggtcgcatgggagtttttgataaaagagctacactaaagtttttaataggggtaaaacaggaaataggcaacctaattaatcacttcttggtaagtgagatcctgtccaaaacgtcaattaatatagaaccggatgagtactaattactccctccattccataatataaggcacaaccactttttttagatgttccataatataaggcatacatgcatgcctacaattaactactgacatcttctccattaaattattaacttttttaaatccttcactctcacatcctctaattctattggatacatgcattgtatttattaggatgatccaaactacaagatgataataattatttcttgatatttgggttaagagtggttgtgccttatattttggaatggagggagtagtaaactccactgctgctagctaccccctccgtcccaaaaaaaaaacccaaacctagctaggaacctacgtatatacatgtctagattcgtagttagggtttatcttcttttttttttggaacagactagtagttaataggattactgtaacaaaactatattggtgtatatctcaatagtgcttctataaggtcagagacagaccaacctggtatgaaacagattaatggctgtgttcgtgtatagaggttaggaacacatgccctgcacacggaaaacaaaacagtctattagcgtgtgattaattaagtattagctatttttttaaaaaaatggatcaatatgattttttaagcaactttcgtatagaaattttttgcaaaaaacacattgtttagcagtttgaaaagcgtgcatgcggaatacgagagacaggggttgggaacccatgattccaaacacaccctaaaagtactcaacctcagtagatcttggatcagatttatactcatattactccctcaatcccgtaatataaggcgcccacgcatttcaagattcctatcttcaaaatattttgaccaatatttatgacaatatgaattgaattttacttgctaaaagttatattattggattgacatttgaatttactttcatatgattacaattttgttactacacagattagttataatatatgagaaattataagacaaaaattagttttggaggccgtgtcaagtttgatcctgccttatattatgggatagagggagtattgctcaaagagtaagactcatatgtggttttgctatgtctaaatattgttgaagtagctgattgatttttcactgcggcgtctgaaagttccctcggtttattctaggttcctttacctgaaaaaggtgagatgtcaacaaaagaagccattgaacatagaattcagcttgttaagaacaaacacagttttttttcaaagaaaggaactaatatcataaacattaatttatttactgatccagctgcgaaatgtggaattctagaagaaaaagatactaaatagatgatcccttacatatgtgattggtccctctggatttcttgttctcgatgcctccgattctcattgacacataagttgacatagcaaaactgaaggataagtagactccattctcctgtgcttcttggtagctactcctacatgccatctgtgctctgttttaaaaacaactggtttggcctttcttctattttcccctcggctcgttntgatacctcatataaccttgagtagctgcaaggcgagatgcagaactggctacggagaggggggagggatggtggatagagtgattacagcaggtacaatagatcgtttttgttggctacactgcatccatgctggagaaattgacgagctggagtaggaatgaatggaaagagagtgaaagcgagcgactaaataagcatcgattgctcacccgctcttattggatctctgcagtagttctattctcacagagagaatgattgaacagggatcaaaaggatatggacatgcgtgaaaagcttagattaaaaaattaagaatagatgcatagtgtttgtaccataaattggcttataattagtgcatttactcaggctaaattatgtaaaatagttggtgtgattgtttagtggtttaattataagagtagcgcaatttatatgtgtgcaggattatttggtgcactggaaggttaaatctggtgctagcttgttgctcgatggtctgcatgacggtgattaaacagaagcagatggatggatggatgtggtcatctgattttatggatgcattaggctggctgctggtgctggcgtggcgtgttagagctgatgaagccggttagcgcgtgttgcggcaagatagatagaaacggattagccggttagtttgtttcctttccgattaaacttttccatatttttgtgggatcaattaggattgttaaagattgattagagtgaccagtatatatactggtgacgacagattagaggaaaccccgaacaaaattatcaatctactattttcctgttatttactttcctgttattttctattttgttttcatggctgagttttgacaaccctagaatttagttaatctttgccgttttgcgctgaaaaacggtcgtgcttctccaaaaaacgagaagattatcctttgctagttgctcggaaactagtcgttcatcgtcacgtaagtacgatatttatcctctttgctaatttgcttgtaaattagtcgtgtgattccgcgaaagtgaattaatctcgaaatcggtttcactagccgattttgatctatcgattttggcgactctattgtttacaccgcaaatcattaggtgatattgtgttggccacaaaaaaacgtcaacacatagcaaattgggtgtagataattttacatctacttattgtacacatactacttttattcactatttctattactgatgtggagatttttggagccagcgatcggctatactattaaacttgctcttattgaaacagatagtttggaggtggtggggatgctaacacagattggagtaaaccgttctatctatgggacaatgatccaagacctcaagaacatgttaaagacgtacttcctgggaaatgaaggtccaatgggtgcagcgatcggcgaataaaagctgctcatttggtagtcatggatgcgtgacgggcgaaacatcgaattggttgtcgattccaccagtctttattgaccatattttaaaggaagaatgtaattttgatagctatatttggtagttcattttgtgaggtcttaccctaaaataaatttttccggaagcaaatacatgacaaaaggtctctgtcttagtgtattactccctacgtatttcatattataagccgtttgattttttttcctagtcaaactttgttaagtttgaccaagtttataaaaaattctagcaacatttaaattattaaattagtttcattaaattaaaaatttgatgtattttgataatatatttgttttgtgttcaaaatactactctatttttctataaacttagtcaaactaagagaagtttgattagaaaaaaagttaaacaacttatgatttttattttgtttttccatggtgcttcccatcctcacacttcggcagatctctgaggaacgggtgtcacatgagatctgtaaccagatggactctacaatgctagtgcataattatcagtcatcactttgtgaatagtcaccactgactcttgatcaactttgcactgcccgctgctctgtttcatatcactgaaaaagtaggtcaatcagaaaaaaacatgttacaagatcagatatacataactggagaatagttctccagtttgtttcatcaaaaaaaaaaaaggtgcaccacaaactgaattttcttaccatcactcctagtgtcggtgagtttcttttacctaatgcttcccatccccatgcacatatacttccagaaaacgaacaatgacgctgctgggacagtagacagagtctacaatgctaccaatgttcagatcgattccccttcgtcattgccttctgtcctcagttctttctcctgtttcattttggaagt

SEQ ID NO: 47387 - DNA, 1077 bp, Oryza sativa
gttcacatttcacaaaagaaaaatcatttggcctattttttccaataaaagaaagtcgagcctcagtgtgctcagctccttttattggattctttgtctattttgacatggttcattcaacggtttggagagcttttgcattgagtaaatcatgcagggaacatatgttccaaaaatttcacttttctggcttccgtctaaattatcacaaaactattttcaggtttacacagttggcccaggatatgcacatgctgaggcacgtaaatcaccagttgttgatggtgttgttatgaggaaccctgatgggaaagaagtgagcgattacacatgttttttgttaaattcatttgaatatgcattgatttgtgttgttcaaagttcatgttgtgccatggtatttgctacatgaaaatagaaaaaatccacctaaaatttgtgttatcatcactggtatgaaacctgcacatatttcatgtgtttccaagcaaattcacagtcaagcaggtctctttgctgagatgtccacatctgttaggtcaaattgataccgttttccacaatggacttctgattgttattaccagctttaaggttttattcgatattgaagtcaacttaaactgggcatgctttgtgcaaacaattttacataatgtagccaagaacaagacaatggattgatttttggtggtttggcaatttgttaaatgattataccgtggagtatggtaaaaactctggtatcaatatatcgtgaactagcatttttattgtatattactcatcagtgcatagaagaaatagtcggactattttttggggtgagaacttgctgtattgcaccaggctgtaattggctaccctatagtcagaccaatgtggacaggcatggagcaatcaacctatggctaatgataattaataaaaccttattatttttaagatcatggagtttgttaattgatacacacagtagtttaaaaatctattggctatttaatggatgttgttaagtaatgtttgaattatgactctaaattaagtttcttgacacggagcttttcatctactcca

SEQ ID NO: 47388 - DNA, 2113 bp, Oryza sativa
gttactccctctgtcccgcaatgagttcatttttggcctctcccatttgtcccaaaataagttcatttttgagcaatcatttcatcggagttagttttctattggtatatgtgatgggtgaaaaatgaacttatttcgtgacggagggagtattatgtattctcatggtaaatatccaccctccctcattacaacttaattaatctaagtttaatttaataagcctcagagctagaattattctgtatcaatcactagttttctgttactccaatctaggctagtacctaagcgttgcaatggaatttaaatgaatataccagaatattgtaaacttgcaaggctctatatatatatcagaagaaaaacatatccatagaaggtcccaccaactcaataggtggtggtgggatggttagtcaactaggttctattatgtcgtactagccaaatatcgatgagttgtaatgatctagaataagtacaatagaaatttgaaaatttttatacaattttcaatttatcatcaatccacaaataactcttacaaccgaatgagcaaatttggatacaacaggaacaaagttcatacagttgcatttgtgatcaactttattcttacgtcatgattttatttttcatgcttctcattcaggctgaagagttgggtaggtttttcagaaacaatatatatccggtaagattcacattgtgttgcttctgttattatgtaaagaactttttttatctttgatgttcttttcaagtgaaaagagaaatttacactggagatccataaacttgagcagtagtggcctaggtccttggcaggcttgtgatgttgaacacctgttccacttagtttactacaacaattttctaattaatttggaaaggaagttcatgtaaaaggtgacttagctgtcataataacatgtatgtgagtagttgatgtggcttgttgaagttactgcttagatgaagttcttgatgctagcaaacaagaaattatagaacacccattttttatctttgcaacttattttagctagttaaatatctgtacaatacctacatcaattatgttttcaaaaccttcagcttacaattggctcattgacataaacgacagaattgtcaagtagggccctagcacacctgtcattaatgggccttctagtgaaaatttcagttattttctttagatataaatgcaataagaacctggcattattataggcaatgattggctaggaaaagtaactttactgacattacagtctgttgcaggtttcttttttttaagaataaagttgcatgtatttaagctttaaaacattttaagtaatgtaatgttctcaatgaaatgtgatctctgtcaggctgccttgtcttgcatgatgaccttgtatcatcttggttttcttttctcttttttttttttttaaaaaaagtttatttcttgtactcaatattcttttcttactagtatgttatcctgaatataggtgaaggaactggtttgcttcgccttcatagcacgtacagacatgatttaaaaatatacagttcagatgaaggccgtgtgcaggtatacttttggtcttctttttttcaatttatagcccctctgaaatagttcaatttagataatctgaaatagttttatttttttaatttattctgtttttcctttctatgttgacattggtcatgccaacaggatttaggaaaattttacctgttgataggtaattgttgttagttacctttcaactactttttatttcctgtggtaataaagcccatacctgcttgtgtttaacctatcaaatacggaacaatggatgggggcaaacataacttaagctgatgaaaattgtttggtctcagtgatatatgatgtttgttcttctcagatagtgctaaatctgcttgatcatatccataccgtgttcaggatggctcggaagcaataatcagtctaatattaatcaatgcatattcaaactttattggaaactctgtaatctaattgtactcctagataattgcattttttcactatttcccggactactggaaaaccaggcaaaatatactattgtataac

SEQ ID NO: 47389 - DNA, 1274 bp, Oryza sativa
tgaattacattgcagatatgacctcctgcataatgcacatcttaaccttgaaggtttggaagagcttttcaaagttgctcaagtaaggaaccttaacgttctgtacttccatttgatctctcttttaaatttgcatgaatgttactgatggacttcttgagtagccacgaagtcatattgactaagtacttcctgcagaagagaaatcagtcaattgcaattgtaaatatatactgatatgcaattgcaaaatatggccatattatttttgtatgaacaactgggtagatagggcattgaagttctgacttctgaggatatcatttgacacaagtcacctgtgccacataaagaatgacattcctagttttctttgcctccacaagtcttggagtgcagactattgcattgtggtcacataggccttgaaaagatcgcaagtggttaaattatacagttccaatgctcaggtgatgtgactatgtgagacaaactgtatggtcagtgcttatgttatgatgattcctcatagaaggttcaatcttatattctttttgtatagccttatgagagatgtgagtcttaagttcattatgctagatcttgtggagtgaagtgacctggaacagacattgtttgtttagtgcatctgtttggatgattcaacgtagaaggtccaattccacattctttttgtataatgttatgtgagatattagtgagaatttcattaagctagatattagtgagatatgttcttttcttcatacttttatcatttcgtataaatcaattactccctctgtagaaaattgtagggcatattttatttggaaaagaagtttttaagacaagactttgaccattgattgcgcataaatatattcataatatctataaaagcaatgtttatgaacgctctttgaaaaatgaatgtattggtataattttatgcactaaaatatacttataatttgactaattgtttgtcaaaaatttacaaagtttgaccttctgaaaaattatagcttttatctattagagccacatatgatgttatagttttggattttttttgttagtttatttgtgtagattagttctctttgacgttttaatattttcatcatagcttatctaacattgattgttgtagcttcttgctgatggcgtaattccaaacgagtatgggatcaccccaaagcaaaaactaaaaattggctcaaaggtttgttttaagaaagacgttactgtttgttccatgggctgcagga

SEQ ID NO: 47390 - DNA, 1749 bp, Oryza sativa
agggatcaaatatactttctgctcctgatcaagctctgaacaatgttggcattttggcaacatggacaatgttcatcagacaatgtctgttggagaacacctatgctaacacctaggcatgcactaattttccttgcatttgatttccaccttgcagctggttagctcatgcacatctattttggcacacttcaactctgctgaaaaaaaaagctgcacggtcaaccagctagacacgatcattgtctgatgaatgatattagaatttgattgcgttgtaaattactataacttacgtgtgcttatgccatttaaactccatctggtgagcctggtctctcaagaaacatgagcatgggtagcatccgtagtttttagtgtattttaagagatctggtcaaaacctacaacagtaaggcaaaattaaaataaaatattttgtttgcatcaacgatatactcctaaaggcaagattttccaattgtgatgaaagccggaaacctagcgaggtaggtgaagaaagacaagggatgtgtgaaacatgatatctttcatcttgtctttctttttggccattttaaaaatgattttaactctaatttatatttgggagcatgattggattacacgttgcactgacaagtgccgctctacatttggatgcttccattgactgaaaagattacaatagcatatcatttcatttttcttaaaagaaattaatagataaagacacagctgatgataaaaggcaagaaaagattgtgtcaacttcactttagtggccgaagagtgagttgccttctgcagcaattcagcaaagtgcagcttggaagcgtctggcgtattatgccaagtatttggacagcaggaatttgtcgcgatgggtctttgacaggcattaccataccaatagttgagagcttgaggctcaatctgaatatgtttccgcctttattcttagtaacgtaatttcaattatatatggataaatattattatccgtaaaaatttattctctagtaactatattcacaagaaaacaatgtaaaataaaattagaaaaagtaaatcaaacatcaaatcctgttcctgtttggcagcctgtaactaaggtagagtttagttccaaacttttttttcaaacttcccaactttttcatcacatcgaaactttcctacacacacaaacttctaatttttcaatcacatcgttccaatttcaaccaaacttccaattttaacgcgaactaaacacaccctaagttgtaacgtggctgctagactcccaagacaacggctggctgcaattccatagtgtttactaggtgaaaccctgcatactcctgtgagagtttaatacgataataataagtaaaattaatgtataagatggcttaaacaatatgagcttacataaacataagttgatgtgatttaaatttaattactatatagaatgatgattcaaatgtaaaagtaagatgatgtggcttatgagaaaacaaaagaaggaagataatttagatcatacatctaacggctaaaaaattgagattatatggcttaatgagagaagaaaagaagaggtataatttgaaccaaagattaataatcatataaggattaaaaattaaaaacaattgatgagatatgacttaatgagagaaaaatataagtaacatgaactaagtggggatgaacttgataggtataggagataatatagaaaaaacgatgaagagatat

SEQ ID NO: 47391 - DNA, 1305 bp, Oryza sativa
ccagagtacatacatcaacctgaaggtaccactttatgttgatcatgcacataaagttagtcggaaatcttaaatcttaatcctatttcctaatgttccaaagcttctctaacatattgtatgttcattgagtgttgaatcctaccaaatgaattactacgtagaaaataatagaaaactctagatcaaacgccaagaaaaccaacaagaggtggaaaaccaagaggtggatccctatctacactgaatcaaccaaccttttttttttgttggtaggtgccgatacgaccgatgtcatatggcctgcaagagatatctatgctcacgtagtataattagttcagtagcgaagaaggtgtagccataacgtcgattttgttgtcgctttgttgatgtccactagatagagtgacgctcctatactaatcactaaagtcaaatatgcaatgggaaacaacatatttgtggtcatatgtatttatatctgtaactccttttaatttatacacgcattgatcattatgtttgccaccacaaccattacacatgttctttgacattattattttacatggaaaaaaaaataaatctagccttttgcccttacaatcatgcatccataccaaaatacttttacaatctctactaggggtgcattcggctggccttgctgccgcaacggctacggctgtgacattgtaaacggttgtagcacccagccggtttgaactaccacaatcctcaccaaaatacttttgtaaactactagggctgtgttcagttggccttgcagccgctacggctgcggcagatagcgcatgctattagggcctagttttataatctagatcaatactttgaatctattcttattttcaaatgtaaacaataaacaacctcaggttagaaagctgaggtctaaaaagaaatttagtaccaagtactagtatatttttaaagctgttataaaatcacacattattactaacataataaaatggtaatgaactaaaatagcaaggagtaaccctatatgacaacaacaacaacccaaaaaaaaaaaccatctataggcatataattgtgaggagaaccacagattgtcctgattttcacataaaaaacctactttttcccagcccaaaatctcccctttgcctggtacactacctaccctttcttttgttgtccaattcatttccatttcttgccgttttcttccacattcttctctgctgctggtgtctcttgtgggccgcgtggaaagccactctctcctcctctttgacctcgctatctatccat

SEQ ID NO: 47392 - DNA, 7438 bp, Oryza sativa
catgcagattctcaacctggcacacaacaagacacagatagaacgacgagtccatgctgtaattgataagtttgcagaacgtggacttcgatcacttgctgtagcatatcaggttagcacttcttcggatactctttgcacaatttgaatgttttaacattttgagttaattaagattaggaactatccagagtcattatatatgttgaaaaatcattgttccctgggccagtttaattttcattatggtctcctttccctgtcatgtaggaagttccagatggaaggaaagagagtcctggtgggccatggcgctttgttgctctccttccactctttgatcctccaaggcatgatagtgcagaaacaattcgaagggcacttaaccttggtgtaaatgttaagatgatcacaggtactcttctgattgaaaaaaaaaatctagatggtttatttgttatatatattttttattattcttttctggtcgttgtggtggtgagagggtactccatgtccagttattatatggtgcatcagttactagaatcctaatctactccatccgtcccaaaatataagagattttgggtggatatgacacttcctaggacaatgaatctggacagagagtcacattcacccaaaatcccttatattttgggacggagggagtacaataggaagaacaactagcataaatttgcagtactgcaatctgttcaataagaaatgcatgattatgatgtatcataaagaagaaactcaattttcatcattaaaaaaaaataaaccatccattgctcttctgtcattgtttggagccatggggaccatcaccagttcaaagctgcagatagtggtctttgtagcggttccagtcttcaccattgcttatatgtatccatttacaggtctaacttaatgtttatagagactctttcttgtttatataacttatttaaattatttttgtgaggataatttatatttaattctgattcaacatttttttaaaattaacactgtaaacatgcctaaaaaattgtggtaagttgagagttggtctaccaagtgtcattactggatcatgtcatggaaatttattgcaattttgttaatctttctgaattatgggaattaaaattatttctttatcttcaggtgaccaactagcgattgggaaagaaacagggcgtcgtctaggaatgggtacaaacatgtacccttcatctgctttgttgggacagaacaaggatgagtctgttgctgctttaccagttgacgatctaatcgagaaagctgatggttttgctggtgtattcccaggtttgtatgcaatcaattgcagaataaaaaccaaatggttgaaagtcacaaagaaaaatataactgtgaagttctctcttttctcagagcacaagtatgagattgtaaaacgtctgcaagcacggaagcacatctgtggaatgactggtgatggtgtaaacgatgctccagccctaaagaaagctgatattggtatagcagttgctgatgcgactgatgcagcaaggagtgcatctgatattgtactcacagaacctggcttgagtgtgatcattagtgctgttcttaccagtcgggcgattttccagcgaatgaagaactacactgtaagtcagatggaaacaaacatagtgtcttttaatattctgcctttttccttgggttattttgctaattcatttccatgtttgcagatatatgctgtctcgattacaatacgtattgtggtatgttttctttactggagaactagaaattatggatttcctctcatttggtaaataaatagttgattgttctcgtaggtattttagtttaactacaggtcaatcagaactaaccattcagataaatttaacagaactaagcactaaatgattccagtgtataaccttttgtacacattaactttgatgatccccaatatgatgttttcatcttactatgccaaacaatgtgtatcaactttatgttttagctagcacttaatgtatattgactgctcttttgacagtttgggtttatgctgcttgcccttatatgggagtttgatttcccgccatttatggttctgatcattgcaattctgaatgatggtatgtcacattcttgttccctccatccctgctatctctcctaaaacttcagtagtaagtagaaactattttcatgatgttcacttcaaccattttctggcacaaacaggtaccataatgactatatctaaggatctagtaaagccttctccactacctgacagctggaagttggctgaaattttcacaactggagttgtgctgggtggatacttggcaatgatgactgttatattcttctgggctgcatacaagaccaactttttccctgtaagaagtgccaaaaaatgataacaaatggttctaattgaactgttggcctaccacattttgtgattgattcttgtattcgctttgaaacttaatgttgcattgattttcagaggatctttcacgtcgaaagccttgagaagacagctcaagatgactaccaaaagcttgcatctgctgtatatcttcaagttagcaccatcagccaagctcttatctttgtcacaaggtctcgcagctggtcatttatcgaacgccctggctttctacttgtctttgctttcttcgttgcacagctggtatgctctctccctattaccgcaaactgataattctcttctgggtagaattgtgttaatctaactttcttccccttcaaatgcagatacctacattgatagctgtttatgctaactgggcattcacttcaatcaaaggcattggatggggctgggccggtatcgtgtggctctacaatctcgttttctacttcccgctcgatatcatcaagttcctcatccgatatgctctgagtgggaaagcatgggatcttgtcattgagcagagagtaatgctaatgcaccctgcatagttgtcttggctccttacctatttcgactgaatttccatgcatttgtgactaatggcccatcgatttcgacagattgcgtttacaaggaagaaggattttggcaaggaagagagggaactcaagtgggcacatgcacataggacactccatggcctgcagccaccggatgcgaagcccttcccagagaagaccggctacagtgagctgaatcagatggcggaagaggcgaaacggagggccgagattgcaaggtaggacctaaatctgcagtagacacttgtataattcttttccatgatctgtcaccttaagaatcatatagaagcaccatgtcctttatattgcatcaattctcagttgcttttgccatgttccttccaagatcaagaagcatctccctttctagctgcacaatgccaatttgcatccccctggaacacgtggcgtgaaaacgatgtaaagctaactaactatgtgcttgttcttgctgttgatgctacacttgcaggctcagggagcttcatacgctgaaggggcatgtggagtcagttgtgaagctgaagggcctggacattgataccattcaccagtcctacacagtgtgatagactcttatctaacaagagtaatatggttgctgcagaggaactgtttcgtttcatctaattagtagtttttatctcctctcagctaacataaatgtaatcaaccaacagttcatacaatctataaatcaaatcatcaaaggggattgttgagattatccgtttttgtcggtgttttcctatatgtattgtcccttaaattggaggcctcccatgtgtgataccattgtgttatggtttatattttcgtacgtctgaccgcgaattcatggaatgggttgtttccattccacttttcccctgaacgaatataaaatagcttgttcagtaggaagcttcaaaatgtcacaccttaaaaagtgaaagttgtctcatctcctttcttgaaaggaaatggatgcatgaataaacttttcttttaatttttatcctgggggttaggtatgtgcaaattgttcactgaacgatcttttttttaaaaaaaagcaaaattgcagttgcgcatgcattttccattggaagctctctgttttctgcatgtaaagcatttcagatggagctggtgaaattcgataagctgactgctgaagcttcagaatcagcctgattgcagtaaacagaacgtgcaaatcagaaatgagaataacaaagtagaggaaacagatagtaatacaacattctttttcaagacaaatgacaaatacatctagcagaagttcaggctttggagatgtttgtttcgacgtgatatggctctttggtataaaggaagtaacattcagacgtttcgctctgtggtttgaacccgaaaaccttcaattgttgcacatgccggacgctcctccactcttcagagctggcatcctgcaaggatatcaggttgagcaagctcaagttgcagtttatgtgtaacctctttacctttgcctcctgtaagtaccccgggagcgtgtcagcatccaagtcctcccaaacgatgctccggatgcaggcaacctgtcaaacgccttcagctctgggcatctgaggatctcaatcttcgtcaagctcgagcagtttacaaccatctctagctttgggttgtcagccaggtaaagttcaaccagcgaatgcaagttctctacggattcaaggctcacggcgttcgtcagcaccaaagctttcagtgctctggtgtggtacacaagccccggagggagacgattcagtttgctgttctccactgtgagcgactccagagcaggcattgcttggacatgctcgtcccagtcccacgatgcccatctcaacatcccctggaaacccagccgcttcagcttgggaaacgcaatgcctgcaccttcagtcttagttgttgttgtcgtcgtcgatggtgcgttgccatcgacagcaatgcctaccggagggaggatgaaatcatgactgacatgctcaatggatggtgcatgctcaatccagaggtagtcaaggtaagggagttggcccaagccaccgggcagccggtcgcagcacgcgtagtcttctagcaccagccgcctcaagctccgaaaggcggtcgccgtggccatccactgcggtagccgatgtccaaagtaacctgcaatcgtaagacggtcaattgaaggtggagggcggagatgctcaaaaacgttctcgattctctcgcaatcctcctcgctgataccaccttgcacggtgccgtttgcgctgatcctgctagtgcatctcagctccagttgtgtgagattctgcttgctgctgagctttgatcttgctgccatttggccaagtgttgccttttccagaacctccaaatgtagtgcactgagatttggcaaagatcctagctcttccaagctacaccaatcatgtgtactgtcatccaaatcggttgggaaccccaacatctcaaccaaattttctagctttccgaaacccctaggaactgaagataccattgtgtgtctgatgtccagtgatcttagcttccgcagtcgaacaatgctttcaggaagttcagacacatttatgcaaccacagagatcaatgtgctgtagaaacctcaaattccctatgaggttagggagtgcagatatgtatgtgcctttgagacctaggtatctcaaatgcttaaggtgacagatggagtctggtagtactatcagatttgcatcctcaagatgtagcacccgaaggcaagaaagattattcaagaaattcttgtgcttagtaacgatgctcctgaatagtatcaacgtccttagtgatacttgcctctgtaaagcatcccactcgacttgcttgtttgaaatacagagccgacgaaacttcagagtaccaagtgcatcacctatggtctgtttctgcatctcgttaatggacaatccctcgtccttcgctacatgttgggcaaaagaccggacaacatcatgcatggtgcatcctagttgatcatagtacccatcacttgggtccaaaaggttccttaagactaactctttgtagtactgagctgctacagcctctggcaatcctgaacccgtgctatcttgcacgaacccttcagcgatccacattcggacaatggttcttgattcgatcacctcacctcgtgggaaaagtgagcagtacacaaagcattgcttcaaatgagaaggcaactctccatagctcaagcagaccactttgttaatttcatcattcacttcatgtttacaccatgcagaatgtctagaaacctccatccaggcacctcttgttctgctcttactaagtaagaggcccccaatcatcttaatcgcgagcggtaaaccatcacacctgtccacaatttgcatcccaatatcctccaactcatccaattcagcttcatcactcttgttcaaaactatctgttggaatagtaaaaagctatcttacttaaaaatgaagtgtatacctaataacatccattgaatataagctattctcaaatacagtaaacaacaacaaaaaaaaaaacctgcaacattcatttttacctaataacaaccatgcttttttatcatgtgatttacttaaaaaaaactctcataattgcagttagaaagtagatagttgtaaaccatttatttaaggattcttcaagatctacaatagcttaaacatcgaagctcatcgtgtgaaatccgaatttcagtcccaaacttgcaattggcacaattgatcagatttgtttgtgatactgacctgcttcttgagcaaggaccaagcatcctgtcgccgcagcttgtcaacacggtggaggtacctcaccttcatcctgtgagcaacgccatcgtttctcgtggtcaccaggatccggctccccggggcgccatggctaagcgggaccctgagcagctcgttccacgccgcgtcgctccacacgtcatccatcaccagcaggaccttcctgtgcgtcaccgcgcgctgcagggcgcgctccagcaggtccttgtccccggcgacggcgaggccctcgcagctggccgccccggcggcatgggcgatggcgctgcgcagcatcgtgacctcgtcggcgtcccggccgacgaacagccagatcctggcgtcgaagctctcttggaccgtggcgtcgccgaagaccatcctggcgagggtggtcttgcctatgccgccggcgccggtgacggcaatggtggggatgagattgcagccgccgccggcgtcgtccaggtccgtcgtcttactgacaaggatgtcggcgagcatcctcgtgtcttccgcgatcttctccccgacgacgtcggatcggatgaggcccagcgcggtgcggcggccgtcgc

SEQ ID NO: 47393 - DNA, 20766 bp, Oryza sativa
  unsure (1)..(20766): unsure at all n locations
gcggtcgcgcgccctctccgcgtcggagaggacggcgcgcaggtcgccgagcgtcgcctcgagcctggagatctcgccgggcacgcccagcagcgcctcgacctcctccttcgccgtctccgccagaatgcgtgcgaggctcgacgcgaaggcgtccagcatcgccgccatgatcgccgccgacacactgtgctgggaaaaaaaaaggaagagacggagagttgaagttgcttgcgccgacagatactcacatagtcaaaactccaaacctctgcgactgctccacgtccatgatcacgagtccacccaaaccaatttccatcgtgtttagttccaaattattcttcaatctttcaacttttctatcaaatccaaacttttctgaatacacagacttgtcacactttttccagtgttggcgtcgatttgtgggacccatactgctgcatttgccgatctatcagccaaccgttcctttctccattctattctccccgtgataaacacttgtttaatcagctgagttcgactcattttggggcgtcgattttcggtctgacacatagcagccgactccggagggtataagagcaagtttaatagcatatctcactactaactccaaatcatctatagctaatgtaatagccaactcatacaatagtgcttactataatattaatacatggtcctatctgtcatatatacattacgtcttggagtccgtgctgcagctggctacagatctgtagtccgctgctattctttctcttcctttttctctttaaaatatgtttacagctggcttatagcatgctattgtacctgctctaatgggcgatcgattgccgtcgcccagtgatcggtttgcccctcctccccctgtactcctctctcttctcccccttcctcctccccttcttttctttttactacagtacaccacacaatttttttttgaaaaacaaaagttagaaaaatttatgactatatataaaaaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcagatataattcaaattcaaatttgaatcaggtatgtaaacttttgacttataaactttggatctataaactttaggtgtataaactttaaaaatatttgaattcaaattcaaatttgaatcagatataattcaaattcaaatttgaaacgcgtatataaacttttgagttataaactttaggtctataaactttaggtgtataaactttagatgtataaactttagatgtatagaaatattatatataaaaaaatttgaattcaaattcaaatttgaatcggatatataaacttttgacttataaacttttggtctctaaactttagatgtgtaaacttgaggcgtattaactttaggtatataaatttactgaaataggaaagtaatgcgatgccaaaaaaggaaatcaggtggaggggtggagggagggaggagggaggggatcgatcgctgccccatccccagggcgatcgatcacccaacagcatttccggccgactcctatagtgtactactccctccgtcccataatataagggattttgactttttactttaactgtttgactattcatcttattcaaaaaaaattgaaattattatttattttatttgtgacttactttattatccaaattactttaagcataacttttcgttttttatatttgcacaaattttttgaataagacgagtggtcaaatagtgcaagcaaaaagtcaaaatttatattatgagacggagggagtatttggttcggtttctctgcccgtgcgttgatttttgtctcacactggagctgctcttagggtgtgtttagttcgtgaaaagaaatttttttaataatacataaatctccgttggatttgttttggatggtccagatctacccaatgtaacgttgtgacttgcctacccaatgtccgccaagctgaatcagtcaaaattcatagtaatagaatatgccaaatccagtgctaggttggtttttataggacgaaatgagcaagttgcatattgcactaggcaatagaaaatattttcactttagaccatgttttgttaccaaagtttgcatctttgcactttaaactagcgagctcacatgcaagtgacaaaactattttcttcatcgttggtcttcccgagtctaatttgttggatgccatttgcaaagcatttttccaccccacgcgtcaaagatcccctcttctcacaacaccggtgaacaagtcctctccccgctccgccacacgatgagcttggcggggtgggccgtgggggtgggtatacctctttttccgattattcgcttcacttttttaacagactacatttgaatttaagatacttatttttaccgatgtttcgctatcgattacccttcaagtaatgtttttactttggtccatgtagttttatgtatcattttggacaacttaatttttttattcatttgcatctaatttgtcatatatcaaagaagaattaaattttaaaatatactgttcattcatttttttctcagaaatattcgggatgcaaaattttttacagaaatataccatcggtctcgcacaaccgttgcgcgaagatgacgtgggaatgacatcgcgaatggtatcgcgcgagactgcgcggtctcgcgccacgagaccgcacggtctcgcggaatggaagagcgagaccgaacggtctcgctgttagggttacggattaggtatacctcttacccttcgatatgcgccacatatcgacatggcatacccgcgcatacacggacattatctgcatacactaaggaaattctccatagtatttgagtcctactcggacaagacagggtcgtcaatgtatcgtgtagggtccgatgtctccgagttctacttggagaccacctgatctgcgatataaaagggactccctgggaggacctaaggcatcgaatctcacagccaacaccacccccacagcctacgaagtcggagcctgcaggagccaagtcgccgggagatctagtcgaactaactcgattacgatctcgccggtttcttcgagttccatcgttccctttgtaacctgtggttttccatcatataatcccatatcaactggattagggctattacctatcaaggggcctgaaccagtataatcctcatcttttgtttgctcgatgtcgtattacgtagatccttgtaccaacgtaccccaataccctctatatccggtctacgggtatcacccgtcgacagtggcgcgccaggtagggggacttggtgctcaaggttctactactatgtcatccagcttcgttgacaacagcgtcaacaccaacctcaaccacgggtttcctgcttcaacaatgttggtgtggactcaagtcggtgaaatcgtcttcccggtttacaccacgataccgatctcagccggtccgtcaatgaccggaaacgagaacgcagtggttgcaacccaagacgactccgtgtcgaaggatcctcccgccgaagcggagaacagaacgtcgacaacatctaagctcgagaaggattctaatgcggccgaaccttgttgttccgacaagaaccacgagccgacgagaacaacttctgaagcgacaaggtcctggtgtcctatccacaaaaccaggaaacacactttgcaagcctgctgggtttttctcaacgtccgcgccgaaattcgcgcttgcaacgagcgtggaattcagcgtatttctccaacgcgtgatgtttactgtcctattcacaagacaaagaatcacgacctctcaagctgcaaggtctttctcagcgccacgaagacgtcacctcctaaggaccaacagtcaggcatatcccttagagatgaagacaaggaacaacgaacgctggtctcagatcgattcgtcggcgtaatcgacatcgattcccacgaaccatcagtcctgcatctactcgaggactacagctcatctccaacgagtacgccacgcgaggtattagctatcgacgggaccagcacgtcagcacacgctaatgcggaggcagaaaatcaagtgactacaccggcccagcacatcaggacccttaacacaatactgagagagagaccttacgatcccgttctgaacaatgatctcgcgtggtggcaggaacggctacgggaatcagtaaccaacctcagccacgcgttcaaagaagccgctgctgctacgcaccgggaacaaccaccaaccggcggtgtcgatggcgaaaatcccgaacagcgggagtcaccccatcaagctacccctccacctcgtggcaccggcgatctccgtgaccatctcaacggccgccgagaggcacggcgcatgcgagacgacgggaatcgctcccaacatcgcgtctcttcccgacatcgcgaagaacgagagggccgctcgagcgaagaccgagaccgcgctaatcgccacaatcgccacgatcatgatgatcgcgagaggcgtacgcagggcgatactggtcgaggacgccgccataacgacgaggacgacggagatcggcgccgggacaacaacggagggcgacgacaggattctcgagaacccagccgacgaccccgtaatcccacaccggaaccaagcgattcatcgtcatcgtcatcttcttattcatcctcatcgtcagacagacatccacgaaggacacacgatcgccgacaacccaccgcccccagcgctggatgtagagctttcggtcgttccctgtgtgatgtccgatggcctgagatattccgacccggagcaatagagaagtacgatgggagtactgacccagaagaattccttcaagtctactccacagtactctatgctgccggagcggacgacaacgcgttggcaaattatttgccatctgcattaaaaggctctacacgctcatggctgatgcacttcccgccctactcgatttctttgtgggcagacctgtggcagcagttcatcgccaatttccaaggaacttacaagcgccacgcgattgaagatgacctacatgcgttgacacataactcgggtgaatccctacgggaatttgttcggcgctttaacgagtgcaggaatacaatccctgagatcaccgacgcttctgtaattcgcgcctttaagtctggagtccgagatcgctataccacccaggagttggcgacaagacgcatcacgactagagttaaagtcgcaagagtgggaaaagaaaagctcaagcagaagttctcgcagcagaatacgcgaacccatccaaatgcctagacccacagggtagcgacgcaaagaaagcatggtgcccaatacacaagacggatagacactctttggaagactgcctcgttttgaagaagtcgctcaagaaacatatggcgttggaaaaatgcaagcgagtacgcgtggtcgaaaaggatgtggaggcggctgctcaggaatcagactcagcatatccagactccgacctccacgtctcacacattttcggaggctccacagcgtactcctccaagcgagaatacaagaaagtggaacgtgaagtctgctcgacatggcagggggctgcacccaagatgaagtggtctgaacagaagatagaattctcggaagaagaccatcccaagactgccgtcatcccaggacgcaatccgatcgtggtcgagcccaccattcgaaacatcaaggtcgcgcgagttctcatcgacggtggcagctcaatcaaccttcttttcgccagcaccttggacgcgatgggaatcccacgaagcgagttgacacctaccgatcaaccctttcatggaattactccccagtcctcgtccaaaccattgggcaaaatcacgttgcctgtgactttcggtcaagcaaacaacttccgaacagagcagatcacctttgatgtcgctgaatttgatacagcgtataacgccatcatcgggagaactgcacttgcgaagttcatggccgcatctcactatgcatatcaagtgctcaagatgccgggaccgaaaggaacaatcactattcaagggaacgctaagctagcggtacaatgcgacaagtcgagcctcgacatggtcgagcaaacgcccagcccacccgccacaactgagcctcccaagaaagtgagcaagacaaacaagatgccgaaaccagacagcgcgatcaagatcgttccactcactagtggcaaccccaacaagaccgttaagatcggggcatcactaagcgagaaataggaactcgcgctcatcaccttcctccgcgacaatgctgacgtgttcgcttggcagccgtccgacatgccaggggtccctagggaggtgattgagcacaaactcatggtgcgacccgatgcgaagccagtaaagcaaagactgcggcgatttgcaccagaccgaaaacaagccatatgagaagagctcgacaaacttctcaaagctggctttatcagagaggtgctccatctagagtggctagccaatccagtcatggtgcgggaggccaacggaaaatggaggatgtgcgtcgatttcaccgacctcaacaaggcgtgtcccaaggatcacttccctcttcatcgaatagatcaaccggtggactcaacagccggctgtgagctattgagcttcctcgacgcttactctggctaccaccaaatcagcatggcgaaagaggacgaagagaagacagcattcatcacgccgttcggggtattttgttatgttaagatgcctttcggactgataaccgtagggaatactttccagcgcacggtccagggcgcgcttagcaaccagctcggcaacaacgtcgaggaatacgtcgacgacatcgttgtcaagaccaagacaagcgactcattgattgacgatctacgggaaacgttcgacaacctctaatgataccgcctcatgctcaatctagtgaagtgcacgttcggagtaccgtcgggcaagttgctcggtttcctcgtctctggcagaggaataaaagcaaatcccgagaagatcaaggcaatcgagaacatgaagtcgcccacaagactcaagaaagtacaaaagctaaccggatgcatggcagcactaagcaggttcgtcgctaggatgggagaacgaggacaacccttcttcgctctgctggagaagcaagacaaatttgtatggacactggaagccgaagaggcatttattgcactcaagtgctacctatcaaacccccctgtacttgttgctccccaacctaatgaagaattattcctctacattgccgccacgccatattccgttagcaccgtcattgtcgtcgagagagagaaagtacgatgaccagtctactacgtcagcgaagctctccacgacgcaagctctccacgacgcaaagtcaagatatcctcagatccaaaagctgctttatacagtaatcatgacgtcaagaaagctacgccactactttcaggcccacagagtcacagttgtctcctccttccctctcggcgaagtcgtgagaaacaaagacgttgtcggccgcattgcgaaatgggtagtcgagctaagccagtttgatgtccactttgtgccacgaacagccatcaagtcccaggtgctcgccgacttcgtagctgactggactatgcctgataacaaatcagacaaccaaatcgacaatgaaacgtggataatggcgttcgatggtgcactcaacagccaaggagcaggggcaggattcatcttgacatctccttccggagatcaattcaagcacgcaatccacctcaacttcagggcaaccaacaacacagccaagtacgaaggactactcgccgggataagagctgcagccgcacttggagtcaaacgactgatcgtgaaaggggactccgaactagtcgcaaaccaggtgcacaaagattataaatgctctaaccctgagttatccaagtatctcgcagaagtcaggaagctggagaaaaggttcgatgggatcgaagtccgacacgtataccgcaaggacaacatcgagccaaacgatctagcacggcgcgcgtccagacgagaaccgctcgaacccggcacttttctggacgtcctgacaaaaccatcagtaaaagaggtcagcggcgacgttaacctagacgcccccgacatcagctcggaggccacagaggcagaacgcgtcgttgccgatattgaaaccacagacgattggcgcaccccactgatcaaattcatcaacagcgatgagttgcccgaggatgacgcagaggctgagaaaataacccgtaaaacaaaaatctattgcataatcggcaacgatctatacaagaaagcgccaaacggggtacttctcaaatgcgtttcgtccgacgacggtagacacctcctcctcgatatacatgaaggcatctgtgggtcacatgccgccggtcggacgttggtcgggaatgcttttcaacaagggtttttctagccaaccgccctcaaagatgcatgcgacatagtccagcggtgtgaagcctattaatttcacagtaaacacacaaagctacccacacaagcgctccagactatccttcttacttggctgttctcgtgttgggggctagatatactcgggccattcccacgaggacagggcggctacaggttcctattcgtggcgatcgacaaattcacaaaatggatcgaggcgatacccacgggggaaatcaaggccgacaacgccatcaaatttatcaaagggatattttgcagatacggactaccacatcgcatcatcaccgacaacggctcccagttcatcagcgccgatttccaagattactgcatcgggctgggagtcaagatatgcttcgcttcggtctctcatcctcaaagcaacggacaagtcgagagggcaaacggcatagtgctacaagggatcaagacccgtgtctacgacaggctcatgtcacacgacaagaaatgggtcgaagaactcccattagtactatgggccgtacgcaccacaccgaccacgtctaacaaggaaacacccttcttcctcgtgtacggctctgaggccatgctccccagcgagctacgatatcaaagtacacgagtacagaagtattccgacgaggatcaggaggaacagggaaacgacgatgtgaatctactcgaggaatatcgcgaacgagttgcagtccgagcagccagttaccaacaggccctccgccattatcacgagaagcacatccgagcacgcatactttcgatcggcgactacgtcctccgatgggttcaaagccaagcagggcgaaacaagctctcacccaaatgggaaggaccttacacgatcacacaagtcttgtgaccaggtgcattcaagatagcagacggcgatggccgcgagttggcaaactcttagaacattgaccaactacgtaaattctatgtatgagtcaatataatccatacctgtaagacaccttacagtatcaataaagcctatttttaggcacatattacaatcacagtgttcctgcctgatgatcccttacctagatgacacctagcgttgaaacctatcctcatgtccctttacgccgtcctgacaaggcctccgaggaacctaagggatcttcggctggggacgcccagagccgataaggccttgtcggatcctgtagagacgaaagaccatgtaagacctggtcgtgtaagagttctcgccgtgcgtattaaccaagccgtgtaatcggaaaattaactttccaacttcacggctgggggctaggatcagtgctttctcaaccaaggcaggtcaaaggtccaagagccttgtcccccgagaagaatcctccgacgacaaggctgggggctagggagagtgtacgactcaaacgactgaccaaagtcgtgaactgaggaaacactcttacacactatatccagaggtacgaatactaccaagaaggccaacgccagtccatagacttgaaaaccttctccgctaacggtgccatcgacttcgccaggtggtctatctccgcaggagtcctccgagaacgagtgaacccttcatgaagaaactcgaggtgcatttgcggacaatgatctcgtatgcaagccaacacatgccctccggcatatcggctcgaccgacggcactcctgtttcagagcttcgtcaatccgcttgccgacgccttcacccgttcagccacgagatgtatccagccgccgactcctcaggttctccgcagaccactcgaagttctctgcaaactctggccatggatgtgcagcagctcttcaaatacgagttaaaccacacctcacgacctcggagcgtttccacggcctgctccttttttacttccaacatggctctctcgagttccgccacttcaaatttcgtcttccaatattggatacgacgatcttggccagcaagtgcgtcctcgaggtctgtccaacacggaaacgactacgtcagactgcttctctctctcgagaacacgactgattaaatcggaggagcgaaaagtgatgaagagaccacaaacctaaggaagtcgtcgttgtccctgtcctcgcgggcaaaatttcacccacgttgtccagcaacgcgtgtcccacagacgcaagatccggagggatcgctgacaatttaggctgcccacgctgctggacatcctcgacatcgacatctctacaaaggacaaaagttcccgaggtcaacatacaagagtaaactagaatgataattgctcgcacgaaggcggtcagaattcaagttttacacagcgtgtcttggaagtacaagaagtcctactcttcaaatagggggagaacagactcccccagatcaccgacttcttccatcaccttcttacgcgtgttgctagccgccccctgatccaagatctcacgcagatcgagttcaggacgcgacagctttacacacgcgaggacatgacacgccccggtgtagatcccgttcgacgtctcctccgcgatcctggccgcatgcttggaggggatctcccccatcgccgtcgccagttccgcaagggaggatgtcagcgagaattcgtcaggattcaccgggatggtagacttgatgccacactccccggcaagctggtgcaggccagtgtaggtgacccgcaacgagcctcggatttccgacaggttgttcccgagttccgacatacagtcctcgagcccctgtcgttgtcgctcgttgccggccaccaattccctcatcttcgtgaggtcttcacgagcttccgccaactcgcgcaccagccggtcagcacgcgcattcgccaacactacttccgacctcgcctctgcaatctcgcggccaatgccgcgagcaccagcttcgaggaggcgccccatttcgacttggagctcctcccaggtgaggacggcagcgggtggaccacgacctgccgcgggatcgctgactgggccgctaggcgttgcctcccgactctcggctacgagtacgacatccgttgagggcgcggcaggcgacgcgctggaagtccctccagacttgttttgcgcagcctttgcccgcgcctccctatggaacgaccacggatcagacaaagcttgaatggaatcacagaaacctaaaaatccatctacttacttctcgccaaccgtcacaagacattgtcgtcgtggaggcgggggagacgcgtccgaggcctgaaagacaaccaatgcgaagtaaggcaaaatccttctggcggcacgatctggcgacaggataacttaccgagggggtcgatgtcttgcgacgatgtccgcttacagaggagaacttcctcccctttgtcggaacattgtcaccactagtagtggccgcaacagcatcagacgcctccttggcgaccttctcttttagagacgctgccacctgatggtccgcgagcggcccgatgatgtcagtcagaggaagagcctacgcttaatcaagtcataaggtgatctcgaaaggaaaatgcgggatgcctatcgagtatacttacgttgatagcgtcatcacgttcagccgcccccttttcacaaaggggcacgaggatgttactcgccgttgtcggaccactgatcatcacctggccgacgcggcgctccacggtttcgctgttcagacctatgaaacgagaaccaagtttcgataaatcaaggggaacgcgaacataagcatgtcaggataaatgcgagaaagataccccgaggagaaacccgggtcgcgtcctctggtccggaatatttaaaggctggatgggcccgagcctggagcggctggatccgcctaccaacgaagtctgcaacgacttcataccccgacaagccccgtaatcggagatcgtcgatgatgtcgataaacgactgaagatagggggtcaaagggggctttgcagtccaagacgaaatcttgtccggttgttcatcgggaacaacgaagacaaggtctgaatctttgatctcaagatagaaccacatattccaccatttgctgcgagaagaagggcactggaaggggatataacgcgacttcaggccatcccgaagtcggaacccaacgcaaccagataccctgttggactccatccaacgcaactcgtagtagaagcgaaaaagatcaagaaaaggctctaccccaatgtaggcctcacaaagatgagcaaagatgttaagaaaggcgatagaattgagattcaaatgaagaagagaaagaccatagaagttcaaaaccaggagaagaaattcggaaggcggggggagaaaaccgcagagaatatagacttcgatcgcaaccatgcgacctaagacgggctggggattaatacctcttgcttccctctccatgcttccacgaccaggaagggcgccgtcttcctgaagcttcttcagcgacgcactggtggaagatgatttgccgaggtccatcgctgatcgaagatcgccggagaaagagcatatgttgctaaaactagggtttcttgtggcagcgaggaaggcgaagagcgcttacaggcggaatgttttctgcatggtgggcggacttcaagatggatccccaaaattcctttaaatagacgcactaccgacggtgcgaattccaaggaaaggagagagatggccgccggaaatttctgggtccgttacgtgcggcagtttttcagacttcagtttaaattcactcgtgaccgttgggcttcacacggtgttctcgatcatgtcctgtctctacggttcccacaccgagaacgacatcagtctcgacatcagaagtcgctattggtcgcacgagttcatttaagcagaaatcaggggctactgtcagggttacggattaggtataccccttacccttcgatatgcgccacatatcgacatggcatacccgcgcatacacggacattatctgcatgcactaaggaaattctccacagtgtttgagtcctactcggacaagacagggtcgttaatgtatcgtgtagggtccgatgtctccgagttctactggagaccacctgatctgcgatataaaagggaccccctgggaagacctaaggcatcgaatctcacagccaacaccacccccacagcctacgaagtcggagcctgcaggagccaagtcgccgggagatctagtcgaaccaactcgattacgatctcgccggtttcatcgagttccatcgttccctttgtaacctgtggttttccatcatataatcccatatcaactgaattagggctattacctattaaggggcctgaaccagtataatcctcgtcttttgtttgctcgatgtcgtattacgtagatccttgtaccaacgtaccccaataccctctatatccgttctacgggtatcacccgtcgacactcgctgaagcaacgagcgacactgtctgacagcttcttttaattagtgattaattactcaattaactaataataattagtgattaattatcataattaacgaattaataattaataattaattaaacgctaataaggataattaatcgctaatgaaatcggcatggcatggtatcgcgcattgcttcagtgagaccgaacggtctcgctctttcattccgcgagaccgcgcagtctcgcgcttttcctgcgtgataccgtctgccacgtcattcccacgtcatcttcacgtaatgtttgtgcgagaccgacggtatatttctgtaaaattttttacataccgaatatttttgagaaaaaattgaatgaacagtatattttaaaatttaaacggtctacaccatacaactgaggaagtttattgataaataggagccgatgtactcaacatcgttcatatgcttaaaaaaaaggataatccaaaataaaacaaagtcaagattacctcgtccaaagtaaatacattggttaaagtatgttaaagcgaaacatgggtaataaaagatgacccataatgaaaatctacttaagaaattatatatttacttatactgcattagattagattagcgggatcgaatgttattatccattctcggatggctcaaccggcttatttttaatgatgggcatattgcccgcgcattgcacttaattaatgaaaactatcattaatccattgttaatattattatttttatacatcatctcttgatatttgtttatataaatttattactaacttgtgaaccatttttcctcacattatcatttttctcttaaaaaaagttgtgattttaatgtgggttctgagaccccattcgtcctttttccattgtaaaaaagataatgagttggtgatggagtgaacagatttattacttaccaccgttattatatatttttttagagtacaggaaagtcaactgatcgctgccctttttagttctcaaaacaaaaaatttttaccctatcaaacgtatgaatagagtattaaatataggtaaaaaataattgtgagacaaatcttttaaatctaattgtaccatgatttggtaatgtgatgttatagtaaacatttagcaataacggattaattaggcttaataaattcgtctcgcagttttctaatggaatctgcaatttattttgttattagattttaaatatatatattcgtatattgatgtgacgacttgaaaaaaaagtcaaagtcaaaatcatgctgcggagaataaaaaaaaaatgcacgcccctatcattgcagcgatacacaacattgtcattgggggtctgatcttctctgctcatggcggcggcgctggaagcattcgcggccaagctggcgaacgtcctggtggggatggcgaaggaggaggtggagacgctcctgggcgtgcccggcgcgatcgccaagctcgagacgacgctcgccgacctgagcagcatcctggccgacgccgaccggaggcgcatccacgacccgggcgtggagcggtgggtgagggagctcaaggacgccatgtacgacgccgacgacatccttgacctcttccgcgccatggagggcggagaagaccccggctcaccgccaagagctgctccggcgccgtcggcgtgctggagcgccctctgccgccgcagccctgccgctacgcgcaagatcgggaggaagatccaggagctcaaccggagggtggaggagatcgcgaagaggagctcccgctttggatttgtctcccaagtaatccactcctcctcggcccttcgtctaaccgatagacccatgtgttcttgctcgtcagaaagcagccgcaaccgcaagacgggaccatccatcattcgatccgatgttgtcggcgacaagatagatcttcacacaaggaacctcgttgatctgctgattggcaacaagctggcggatggtcgcacgcgcgcaagatcgtcaggcgatgtcatcgccgtcgctatcaccggcgctgggggataggcaagaccacgcttgccaggatggtcttcaacgacgccgtgttggagagccacttcgacaagaaggtatggctgagcgtgaatcaggaggtcaacgaggttcacctcctgcacggcgtgatcgccgcgtttgggggaagctaccatggctgcgccggggacaaggccctgctcgaggacacgttgaagcatgccgtgaggcagaagaggttcctgctggtgatggatgacgtgtggagcgatagggtgtggagcgatctgctccgagcaccgctcggtgcttgtgctcctggaagccgagtgttggtgacgacgaggaacgacggagttgctcgtgggatgagagcccagcacctccaccgggttgagaagctggatctaggtgattcttggtcactgctaaagaagcaggtaagactatcacatagtatctatctatctattatctatctatctatctatctactatcagacagctcgaaaagaaggcaccacgttcgctgtggaggctagaaatttccacattaatcggaggaaaagaaaaaaaagaaaaagagagtccaagtagaaatacaatcgaaaaaagagctgaaattaggaattaaaaataagcaatattgaaagaaatttctatataagaacccaatacgagattaattaaaattcgaaataaaaataaaataaaatctaaaattagaaaaagaaaatgtgagtccatgtaggaatacaatataaaaaaatctgaaattcttaattaaaaataagcaatattgaaagaatttttcatataagaacccaatacgagattaatcaaaattcgaaataaaaataaaataaaattcaaaattagaaaagaaaaggagaatccaagtaggaatacaattaaaaacagctgaaattcgaaatttaaaaataaggaatattaaaagaagaatccatataagaatccaatacgagattaattaaaattcggaataaaaataaaaataaatccaaaattagcaaaagaaaataaaagaagagttcaagtaggaatacaatttaaaattagctggaattaggaattgaaaataagcaatattaaaagaagaatccatataagaacccaatacgagattaattaaaatttagaataaaaaataaaataataaccaaaattagaaaaattaaaagagagttcaagtaggaatacaattataaaacaacgaaaattgaaaataaaaaaataaaaacattaaaagaacacaatacagtattagctaattttttatgaaataaattctggaattagaaaaagaaaaataaaatttcaattaggaatacaatttttaaataactaaaatttgtgataaaaataaagactattaaaataaaagaccatctaaaacacatgacgaaataaattaagtaacatgcctataaagaagtagagtggtggtggttgatacgacatataaaaattgttaataaaacatcaaataaaatcctaatgacgattaaaaggagggacgtcaggcagaccgtgaagcaaacaagtaaggtggtggccaggacttctagaaagtaaaaaaaacatttataatcatttcgatttttaaaatctcaatgacaataaaaaggagaagcagcgggcggggtgtataagagtatagttgcagagccgccgacggttgatgggacttctagaaaataaaaaatgaattccaatgatagttatgttcaatttttagaatcacaatgacaataaagagtatgcggcggacgggctgtaaaggggcatagtggcctcgtttgatgggacttctaaaaattataaaaaataaaacaacaagttcattttttaaaggttcggaatttctaaaaagtaaaaaaaaaacaatgataatcaggttcgattttaaaatctcaatgacaataaagaaaggagatagcggacgagccatagaggagtacaatggcaaagctactgacggtttggcgggacttctaaaaagtaaaaatgaacccaaacgataattatgttcaatttttaaaatctcaatgacaataaagagaagagacagtggacgggccgtacaggagtgtaatggcaacgtttgacgggacatctagaaattataaaaatgaaactcaacgtgacaataaactctaaaaactacaaaatccaatttttaaatgttccaagaagaatggatagaaatagtggtagatcgagcaagcaaataaagaaagagatagcataagaggtagcaactggtgtgacttttcaaaactatataattagaaacacgaggatgataagttttggtctttcaaagtcttaatacaatgagatagctattaaataaattttaagtaaaatcatatttaaaaaatatatgattttgtttgggtgctagccgcgcaattgcgcgggctacccagctagttaattactaattagtactgagatgcacattactaattactccctccatctaattttaatagtcatattttattttggcatactgaccaaggataagtaattctacttatcatccatttaaacatgttatttctcgttaacaagcgattcattaatatttacatttctcgatgcccatgcagccaatcttgtgtggaagaatgaagagtcacgcattaaatctgagaaaatcattaagatgataggttgttggattgaaatatgcctattaaaaataaatttttcagatttggaaatatgactatcaaaactagatggagggagtactaattattactccctccatcccataatataagggattttgagtttttccttgcaacgtttgaccactcgtcttattcaattttttttgaaattattaattattttatttgtgacttactttattatctacagtactttaagcataacttttcgttttttatatttgcaaaaaaaaatttgaataagacgagtggtcaaatgttacaagtaaaaactaaaattcccttatattgtgggacggagggagtattagtactgggaataattgaatatagaatagaaatgtgtatctctgtactactccgtcccaaaatataagaacaccgaataggacaatttctaggattacgaatctggatatttcctagtactatgaatctggacatatagcctgtctagattcgtagtactaggaaatgtcctatccggtgttcttattgggacggaggaagtanaattagtgagatgcacattctattctatattcaattattcacagcagcacatacatgcgttggtggatggtatttctcttgctcctacaaaatgtgaggctgttactagtatttctgctcagaggaaaacaagtgtttttagcacaaattaagccgttgagaccagcggaaaacaacttgatgcaatatattttactagtactaggttttttctccctagttttgttcctctcttgctctctgatgtggcaattctccaacaggtagttctgaacgagggcgatgaatctgagattgtggactagaggacatcggattgaagatcgtagaaagatgtgatggcttgccacttgcgattaaggttgtgggtggactcttactgaacaagggcaaaacgagagatgcttgggtgaacgtctctaatcactttgcatggtcaatgacaagaagcaatgacgacatcaacaaagcggtctatctgagctacgaagagctgcctccgcatttgaaacagtgcttcgtgttctgctcacttttccctaaagatgaactgatcataagaggagtaatagtcaggatgtggattgcacaaggttacggacatgacataatgagatcgacgctacctgaagatttgggagttgaatattacaatgagttggtgtcacggaatcttctagagccatacaaacgatcctatgatctatcagcaagcacaatgcatgatgttattcgctcctttgctcaacagatagttaaagatgaaggactacttgtcaatgacagacaagatgtgcatggtattgcaggtgcttcaaagctgcgtcacttgtctgtatccaaaactgcaatagagcgggtcgctatacaaaagcaagtgtcattgaggacattgttgctctttgggagatgtataactgagttgacgtatttcaggaacaatatctcttgcctaagagtactacatttacaaggtgtagatcttgttgacctgccggactatatatgccatctcaagcatctaagatacttggggcttgcaaatacaggcatatctgcaatccctcgaggcataggaaatctaaaatttctacagttcattgaccttatggggtgtcggaattttcatcagcttcctgacagcatcttgaagctacagaatatgaggtttctcgacttcaggggcacgaggttaacctcaattcctccaggtatgggaaagctagaaaacttggtgaacatgttggggttcccaacttatttggatgacaggggacatgcctggagcagcttggaagaactacggtctttgtcgaacctaaaatggcttgatttaagaggtctagagcttgcatcttcaggctctatggctgctacagcaatgctcaacagtaaaaagcacttgaaaatcttagacttgacatttgccagtaggctcaccgac

SEQ ID NO: 47394 - DNA, 7339 bp, Oryza sativa
aatgcgccgcacctgatctccgtagagaacttcccgtcacttgtggagctcacgtcagctgacaacccgaagctgcagaggatctcccacagtccaagactgcgacatatcgtcgttatcagatgcccagggctgaaggtagtgaaggatttgcaatcacttaggagcgtcatttggaaggatttggatgctgatgccctcccagagtacctacgagagacagagctaaataagctggacgtgtactgcagtctaagattgcttaaactcatatccttgcaagatggcagctatgagtgggaaaagatccagcacgtccagctactgaaggcatatgggaagagatcaacggaggataaggttgaccggcacatcttctacactaaggatccgtactcgtttgaagcagatatgggcgaagatctatgatcagtggtgggccaggatctcttcaagcctagtagggcttaaacataaaggctaaaactatccatgtctactcactagtggatccatcgccgggcggccgccctggctcaccggtacgcagatgatctattataattctatgtaattaaaaatacagaatttagtggaaattttaactccacaacgcattatcctttagcattcaataccatagttttcaaccataggttattcttagcatcagtgtactcctatccaaccaattgtgccttttcaaccataaaattgcatgcacaaccagttgtgccctcctctaacaacatccctaatttttagatctaattcattcaattggtgtgagaaacctagagcccataacaaagacattcgaaccaagcacaatacaacaaattattttgctaattactaatatactagctctggctcctactatttatagggtgaattcattgtaccgaacttgacaaaacgattgcaatgctctgcttatcttcgtccagtaatccattagactaaaacaaactaaaatccagattagcaaaatcctaatcgactcaatattacacagtgcaaggtgaagaactgaagacctgacctagagttggggaatcagaagtttggagcatttccagattagctgggcatgaacagcgaaagagaggacagcacctgaggttggagtggacttactagactggagttaaatgattttaaaggactgctcgtcttttctaatagactaactgctaccaaatgcaaaataaggatgcagattgaagaatagagagaagactgacctggactgggttgagtgcacaccgtagcctaaaggatgcggtaccacaagtgtatgcaaactataaataaaaataacaaagaacagaaccttcaagtataaatggccatatggcccgaggtccgacggcctgacccaaggcccggtgatttggcccgtcccaggcacaacacggttcgactcgggagtcgggttgtacccatgctggcccggcccgatagctgtgctgtgcctgggctactacctcggcaagctgggccagcacggtccagcacgaagttcagggatgcgaaagagacttattttcaatctatgtaacagacgacacaaagaataaggagtattatttatttacttattttgtaaaattgcaaagcaagtcacaaacggtgtttacagaaccgattgaaaccaaacatggactacataaaccactcaatttttcggtcaagttgatttttatttttttacaagatttgttaggattttatcggtttaatagatggtttcccataaaatccgaagataccgctggggagcagttttgatccaatatcaatattgtgaaccctgatcgtgaatttcacttcgtgtgttcaaaatatatcaatgtgtgccatgtgggttgtttaattagatgttatgctggtctttttcacaaacatggccacacatgatccataaaatatgccaacagtatcaaattttgaacattaaattccacagctgcctcgtgaccttgccgccgtcaccatcgccaccatcgccgagacccgccacaccctaccggaagtagccgcagccaccgccaccaaagaagagagccatggccagtagccaccagcctagctccgtcatggtccctaaatttgaaaatatactgttcattcactttttttcaggaatattcgggatgcaaaaacttgtgtagaaatatgccatcggtgtcgcacttcagttgcgcaaaaatgacgtggggatgacgtcgcggacggtatcgcgcggcgaaagcgtgagaccgcacggtctcgtgcggcaacagcgcgagaccgtctcgtgggatggaagagcgagaccgaacggtctcgcagaagccatcagcgatattgtccaatgggatccatttgattagtgattaagtaattaattaacaattaactaataataattagtgattaattatcataattaaccgctaattaaatcggcaaggcacggtatcgctgtttgcttgagcgagaccgtgcggtctcgcattttcattgtgcgataccggtcgcgacgttattttcatgtcattttcgcgcaattgttgtgcgaaaccgatggtatatttttgtaaaagattttgcatcccgaatatttctagcaaaaaattgaataaacagtatagtttcaaatttaattcggtcccctccctcatctctctttttcttccccacaacagcagcctcctcattgccactgccacatctgccattcgagctcgggagaagagggcaatagaggatgagagaagatatgacacgtgggcccaaccactttttaatcctttgctcttgaaattttgcatggtagtacaaggtacttccctgcttgtggtagtattttcaaaatctcgtagaacttgtacacacagttttgtggagtgaaaatccatgatttcaccaaattacaacttcctccatttcatattataagttgctttgattttttcctagttaaactttttaaagtttgatcaagtttatagaaatatctaacatctataacatcaaattagtttaactaaaacaaacatttaatatatattgataatatgattgttttgtgtttaaaatgtttatatttttgtcaaacttaaaaaaaaatcgaccatttcagttaaagcatatgaaacggagggagtagctgccatccattcctttgtcatatccaatgctgtcagacgacagcagtgcagggaacgctgggcacaatttcctcgtagcatcagatagaacaagagtgaaaaaacaacatatttgctcattggtccggtcgtactccctctgtcctaaaaaatgataaacctgaatttccgtgtctaacgtttaactgttcatcttatatgaaatttttttataattagtattttcattattgttagatgataaaacatgataatactttatgtgacttgtctttctaatttttttcataatttttttaaataagacggacggttaaacgttggacacggaaacccaatatttgtctttttttgagacggagggagtaactcgtaagggtcccatcaaatcatatataaattggttcgcggccacttattatgtcaaacagcgaatgtgcactctatagggcatgtaagcatattggtatactgtatttcataactcgaaattaacgagaataagcagcctgtagagcatttgccttttcggatgcgactgaagcatctgcagctctgccatgcaatgagtatgccttctcctggtagagagaaaacaactaaatcctattagaaatacaatggaaatatgtgtacctcactagtgtcttctgtatgattacggattaccaagcaacaactgaattggcttgacctttttaaagccacaaaccctgagggtagttgtattcagaatagggcctgggatgaatatcagaatggtactaattggtctggccgataaaataagtttgcaagaagtccaaggttaggccaagattgcaccgaaggtcattccttagttcacatgttacatttggcatggagatatcagttgatgtgttgatactagacagaaacacgtattaatctcaaatgccttgtagcattctgcttatatgcaaagatgaatgccagcagtctctacagatgatacaaagttgacgcaaatatttctattttgcctatagcacagccaccaacttatctgaaagtactagtagattgttgtcaaaatgctatgttcaggcaaccatcgatctatagcaaccaacattacgtgtcatgacaagatattttaaagattattggagttaatgtttcggatctttaacaagtcagttaagaaacattagcgagaagaaaatgcaaaatggataaatagtaaatacttaccagcaagcgccacaagaagggtgcaccctctcgtttcctaatttgtttctcgagcacctcaattgctgtgtacaatccaaattgcattagctccttaaggagcgacaaaacagtaatttagttttctaatgatgaagaacaaataggcaaatacctctggaactctctccggtatttattagcacagtgtaccaaacttcattgaagacatccacttgctcatctgatgccccaatcatctacttgtacgtatgttgatgttcagtaaaagaaaacaaatacgataactacttgtcttgaacgaaaacaggtttgttaatcatactttacaactgagtgcatcgaaatctggacccaagatgtcaaagactttcttgtgctctccttttccatattcatacacagcctctgctagctgtgccaaggaaagaattaaataacagcaaaaatatagtatcttttatagaataaatatgcaattttatctttcaaaatactcctcaacagtacagtaggcatgcatgtaaaaagttaaataaattacaaactaatagctacaggaaagcaaacatatcttaaaattagttagcaggtaatagtaatgccacaaaaacatacaatgtaatgatattgaggcatcagaagtgaatggtgttcatttttcagaaacactagacaaatgatagtccacacttttcattgtgcatgagttatatattgcttgtgtcttggtacttaatcttgcaaacagaattcagcatacctggattgccttttgcatcacttgctgtttttttgtgtccatcgaactaactctgcaaggttaatgggttattctagcattattgactagtattaatagcagagtcttgtgttccctgaagaaaagtttaatgtatctgaccttgacctaagtgattccaacaagttgtctgctcttgtaatctcacccatacttgacagtgcccataatacaagtagatcaaggagccattccacatgccatattttctgaacaaagtacaaagttcaaatcgaaatagtcagaaaaatgagtcctgcacagctttagttcagacctgtaaaatgctcttggcagtcagcagtatacagcttacttaaatctgaacagtttttatgaatatatttgaaattattgaagcttaaatctgaacagtttttacgaatatatttgaaattattgaagctgagacagtacctcattcgtaagtgcatctagcaatgctgccaatctatctttggccagatcaacctgaccacgaatatgcaaacggagtagcagccctagtgcattaaggtacacctgatgcatgagaaattactcagtgtctctaaaacattgatgtacaggaaaaatggccagcattaatacctctgctgcctcacaatcacttttctcaagctctgtcatgaagttatgatcgtatatctccagaactttacttgtagggaattcaccttccaagtaacaaacagcaacatgccaccagttgtgggttagcctacagaaagaagaaaatgattttgtaagaactatttctgtggttattagttattactagcatcaaacgagagagcatcatgtggaaaattgtatacataaacgatgagcatgctgcccatgatggagaacacgatttcatgaactcagtagcttctttgaaatggcattcctgctggaaaacatggcacagctgcaagatggaatggcagatgaagcttgtattaaagaagtttgtcggtagaatatgaacgattaggtataaatgcataacacaatctgttatgccgataaacttcttaaaataacaaaattatgtcaaaaccacccgcatacattatgctgtgaccagcagtcgttcttgtttatggccaagcctttccgagcagctttttcagcgtcatccatccttccaagttctagtaatgggaaagcaagcatgccgtaaatgtagttctggtcttgattctctggcaaaacctgatcaagaatgagtacaacaaagctaatgaaaagaatagtacctagaactatggtacattgataagaggaagtgttttgaagcacatccagaaaatcctgcattcttctattccacacacacgcgcatgcacacaaaatcccagcactaaaagtgatgcttttttgatcaactgttgtaaaatattttatttttatccaaagttttgaagtgatgattcaataaagttgctaccatgggtgttcctttaaataataacaaacagtgttagattcaacttcggtttcattagttatatacgatatttccactttgtaagcatataaacatacacgagcctttgtagtgaacttacctgttcaacaaatttgagcgatgtatcagggcgtcccatgtagaagcagatgagctgagctctctttagagacatgagatccctggggaattccttcagcaactgccacatgtaaagcacacaccaccaatcaattcttgccattaatcaatttatccagcagcacatactctcaatttacaaaaaatggagacaagctacccccaaacctcgaagtgccgctcgatcgccacctgctcgtccctctcctccccgatcagcgccgacagcgcgcggaacaccgccctctcgtactccgtcgctgcaccctggtggaagtttagagcaacacgaaagcgcaagctcaccgagtaaatggaggattcgaggaggggggaaaaaattaaggcggcgagcgacaacgtgaggggcgacgacgcttacgaggttgtcggcggcggcggcgaggaaggcggcggcccgggcggggtcccgcggggcgacgtggtgcgcggcgagggaggaggcgagcgcgcaccgcgggtcggcggcggcggcgcggagcacggcgtggccacggccccggccgaagctcatggtgtgcgcgtagtgctcgtccagcgccgccg

SEQ ID NO: 47395 - DNA, 4294 bp, Oryza sativa
gcgctctcgccgtcgccgtcgccgtcgccgtcgccgtcgcgtcggctgggcggtgggtgggagtgggagagcgggacacgcacgggtgcgagttgtgtttagctgccacggcgacgacgtgggccccacgctggcctcccgggtttctagggtgaggtcactgacatgtggggacaggtaatgctggagcccacgtgtcagtgactgttaggcaggcgggggtagtccgcgtgagaagcgtagatgccgcaagcgtggggagaagaagacgacgaggacgaggtgaggtggattagtttggagcgacctgattgggttggaattggattagtgtgtgtgctaatcttatcttaaaacaacctgcagctggctttactttcgaatatgctaaacaaaaccgatttaaaaaatttattggatacataccactacgatgtgaatattagagaatgagctaatatcaaatgattatacgagtgaggcttcgaattcaagtcggctagctcatcatcatgtggagctagctgaaacacctctagacgttttctcgatacataccattactatttaaaaaaatataattacaattcatatattcgtatccatgctatacgaatacgtacaaaataacaaccatgctatcgacgttacgttttctatcatatagaccaaaatacgctagacgtgagacccgcatgtcagttccatcttctttctctatccatcactcttctttcttcatatctctctccacctcgctgaaccaaaagtgtcaggaggcgagtaggacacgatgagggaggcgaatggagaagtggtgtccaacgcaccggtgaagcgttggtactattcaccttggttcgagaaggaaggaggaaactcgatgtgcccccactcgagctcgccgctaagctgccacccgtcccaagctcctcccaatggccccgcttgctcccggtgccgaagaagacggttctcgccagatctaggttgacaccctcctcgtcttcacaagttccactcgtcctcatcgtgtcgtcgtcttcacgactgccggtgggaggatgagagacccaagcccggcgccggagatttggcgactcaagaccgtttccttggggctaccatcaaaattggcggacagagctatgtgcatgaggcacctagtatcgcctgagttggcaagcactatcgtcatctgctccacaggagagagagagaggttggagatgtgggggtggcgatggaggttggcaccgttgccgtggcagaccaacatgaggggaagggagagaggggagaagaagaaaaaagaattgggaagaagatggaaaatgtgaccataattggctttatgtatttagatggtatggatcatggtaacaaagtttttgggtcgatgagaggttggagatgtggggtggcgatgaaggttggcatcgctgtcgtggctgagcaacatgaggggaagggagagaggggagaagaaggaaaaaaaaggggaagaagatggaaaatgtgaccataattggttttatgtatttggatggtatggattatagtaacaaagtttctaggtcgatgggatcgaggaactggactgaggaacgtggtacgctatttgtgagagggttttataaggtgggacgaaaataaccccgtgtttccgtgacggcctgacgggtataacgttcttgggtcgaggaacgctaccactgattccgttttacgtgactatggtgtggactcgaatagaatattttctaaaattacattattaaattcaaaaaattgaaaccaaatcaaccaaaatatgcactggcgagatgtgaaaacgtctcagtgtgatgcagcgaccaggaaatctagcgcggcaggttacgtccatctcacccgttcatcttccgatcggacggcccacgctccacggacgcgacggttggagccacttcaactgctctttcatctctccccgattttgtttcttcctcgacctgctctgcttctcctccgcacccaaaaatatcaaagaactcaaaagcggagagaggcgaagaacaggggggacgccatgaacgtggaggaggaggtggggaagctcaaggaggagatccagaggctcggccagaagcagcccgatggatcctacaaggtaaatcacttttttctcatctcctctcctctcctccgaaacgagcaccagatctggcgcctgcagcaagggccccgcattttcggtgatccctcgagttagaattgctttcctcttcgcgattcatacgccattgtgcagcttgggtgtcatcgtgtgcgcttttccaatctcaccgacatgagattcctccagaaatcatggcctggtctatttgtgtccattgcccaaaaaaaatggatttctaggtgaccattattggtaatgctggtatgtgtctctatggaaaattggcgatgcattgttcagaggaagagagcttttatctgctggtgtgtacattgaagatccctagttagtgcgtagctggtcatgaaacaaaatagagggatcagtgatgctattgatgatcttgaattcgtgattgaaaattttgagcttgatttggtattttgtaatgttcatatgcccccaagcctgtgaaattgcattttatatgttagatatcgtttgttgtatatgtccaacgtcctagtgacgagaaagatgcccactgtgactgtcaggcagttgaaagaaatgggaaacaataaaggaccaacaagtaagaactagaattgtgtatatattttttttcccagaattcttgatgtatatgcttcttgaaaaaaagaacactacatgtgcattctattttattttctgccatcattgttccattacgacatatactcatgtaaatgtataatcatatcatacaacaagtatgtggtgatgccattatccgtcttttcttctgatgcagcctacaatttccaatcatcatctcatattgtaattttgaatcacaaattttgtttcttagttgtgtgttctataaacagtgtgatgaccaactggtccttatcattttgatcagactttcattttcctctttggtggttacagcttttaccttgttaattgtctcattccttctctttttcctctttatttttatgttaggtacaaccaacgaaagctttgcaagtgatagttttgaccatttttaggcactttactcccttgagtacttcctaattattctcccattttctccaagctctttttccattgaatcgacaactccagctatccctggcattcgtctacctatatacgcaagatgtgttgctttgtcaatttatcctatgagttaaatatatcctactcctccctgttaattgttctgttcttcatcaaaacaattcctgtcaatttcacttgaaaaaaacattttttttctatatcttcatggacaggacttattccttgatccagactcatgtatgatggtttttgtattaatttttaatcattatacgctacattacaattaatttttgatacactgtataacactcacttttggattcagtcgtaaatgttaattgttcaaggcattatgaatgtgtgaagcagggttcaatttgaacagatgggtatcatagttcagggattgtttctattttttctgaatcatccaagttaaacaatttatgaaatactagcctggttttgcatgattcacatactgaaatagcatagggtaatgcaacaaataacaatcaaaactagtaaaagaaatggctgattttttagtaagttcctatccgagttgctgaccatcacatctgtaggagtaggagcagcagagcgcataaacttaaccttggaaacgtttttggcatagctatcctacgccttatgaatttctgaattactgagcttatgcaaatcatactggttcaccttacttaaatattgtgatctgcaggtaactttcggtgttatcttcaacgatgaccgttgtgcaaacatatttgaagcactagtcggcaccttgcgggctgccaagaagagaaaaattgttaagtatgatggtgagctgcttctacagggggctcatgacaatgttgagataaccctgttgcctcctccagcggtcgctgctgcctgaagagggaagcatctgcgagcctctggtgttaaggcgttgatatgcatataatctattgtgtctagattctcatgaaccatttgatattcgaagcggatgcctatcgcgtgatgtatgaactatgggtatgcagtttcttggac

SEQ ID NO: 47396 - DNA, 2376 bp, Oryza sativa
tgtttggatccttgagggctaattcagagctaaaaggtgggggctaataattagctcatggaaccaaacaggaccctagaatgaacatggcgagaatgaagtgtagattccttgaatgcagaagaatacaaattacagcaatggagaataataaactggtaaaaggcaaatgatgggagcgggagcatttgtgaattgggaaagccatccaaaataacatactatatgctagcattggagagtccatcttgtgtctcacgcgatctccatttcttagatccttgaagagtgtgaggataggaagcatcaggaaaaagaaatctccattgctattgcttggtgggtgtagcagcaacaagcctacattgggcagtaaccatggttctagaaattaattgatcatttccattttccaccatggttctttagtcagcttgctgtgcatctacattgggcagtaaccatttacattagcaagcaattacagcgcctacttctactctgctactataatcctgagtaagacaacataattgtctaggactgacatcgataatggcctcttcattgttctcacgttatcactactagtatgaaaaaaaaggagctagcatgaagaaaatcgctattgcacatctgtgaggatctttataacaccgacctttcactactcatcttcctaacattagtgtatgaaaattggcgtaaaccgttgagactagccactagcgtctgtcacttccgttcttcctctttagtccaaatgggaataggaggtatcaggataagcgtagccaaaccgttcttccaataaagtaagcagtgcttatgatattagtccttatctctgaaaatcttgtgtttcttgctgtaacaaataactaaggctgaactttagcaagctggttcaataccctctttcatagagttacattacttatatataatgtcttttcaggtgtgcgagataaactagaagaacaaacatggggagaatggagtgttgcggctcttctacctatgaggattgaagttatgtgactcctcgcatcttgaagaagaacggcacggatacacttccctgcagctaaagatcattttccgcttacataggtttgcaaggtccttcagccctacgtaggttttgtgtgtcagatgatcaatgacagattgacacacaccaacctgatcttcattgctgcatcgatcttcaaatattcggtgcataattatctagatgtatagaatagatgaagaaccagcaaaagatagaaagacaaaagatgaaaggaaataaaatgtttttgcttctgtgaaagccatccgattaatatatacgctagcattggagagcccatcttgtttggtcatgagatgtccatttctcagctatctcttagagcgcgaggatgttaagcatcaggagaaagagattgagagatcgaaatgataagtaagagaaataccgtgttttttttactctcagaaatccattatatctgaaaacaaacttttttatgaacaaagtagagaccaacttcagaattgtacatccttagaataagttatctctgtgcatccacattttcagggatatgaaagaaacagagtaaaacgtacccacgaagtgagattgaagtaatgctctgtaggacagagatggttaatgttacccattctctccattttttttcccatcaacgaatgcttattatgagaataagcatgtaactggactgccaatggacttccgctggatgtagcaaggctgtgattctgtttagacttagttcttatcccctaatacaatgacgatatattgttctttctcaatttgctgtgcaagtgtgcatgcagggttttcaatttcgatttgtcgaaaatttcggtaagaccaaaatttatgaaatttcgtgattttcggtactttttggactgatttttttttgaaattctaacaaatttttactggagttgaataaactttgaccaaattcaacaaaaaattgataaaatacgaaaatttcagttaatatattgattaccaaaatttcagaaattttgaactaaaattgcaattccctgtgtgcgtgtagattcgatatttacatcaacaaaaatcatagcacctacttctaccctgctcctactatcatcctgagtaatataacctagtactacttgtctatgagactgacatctataagggcctcctcttggagtaatgcaaatgaaaaaaaatggagcaatcatgaggaaagtaactggatgacatctatcagggtttatttttatagcacctaccacttgtaactactccatcttcctacgcatgtttgtcacataaacctccaaatgcataatgcagggaatggt

SEQ ID NO: 47397 - DNA, 23567 bp, Oryza sativa
gatgtcgctttgatttttttacttgcaacgtttgatcattcgttttatttgaaaaattagtgcaaatataaaaaatgataagtcatatttaaagtacttttaataataaaacaagtcacaaacaaaataaataataattctaaaattttttgaataagatgaatgatcgaacattacaaacaaaaaactcaaagcgataagtaatatgggacggaggtagtataagagtaacttaaatatttaagaagtaaacttaatcagtagcaaattaatcgacctgctattaattaatgttggtatttatgttaatttccagagtaggatctacggctcaaattaaagccataaatcaagtactttacaaatctaaattgaaattagctcaaataattgcagttacaagcttttgtacaattcacctatgttctcaataaaacaagtcagaattaattaacaagggctaaaacaatcgaactaaattataaagaagaaacatatcatttttaaagaaacacagttttaaagacattgagtaagtaaattaacctactcatacagatagggtgtatgtgtgtatgttcaaaggggtggttgtacgcgagttgtggacgcatacgtctatacagtggtggatccactgttggggcttgtcagtgcgcaagtcccagctccatgatccccttcctctaattagcaactaatgactctattagcatttagtgtaaatccagtagtatgacaaggaaagctagctcaagcactcaatgtccaaattaaattgcaatgtcaaatatgttataagtataccatatcaatttcttgatacatttgtgtgtatatattaatatagctgcaaattaaaatggagaaagcaatgggttgtcttttgatcatatgggtttgggtttcatcgaaaatacttagttgatatatcctagtttgtttcagtcacattgcccatatttatacaaagccctccctcaatttatatctagattcgccactgtgtctatactgtgtttttcttaaaaaaaagacgtggagtaaataatcatacttaaaaacaaggcgagatgagatgacaaaagatgagagagagagtaaaaatcaccactttggcttgtatatatcccggccgccgcttgctgctttcttctagtcttctccaattattcgcccatctctctctctcttcttcctcctctcctccatgaaagctagggaaattaactaagggcagtggtgcaccacaagttggtgaagctgccagcatgatctgatgatgatgatgatccacctctctcatctgtgttcttgattaattacggatcaatcgatcaggtcatgctgtagtttcatctgctggttgggagcacagcaaaaaaaaaccctaactttgtagccggatttgcatggattaatctgctaggtagctcatcagattctttgagagtctgccttgctcttctgcagatgaagacgtaatctttgaacagatgggattctcaactctcaaggtgaggtagtcatcaatccaatccatatacctgctcaaattcagttttaattaaagactagctgcttctatggagttaattagggatccttttttatagatctctcttgatctgtttcttagtctgttctttcttaataaggcatatatacctcttggatttggattttcttgaaaattaaggtagtttatgagttggatgtgttgtgttatctgcccagccttaatttaactgtgcttcctaaaaattcgtttgatttgatggtagcatctgaattgtgaactcatctttggagcttggactttagaccaggtgccttaattccttaacataagatttggtccatattgtttatggagcttcttatcaagaaatactcttttgattagggagtccccttgtcactttcttcagttgtgcaggtacatatgacatatctgtattaaactgatgacattcataaccaactgtccaagtagggattcatatctttctactaattgcagaatgttttcttggctgaaggaagtttaatctaactgttcaagttagttgcttggttagctgatagtgatccctgtgttttctagttgttgatactgcatatacatatatctgtgacatatggctagttcttgtttgttgtgtgtagataagatacatacaagattctgatctctgcagcaaaagaaacaaagcttccttttttctcttgttttatcccctaatatatctcttcttttgcagttctagctagcaatttcactgtaaaacatgtgtattaccgatcaatactggcatatatctgaacttgatgcaatacatgtgtattactgatcaatacataaaactgaaaatgtggaacatatctgctaattattttcatgagtgtggctttgattattgtgatcttgccacttgccagcaatgatgttagctagtgatgggaatatcacctgaccaaaggagggacatgattaaccttgctaattaagtaacaagaaaaggaggagggggcaaaagaattatggaatgggttttcttgacctgaagacaagtagtaagatttgctaatgcttgcttgcaagatatgcatgcctaaccacaaaacaaggagtttggcactacaaaactgaatgatgattgcctcttgcttgaaggatgaaactgctgcccatcttttgatcatggcacccccttcgcatatgcatgattgcccacacttttctcctcttttgggctctgtactatggagatattcaagccattttcttgagattttctctgcaatgtaatgacctgttctgtcccttgatgtttcacttgcaaaggagactgtactacagcatctctctctctagtctctacctctcttgatgtttcacttgcaaaggagattgtactacaccaccatctctctctaccaatctctctctctctctctctaattagttgcaagttttgttggcatctctaaccacctctccacactcatggtcatggccatggctagcacatttgtcacctagcttgcattgcatggtcctttggaagattcatgggccacacacacatggtgacattcatgcaaagctccaagcaggtctcctttattgtgatttggtcagctagctggtttgttacaagatgcccacaacctttgtcctttcaattcaatgcagtgtgcagtgtgtgcctgcaactttcatatacatgttgtaccatcatgtgtcctcttcctggcttgcaaaaatgtaatggctaatcacatccatcatgcttgcaaattaagctaattaattaatcacaggtggctagctaattaccaactgatgatgatgattagtgacaggcaaagatgataatctagatatcttgttcttctcactactgtcttgtcattgttggcgtggagtgcaatgctgccgtttgtgtggctccagaaaggttgccggctttgctgcccttctctccatgttcttgtctgaatcctgaacattttaacaaccgtgtctttttctcttcttccttttcctctttgctgacaagttgatggttttgagatatctattgttctgcttgtttttgtttttgcatgtgaagtcatattcagatggtttgcaaggattagaagtcatgggtgtactgtgtgcaaattgaacttgtcaggaacagtgactgaattttattgttcaggctttgcttgtctgaactcaagaagaggtagagctagggtgttattttttttatctgatttatgtgatacataatcaactaccattcgtttgacagaacaagattgataggtgcatgttcagagaagttccttcaggttaatttcttatcagcttaagattttcctccttttttctctctagtagctaaagtacacttgcatgtacaatatattcaaccggaacttacacagaagagctaatttaacttatagtatatgcaaattgttcttgtttttctcatacctgcatcagatattcagattagtgatacgagtaatgggcctgttcggctgctttgtaccgccgctgccctgccacagctggagaaacaatataccatgcttgttggctgcacccgaatagagccaatacactcagaataagttcactttaggtccctcaatttgtcacccagtctgatttgcattctcagtccagaaaaacggatacaacgcatccctcaacttacaaaaccgtgcagaaaaggtctctgggcagtattgtgcccggttttggatgatgtgctccctttgattaggtcctcgcccacgtggcattgacgtggtgcttatgtggtaattggatcccggaaaaataataaaaaatagtgggacccacatgtcagctacacaaaaataataagaaaaggtggggcccatgtggtcccacatgtcagccccctcttctctctacccccctctctctcccctacagaacagcgagcagtggcgcagaggggggaggtgggcggagcggcgcgcggcagcgggcaaggagggaggcggtgcgcggctaccgggaaaggagggagggctccgacccggatgtgaccatcgaggacgtcggcggcagcggccgggcgaggagaagccgcgggcggcggtcgggcgaggagggagggggcctgcggcggccgggcgaggagggaagcggcgctcgacgaccgggcgaggagggcggcgccgttctgttgggcatcgcgggcggagcggccgacggcgtggagctaccgcgctcgcgggcgacctcttttctgcctcttccacctccggccacctccgccgcccgcggcctgctgtcgctccgccagcgacctcttcctttgcctcttcctcctccggccacctccactgttgctccgcccgcggcctgccactgccgccacccctgccgctctgtccgccggcattctcatgccgccgctccgccgcgaggacgagggtgagccgagaggaagaggagggagagccgagatggacttgtggggcccacgtgggccccaccatctcttatttttagctgacatgtgggcccacatgggtcccaccatcttttaattaatttatgtgtgagcctgacatgtgggtcccacgaagtttactatttttccgaatcgaattatcatgtaagcaccaggtcaatgccacatcagatgaagaccaagtcaaatttgtcacgtaggcgtcatattagccaaaatcgccgtcaaaaccaccgagggacctcgtctgcactggttttgacagttgaggcacccgttgtatctggttttccgattgaagcatgaaaatcggattcgttgacaagttaagggacctcatatgaacttgttccaatacactccggctgatgaggaatgcatgtttcttttggcccaatcaggtactgttctaatggaggaccaatcagcccacatatgtaaatgggccgagcccatggtgctaagctctcaatctatttgggcttattttagcccaacctaactatctgggccatctctaaaaacaatactctgaaaaggccttctcgccattttttcttcagaaatcctcaacacagattctcaggccagttcagacttcacaaaagcatgtactccagaattaggattcctgcattctcagcaaaaccagttgctatgaactagtggattatcctatgttcagctaattaattcagttatctccaactagtttctgtcagggttagtaggagaacagaaacaccctttctgaagaactgaagaatggcatcacattagttcagccagcttgcaacttttctaaagcacttgggattaatacaataatctgtacttgaagcagtcgacggatggagccttcaatctgtacttgaagcagtcgccaccgccgtctcccgagcacagtgatgctcccaagttccaacatatactccacatggttgattcttttcttcccaaatctgaaggagaaaacaacattggcaattatgtgtgacaattattggagcgtacaaatgaatagattaactactatgaatttgaaaattatattgaaatcaatattataagaaattcatatactgaaagtttttacaaaaatcacaccactaatcgattcatcagaaaagatcagggccagactcacacacccagatcactgtctgtcttccaaaaccagctgtcctacccttgatttttcttcggattcaaagaaaatgatgttaacgaatggaaagagttgaaacaaatactaaagttctgctgctgatgctactccaacacctgctacagtagtactgcctactccatatgaagatgctgatgcttttgctttgcaggacgactcggcatccaatccaatcacgtttatcaaaagaagctgcagggccctgtagttgtagtactagtactagcatctcctgatctgatcatctgaattgacctgcctgaattgacctgtcccaattcttttcttattattactcctacttgattcttttcttactctattataattaatactgaaaagaaactcatgtgtttttcctttccttcttgtcgttttggctccaatctttgttcttccttgaagaggatgatgaatagttgtaggtttcagcaacagcaatgtggtgtttagtttcattttcttcttttcatgtttgttcagagaaaggatctcaaggcaggagcaagttttgtgatcttgcagcctttctctaaagagatgagatgagctctcacttttactttaccgtttgcttgctgcctaaaccccactgtcaaagcctgagattgcattagattcggcattatatatatgcagatgtaaacatgaagaagaaaagtgaggtttgagatgatctttagtcaccaatctcgagcaccgaaaagcatttcacagtttcacatcattccatgtctgaacattctgaatacctcctttttatacaagtttaagtaaaaaaagaagatcaaatgttaagcttatctgaacttaaaatgttccacaatccatacacaccgtgtttagagcgaatgaatttcatatgaaacaattcaattcccgtattagaaatgggaccctcattgttaagtaccacttctatacgatcttaagtttaaaaaaaagatcgagtttaaagtttacccaaacttgaaatgctccacacttaatgcacgccgcattcaggggcatgcatgaatttcacaggaaacagttcaattcccgcattataaacgggacctcatcgttattatagcactacagttttgcatgattgcatcatttgaaacataaattcctctcactcaccaagacagcaacagccatcaatgcccagagcctgaactgcaaatgcagctaagctaattaggattcaagaattgtgtggtccttgcaaaaccaaactgtcctacatccatataagctggtcctggaacaattcctccttgcttcgtccatatctacagttggagaggggagaacaagtgaacaaccctagctaatacattctcaccctgctatatgcaaatgcaattgcaaacaaagcaatcatcattaagggacccagcaattcaaagggggcaacaaactatttggtgtatgtagaatctatggattgataggcaagaggggtagatgatgttaaggtggcaaatggttaattggttagccaacttttgctttcaggctgcagtcaaagattctttagcctacaacaattctgttgtgacctgtgacttgtgagtactgagtagtagtaccaggtacactctattgttctttcttgttcttatatactgaaaaaaattacaagtagacataaacagattattggtaatgacaataaaagcataaggagaacattcaagtaagttcactggctgacaaatgcaacggtaatacttcatccatttcaaattacttgttgttttagctttttttctaaatcaaacatttgaatcttcaatcatcaattttcgtatacaccgaaagatttatgttttagattcactataagaaatactttcacaatatataatctatatgttaataaagtacacaatttttttaaaattaatagtcaaagataaaggtgtttcagtaaaaaaaaaaaagatgataaaagtatttgacttaggtcaatggagggagtagctaagtttaccacggttatcggctttatcaaggtaatacaaatcgagaaaccgctcgggaaaccagccaagttagagaaaagaaaaccgaaagtccaattttcagcaaatttgtttgaattctaccccctttttttttgttagtaatcgaagtgaaaccacggttaccggaagagcaaaagcacttaagaagttatgattccctgcagacaccacatattacaaatgcagatgatgcttgtctgtctgtattttcattgcccaaaccccctcaagttaaatcagagacaactgaaaagagaagatacaaaacaacacttcttacatgacacataaaaccaaaaaagaaaagagaaatcaacaccacacacatctacaaaccatctctgaatcttgttcagttttctgctcctaatgacagcaacagtgaagagtgacatgatcacaacagcttttgcaggcaatgccggcgacggcggcggcgttcggtcaggcgaagcgcttgcgacggccatcgatggtggcgaggaggcgggcgacgcccttggtccacatgtcatgctctctctggctgccgcactcgaactcgatcacccggtgctccgcggtgcggagcccgaagtaccgccggtgctcgccgccctctagcaggtgcctccccggccacgccgccacgtccctgcacacgtccaccaccacatctgccgccaccgccaccgcgacaaaaccccgccattgttagagacaaaggcatacacccctccgttcttaaaaatatatatatataaaaatcaacttctggaaacgaatctggacaagcgcttactcttcttcttcttggtgagcgtgcccgcgacgtgccggctcttcatcttgagcatcacctgcaacaatggcgaaccgcaacttgggatcagtaaaccttttttttcgccaacaaatttgatacatctaagaacacaatttggcatatgttggttatggatttaccactcccgtccgatggatgtagaccgagaccaccttccaatgcaaagctcctgcacatgatcatcgagtttgattgattaacatcatcgaatcgaattagtggatgatcaatggtgattgggtaggtaggtttgttacctttgcgagtgcgcttgaggagctcggtgccacgggcgaggagctcttggctgcagatggtgaggaagttgttgtcgtcgtcgtcgtcgtcgtcgacggcggcgacctcgtcgctgaagctgctgctcgtgttgctgccgttgccatggtggcggtggtgatgctgctgcttctgggcgttgtgtttgtggtggccaccgccggtggtggcggcggcgatggcgttcttctcgacggggatcaccgcggccacgttccacacgtccttgagcgccctcgccttgagcgtcgcggcgcctcgcaacgctgcaatgcaatgtagagagatggcgtgatcagtcacggtggctcgccggagacgatgaggatgggggtggaacgcgaaccggtggcggcggcggcggtgatggtgacgatgtcgccgggtgtgcggacgttgacggcggaggcgatggcggcggcgaggtggtcgcgctcggcgccgagggactcggcagcctcgacgcactgggcggcgaccagcgtcgccgcggacgccacggccatgtcggtgcgcgcggcgcggtcgtccctgccgccgccggaggccgcggtggcggcggccacggcggcgacagtggccgccaccgccgccaccgacaccgcggcgtggacctgcgcgttgtgcgcccgcgcctcctccttcttcttctccttcctctccttcagccaccgccccaccgtcttcccgccgccgccgacgacgccgcggtacggctgcggcttcggcgtgctcaccgctctgcaaaactgcacatttttccaagaaaaaaattgtctaattagcaaatagttccaaattagttcctagtaaatcaaatccctaggtttcatattatatgtcgctttaatttttgttagtcaaacttacaaaatataatatattttaacacaaaataaatatattatcaaaatatattaatgttatatttagtgaagctaatataatgttgtagatgttcctaaatttttctataaatttaatcaaacatacataaagatgtttctaaatttttctataaatttaatcaaacataaataaatttaaatagaaaaaaatcaaaacaacttataatataaaatggagggagtagtgttcaatgcatcaaagtcattcgatccgattctgtcctaataatcccatgtcaccatcatataattcaatccaaaacccaataatcctatcaaaaaccgaaatttttttaatgaaaagaattgtattaatttcatcggattggaactgcttaaccaaaatgtggcattcatgtacatgcactcctactacacaccattaggtaaaatggaatggatagctaataaattcccccaacttaaatttgatctacagcaaaagtggcaagcaaacagtagcattacaactggagcagctaagccaagaacaaactctgaatttgacaggttgcatccaaaggggttcttatttctgaacagcagcagcacacactgtaactgtatcaaaatgatgctaattgcaaagtgtggctgcatttcactgacccagggcaaatcattgtgcttcttttccattccatgacgttaatctagaaccctaggttaaatcaatggagaatgttgagcgtgccataggataggccaggtcagtcagtgcacacgccactgaagaaagaagaaagaagaacacaagaagacataatcatggagggcatgagcatgagccccaagcagcagctttctggagaggagaatttacattacattactctcaagcccctgttcctttcagatctttgtcgcagattatttgcttcccgcttctaaaaatatgatttctcaaaaaaaaaaagtctactgcgaagtttatttgtcaaaatattaatttatcgtgttaacaaataaaagctatttcctcagacagtgccttgattagagcacagattaaaataaaagaatggcatcatcaggttaggaacagaaagctgtgggggaataacacttgattagggataagaaaggcatcaggtagtcttgacactctcagctcatcactctcatcaagctcatggggcaaaaaggcaggcaagcagctaaagttcagagaagagagagagagagagggaggcaaggcaaggcaaggcaagcctgctgcttttcacccagagatggcagtgaagagagtgggggcactgaacatgttgcagggctttgcttgtggaaagaggagaccacaaggacagaaatgggagcaagaatcaaagcttcagttcttacacaccaagcaaccaccaaagaccatcaaatcaaacacctcttcctgctggtcagagctacaagtgtacagtacagaggaggaaatgtttttttttaaagaaaaaatggaattgggagtgtttcttgtggaaggaaaaagcatgagatcacatggtggtcttttcttcagttcttctctttctgaactttgagatggcccagaggctcatggggcaacaataacatgcagtgacaaattgccaatcaagtcttttgaccatgaccactctcatgagacatgtctctcatgagccaatgcaaagaggagctgaattgtggtggcacccatgcataggatttctgttcctatcaagattcaacttcaggaccaaagcttggctgagtacacagtacactgagagtgcatttcacattgctttgtgatgctatcagagtagacatcagcaaaggaatgcatggttgggaaaggtaagcagattctttcaatattcaatgtgagcattggtcaggtgacatggtccaatcactagtctttggttgttgattctttttgtcaccctaatgtttgctctactacatctgcttaattagatggcatgcttcagttgctaggcttgataagctattcacaagaactgcctctgttaaagagcatggcatgttggcatgcctatgtagctgccgcctgcagaatggagtgaaaaatgagcaatcattgctgtgagagctcaaaggcaacactctaacaaactagtgcagtgattcagagaacaaaatgtatcaaagggagaagaggataccagccaggcatgagaaaaggagcaaaagcatggaagaaaaggggaatgattattggtcacaagatgtatcccattttggggtgagaaattctgcagatggaaggaagaaaaagatatctccatccatatttgtgaaaaattcacaagtatatacattattctgcagtggctttttggtgtgtagtatttctgaagcatgtgagcctgcagagaaaatggaatttgggcagcaaagtattccattggatgaagagaaaggcataaactggaattctttctcactgtgcagaaaattttgtgaaaaggaaagctgcaaggctggtgtttttgtcccagaggccaagtccccacaagttctaacactgaaattgactaacctggaaatgctaaacactacacaaaattagccaaagtgacttcttgttgtgtcccagatatatattgctccacaccaaaaagatgcaaacaagctagtgttccatttccacaaggaaaaaaggagtacacaaaatcatagctgaatataaccatctcaaacaaaatgcaatgagcaggataaaaagatatcatggaatttcttgattatcttatccaaattggcagtaaagaatagcttatcctgtttttacccaacaatgctagtgcagcaactcccttaatcatgttcagtatgtataaactagagcaatcacacaccccccccccctctagaattgacaagattaacaagtcatccatgaagggaaaaaaaatgttcaggtgcagggatcaggagaagagaccttgctgtcgtcgacgtccggcgagaccggtgggctgtcggagagcgagccgccgccgttgagagggccgctgctgtgtgagaggcggccggaggtcagcggcgacacctcctgctgctccatgaaacaagaaacgagtaaattctcagtgtctatctgcaaagtgagctactgttccaagcagaacagcacaatttcacaataatcattgaacatgcaaggaagttttaaagagtaggaaatgttggtgtgaattgtgatcattaattagcttggattcatgttacagaaccaaataaagatggctagtattttgtgtgtgttttttcgttgattatgatgggggtgtgtggggggaaagaaatctcatatttggcctcttgttcttgtcctcacttcagtccaagaagtacaggaagtcagagaacattaaagcaaagcaggtactactaatcgacgaggtaatacccatgagaaatcaaaccaaaaacatgcagttgagagaatcacacctaaaagttgggagatacaagttttttactgcactgattgaagttcatgtattgtttggctagagagagagagaaacagaatgaaaaagcagagaaacatactacagaataatctcaccaacctctcacctaaaaaaagaataaaataattaaagtccataatccggttgctattaggatgtactcagttactcactcactcagggacaagctcaattaaaaaagaccgaattaatctctctattttttttaattaaggaagagagagagagagagagagagagaggatgaggcaagaacgaagggacgaaacgcgcacgcaccgattgcgacatgatcctgtccatgatgagctgcgaggtggccgccgacgcgaaggagaaggagctcccggaggcggagccgtcgacgtcgagctcaccggagacgtcctcggcgatgaccgcggccgacgccgccgccgccgggaaggcggcggcggcgagcgcgcggcgggagacgtcggcggcgcccgacgcgctccacgaccgggacaggaactccagcgccgggtcccgcggcagctccggcggccgcagctcgccccttcctccgccggcggtgaccctgccggattcgctcatcggagcagtcgctctcgtcgtcggcggcgagcggtggcggcgtgcgtgggcgcgaaaaaggtggtgcctttggagaagtgggggtgttggttttataggagtgaccctctgcaaagaaagacaaggaggggattaaccgtttgtgcatctaaagtgttttttttcttttttttttagtttctctggctttttgttttttgaagtagaattggtcattttctttattggtatatattttacttttttttggcttttaatatgtttttaatacttgcaggggatttcgcttacggatgttgttgataaggtcgtcttgatttacggggttgtcgtttctgatgtaatgacgtggtattgttggcgtatacggaataagtgataagctctacagaaagtttaataccgtaaaccataattctcgatgggttgttagaagtttaatcgtgtgggtttgaggtatgacgtggtgagcgagaggtttactcattgtcggtttgtcgacttgctggtttggtaagacaacgataagaaagatgaagatagtatagtatactatgagataattttggctattcatggtttatggcctgaatggttaggatggacctctaataataaggagagtatagtagtgttcaataatacataaaaggtgaaccactcgcacaaggtaactataggagccagagaagaggttgccaatataattgtgaatatgatactcaataacctacaatgctccgcagttacatcagcattgggagattcatatcgcaatagacctttctcaaagcaacttagcacaaggctaaccattactctaatgaaccactaaaaagtttctttttttagtttatctgccttttttaagtagaattgttcattttctttattggcatattttaccctttttttgtctttaatgtgtttgtaatacttgagggggggtgtcacttacgaatattatcgataaggtcgtcttaatttaccgatggttgtttatgatataatgacgtgataatgttggcgtatacggaagaagtgataagatctatggaaagtatactagcgtaaaccataattcaacgggttggtagaaatttattcataagggcatccacaatgtacatgaaaaccagtccataggaaataaaaaattccattcagctatcttaacacattatgcaactagtctatagcaaagaaataacaaaagttgtccatagcactatgggtagtccatagacaataaaaaatcatagttatgccaggtgcatgcatgctgcagcctgcagcttcagctccggctgatttttttttgcctttagtgggacccaccttaattgcacacattgtggtggtttctaaaactatggactcccaggtgtgggtcccacatctatggactagtttgctaaatacattggtgttgccctaagggtttgaggtatgacgtggggaatgagatttactcatcgtcggtttgtcgacttgctgattaatggcaagacgacgataataaagatgtaggtagcgtcatcattgtagactatgagataattttggttattcatggtgtatggacttgatgattgagacgaacctctaatgaacagtagtaagaaggagagtagtagcattcgatgatatatgaaaggtgaaccactcacatgaggaaaccgtaggagccaaagaagaggttgacaatataattgtgaatatgatgctcaataaaactcgcctgcaataaattcagcacgacacacagcttaacctcttaaacactacaatgctcagcagctacatcaacctttggagattcatatcacaatagatctttctcaaagcaacttagcacaaggctatccattacttttacaagtagcatcacatgtaaaacttaactaacaattaaaaaaccctcatgtcagccactcttcatttccaaattacaagcaatggctccacattccctggaattattgctccttaaaatagcagtactatactactatttttttcctaactcacccaatataatcaattatgccataataagtggtgctccatttgttgtcaagttagtttaaggtctcatctcatgcctttttggatgggccttctctgctttagtttttgtcttctcttttcccagatgttaagaaaccatagcaaaaccagctatcctcacactttttttctctttttttcccttagcttccatgtccttttgttgtgtacacttgtgctagctgtgaaccatacctaggcccccacacaagacatggtagtatggtacttgttctgttggatactcatgtgttgtgagcagcagtggttttcttctgtctagaagcaaacatggcctgtactggcaacatacttatgtgctttctttgctaatggtcatgatgatctttttttattatttgggggtcgctttaacttaatttgactttaagcagatacagatacatggatgagctttggattgtagtgcctttcttgtccatgcagaattgcataatagaagctgaaacatgtgtgatgaacagaattatactactacttgtttgttgataggcctatttctaggaaaaaaaatgttattttttgagtagctagaatgtgatcaaatagtacatgatttaattgattctatggatataatgataaatactacatccgtccataaggaatcctattttttttagagactacgggtaaaaaaaacatgttgccttattaacgagggatgtttagggggtggggaagacctcttataattatagaaaaattctaaaccattagatcccttatatttgtatttgtagatagagggaacatgatttaacctgtgattgtaaggttaaccctcactttctatatatacaaaccaaatttgtattgcgtatcacgttatgcatatactcaaattttatttttaaaaagttacagggcagattaaccatcacaatactcacattagtggttgcagtgccaagggcaccaagattagatcattagagcatccaatttgatcatatcaacataagtacatgacagggacgaccattaattttgatttgatcttgtgttcttgtacatatgtgggaatgcacagaggcagcagccataaacagctgatgcaaccacccacagcatccaccgactcacactgtagtgtatactgtacacacacaccatttggtactctacctgatcacctccagctctttcttcctctctactcctactcctactagatcagtgatcagtagcctaccctgccggctgggtcactgccaggtggggcccacccagaagcatgagctatatagcagattagcagtagcacctgagctacttcacctccctgtctgtatgcatgatcatgttctgttttgggcttgtggcctgcattggcggtggtggccaatggctcatgcagtagttgaagaatttagattattggttggattattgctgcgaattatcaacttgattacaattatctatatatatttcttttaaaaaaactccaatggtggttacagtaaatctgtcccacattaccctttgaacttctaaatatattacataacaactacatttaaatgaatagtcacaaataaaattaaattgaggtgagtataacttgtagcaaaaaggtggatgacacattgataaaaaaatatatgcttttatttattttagacaataatattatgataacataataactagtttaaaataggtggtctaatgcagaaaaaaagaattttaagaaaacgcatttcaaagcgtggagcaaataacccgttttgaacttttgataatccggtaaataagctgaactgaaattcctatagtaacaggcagcaggcagagaaagacagatttcgctgggttgctttgatgattggttggttgggttggctgcttgatggtctccatcaggtccacccagcatgcagtcagtcatcagtgtgatcgatccatccttgatatgagaatgagatgctgctgctcatcagtggtgatcactagtgctgctgccagtggacagcagcaacagcaagatggaaatttcttccatcctgttgtaaattcttcttctctgattttatctgcaaccatgagtatatgctgctgctgatgccaactcatgatgcagcacatgaaactacagcttctctgcagtcagaaatcgaaatagtgatcaacagatcaggtactattaaccagcaggatttgcattgtttggctacatgtgcagagtcttaaatttcccggctattcttgctcgagctgaaacctgataagtctgtccgtcctaaaatataactgacttaataagaacaagaaaactatattacttcttgggtgtgtttagttcacgctaaaattagaagtttaattgaaattgtaacgatatgacggaaaagttagaagtttgtgtgtgtaagaaagttttgatgtgatggaaaaattggaagtttaaagaaaaagttgggaactaaaccaagccctaattgagtattaggttactatattttaaaatggagggagtacttacttatctgaaaataattcagtttggaagttcagcttagctctcatcaggaagacggcatgtaaatgcaggtatcatgattcatgagcaaagaaggcagttgacagaagacagtgtgtgaagaactctgcaatggcaacagcaagagcactgtagtaggtcgctgcagattactatgcacgcatcaggcttcagttcagacagcaagcaggcaggaggaaacaggtataaatttcatacgagaaaaagaggagggaagcagcgagaagagtgaacagtggaagggaatcggcaacggcaagtgcagtcgcattcatctccaagagtaaagaagctagataggcagcctaccttgctacgaacatgggcagctgcagaagcagcaatggcggcaacgcatcagcagagcagcagcttaagaattcagatcaatagcgagcactgttcattgcgtagcgtagttcagaaactgaagctcactactcctccgtggtactctccgcctcaaaataacatcatttttcactcatctcacacatatcaatacaaagaaaaaaactatagtaccctcactttattaaatcctaatgcgtcaatgtaattatttcatactttattatttttaatatttatcccctatttttataaacttatttcataaattctgatgcaacgattatttaaaattaaatttattttgagataaacaggagaaataaaagatgaacttattgagtatggaaccggatcctctgacgtagcgctcgctacgtcagagggacgtccggcagcgctcgtccatccgttcagcatccaacggagttgagcgcgcacagcacacaggctcggcccacggcaaataaaaaacggcccacatcttcgcgttgacgccacacaagccgctgcggtgcagccggtggtgcgccgcgccgccgccacaagtgagggaggggaggcctatgccgccgccgccacacggccacaacccgtgcttcctgatgaagccccctctgccaccgccctcttccttgaccctgtcccacgcctccgcgtcctccctcgtgccgtcgtgcgggagcctcgctgcgctccggctgcgtggaggtccgattccagatcgcgtatctgacggcatggcagcattcgctccgctgcagttcgtcctttgtcgttcgtcccagaagcgcgtcgcccagtcgttcaacccatgtcgccagggaactccggccgccagaatcgccgctcaatctcctcgagttcctctcgagctggtggagcgcgtcggccgtcgatgttccccgtgcgtggggcacgcgatgtcacctccagcgagggcagagtagaaccgatcgaagatgacgctttctttccatttgttaaagaagacatcaagagagtgtaatgtgttaaccaagaaaaggaatttgcggccatgaactgaagagaaaacgagtgatttttttatttttttcttcaatttgttcctcgtctagctcctcgacggcgaggacggactagtattccagccgaccaagttgaagatcacggcggggttgctcgatccttacccctaggaccttggcttcctgctctgcttcttgctcctctagccaaacagcttggacacagacaaattgatgtgaccatggctactacggatacatccgttgctcacatcatggatgaacaacaagatatcaagttcaagtcctccaagtgctggaatccgattcggccacctactacactgctgacttcaaacggccgccgaatctccatacgacctccgttttcggccggtgagtacttgatggaaagctctcggagtcctctttccaatgcatcaagcctcattgccaaattccatctcagtcagcagcaactgaagaaacaaggtgctgcgacacctgtaatgggcctatgggcttgtaacttcatttgggaccccggcccaggtggggcccatgtggggtgcgccccaagctggtggggcacgaccctaggcacccctaggtcgtcctcctacccctatatatagctagttaccccttcagggtttctgggttttgatgatagagatagctacttgctaccggctcgcagcgcgcgtgttggctaaaccgcccgtctgcctgtaatcggaaccccaccatattgtgttttgatagtgaaactttcatctttatctagcaatttcagtgcttgttctacttgttcttgcttgttcttcgattgcttgcaggacgagtgccctcgtggccgggttgacgcgcaccacaagttcgcggtgaccattggaggtggtgtatcggttgctaaggcgtagcgtctttggacagttgtagtcgggctgtgaacgtcgtcttcatccaatcgagttatcccttacctctcatcgaaagatcggaccacaaaccctagcgggttcccatcacaaatgctacccagccgtcgacttcacaacggcatacttaacaacagcagaaccagcggcgcggtgaacgacagcgagcaagtagcgcacatgctgcacccatttttccctgagcgagtagcgagcgttcgatgcttgatggacggcggatcgacgggctactgccctctgacttagtttttcctaagtcagaggatctggttccggaagcaagggcaaattgtggggccatttgtcagtgtcacaaggtggctagtttcccttgtttgcaatatgtttgccttcttcttcttcgggttctttatggccggacatatataggacatggttgtattcctactgaataatgatagcccggcatatataggacatggctggctatattcctgctgaataatgatatggagtagctagtaatctggattcttcgagaagatgttccctagtttctttgcattccatctaattagttatgaaaaaaattggtaagatagattagtatgtgacggggtatattattttgtaaacatttaagtttagattatacaagttaaaaaaatatgaccgtgagtacacatatactagtttgagttaaatttgttgattttattacaacttgtggggatcaaattttaagttacatattttttagatcgatatattacatattaatctatcttatcattcattttatataactttttggataatatacaccaccgaggagacatccccttatgcatgagattaaaacctatttccgtagtaaccttcactatttcgtgttttcaatactcctatatgacaccgctaactttattcgatagacggttggtcaacaacatgatacccggagaattgactacgtacgaatgataatagatgaaaccagcatgatatgaactgcaatgatgatccatcgcctcgcctgaagaaagcttaagcttatataacctgggatggatgaatggatggagaggacagaatattcctctcctcgagccttttgatgtcctgcctgctgctgccattctaccaaattgccaatcagcaatatgcaggcatgcttgcttgcatgggcaaaaccatagaggatgtcgagctaatttaaggtggtgtttggatccggggacttaattttagtatctgtatttagacactaatttagagtattaaatatagattacttacaaaactaattacataaatgaacgctaatatgcgagacaaatttttaagcctaattaatccataatatgcgagacaaatttttaagcctaattaatccataattagagaatgtttattgtgctaatcacggattaattaggctcaatagattcgtctcgcgaattagtccaagattatggatgtgttttattaatagtctatgtttaatatttatagttagtgtccaaacattcgatgtgatagggacttttaaagttccagtcccatctaaatagggtcttaagctagcggcattcatgctcgatgagccagttgaaaatgaagaacaatgtatatataatatatgtctgatgtctccaaaagcttcgaatgtccacgtgatgttgctgtagcctgtacaattttactacgtatatgcctagtaatactacaaattatacaatgtgttttgagtttatatggaccttgggatcttcaacctcttagccaagacaacgatgattaccactctgctgcagacacacacactcacaaactcactctcactgtcgattcttttcccattaagataaatatatattttacctccgttcttttgtggttacgatataaattttacctcggttttagtgtgctttttaactgaaggtgtattttgtacgaaaactttttatatagaagttgctttaaaatatcaggtaaattcatttttcaagtttataataattaaaactcaattaatcatatgctaataacttttttgtttttcgtgccttaacttcatcttcattttcagtagaaatgaacatcatctcggcgtgtgctttcagctgttcaactcatttcgtatgcttttgtactttcttagaataataaagtggtgtttaacatccaactttgcattcctattcagattacaatgaggatttgagaatcaaacatgacacccctcctgtaaggtagaagcaaacctggctaggttgtgagcatcaaagttacaatacaagcctgattttcctaacaaaatttacttttgcagaatacttctttcttgc

SEQ ID NO: 47398 - DNA, 9958 bp, Oryza sativa
tttgtgtgtatgaattatgatgggcccatgacctggcccgaaagacaggtaggccaggaatatgggccggcccgttattattatctacccagtttggattgaatgaaactggcaactcgttcgtcagtgtcagtctcgagacgtcctaaaatcaagaacgaacaatcaagcagagatcttgtattgtatgcacatatatatataggccgatttttgtacccattctcaagcttcttttcattgattattcagaataccaaagaagatagaaacaaacttttgtatattgtgatgccaagttttctcttgtcgaaagattgaaactctgaacatttaggacaacgaacatcataaattaagaaaacattactacttaccttcttgttagcatttggaggagaatcttgttgtggcctcttcatttttttttcctcaactcatcatattcataccatactaccatcctccaaatgagcattcagtcttcgaccagatgcgcaaaatttgtctagtgtttgtataattttgagttatcaacagtcgcgatggagatttgagaagataaagagatctcactccagtccaatgcactcatcgcagccatgatgaatgatgcatcagaggagaaggaagtttcaagaatgtgactgaattcttgctactaccttcaaaaaattcagaacttcttcgaactgccaccattcgccattggatcctgaatttgattccaacgtttgtaaccgcctccaaattctttcactcaaaattaaatgaaacaaagatcattccttactacatttattgccaagctccggtttcgagtgtcaccatggcccattgttctgctgcctgctccctgctgctgcagcactgttcaggccttcaaggtccaggctagcacattgaatcctcaaccattgtggctgtctcgacactcataaacccagcagcctcctacatcagtagcagcagcagcagcaccatggtgtaccagcatgcagtacagatcaaagtttcaaaggcacacattactcatcactattcaatacgccattgttacacactcatcataagcacaatcatgtgaaagaagctagtcaagtcaggaaggagaaggttcaggccactgctcccctctgtccgcaaatataaggtatttggggtttctccatccatccacaaaaatacctttgaatttatcacttattggtagttgaatcggtaggcatgatctttcccgataagtaaagtatcaggggcatcagaggaatttcaccttaaccttaaacagtgctaaacaatttagaaccccttaagtcccatcatttcgcctacagctgactatcagcttaaaaaataacttgtgagcaaaacttttatacttatcttcttagtgactttaaagccaccactgaaaaataaactacaataaaaaaatcaaaatcaactataaaattaaaattttaaattttagccgtgactgataagctaaagaacaaacgatgaacaaactttatgtttgtggaccaagggagtaattaattggtattggatcatgagccctcatgaaaaactttgctcagatggtgtttgttaccactggttaaagtagctagcagtagctgtagcacttgtagaccatggtcattgtagcagtaccacattgtgctgagttgtgccatgtgtttgcttctggaagatgagggagtactgcatgatgcatgaatgaatccacagtgctcacattcatagccaggttaattccagtaaaaaaaagcaaaagaaagattgtactgaattactcaccacatgtagcctctgaaaaccccccttaaatccccacaattacaccataattaacattgtccatctcatatgagggacacatttttctttgttgtcccattttttgcagtgaaaggctgtgtttagatccaaagtttgaatccaaacttcagtcattttccatcacatcaatctgtcatacacacataacttttcagtcacatcatctccaatttcaaccaaaatccaaactttgcgctgaactaaacacagccaaagttgaggagttagtaattggtatgcttaaattgtgttgggtacagagtttgcagtcctgcagatatatttaactgaatgcatgtgcaagaagaagaagaagaagagcagtatgtagattggcagattgcagaggcataggtggaagatgtgtaaggttctagaagcatctagaagccgaagctgaggtcactaggccatcacttctgctgcagaagcttcttctccttcttgtgcagagatggggaaggcgggtaggtggctcagaagcttcctgaccggcggcaagaaggacaggaagggcaaggacggcggccagccgccggcgccgccgtcgccggcgccgccgtctgccaaggagaagcggcggtggagcttccggaggccgccggcgcaggccaccaccaacacgtcgtcgctctgcttctccgacgtgcacgccgtctcgccggcgccggaggcggagagctcggccgccgctgacgtcgccgaggagaacgaggccgccgcggccgcggcggtcaggattcaggcggcgttccgatcctacctggtacgtataatgatacgccattgatgacgccatcatctgttcctggttttgtgcaactcgatggcgtgtgggggggtgcaggcgaggaaggcgctgtgcgcgctgagagggatggtgaagctgcaggcgatggtgagggggcagctggtgcggcgccaggcgagcacgacgctgcgccgcatgcaggcgctcgtcgccgcgcagaggcgcgcgcgcgccgagcggctgtgcctcctcgacgacgacaaggacaagcacgcgcgctcgccgcggccgccgacgacgaccagccgccgctcgtcgccgcagcaccaccgatcacggaagccactggtaagcgaagcgtctccgccaccgcactctagctcgcgacggcgatcatgggagacatgaggagaagatgactatggcattgcaggaggtggtggataggggatcggaggagaacgtgagggtcgtcgaggtggacaatggcggcggcggcggcggcgcggcgagggggtgcgggaggcgcagcacgtgcggcgcggcggcggcggcggcgaagggcgagctctaccagaaggtgtcgccgacgccgtcggcgttgacggaggcgagcgcgcggacaatgagcggccggctcgacgactactccttctccgccgcggcgtccgaggccagcgggcgccaccacagcgttccagcagccgcagtcgccggcggcgaccacgcggcggcgctgcagcagctgttcccgaagaactacatgtcgaacacggagtcgtcgcgcgccaaggcgcggtcccagagcgcgccgaggcagcggcacgaccagccgatcagcgccgctgcctcgccgtccccttcgccgtcgtgcggcgagtggacgacgacgccgggcgaccgccggcgcagggcgtcgctggacccgcgtgacctcgccgcccccgcctccgccgccggcgtcggcgtcggcgcgcgcatggagcggtgcgcgtcgcaggcgcgcgccagcgccagcgcgagcgcggcgtgcccgtgggcagtgaggatggacaggtcgacggcgtcgctcgccggcggcagcgacggcggctcgtccgccgccaccgcggtgaccgcggccacggcggcgcgcgtgacaagctgacacggacgaacacgagctgcatgctactgtgtgaagaagcgatcactctcttctctcgaagtctcaagtctgaaattttttttttttcagtggcttgaacagatcaacagtagaagctgacaaccttgttgcttctttgcttcttgctgacctgaatgagccttgtttcttttcagtgatctgaagttctgaacagtgaaattttgttgtgtgttgtctgtggcattgtgcaagttacagattgtgtcagtgagaaacaattgtgtgagtttaattcagatttgtttcttgagatagtgtggaattgcagttattctctgaggtgatattttcagttatggccttgaaaaatttatggaaactgggcctgtttcttttagcatccattcctgcccaaagtgactgaagggttttaatttatgagttgtccatttacaatgtttttttttgttattttcggatcctctttgatgtagtactgcaattcaccataattagactactgttacttgttaccgtaaatgcgatgtgcatatgatttatgatatgtaaaatatattgacaggttttgcactagccttatcctaattgtggtatatcaagatgtatcgcaattctatatacatctcgcgcgttaggttttacactagtcgtatgtctattttagtcattgaagatagtcattattgttcatacatatcagcgatctcgctatgatttagaacatccttatagccatcttttaattaaccacctaagatgtttgctagtatagcacccttatcacctttgctcaacccacaccccctttacaacatcaccacctttcatcacataatgatgtaatgataaaagcacgggcacaaaccataatgcaagatatagagatgagcgcactatgatctaagatagacgataatttcatccaaatgtgaaagactcatgtataagtctggttcgaatgctttatcatactacaataaagaataaataatgtaaccatagctactacgcaagaaaacgtataaggtatatctatgtacctatgtcatggtgcagtctagcattaccataatttatttttcaaatggccggatattatcctgagatctatatatgctagattgatttcaattacccccatataaaaaaatataatttctactacgccctctgtttcatattataaatcttttaacttttttcctagctaatcattgttaaatttgaccaattttttagaaaaatttagcaacatctaaatatatcaaattagttttattaaatcttacattgaatatattttgataatatatttgttttgtattgaaaatactactccctctatttcaggttataagacgttttgactttggttaaagtcaaactaccataagtttgactaactctgtagaaaaaagtagtaatatttacaacaccagtatagtttcattaaatctataattggataaattttcataatatatattatgtcttgggttaaaaatattaatattttttctacaaaattaatcaaacttaaaatagttcgactttgactaaagtcaaaacgtcttataacctaaaatagatggagtactatatttaagaaaaatatggccaaacttaaaaaaatttgcctaggaacaaaagtcaaacgactcatataacatggagcacgaggtaaaacaagagggggctgaaatgtgataagttatttttacagggacaataagctgagttaccccgatgggaggagaggcgagggccgaggggtataaaagcaaattaaaaaaaaaaggaggagaagggggagaggcctcgcgtcgcgtctcccacgtatcgtggtccgcgaaacccgagtggccggagaagccgaggcgaggcgaggcggttgccgtggcgggcgagtgacatcgtcgtcgtcgttgtcgtcgtcgtcgtcgtcgtcgcgcgccccacgaaccctatcggatcgggatcgggatcggagaggagaggagagggtatggacgaagcggcggcggcggaggcggtgcagctgatcgacggcgagggggagttcgcggccgactccgcggagcgcttcatggcggccgcgggcgtcgccggctgcggcctctcctacgccgtcgtctccatcatgggaccccagagcagcggtacgtacggacccatcccatccctcgcgccatgtcgagatcgcctcatcgatcggccgccgcgcgccatgcgtcatgattgggtatcgatcgatccctcgcacggcacctgttcgatcaaatgtttcggcgcgcgcgcagggccgctacgacgctcgtagtatacaaacatcagttttgaataatctttgctttaatttgtttggattggtagtacatcagtacaatacaaatctgcatttgctactagtggagtacttgcatacgtacgtttgtgtttctagcaagttattatggttgcattttttttttcgtctcccaatactgattgatggatgcatgaacgtactctttggctaaggtgtgtgtaaaggagccacttaattgtacacatctttcatcaagctctgcctctgctgacatgaatggatattataacccggcaaaatgaatggatattatagggtgtataagtctcgcataatctgttctccgcaatccacatagatgacagcatctaccgtttttcatttttcttacacgcctacctttcatgcatggaggaaagacccctttgtttttgtcttttctgatacttgactgtgttatactccttccgtttcataatgtaagactttctagcattgcccacatacatatagatgttaatgaatctagacacatacatatgtttagattcattaacatctaaatgaatgttggcaatgctagaaagtcttatattgtgaaacagatgaagtattactcttagcacgcattctttggctaatagtaccctgacactggcctttactacaatgtactattagcttttagctgacatgtgtgctttctgtcaccaatatttgtgagtacatgattaagaaattaattagtacttgtttgatcatcataacataccttttattttgagcaggaaagagtacgttgctgaaccaactctttggaactaattttagggagatggatgcgttcaggggaaggtagtcccgttttgttcctccacatgattataaatattcgtactgtcttatttttattttgttttttgaactagttacttttctttgctaggcagtagtacgtatctttgcttgttcattttcctgttctctgattgctgaactggatctctcacaggaactcatagtcacactattacattttgatttctggtagggaaataccatgatatcactgatattatgcctatgtctttaggagtcaaactaccaaaggtatctggatagcacgatgtgttggtgttgagccgtgtactgttgtgatggatttggagggtactgatggaagagaaagaggagaggtatgcttgcttaacgcgtatacaattcaattcccatgttcaatatatcttctagtgaaccttttggagtggccgtgtgcacttgtagaaagctgttctgtagaaatcggtaactagcccaagatatggtttcacagaacaataaccaaccactgacaattggatttttccctagcccgagatctttaaaagcaaagtttggatttttccctaccccgagatctttaaaagcaaaagttcagttagcattagtatctcctttcctcctgcaatgatttatctgagcaaattaagtttgcaatatttggtttataagtattgcgttttcattgcattgtcattttcttgtcttctgtttatatcttccaattaatgaaaatgagcttaacctgcttggctagctcctatgttttaaaatgtgcctttacatgtattacgagtttaagcaacttgagggatacatgagttgtttcttcagttccttttctgatacctgtgtcttctgccccattttaggacgacactgcatttgagaagcaaagttcgttgtttgctcttgcaatttcagacatagttctaattaacatgtgagttactcaattgttcaactctactactgagctcatattatgaaaattcctcatagccttctaggttgaactttaatatataattcatcaacttcatgactttgtattaccaccatatgtatgtcgataggtggtgccatgatattggccgggaacaagctgccaataagcctcttctaaaaacagtatttcaggtatttatctgttttttcagataacctttgccacagcaatacattcttgatgcatttgtaacatttggacaactgggtttgtaggtcatgatgcgtttgttcagtccccgaaagacaacactattatttgttatacgtgataaaaccagggtttgcctctttgttctttattctttcttgaatatatttactgttatgttttgtgcaagctgtttggaaatataatcattgctccatttacttgggccaatctcagacacatcgttgttttcatgtagactccacttgagcatctagaaccagttctgagggaggatattcaaaaggtgatgccatcatctattgtttccatctttgttacaacatagtttcctttctctagtcctaatattgtcacagatttaatcagatatggaactctgttgataagccagaggcgcacaaagacacccctatcagtgaatttttcaatgtaggttttgtagttccagtattcaatctttgaaacaaagatgaaggttttactgtttatgttaacatggtttgtcaatatgaaggtgcaagtcactgcattgcccagttttgaagaaaaagaagaacaattcagagagcaggtaccttttcacttgtactctaatgaaacagttgtctggggacaacagaacgttttcaaacaaaaatagggaactgaaaattattatttttcaagcaccttacttttacctctgccaggttcaacaacttaggcagagattttcaaattcaattgcaccaggaggtcttgcaggtgatagaagaggagtggttcctgcttcaggatttttgtttagttcacaacagatttggaaagttatacgagagaataaggatcttgacctacctgctcacaaggtacacttatatctccttctgtgcactaaagacttatactgggtcagtattattacacttaccattaaggatttaaaatctataatattgtctgtgcactttagaatacaattgaatatactatgcagaatacaccaatgaatccccactttctgaacgaaaagactaatgccacaccatctgatgtatgctaaaattgtttctttcaaatgcattgtggaaacttttgttgtcaacagtgatcagtaaaatagttaactgcgagtttaaatctgtatgatatacctaggtgaagtaacatcatcaattcagtaagagaaaccactctagcttgtcggttattgatttattttcatttgtttcattatacaaggtaatggttgctacagttcgatgtgatgaaattgcacacgaaaagttttcctgcctaacctcagatgcagtaagaatctcccacttgatctattgacctgtgtacaatttccaggttcattaatttgtttgtgtcattctttaggaatggatggaattggagagtgatgtgcagtcaggtccagtacctggttttggaaaaaaacttggctatattgtggacgtccacatgcaagagtaagcccctgcataatataagttgttgacagctcacagttgtggtttgttcagtgtgattcctattaccttcaatttagcaagcaaacagtataagtaatataaacttggtaacataaatgcatttgatgtttctataaatctaccagtagataggcatatgcatcgcaaacaggaaatgtcttaaaagttctcaaacacttaattatgatatttacggaagaattaatatagagatgttttcctctgtttcgaattgctatttgcaaattctggaagctagaaattggtcccttgttttgtaccaaatccaatattttgtggtgacggtaagtatttgttcatgaataaaattgatacgtgaattatttttaggtatgacaaagaagccatctatttcgatgaagctgttaggacagca

SEQ ID NO: 47399 - DNA, 7927 bp, Oryza sativa
ttaacatgcaatttgcagggtactcttttccagattatttttgtgtaacaattcttaatgtggtactggtgaccttgaggaaagtgatactgccatctgacttgtttttctgttgattctgttgtagatgctgtaatcgagcaggcagactgggactactctaaaatactagagaaggttcggcgcgatgttgaagaccacacactttcaattcgtgaaggcaagctatcagaattgacaaatcatgctaaggttaagtatggcaagctaaagaaagccctttcttttagcaactcataactaacctctcttctgcatcgatttagcatgtgctacgggatttggttaccacatggtactaatgcaggtatattatacatgcaggagaaactaagaaaagcactagttgaacctgtagagtctcttttcgatgctgcaggcccttcaacctgggcatcaataagaaacctttttaaacgagaaacggaggctatcctgccagagtttcagaaaaaccttgctgggtttgaaatggaaagtgcaacgtcagaaggaatggtatcaaaattaagggattatgccagaagtatcgtagaaaataaagctaaagaagaagctggcaaagttttgattcatatgaaggagaggttggcaaaatcatctattattcgttcaccataccgatcaatttctcgcacttctgacaaagttgcttgccattgccaggtttacaacggttttcagtcatgacaaggattcaattccgagggtctggacagggaaggaagatgtccgtgcaatagcaaaggatgctcgatctgctgtataggacttgaacccttctaagttctaatgggatgacatagttcttcctttgattccccttctttgttaaatggacttgcactcgtgttgcaggctctcaaacttctttctgtattggctgccattcgctgggatgagaaaccggataagatcgaaaaaatcctcacttccacactcctagatggttctgttacaccgaagtcgaagggtgcaagtgcttctagtgatccacttgcttcaactacttgggaagaagtaagcttgtgttaatttttcgcgctgctgtaaatattagaagtgcataaatcatggaaccatcacgattattgaactcttgagcaggtttctccaaagtataccctcatcactccttctcaatgcaagtcactgtggaagcagttcaaagcagaaactgagttcgccattacacaagcggtttccacgcaggtgtgtatccataatttgggaggatctttatgctttcttccaaaatttggatcacgtacatggtttgatcttttcctatttgatcaaagagtcttattttcatttgtcagttccttgaattttcatctttttttactccagcaagctcacaagcgcggcaatggtaggctgcctcctccttgggccatggtggcaattgcagttcttgggtttaatgagatcatgacgcttcttaggtatttgcttgtactatacatatcaattctatacccactcacaaaacaatataacattatatcttcgtttcttcttgttttgcacaggaatcccatatatctattcttgctatttgtgggttatttgctggtcaaagctttagcagtgcagctagatatcaacagagaattccaaaatggcgtggtaaggttttgaacattcaccgtgaagctaacctatagtattgatatgctattgcaatagtatcctatagagatcaacaaatttcccggtactatctgattatgtgttgcatcatagattcatagtggagcatgtacaaggtcattatctattgaacactttttacgaaatttgtttcctatgaggctatgaatcgggaaggataaattgtttattgaacactagtatcctattgctagtgtataaattgtttcctatgctacttatttcatgaatatttagtgcaacctcaacttagaggatcttgtgaaaaatatatagtggcatagtttattctacagagaaagttttcttttgttaacatagcaatctgcttataaaaccttaattttgctctaattttgatgaaacatcaggctataagcgctacacattggtgcagggattgaaattttggttcgaaatttccgaaatttcggtaaattcggaccccccggcatgccaatatctcggccgaatttttcagtttttctcaaacttttgtgaatttaatcaaattcagttaaattgtgtcgaaatttcagaaaattttggcccaaaaatttttgttctaccgaaatggccgatattttagccgaaatcgaaattgaaaaccctacattggtgtgtatcagcaattcagtattgtcttctgagttagaatgttatgccagtgcctcactagtgttaataagtttgcaaaaaaccacattgatccttttctccactaacacaacaattatgctgaatcttatatattgcaggttcctgggatcatctctgttacagcaaaactaatccccacactacagaacattctaaacaaagttgcaacagagcaacaacaacagcaagggcatcaccaagatgctgctgcagaagctccacagcaacagcagcaaccacagccgcagccacctcctctactcctgagccccagaagcccaatgagcgaactgcggaggccgctgcacatgccattcagcccggtgcgcaaggcggtatcgccttcgccatcctcatcgtcttccaccgttacatcgcccaggaacgctggtgaagaccagaagcccaggcaaatggtacagcctgacaacgaatccaacaatgcttactctatagtttgatgatcttgggtgttcagggtcagctggtggtttatactgtccaactggaaattggaaggtatgagcatttcgttgtcctcatttgaatgcataggtacactgattgcagcaatgatccatcgtcagtagggtatcaagacagaataattcaaaatattttgtctcgcaaaattttgtaaggagggtggttaatctgtagaatggacagaacaattgctactgaacaccatttatcagcatgtatataggaaagattcaactgcaatgcctaggatatggtcaatcaaaaagaaaaaaaatatatatatacttctaatgccacttggataaaatagcacatgcaaaggtttgtttcctttcaaaatactctatcctaggtttgaatttgtgctgtcaagacagtgaccatggcctgacagtacattatctagggaatggtgagttaaaaaccttggttacatgactagtactatactgcatgtgtgcatctgttgattgtcaatcagtctggatacttacaaagagagacaggggacactgttgtggacatggggtgttgcctgctctgctgaacgcctgcaagaagccacgacattgcccccatgccgacggcctctcccgagagagatccatgcatccattgttttcttcttcctccagtcctgttggcagcacagataagtggtagattttggatcatcttgtacaggcaggtgacaattgtgacaatacaagcagcatggcacatgcagagattctgcatttgtacaaagcctctactggttttgattctaagcctctactggttttgattctctcttctcccctcctctctgcatgactgcatccatcaccacatggtcatctgctgttttgtggagtagttaagtactctccccatcgtttggcctggcttattagagactaaaaatagtttatgcataaattgtttatatgtgtgctctcagcgacttagaagccagtattgaaaaataaactacgataaaaagaaacatcaagatccgcttataaattaagttttaaaaatcaaattttagctacggttgataagctaaagagcaaacaattctagcgtttgaaatttatccacaaatataatcatttctagagtactattttcccaatctaaccacacatgattctctgtatttatcgttacattgcttggtgttatatctcataaagctagtaaactcttagggaaatcagagtaatttcacctcaacctttatatctgttaaaactcctagaaatgcttatatttatggacagagggagtagctagctgtgactgagatggcatgcaaattcaaccacagggtatggcttacagctcaggtagttaggcttagcttacaaaggccacagggtaggtacatggtatgtgatacatgatctgcacagcatccatgcatgcatctgggtaacatagatttctctgttcttatgattggagtgagctgagagagagctggatcagtatagtgtaatgtaatgtaatgtagtcagagtaagatgaatctggagatcctggcataggataccccaaaccctgctcaaagaaaataatcctggagaccccaccctgcctgctgccaactggatatccttaaccccacatttatatcactacatgattgcaggtgccacatgattacaaaggttctaagatcttgcaagatcttcagcttaacttacagttctactactacaactcctgctgctgattgctgattcctaatagaaagtaaaaaactggaaactagctagagctagaagtagattttgagttaacagcaacactgagatggtgctgcctcccaacagctaaaagtctcaaatcctaaatattgtttaccactacctgagctaatattgcacatgacaaaactggcgattttagacgcgcctgatacaaggtggcgctatgatgccgtctccttgaagctctttgtgagccagatggccgtctccctgggagacgctttctccggtccgaatggcttcagcagaatgcccagctcctcatacctctcctgctgcagcagctgcgcgctgaactccagcagcccttccaatgcctcggcacgctgctggaacgacgaggtgtcgaaccgctgctgcctggagtcattggatccgcggctcgaggcagcagtggcgttgcggcctgaggagtcgctcccgttgtccccatcggtgcgtaacacctggatcgtgcatttgtccttggtgattgaccggttgataaagggaggagtggaacatgagccatggccaggagagagcttgttgtggatggggagcaaggggtcctcagacgatgccagtgggaattccgcaattctgtcgattcgaggggcattcacagagacgtcaggggagtctagttgttccagaatgctgatgctgcgcttggtgggtgtttcatatgttgacagcgggagtgatgctcttcttgctggtcgggcaattttgtttggagttgtttttgagggcagctgtaaaagtggaagaaattggagctcaatgaatattggcacattcatttcaacagacaaataatgaaagaggcagcataatcatgcaaaatgcaagctcgtgctgaagccataaatagcataaagaaacaactgcatcatgacaagatcttaataactctaaaagaccaaaagctgaataacactaatgtagtatgcactgagcaagcacatgctataattgaggctattgtagtttctaaacaaatgaagaacaggttcactggtattattgagtgcacaaataatatagaaaaaaaaggcacaaaatggaatacctcagagcggtatgttctgttatacgatgttttgggaggttcaagctgatttctagctgtataagtcttggctggcaagctcttgggcgtccttaggatgcttgatgtctttgttatgatggctttactggtaacctcatccccagcctcactactgtcaacagagagccctttgacactctgggtggttgtgtattctttgatgctccgtgtagagctaactgaattccgttccggagatggcttgctaaatgtcacagtcctctcatttcccagagagttcctcctggccattcttctgcgtgcagaatcaaccacgtcactaggaaatgtcatcttcttaactttgtcagtcaaagattgatggattggaagtatgttgcgagtaggactagatttcaattggacttgcagcacataaggctgaagttgtggatgcttgagtagctgtgcagcctgtacaggaaatttagtaaatatttataccacaaaacaaataggagtatacatcagcaactattacaaagtagtaactaggatatagtataatggacttacactaggtctgtgctctggacttttccgcagcatgctcttaataagtcccctactgcacgcagaatataaatttaagaagcatgctctatccagataagatggtgggcaaaatagggtgaaacaacaaaaggcaactagttcaaaacttacaaggcaccagaatatttagtgggtaatggtgagactattgatttcgtgatcttgttaatcagcgcttgcatgtcctgcagggaaatgagaaaattagacccttgtacgtttcataacactgcattactattagcatagatgtagtatctaaacatatgctcaaataaaccatcacacagtaaaagtaaagaaaccaaaacagggacttacaaaagctttaaatgcaggcctgagcgcggtcatttcatatatacaacatcctgaaacaaagtaataaaaatgagagttcaatagtaagttttccatttagggcaggaaagtggtttctcaaattgaagtcatatatacctagagaccaaatatctgacttggtaccatatggtatatcagcaagaagttctggacacatgtaacttggtgttcctactacctgtgttgggagcaatatactactaagagtgacatcgaatatgtactggaaatatgaaaagtgctacaattacttacagaagatgccagatcatcagaagtcaatatttttgcaagcccaaagtcacctgcattggtttaaatttggaattgcaacattaccaggattgctaaacccatacataaagtatgatactttttgggactaagatacataccaagtcttatactttggtccctggcaatgaaaatattggagcactgaaacgaatttttagcagctttagtatatattatttccatgccatggaaatataaatactataaggtactcccaagtttagcactactactgaccttgacatctcggtgaagaatgtggtttgcatgtaaataatctagagccatgagaagttgcacaagccatttgcaaagcttctgaaaaaaaaatgagaaaaacatttcagtgcacatcccttgtttgcagcaaagcaatttttaaggtatcaaaggaaatgcaaggtcagaatccacacctcctcagagaaatatgtaccattagctctttaatagcttcagccctgaaccgattatagattgtgttagctaaggaactaaagttcaagaccaaaataaactattttaaaagaatttcatcaaaggaacacatacatgtctcctcccttacaatattctatacaaatgcagacatagcaaccctgaaaaatccaaagataaagaagtgagaatgaaacaaatctattccaccctcccaacttcataacattttcttcagtccttttcaacaacgttctccacccatgaatctttgtactccacgataaacggattcctgaccgtcgcaataagttgcatctgcatgaggagcatttccacataaatcagtataaaaaaaaaggaagtaccgcacaagagcaagaagacatcacatcattttacttcacagtttcagatcagttcagcaccagccaaactaaacacactagcatcatcatcatcaccaccacccaacacaccaatttatgcagctcatggtgaacacaaggcattccccttgaaaccatagcttact

SEQ ID NO: 47400 - DNA, 8158 bp, Oryza sativa
  unsure (1)..(8158): unsure at all n locations
ttcctgcaccccacctcctggttcgcagagcggcgggtgcggtcggtctgccgcgcaagccgaatcttcttcagcacatacctgcataaacacacacacaaacctccaacatgatcaaaatggctgaaataacagtgagcttcaagaatgccaaaaaaaaaaggaaagaaagaaaaatgagatgaacaatgtcgagtcaaaagctcacttcttcttctccagcttgtgcctcaccaacaacgccgagccaaacgcccctttcccaatctgctccagcacctcatactgatccatccctttttcctacgagagacgcccccaagaaaccaccgcgaagatccaagaactcgcttccccccacccaaactcccgatcagcaaaggatcgatctttgggcccccgcgccgacgccttcacgcgcgcagatctcgccgcatttgatcggaggagagccaaggcaggggcaccgagaagagaagaacacgagccgcgaaattgaaagccgcagcgagggaagaacgaaaatgaaaagaaaagaaaaaaaagatggggtttttggtggggttcaatcaaactcgcttactcccctcagctttatatagcctccaaaaagccaaagcaaatgaggagcaagaagaagaggccaagctcctcaagctcctcgaggagagagaaagcaagagcaatgctagagagagagagagagatggtgatggcactgaagagagagagagggaggaggaggaggaagaagaagaagagtgagagatgactgaggagagagaaagagggggtgtgggccccactggtctagtcaaattagtgctctcttttttttaatttatttttttaaaagaaaatattttgggtcttttaggttgcattgatccaattggtgtttgtgaagagaacaaaaaggaagtcattagtgtgagtatggctacactaatgatatggtaacagtgtgtgattatacaaagtacctacttgtggaggtgtgggtaccactgattttttttttttttgattttttggatgaactgagaggagaaggcatgtgatcagatgagaaatcaaagaacaaatcagtacggagttcgagcctgcttgattttaaaatttggggggtttgattttatgactagttttagagatttcttggtcacttttgttgtccaaatctctttacatgttttcgttgcttgaaaagaaacaccaaaatagcataatttcattaaagacagctactagtttttttccttttctggaaactgattctatttagctagttgaattgtatatgcatttttctcttgacatttttttaacttttttttaaaaaataggacaaaatccgtatcatttgtctatgatgttagggtgattagtgatggggctcacactatacacatttgttttataatgtagccatttctcctgcaactactactaacaccacttgcagcattatactacttcacaattacactatcaaacaaagaagtgaaacattttataatccaactatccaagcagtgttagaggcatctgaaaagaaaaaaaaacacatgtacagaaagcccattggatgtagcctttgtttggcatcttctgaactcaagagaaagttcacagataacagattcattcagatatggtagtagtgtagatggagaggtgcttgctttagctggaacaagttcagaggtgactttgggtcattgttcattttgctagggtccacacgtcagtcactcaaagtcaggtgatgttaccgcggaggattcgcttcgtgctttagctagatagaattagatttttgaagcaaatcaaatcaaattgctcagttcctttcatcctttaatttcttgctttctttctttcatgtgtgctgcttctgcgatctctgcttttggctgcatgccatggctcctttctctctgcctgacaccagagcattttgtgcaaagcaatgttccatccattccatatatcttcttttgacacgcctgcaatgctgcttggtaaagcagatcgatcacattgatgtttattgcaacagaaattgttatgctctttgatcagttgctctcaatgtttagttagtacatgcattgcattttacaatcactgtccatttggttggttaagtcaccatcaacctaggaaagcacctaatgtacccatccctccttttccatgcatcaaaagtataggcaaattaaacaaaacactttcatgcttaccaaattgtatgggatataactagtgggaatcatggatgaagcttaattatctgaagcaaagaatagcattcaagaatctcatcattattgtttctctaatttagttgctttaatgtgtcctatgtaagccatttattctgctattttggttctctctgtattatttgaaccctataaacacctccagatttattgcctgtttgaaacatagaaaatttcacctagagttttgccttatgtttgcttattagcttatcagccgtaagttaaaatttgaattttaaaagttagttttggattcgattcatagttatttcatcatagcttattttttagcattggttttaaatgttaataacacagcttatttaaaaaaatagtgaaaaaataaataaaacaacccaaaaaaaatttatgggtaatattttttaagtaaaagttttaagaaaaaactcaaatgaattattgatacgatttgtgaaacacaagtaaagcaaataaaaccgtattattaagatatgtatatatcgtgtgatgtactgaacgtgtgtacgtgcacgagatgaaaattaaaaatccgacaggtaccgaactgggtctcacatggagggaacagtggaatccaatgcgtctatatatatgtgccaattaaattgaatataaaagtagaattagatgcatctaataatgatatgtgatagatgtggcagcatgagaaagtgacccatacttaacccctactattactatactttgagttggatctaatcctagcatgtaaaaatatcactctagcaaaaataaagaaattcagaatgtcaactcactcgagtctgatccaattgattgttagttttgctcttaaggtatgctcctatatacgtgcattttgcatctacacccttcttgaaatacacgttttttcatagtggtagtaagtagatgttcccagtgaaaatttgattgtgataatttcttatttgcccctgcaaaatacacacgatcaatcatttatttactcatgacgagtcactgacattgggtcctagatccatatgtcattgagagaatgagaggaaaataagggatcgggttaattgtagaggcaaataatgattttatccaaatttaattgatccactacattgaaattgagggtacagttacaaataaggcctctaactttttttcccttttgctttatctgcttctaaaaagagccagaaatattcctgattccattgccatgcagttccatcacaagctttttgtttgacagtttgactgcatctcctatcaacctttttgccttcgctttgtttggcaaacgggataacgtacagtctccttgatgcaaaaaaaaaaaaagaaagaaaaaaaagaaaaaaaaagaagaagaagcatgcctaggtgactggcatgtgggtcccaccccaagcttctaaacactgttgcttcgctatgcatgattccaaaagcactaatgcaaaacagtgagcatgcaattgagtagcaagaactaaaagatatatggtcggtacactgaagaaaaacaaaccttcaaaaggataacaatgtctctgtttcttgcaaagaagaaaaaagggtgctgatcatgatgttaacttcctactactgttgacttagaatctcaattatgtccaagatatcactctagctagcttttttttaaaaaaaaacaaatcctgaattgtggtgtaatattataggatgggtgtattaataattagctaattcatttaacaaaatatttagaattttatctccctatatacctcaacatttcttttccaaaaagctaaattgttaaataacagaatgatggaatgatttagcgatctctattcaagagcaaaaaggaataaattaagtacataatataaactttaaaaataaatttataactttttaaaagaaattcagaaatgaaaaacttttgcgaaaaccacaacgttaaggagctcaggcccattgatccatttctccattcctttagatagaacaaagaaatatacaggctggagctcgattccaagaagcaatccagaaatcaggaaaagaaaaaaaaagaaaccaggaaagttaaaaaagaaaagatcaggggaaaagaaaaaaacagaaagcagatcgagaacacgtatacgccatgtcgatgcatgccgtaatttaataactgcagccaaaaggatagaggatagagttgatgtcatgcgtcccttctgaatctccgaatgtgtctgaataagtttttcagcgatgcatcgcgctttttgcttacctgtttctctccaacctctttcttggcgtatcatgcgaagatattgattcaccgtgtttactacttatcataaactagatattaatccaccgtgtttactactcacaacacaacgcgcgaagctttcatctgatagaaatgtatttttgtcaaccctgcaatcttcgctcgacattggcatttgaagcatctaaaatttgttcgcaaatataaataatctagaatacctcttgtccctacaattacctcttattaaaatttcttcccatctttactacttatcaccctctcacctcatccatcgatccctcatttatcgaaggccaccgattttttttctcttagcgttaattcaggttgaacaaacataaaaatgcatatttataaacggagagagcatatatatatatatatgtcagcgccatgcaatgtcaaggaatgcactgctgcaactgcaaacaagccttgtattttttttttatatagccatttaaattggaaacttagtcccacgaacatgccaatctaaaatttcgctcgtatgaagatttaaaatcaaaaccttaagatgctactgaggtcactgcaactactaaactatacaccctttggcaagcatgccattgcaagcctggatcgagtcagactcaggggatgcatacgccattgcaatttcgattgcgattgacgtactgtttgaagagagaagactgaaacggagccatctccgccattactgcggcgaaagcagcagcttcgtcatgcagagatgcaggggcatacgtgacggccattaatacaaggagatgaaggtcacatgctccttgctccccttcgccagtctcgccggaactgacggcctcgacggcgaccggccggagcggcggagccattcatgctgctgtacctgctgcatttgcatgcgcatccctctctacagtctacacacgtgttgctacatctggtctaaggagaagatagaagaagatcgaatacgtaaaatgagataagtcatcagcacggaattagttaagtattaattatcttaaatttaaaaataaattaatatgattttctttagaaaaacatactatcttcgtcccaaaaaaaagtgcaaccgtggatatccatgtccaacatttgatcgttcgttttatttgaaaaatttataaaatttttttaaaaatattagccatacataaagtgctatttatgttttatcatgtactagtaacaatattaatcgtaaaagtttttctaataagacgaacggttaaacattgaacatgaaccgtgtaaaactacacttattttgagacggagagagtaccatttcgcagtccaccagggagtgcgcatgcggagaacgagtttttctcccaatccccatgacttgaaacaagcaaaatgagcatactacatcatagatgctagtagctagcaaaatgagcaccaataaaagacgcagtaagcatgaatattgttactagtagctagccatccaaagtggatgaagcagatactagcaattgaaattctatgggtaggcttctctaataaaacaaatgaatctcttccctcccgatcagaaatggagccaactgattttgaacattgttttgtttgattcatgtgatgtagtacctgcaacttatctccttgttttgttggtatgcacgtacagtacggtgcttttgtactgtattttagttggttgagaaaatgtgatcggataaagttggggaaaaaaagatgggaatggagatgctatgagtcacgaattaattgtatctgttctcaaccgatgcaggcatagctgtgtacttcgtacaattgtacatcacatttgtcagactgcagagctactgatggtgatacatcacatgccatagtttctagggcatcgccatcaattcatcgtccatatgtactccagatgccagaagtcatcaggtcattttaaaaaaaaatactatgtgcaacctatacaagcacaattttcttatgctccataatagtggtaaaagatgtggtcacagttgatcacaggaatgtagaatatggtgtctaaattttgaggaatcaaaatctgcatttcacaaacccagacaaaagcttgtatacaatggaaattgcaccacttaaggcatatataattaaaaaaccagatcagcaaaatttgtgtgcctcggtgtacaatacagatcaacagcttacaaaatctggcatgcaaatctaagctctcaccacgctatgaaaaatatcccctttgcaactgtaagctaggaaagaatatgaccacaacaggggaagaatttgggagccattcactgtccatttgttgtttattcaagccgtttctttgaatatacggggaagcacttcgtggatgctaatgtccaggagctcaggactcctgcagaaatattaaagaagagatatagtacactatataaaagctggagacacccacaagaggagggaatagacattgatggttatctaacaggtcgggaaagcaaaccctaagtcatgaatgaatggtgcaaagtttatagctgtacaacaggtacaacataggtcacaaaaagtgctgagcaccacaagatggcgcaaaaagctggaacatagatcaattatatcctaacaaaattcatagcaggagaaacatgccagcacaatgcaaaggttttctatttatgtttactactaattccttgagaaattgaattcctcaaagtaaaatatggaaatgcagatataataattttgtctcatgaagaaagggataagtacctgcataatactcgtcccttttcagttgtgctagggacaaaccatatcttccgcagaattggtgactcaaattgcacaaagaaaccatcactctggtcaagcttccattttcttgatccctgtcctttccagacctgtatataacaagatcattgttagtctatcattttcattctagcaccaaaaaaggaaatcttatgcgctgatttaacatgaacaaaagaaaatatattagagccaagcatgcagcaacacaacatcagaaaatgataggcacaaatcatacagggcatggtgacacatgaaagaggggagagggtgatttgacctgagggtacgagatggcgctcttaggtgctaccatacaagcagcctttgagaaagactcctcggaatattgccgcaaaaatgtgaagcaactgctgtgagtgtggggtgagtcaaaggcctagtaaaaaaagaaaccagataggtgttaataggagacaatgtcatggattcagaatagaagccgtaacagaaaattgaagatttacatatgtaaaaaataactagatcctaattctgttaaagaaattgactattataaatttcaagatgtctgcctatttatgaattgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47401 - DNA, 16411 bp, Oryza sativa
  unsure (1)..(16411): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaataaaacaataaaatatgaaggtgaagatcattatatcgagcaagaaatgtcaaatgtcaaagtacatatgcccaacctgaagaagctatagtacaccctacccaacttaatctaatctgtagaactgtagatcgattccaaatctaattaaaaaaagcaaacccattccattcccatgcatcaactaattaaagattgctagaaggagagaatatatgcaagaagttgggcgatttgggatcgatgccgccaccaagaaaaaaaatatatatttgaagcatcagagaagtgattaaaacagcaagtgaacacacaagcaaacgatgtataaaatggcatggaggagacgaggatcagtgctatacctctagctccgacgagaggccggtgcggcggcgagacgacggcgatgatctccacctccacctcgtcgtcgtcgtcgccgtcgtcgtcttcctcatccaccatcatgctgaacctgaggaactcctcctcgaactcacggccgtcgtactcgtcgtcgtcgtcctcctcctcctcattgtactccacctccttcccggggcggtggccgcgcggcggcgccatctccaccgccaccaccgacggcggcggcggcggcaggtcggcggcgacggtgatggcgtggtgattgtcggggcctcctccacacatggctggaattaatggatcgattggattctccaatgccggatggagatgttgcagcagcagcagcagcaacagtaacagtggaggtagctagctagctgaaaaaagcaagagagctcactctctctgtctggcctctgccgactcaagtgaagaagagacgagacaatgtcaataaataataatggaccaaagcaagcaaggcaaagcttcaccgtcacagctgcagattcacaagagggacacgtgatagagacacgtacggtgtgtgtggagtagcaagttgtaagcctattttctctgttctaaaatctatctaaaatatcaaatcacatcatatatatacacgacgactaagggtgtgtttagttcatgtcaaaattaaaagtttggttgaaattacaacgatgtaacgaaaaagttgaaagtttacgtgtgtagaaaagtttcgatgtgatggaaaagttggaagtttgaaaaaaaattttggaacaaaactcggcctaagatgcatcagatcccatttagatagtgatattttgagacgaaggtatcattacctaatagtagcgctactatagtattcccttcgttagaaaaaaaggaaaaacttagcctatgataaatgtgatcaatctcttttagtacaataaatctagacagataattgttcagatttgttatactagaaatagtcacatcatctagtttgagttttttttggacgaaagaagtatgtagaggagagaggagagtcttgagatgaaaagtgtgctatagatttatagccatttacagtacagggctctaatatattatacgtctgagagataaatcaaatattaatggagtagtatatatttatattaaactattatgtagatagtcgctctaaatattatgttagtttttagagttatttttagttaactactttcttcgtttgaaaataaattaatttataagggatatgataaattataatatatactactattaattaaatttgctctagtgcaagcagcaacgagccaacgcagcagcagtagcagcacagggcggaggcaacagaccagacggcacacatggctcaacttgatttgggggctcgcgcacgcacacacccctgcacactgttaagagcacccgtaatggttatctatatgctctctacaagagatccatgtcatcatattttcctacttggaagagattaaatgaagagagagagtaaaactatctactaacttagagatagtctatagagaaaaacgaggcaatggatgagagagctattgatacccatgtagacatactattgaggtgatttactattaatctaatctattgctgagatgtacatgttttatagagagcaccttactttaccattgcgggtgctctaatatcagctttaccttctactacctccattttttttaagtgtagttacacggctttcggttaaacgttagatataaaaattcactactatattttaaaatgagacgaagggagtactgacaataacaataagtaacctagctgtagctttatagcttgctttgccatgtgcggccaaaaccctgggcgcactcaggcaggcaggaccaacagtccaaggtccctattaatatagcactagttcggtatgaattatcatgctttaatatatatgtagtaactgttatccatattaattgtcatgctttaatatagtactagttcgatatgaaactaacttgagtgagattaatgacgtgtagattgtggtgccagtattattataattttgctcacataatagcatatatatatatatacacgttaaaataaaataaaatgataacataattttaaactctgatctaactcgatccaattgaccgattcctggtactttgtaattcatatcttcataaaaccaacgtattagatcgtttaacactagatctctcttcgtaaagtcggtattgaaagccatacggaattaacacggtagcctatcatctatattatcacctatcatatagagcttgcttgctttcaagctaatttttcactgccaaaaccttgacaaattttgacaataccaaatttgttataatagaatttgtacttgtgtgtataaaatttaacatcaaaccaaacatccatacaatactaatggagttgtcaaaaaaattaaatataattcaatgaggataaatcatcttgtgattgagcaatgtcttcagcctggtggagatcagagaggagacgtgcgatgacggcggacctcgggaggatagaaggggtagcagcggaggtcggggaggagaggaataagtggcggatgtcgaagaagagggagagtagcagcggaggttggagaggagggggagtagcgatggaggtcgggtaggagacacatgatggtggtaagcctcgaagtggatggaaggggcagtagcaatccaaatccacccgcccaaccatcctaatcttcttccctcttctcctatatattctatctgactacctccttcccctttcttgaagggtgacgctgatggtcccgatgaagaaggtagcagtgtcagcagcaccattggtggccttgtggaaggttgatatatggagctggactcaacaatagcacgattccatcggccatgcggcatgtggggaagaaggggaatggttgacggcagcaataagtagaggtggacctagaggttggttgttgcctcttcatccttgaccaatcgtcttgcaccatcgccaaccagatatttgctcccccaccccctcccttgacttagctatgttgaagaaatgtgggtgaggttgtcagatgtgcctcatttacacataggtttaaaaatagatttaattgtcacgttggatgccatctaatcgaaacagtacgtaatgtataggaatagaggggattattcgtccggtttgaaaagtttggacctatttagattactgtaaaatgaacctttccaaaatttgggaacgctaaaattttaccatgttgacagtattaccaagctttggtaggacaaactaaatatgatgttatcaaaatttcctaaacactaccaatgtttggtaacaaactaaaagcatctacatgcttatcaattttaccaaatatgatacggtttaaattggtatcaatctgaacgggtccttcagagtagtttgtagtttagtagcttaattcggatgatcgcagtagttaagggtaaatttagacatttcccttaattaaattgaaccatatatatgagatttactttgttgtgtttgtctctgtttcctcgacagaaggtacgtacggttgatgcagcaacagcagcagctgctggcgcggcacgtgacattaatctgcacccatcgtgattaacaacctgttgatccgtacatctccctttctgtcccaatcgtacacacagtaattaattaagcacactgcaagttgtacaagtggccatcaaagggaaatgacccgtgaagggcacctcgccaaaaaacaggaatcgatactgtaaacaacgaccctgcccagctggcctgtctgtacatactatatattcagagatttcatcagactatcaagctagccagtgtgccacacaagttacattgtacccccccccccccccatcgtccttgtgtgtatctgtgttcaatggtttatcgttcatcttattttaaattttttttataattaatgtttttattattattagataataaaatatgaatagtattttatgtgtgatttattttttttataaatttttcgattaagacggacaatctaattaatgttggacgcaaaaactcgtaaatgaatttattttgggaagaagggtgtattgtacatagtacagtactccgtactatgttaagatcaagttgagggtagatgtgaggatgagcatgaatctttttgcacgaccctacacgcatatatggatgatcgatcttatctatagctagttttgcacactggaatgaaacgatcgactaatactgccgctggttttgaacggttggcgtgcaaaccaggaacgaatttcaggggccgtttgatgcatgccaaccacacacgtttgccacaccttaacaagtaaaaatcacattactcacgatttgagtaggaaccgggactaaagaatatctttagtcctggttcaaaagcccgtgggtactttttgatctaaccgggactaaagatcatttttagtcccgattgaaaaagttattagggtgtgtcaggccccaaccggttaagcagtatactttttcataaaaaaatatatattactttaaaaatcatattaatcgatttttaaagtttctagcatcagtatgttttgcgtgcggggaaaaaagtttccaaataccctcacacttataaacgagtacacacatcctacccctacggacatttccgaaaatctggactggattattttgatattgataaagtcattaccaccgtctcgcagtccagacctcgagggtacgtcatcttcaataaaaaagataattagcagtaaatgtaagcactcgtcctcatgatagatcacctcagatcgagagagatgatagacacgtggggacagtagagtcagtactaatagcccgctctgtcagcccagataaaaaggaaaggtgaaaaaatcgtggagagatcaatcaatgagtaatacgattacagtgccccttactttgtgggtggctcgcccggaaggccaagagccaaggcccggaaatagacagactatatgcagagcgtgctggcaggacagcacaaggccacaagctagtggagtactactagtagtacgtccttgctctcgacaaactgggcatttaactaatactacctgtttattttttactcatttcacacattaaacataatagaaaaatcagaatacccctactttatcaaattttgaggaaactatgttttacttaatcgtctcgttaacatgaaataatatttttagatatgtagcatgtcttattaaaaaaataaaatttgattgaaacctgtttcctacgaatatatattcacctatcaaggttgaaatcctacttcctacgaatattatgcacacacatgtataagcttttaatatgactttagtaagatcagaaatgtatcactggtttttgtctttttaaacgtatgttactgagcatattcataagaaaaaattcatggacaagataacgaacaaaagtagtcatagttcttttcgtgcagggcttagcaggatgagaatcctaataataataatgatcacaatttcaatcgcaaaattgtgcgagagcaccgtagttgtccttcctagcccctcatttattttgtgctgatcaatcttttttcatccctcagtacgtcttcaagttgaccaagcttgcaagtttgtgggggctaatacactacacatgcatttatataatccaacaacaatcaagatatacatatatattctttacttccaatgatcatacttgtctccggtgatcgtatgattgatatatcgagttcgagacacaaaaatcatgaaacattaatctaacatggaatcaagttgatttgcatatatagtccatatatatcactaattaatactacttggtactagtagtaattaattaatctggataataatggcagcaaatatatacaccgtgtttagttgcaaacttttttttcaaactttcaacttttccattacattaaaactttcctacacaaataaatttccaacttgtccgtcagatcgtttcaatttcaaccaaactttcaattttagcgtgacctaaacacacccatagtttagttttcgataatggcgatcttgcacgtaattaacttgctcgatcgatcagaagctccagagatcatcgccgacgtgctcctgcccgtcgccgccgccgagcaggagctagcatctcctggatgatctcaggagcaggagctaacattattcagaagccaaattggatttgggcgttttggctaacaattaatgggcccctggtgaatctgagacggtaaactgtgtgagctagctagctgcattttgataaggaacatatatataggaaaactagctgctgcggtcggtataagtaaaaggaaaattggctagcacttaattggctgaactcagattatttatgatttgtattaggtatatattaactaattatatactacaatttctgttgtacagctagaatgccggttagttttttttttcataagagataaggagaattgccatacaatgtcggtttgaatttttcttttctttatatttttcttcaaacatagggaggatatgatggttacaataaatatctctgtttggatgactctataaaagggcttggaatacaatcttggatatgcatgaatttacatagtagtgtacgtgtatcctttataactcagagctagctcatgagatgagatcaataagaatgcaacttatcctccatagaacttcttgtgaaaataaaataccacttcctatctttcatattaaaagttgtttatataaaaatattgtaagattttcaatacaaaacaatcatattatcaaaatatattcaatgttaaatttaatgaaattaatttggtgttacagatgatgctaattttttttataaacttatcaaaccaaaaaaaatttaactaagaaaaaaatcaaacaactataaaaaaaattagaaacggattggagttctacacttctactagctatctcattgggaatgaagaagtacaatattccatgcgtggaatagatctatcaaattaaaatgttaatagtaattcactttgcgtttctaatggaactttcaagctgcaataaaatatggaggtgaagagatcctagttacaaatgtcaatgctagctagcatgcccatcctcaagtgtgtgtgtatcccaacttaatctaatgtgtagtagaaaggagagaatggccgatttgggagagaatttttttttaaggatgatcagaagaaaacgcatgcagaagaacctttaactccgatgaggccggcgcggcggcgagacggtgatgagacctcgtcgtcgtcgtcgtccatcgatcatgctcacggtggtcgtcgtcctctttcccgggacggcggccgtgtgccatcaacgcggcggcggcggcggcggcgacggggccggtggtggttgtcgggccggggcttcttccacacatctttcgatggatggagaggtcgtcgtcgtcgcagcggcagcggcagcagcagtgacagtactggaggtagctagctactctactgtctactctatggcctctgaagagggaggaggaagcaatatacagtactacctccgtccttttaagtttttatttatcaatatttgatcattcgtcttatttaaacaattttagaattattatttattttgtttgtcatttgctttattatcaaaaatactttacatataacttatcttttttttatatttgcactaatttttcaaataaaacgaatggtcaaatgttgtaaataaaaagtcaaaaacatcacttattatgagacttggagggagtactaaattaatggtgaccctaattaggagtagagaacaagggtcttgtttagtttcaaactttttttttaacttttaactttttcatcacattaaaatttttctacacataaattttcaatttttccgtcacattattctaatttcaactaaaattttaattttgacgtaaactaaatacgcctaaggaaaaccaatggatcgatgaaaagcttttgcttcacacaggcgccctagccacagctgcagcttcacaagaggggacacgtatacagagaggggagtagctaccagcagcagcagtatccgtggacacggacacggattggaccaaatcgacaagacgacacacaacacgcggctgatcatcttgatttgggacctgcactgctactgctgctagctttacccccatttctctcacctgcgagggcagtaacaacaatagttccaaacatttttgtttgaactttcaacttttacatcacatcaaaattttcctacacacgtaagcttaaaaaacaaaacaaactctctctttttcttctgctgccgaacgtagcctaagagattatgcagattgttaccaaaataaatcttactaaattttatcaatttagtaatattatcaagttttttatgatttctaacgtatttactgaagtttagtaaaaaaaactaaatggatacgcatcttgatcactttatctaaaaaaaaatggtaggatttgaaatgacatcagtctaaacaatctccctaagtatcctagctagcttaaggttgagtttaggagtgagggttgggaataccttcactcccgacatgcaaaacggagcaacggttagtgcatgatttattaagtattagctaaaataaacttgataaatggattaatatattttttaaagcaacttttctataattttttttaaaaaaatatgtaccgtttaatagtttataaaacgtgagttagaaaaggtgtgggaaaaacacaacctaagtttagccagtgccattgccatttccgcccaagaaacccttgggcgcacgcaggaccgccaaagtccaaggtaagtagtcccatccatctctcttattcactagcagtacattacaacctttaatttttaatagatgacgtcattaatatatgaaccatatttatttatttgtcttatttaaaatttatgtaaatgtataagatataaatcatatctaaaaaacttttaagtgataaaacaactcacaacaaaataaattattattaaaatattaaataaaagataaatatgtgataaaaaaatcaacggtgtcatatattaaaaaacatagatagtacatcagaaattacaatccatgcttaactataattacttgagtcggtacaatacctctacatcagccgggtataagggtattatgttacacatcaagtttgttctgagttggttccaaataaattatatgagagagcaaaattagaatccactagcaagttctagacttctagtacgttaaaatccgaagaatcatttgtttagctatgcgggtctaggtctgtgatccctcacatgattttgtcagcttgcgtagccgacaactaatctatggagtacattattactttctcttaattatgtacacttaataatatcatggttacaattgtcagacacaccaaaattaaatatggtccctctcggagcttgcaatattgggaagcatattcctttagcttagctagctagggcataatgctattcgatcgattttttcagtggcaagcagatatcaatcgttttgctagacttgctcggctgagctggagcttctctgccagttaatctctttgatgctgttaactttgataccatttttaaccttaccaaattttaataaagttgctaaaaaagtggttacatttagtttgctgctaaattttggtaactatataggaaatcctgccaaaattttggtaagttgccaaaattttgacaactatattaaaattttggcaatgctaaaatttgataaggttttttttatcaaagtgaacaggagctgagattttactgaccctagtagctgcgcagtaaccatagctagctacagctaatccgagcaaagggtagtaatatttcgattatttattaattgatttaattctctcaatttgaactcatcaaccccacatgtacatatattgagcttagcttcttatatatgttgattatgcgcagtttactgttgttgccgttgtcattgcacctccctccatatttagcatcgggattctctataatactgttcactaacatgtggacatgaggatctataagacccacatatcagtgagtgtgtgcagtacggcagaggaattgcttcccatcgcttagcttcactgccagcaagttcatgggcctttttcacaacctaaaatactccttaatttatcctaaaatgtactgcccatactatcccatattctccaatccggatttatatcttacctttcctgataaggcaaacaagtctttctacatttctctccttaattaataaccatgtcattttctaaaaattgttagtactgcatcttagtatggagggagtagattgatgagccttcatgtttcaagctataatgttccaccaccaatatatcaaaagtgtgagcctaaaccaacaacataaatttcctcgttaccattagccacgtatcacataattatgtgatcttgaagatattttaaatttcaagagaccattcaaactgtataacacctgctatcttgatcagccttataatataatactagctagatgaaggcagtttaacatttggtggcagtttaacatttggaatttgttctaaaatataattaacttattcaccagcattctctttctaacctacgattcaatttctgcacttaccttcccttctcaactaaccacaatatttactatgtaattttatctacctttttaattaataactaggacggaggtactatatatattagccaaacaataggcagctaaattatacacgttgtactattaattatgtcaagacttaggaataatatatacttagtataatttaatttaatcacatgagatttgtatatactcctagtataagtttggttgttttctgtcgctgttgcagaacagaacgtacgtacggctgctgcatctgcatgtgacaattcatctgcaccactcgtgttaatcccagtcatgtcctttcctctgccccaatcgtacactaattgaccatagtaccacaagttgtgcaagtggccactaaaggtaatgacccagcgaattgaagctcacctcgccaaaaacagaaattaatataaacaacgaccctgctggcctgctctgttccgtaccccgtcgcctgtaacaaaattacttaggctgtgtttaattcacatcaaaatttgaagtttggctgaaattgaaacaatgtgatggaaaagttagaagtttatgtgtgtaggaaaattttgatgtgatgaaaaaattagaagtttaaagaattattttggaactaaacacggcgttagcctagtactcctatcctaacatactacatactatacgatcttttagtgtgtgtttagttcacgttaaaattggaagtttggttgaaattggaacgatgtgacggaaaagttggaagtttatgtgtgtaggaaagttttgatgtgattaaaaagttggaagtttaaagaaaaaatttagaactaaactcggccttatattataatgctatgaatctaatatccagattcatagtatcaagatatgtcatatccgatactattaagttattttggaacgaagaaggtatgtatatttttctgattcaatgatattcagggggtgtctagatacagaggtgtaaagttttagcgtgtcacatcaggtattatatagggtgtcgcatggggtgttcggcactaataaaaaaactaattacagaatccgtcagtaaaccgcgagacgaacttattaagaataattaatccatcattagcaaatgtttactgtagcaccacattgttaaatcatgaagcaattcgtctcgcaaattagtcgtaatatgttcaattagtttttttttagcctatatttaatactttatataggtgttcaataaagttttaggatgggatgtaaacatgtaatcaattttataaataaattaagcaccatccatcaggctactccagctatatatagctagggcacacaagttgcattgtacggtaatactgtatactgacttacagccgaagtagtatgatgaggatgagcatgaatctgcagctagtaaattttgcacactggaaaacgactgctgccctggtttttgcacgattcaattttgtatgaccatgatcggggaaggtgacgctgtgacaagcatatatgcacatatattcactgctagtctgtagtagatataatagggctgtgtttagtttacgttaaaattaaaactggaacgatgtgacgtaaaagttgaaagtttatgttagtaggaaagtttgatgtgatggaaaaagttggaagtttaaagaaaaaattaggatctaaacacggtgtaggtagatgattttgtaaatttcaagctcttattactagttagtatattatatctttattattactttcattattactttcgttttggttgccgattattacacgatgttcgtcataacgacgtttaattagcagctgacgccctagctagctgcaggccttgttttgactttctcatcccacagcccggcccaaatagttctgatcctctcagatgggcctgtcaatagcagagaatttggcccatgagatttctctttcttttttctgcggggacggcccatgatatttaacacgtgtggttactgggccggactatgtattcagaagaggaccatttttctttttttttttgcgcaagaaattattttgtaccccattctgccaatttaactctgcattgaaactttgtccatccgagttcaagtcctagactcagctcacgtgctagcatgtgccaggacttgtcctcgttgtactatctttatgaataaaaagggacatttttttttcagaaaataatgtacccttcatttgtttcccccttttattatgtaaattaaatggtggtgcaaaagaatcttcatgcagataccatatgctgcttatatttattcagatatcagggggacttgtagcagcagctgaaagcctgaaagtgatcatatccatgatgtgtgtggaactgttcttgagtgacgacgacatgttgtcgctgcactttttggagcatagtggagataacatattcttctgtacttccaatgaggagaaaggaggatggtcaagttgataaactagtttaatataatgcaagagattatggtttcagatctaggatatctcatgctctggatctttcctggattgttggcactttcttcaaccacaatatgatcccttgataagcacaaatctctgttagatatatgtctaggaagttgatatgttcatcacttatccaatctttgtctttgttggagtatatgtagtatatccctattgtcatatgctactccctcgtttactgtgggcacactttttgaaccgttacactgtgtttttttaaaaattctctatataaaagttttgttaaaaaatcaataatttttttgagtttataatagttaatatttaattaaatggtgcactagcggtcccgtgcctaagtcaaatagtgtgctttcgttttcacctttttactgatcaatgaggttagagttcagaatggccagcttggttcagaaaacgagcctttataatgtcatgaaccaattaggagatgggctgaatttataggctacctgttttggcagtactaccggtttgtttcttagctggttttcaggtcaaatcacagtttaatttgccataactatttccaagttgcatctcctatgagttaaatctttggcaacttgtggcatcttgaaaatttaataagtaaaggtcactttgattttatttaggagagctatcatgacatgacatgtatatatgtgtgttcttgttcattaatgggtgttattgacagcagttaacgttgggtttcagattgtgaactgatcaacactctttgagcttcaaagtgtccatgtaacttctctatgcttttccagaggaaacttgcaattagctttagtataactaacaatttgcagttattaatgggtggatacaaaatagtactctgttatcttcacaacactttccaggaaataatggttttttttcttgtcagttcctgcaattggctgtatcatgtattttgcttgattaccagttgatgtggttgttaacatctgtagtcacactcatagtatgtcatgaactcaaggtgccaaggaacctgtcatttcagacccctgaaccaacggctgccatgaactctacctcacaaccttcactctcaccttattcaggatatcgatcaaatcattcagaaaatcagtcaacagaaagcttcattacattacatggaaaaaactgaactcatacatacatggaaagtgaccctcttataatttctctcctcacatacataaaattagtcttattcaaggtcattaattaacagactagtgtttcaaatgctaggatcaaaaagggaaatatgctcgtccttgatgcatgagcatttcctgtggtgtagtgctgaaacaagtccagacatgacatcccaattgattgagtgatccatctgagtctgaaatctgaacaaccattttatgtagtaacagaaggccacaagtgagccaaacatgtcagtgtattttggagtgtcttcatgctctaaatttaactcacttcattggtacatgaacatgtcagttaacaatagcagatactcatactacttggactgtgactgcagcttgtcttcttgttgaaaaggaaggaaaggattagttgcaggatagcaggtgatcaacaattagcttaagctctaccttttcagcccaatatgggagccagcttgatcaaacccaacatctaatgcccttgtttaagtagggtttgttatcaacttatcataatctcttcttggagaggttatagaatgataaaggcatccatgcagtgatggtggcacctgaactttaagccgagctttttcagaatgagagtaggcacacattttcaatatcacacaattcatccttgaattgatggtgacatagtgttactgttcatgtactgaacagagcaagatagtctctgaattgttaatacagaacagagcaagaatatactatcttttgttagaataattgggctaggcccaactataacattaaatctcaaaggcccataataagtgttgaggataataataccacctcaggatttaagcgagaaatatctcaacctaaataaggagttattggaggctccctgttgaccagttgaggtaggggtcggaatgccacacgcgcgcgcgccgggccgggcgtgggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgtcttcttcgcttctttcccggtgttagtttcttcttctccgcgtctgagttgctctcgcttcctcgcttctgatctcttgcgcgcacgaaagattggaaagatcaatgccttcgaaaccacacccttagctgaaatctgcaccgggtaggcggg

SEQ ID NO: 47402 - DNA, 1642 bp, Oryza sativa
cttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggtcgataaccgttctgtagtagaacaagctcatgagattcagatgctggctaaagaacttgagaacaacaactgtgagttgccggacaagtttgtggcgggtggcattattgccaaactaccaccttcttggtcggactttgccacttctctaaagcacaagagacaagagttcagtgtttctgatctcattggctctttgggtgttgaggagaaggcgagggcaaaggacgtgcggggcaaaaaggttgagggatgttctagtgccaatatggtacagaagaagaaccctcatgcatcccacaacaacaagaaagtcaagcctgatgtcaaacccaaggctgcaaccaattttaagaaaaaaggcaagggaaaggcaaagggagactgctttgtgtgtggcaagtctgggcattgggccaaggactgtcctgagcgcaaagacaggaagtctgccaacatggtcattagcgagggcggaggaacatcggggtacggtaaaatattacctacagttctctctgtttttcattcacctgattggtgggtggatactggtgctaatattcatgtatgtgctgacatttctctgttttcttcttatcaggttgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtttctaaatatgggacttttgttggaaaaggttatgacagcggaggcttgttccgcttttctttgaatgacatgtgtaataatcataatgctgtgaaccatattagcgagaatgatgagtcaaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcacaaggcgtctgaggcgaggaatttggcacctctagaacttgttcattccgatttgtgcgaaatgaacggcgtgttgactaaagggggaaagaaatatttcatgacactgatagatgattgtactagattttgctatgtgtatctattgaa

SEQ ID NO: 47403 - DNA, 8066 bp, Oryza sativa
aggggtgatcttgtgcttatatgtcaatgacatactgatctttgggaccagcttaatgtgattgaggaggtcaaagactatctgtccaagagttttgaaatgaaggatttgggagaggctgatgttattcttaacatcaaactacaaagagaagatgaggatgggattacacttgtgcaatcccactatgtggacaaggttttaagtcgctttggatatagtgactgcaagccagctcctactccttatgatcccagcgtgctattaaggaaaaaccaaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacaatgattattaaagtgaacagttcaaaggacaacatgaagtcatctagacaaatcaagagaagactgaaatctgtcagaaagcagaaaaactccggagtgatagcattggactatgtccaaaaggctagaaatctggcagatcagtttaccaaggggctaccacgtaatgtgattgacagtgcatcgagggaaatgggcttgatacccacctaaggttgcataatagttgaaacctgtgcattatgatcggagatcccgtgaatttggatggtgaaacaaactattgtgtgactaagagaagagacccttgaaaggggctcattttcatgatgtgcttctcttctttcatgcatggtaggatggcttatgtcttaatgtgatccgagtggcttttccaagcagagatgttgacctgcagaacatctcagaaggaacacatctatatgagttcgactgctagtcacagtctatgaggtttgggcgatctctagttactcatgaaaggcctggagtttgacttatatgctccaaacagaggggatgcaaacggcagcccagtaccagtcaaggttctgagtgaaatctgatcacacaaaactcacaattcaaggcatagtccattgttaagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaactataatattaaatctcaaaggcccataataagtgttgaggataataataccacctcaggatttaagcgagaaatatctcaacctaaataaggagttattggaggctccctgttgaccagttgaggtaggggtcggaatgccacacgcgcgcgcgccgggccgggcgtgggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgtcttcttcgcttctttcccggtgttagtttcttcttctccgcgtctgagttgctctcgcttcctcgcttctgatctcttgcgcgcacgagagattggaaggagcagtgcctccgaaaccacaccttcgcctgagatctgcaccgggtaggcgggtgatcaggtttttggggagtgcttcccgcacgactgctcatcgccatgtctggagttgccgccgccactgctggcggaggtggtacgccgccgacaggagctggatccggagctggtgcgccaggaggtgccgtgaacgacaacaacaacggaggcaattctgccacaccatccagcggagggccattctcggggtataatcttctcctcctgctactgttgttagcgctattcctgttccctttgttagcgctatcgctatactatgtgcgctatgttcttgttcctgttctacatgatgcctctagcatgttatcgcattactggtatgttcctgttcctgacattcatgatgcgcatagtatgctactggttatgttaagatcaccctacactgcttatgccatgatcattgtttcaatttcttggattaaaatatgccgattaatgactatatttccaacatctttttcatattttttttaccaaagattgttttttcttaatcttctccattattatactcctatttgtctctgttttttgcactgataactggagcaaatctgggccgagcaattagtagtatatgcagtcaaatgaacggggaaaaatgagaagtacatgaaaggaactgattttgtgactcaccatttgaatgaggaagggagaaaagtatcaaatctggagcttgatgcatgaacagttgtatatatgatgaggaaaatggaactttgcatgccacaactgtagcctcctataacaaaacttttattgtttactcgttttttttcctctgctttcgtaatgaggatctgggcgtatacttcgaatcatatttcattacgcacataattgactatttctgactgcagcttgtcttattgttgaaaaggaaaggatgattagttgtaggatagtacatgagctatgatgttttaactctacttttttcagcgcaatatggtaaccagcttaatcaaacccatctaatgatttagtttttaagtaagaatatttgtttgagagatagtatagaatggtaaaatggcacttgaactttaaactgagatttttgggaatgagagttctatacattatcaaatatggcacaattcatccttgaaacgatgtgacataatataacagttcatgtcctgagcagagcaagctagtctggatggaaaatacataacagagcaagcatggtatcatttttattatttttttgtcaaagagaacttgaatactctctaattcaacattgttttcttaacctttttcatatttatactcctgtttgtctctcgtttttttgcattgagaatggagaactctgggatcagtagatgtagtcaaataaatggggaaaaaagagaagtacatgaaaggaactgattttgtgtgactcaccaagaagcgtgtgagaaatgggaaaaagcacacaaatcatgcatgaacttctagttgtatacttgtatatgaagggtaaaatggagcagttaaaagtagcaccacataaatatcatctgctatcaccaaactgtgttctttgcatcttcctcctcgcttttcatgatgataaaccagactaaattagctattagtatacttttacttggtgataaagagattggagaaaaactaataaaataaagttatcatgcaaaatcctaaaattattttagagaaaaaattgcacaccagcattcttccacgccggttgaattcaatgcatgtacttctatgcatagatagaatctgcattatgcgaagtagaccaacaatcgctgcccaaaagacttggtaagttaagacataactaaccatgttcatacatgtttaaatcacattgcatttatcacatgtgaatttaattcacaacaaaatcaattatatttatttgttgcagatgtacataagtgtgagcccaattggtcgatctatctacactcgaacatgtcaatggcaagacaatagaagtgtgacaggagtaggtcgcctccacctcgtatgtgatgaccaactttaggctgcaactgctcacctctcgccaccaaccagcatggtaccaagcgtcccaaatggaattcaccatgtctgccacttctacacgctacatgctacaactgcaagatctatactccatatatgcgagagctatagtttatggaagttagactttaggaaatgtatatgtgattcttttagataggtaggacatgtatatgtatgaacattacgcatatatttgttctttctatggactaaaagaaacaaggctaaatatctatcacaacatatgtatttgtaggtactaattaaagattgattctccacagcaaaataatgagatgcgtttaccctgtcaagcgaattaatagctagctagtatttggtctgataaatcctaattatataattttagaaaaagagaaaataaatttagcattcatacattactatattacaattacatctccaaactacaaaacagtcccttgccatttacaaacacccccctaaacttcacacaaatcctcacagctatgccaagccctaactacatcacctagctccattctcagctgctcccatccgaacccctgcacctcgccgccgttgccgtcgacgtcgacggtgacctccagccttagatcgacgagcaacagcggtgactgcctagagacttagtaagttaaactaagttactgagattaacaaattaagtacatttcgtacatgtttgaatcacattatctatcttttctttctaattaagtttgatacgaagtgaaattaattatatttgtgaatcacctgaggtcgttatttatttgtggctatggtatgtttccactgtcctatttgtcccctagttcaggtagaattcaccatgttctaactctgggtggatttgcaatataagtgcaaccgatctagatggtacaagtgcacaagattattatcagcataacaaatcaacaacgcatacacgcatggagctaaagattatggacatacaggttgcattgagtacgtacagaagtctggagacgtatctttttttttattttccatttctcaaaaattaattggtgcttgccttaacaccttattattagatttgtaggactgatctaacaccatatgccattacgcatataattgactatttctgactgcagcttgtcttattgttgaaaaggaaaggagggttagttgtaggatagtagataatcagctatgatgttttaactatactttttttttaatgttaaaaaaaaaactatactttttttcagcgcaatatgggaaccagcttgatcaaacccatctaatgattttgttttaagtaggaatatttttattataatctcttcttgattgagagagattatagaatataaaggcatccatgtggcaccctgaactttaaagtgagcttttttggaatgagagttgctacacaatatcaaatgtgacatagtataacagttcatgtcctgagcagagcaagataatctggatgataaatacagaacagagcaagcatggtatcttttttttcttaattttttgtcaaagagaacttgaataaactctagttcaacattgttttcttaaccttttccatatttatactcctgtttgtctctcgttttttgcattgagaatggagcaactctggcggcagtatatgcagtcaaacaaattaatgggaaaaaaaagagaagtacatgaaaggaactgattttgtgtgacttaccaagaagcgcgtgagaaaagggaaaagcatcacaaatcatgcatgaacttttagttgtatacttgtatataaagtgtaaaatggagccgttaaaagtagcaccacataaatgtcatctgctatcaccaaactgtgtccttcgcatcttgctcctcaattttcatgatgatgaactagactaaattagctgttagcgtgatttggtaatgagaaattggaggaaaactaattaaataaagttgtcatgcaaaatcataaaattattttagagagaaaatttcacacaagtagtaatctatactggttaagtcaaatgcatatacgtccatgttaagtcaaatgcatatacgtccatgcattgatgaatttacattctcgctaactgcccagagatttagttaagacagaactaaccacattcatacatgtttaaatcatattaattttatatcccgtgagctaatttaggtataagaagtaaatcatattacttctatatgccgtgagctaatttatgtataagaatcaaaatcaattatatttatttgtttgttacatagaccaagttagagatgttaataagtgtgtgtcccaatagcaaagataatcgattccacgttacggggctaggtcgcctctacctcggacatgatgtcaacttctggatatagttctttgcctctgttgccctcatcgccgccagcgtgctaactaaatgaaatcatcgccgccagcgtgctagctaggggtccaaatgaaattcaccatgtttgtagcttctccaggctacatactgcaagcccaaggttacatgttaggaaatttagaccatggaaaatgcatttataattttttagatctttaggacatgcatatgtacgagcattatatgcattaggaagaaggggtaattgtctacacatgtattttagatttgtaggtgattgtaaagattattctccccaaaagaaaatattgtgtttaatctgcaaactaagggagttaaggtagcgaaaataatgagttgtgtttgcgctgcaaactaagagagttgtagctagctagcacagtagcacagtacatagtaccttctcataaatcctaataattatatatctctactattataaaaattgaagatgttttgccggtattttagtacgtcatccgcatttgtgttggtttttaagttcattcgcttttggaaatacatatccgtgtttgagttggattgtaaattcgtttgcttttaaaaatacaaaaggggtcatataaggaatctctttaataaaactcgcatgctaaattgagatggaagtcggacttctaaatgcagctaataattttctaaaaaatatctaagcgaattcccacagtgaatttcattatagctaaaccgcacaaatataataagattaaaatagcattcaccacccgttgcaacgcacggtcatttttttagtaattatataatttaaaagaaaaatgttgagaataaatctagcattcatacattgctatattatacaattacatctccaaactacaaaagagtcccttgccatttacaaacacccccctaaatttcacacaaatcctcacaactatgccaagccctaactacatcacctagctccattctcagctgctcccacccaaaccccttcacctcgccgtcgccgccgtcgacgtcgccggcggcgacctccagcctcagctcgacgagcaacagcggcggcgccacctccgacatctccaccgacatcgcggcgatccccgacgacagccgcccccccgccagcggcaagcactccacccctttcttccccaccaccaccacgtacccgagcttcccgccggcgaggccgagctgctccagcgtcttctccggcgacgccgtcgtcgtgaaccgcttctcccttaggctcttgtcgtgttcgccgaacagcccggacaggtcgagcccgggagacatggagatgatgtcgaacgcgttcagcggcggcggcggcgccgcctggaacgccacggcgcgctctggctcgccgttgaggaggccgtcgagctgggagtcgacgctgagcgagcgcttgaaccacgggtggtgcgccgccagcgactcgacggcgacgcgggtgtccgggttcgggtcgagcaggcggctcaccaggcggcgcgccggctgggacacccaccgcgggagctcgtactcgcggcggtgcgccttccggcacatgtcggcgatgttggagtcgtctaaagggaggtggccggcgaggaggacgaagaggat

SEQ ID NO: 47404 - DNA, 6905 bp, Oryza sativa
gaggacgttctgcggcttcacgtcacggtgcgccacgccgcgcgcgtggcagtaggacagcgcgtcgacgagctggacgaacacccggcgcgccgcgctctcgggcaggcgccgccgcggcagcgccgccagcctcgacaggaggtcgccgccggtggcgagctccatgacgaggtagatcctggcgcgcgtggcgagcacctcgtggaggcgcagcacgtgcgggtggcgcagccgccgcatcgccgccacctcccggagcacgcgcggcgccatgcccgccgtgcccatcacctccgccttgtcgatcaccttcaccgccaccgcctcgccgccggccaccgcgcgcgccaggtacaccttggcgaacgtccctcgcccaagcatccgcccaagctcatacttgccgagaagcggctcgccgccgccgccgccgctcttcttcttcctcgcgtccatggcagccatggccatggacaccaaccacaaacaccttcaagatttggtgtcttaggtttagtttgttgaatgatgagttgtgtgtgtgtgtatgtgtgtgttgggtttatatgatggaggtgagttggctgtcttaattagtttggttagttaattaaccatcttagttgggttagttaaccatggttagtgtcatcttaattataattggtataaaggacacattgcaaccaatagagtgatgcaacattggagtagtttctgggtggagtgatcatgtgtagggggtttatgtgtaccaaagggtgtcgtctaaccatctgatatcgataaattattatattttataacatatattatttcacgcaatttgttcttaattaggcgttttctcgaacataaaccttaatttactatacatacggaaaaggaaaatatgtgtatgattcaactgtatcatactccctccgtattttaatgtatgacgccgttgacttttcgactaacgtttgaccatttgttttatttaaaatttttgtgcaaatataaaaatattgatgtcatgtttaaacaacatttgatgacgaatcaagtcataataaaataaatgataattacataaatttttttgaataagacgaatggtcaaacgttggataaaaagtcaacagcgtcatacattaaaatatggagttagtactatttgtggttgttttgaggtgtggggttgatgtgtccattctggtggtggcattatgttgcaaattggccattgatatttgcaagctggtgggccatgcttgagctgcagctgctaccatagtgttgacaatggccctccatgggccaatatatatgtatgttggcagatggaatctgtcaccaagatgcctttgcctgaacctcaagacaacaggaaaaaatatcaccaggtttaatttcctctaagtggccaccaacccactttattataatctaaggaattgtttggaatacagtgatcattctgcaggaattaaatagaaaaaaaaatcagtagtgcaaggtccctattttgtggtcaattctttgggcacgtaagttttcagttccatagatcaaactgcatatgtttgtatctgctatgtttggctcaatctgattcaatcagcttgattatttcatatatgaaggttcctgagtaatgaccaaatatcactgttgaaggaaaagggaaaactgaagaagaaagctgagaacagtagaggtaagagtgtgaaaacaactgacacatatcattgttgaactctgatcttttttctcgaacgcgcaagttgaactctgatctagtattagacttaatgagcaactaatcaatcacttctctccatttagctatcctatttcctatcagtatatgtctcacttggacagtgatacaacattctctgatagtagatcgcaggttaaattgttcctagaaatgaatattcagtttttctttctaattcttggatgcatgtgaattgtggttcagagtttcagacagcacaactttaagggatttgttggaatagcaaaatagcgtcccaaagatttgcagtcagtgtcaggttggtcgttttctagtattaattatagcatatttctgttttcttgcaaaaatttattaaggatttgttgctacctcgtatgtagttttgtgcaacttcctctcattggcaaccatttttcagataaactctcattggaacatatataccagtttggttgcttcagagcaactagtactttatgttgatttctttcattgaggaagaattaacaatgtttcaagcaaaagcttttggaaaagaagaagacttccattaaattgtaaaataaaaggtggcatatcctcattctttgattaatctctaaatgtgcaacaataaagatgctagggcaaaagcatcgtcttggctttaatctttacatttggctaaagatcaccactaatcatcgtctaaagaaagatctcttctgatatcagtatacattgcaaagcaagacaaacccatatttaaagcaaataagcaatacaagatgatcttctccacaagcactcagattttctttttccaactaatggcaaatgatttgtccttgctcactaactaatattctgagagctagacctgcatgctctgaatcccaaggataagaacagagtattaaattgagcacatgatcgattgaatgcatttgtcacatggcatttctaaatgcatactccgtccatcctaaagaaaacgagaaggatatgtccagattcgtaatcagaaattggtttttttctaggatgaatggagtaccaatgaattataaaacatggactagaacacatttcttgtcttcaatcttaccatgctgaattgatgctacagttgggcctacaaatttagcaggatctgttgtttgtttcagacattaagacccatgctttggccagagcattgatcactgcatttgtccatgttgtttaattaacaagtaggagtagaatagaagctgattggtggcagaggtagatgagatattttcagagaaggcatcaagagtgccttatgtgagcaggcataaatgtatattccccagcttgattggtttgacaggtaaaattattctgctgttgattggctcatatgaacaactggggaaaacatatcacatatattttttgttatcttctcagtagaagtatcctgacaaccatagttgtgaccttccaagtttggccacctaagaaaatattttttattaggtgatatttttgcatgaagctttgagggaaaaaaaaggttttttgttcttttgtcagaagtatataatggatttaggtccaacctggctataaacatatgttctattttttagatacatctaacatttagttttcagccattccgaaaggcctatttctgtttgagagtactccatgccatattttgcgaatgtgaactgatattttttttatatcacccaatttcaagtgacaagtggaaaacaagcaagagagtgacccagaatatgtctcttgatctgtcgtccattcactgaaactgacaccaaggattcatatcacaacttttgtaggagagcatgcatcttccacttacaaatttttacataaaattgcacattcagtctctaaacttattcgcgagaggaatttctactaactaataaggttggctgaaaatctgagagatgttttcttatttgggtgacttactgatgagctctaaggccaaccaatatatatttgggtatattttgtgatcattttcaatgtccatttatggtgattgtcagtttctctagatcgccgtttcttgataaattgacatactggcaggtcatggttttcaaagcacaagtggatgacaaaagtagaaggcgactgaaaagtgaaaacaccagcacatctattgtccatttcaagaagttgtcttacctttcaagcaaagaccagccatgacatatatatctaccaaaatcaaatttggcgaaaattcacgcatgcccgtatcgaaaaacttcgtcgaatacaattgaatacactttgtccacaaccaaaatagttatactgaaaaccacatttgcatcagcccttccacatcgatcattgataacatgcttcctgaacttttcttcagtatctgaaattctgaactctgaactttctgaaccgaaaaatgttggacaaattagtcgacaggaaattgacgacagccaagcaacccagcgatgcgtcagcttccagggcggggccgaatgattggtgggccccacatgtgcgctgctgtccacacattccagtgggtgtgggcccgggcgtgacatgcaatgtgggcccgaggaaggtgccacgccagatttggattctcgaggagccacagccactagctaccggatctctgcctaacctgacgaacacaccaagaactactcgagcattcgacgaatatgcagaacaaaattaaggttgctgccgattgtcgtcgttttagggttttgattatactcctgagttctaaaattgttgtccttttagaatttaaagtttatctaaaataattatctttatagagtactaattatctcaccaatcacttccaatttaaatttctctcaaccgtactcccacatctaacaaaaaaaaatcatataatgaggaatcacatagtttttttcctgaaatcttaatctatgttaaataacttagaacaataattattttaaaacgggttgagtataatggttgcaggtgaagtgttcctgtcgtaatcactaactacactataacatagtcgtactacatatggatgcatgagagctagtggtcctaattggaaggtggggattaaaatgtgctagttaattagtgactagtcatattataaacatttggcgttttgctgatatttttgttaattagtttattaattatttaattactagggcattgtttttttgtgttgcaaactgaagttatatagccattgttagtggtgtggaaaatgtgccgctgaatggaattgttccagtctttataagaaaaaacacactaacaatttagtagtgttaaaatttgctttgattctgatactaccaaattttagtagggtataaaaaaccgaaacagtcgtaggttcactgtgtctttgatatagtgacctctccttatatatatgctttcacttacaccctaaatgcatatatatacgagtcaactttaagagttgattagcaaaattaattaggcagtgatcatgcatgcgtgaactgtaatctccgaagattacacatgatgatggccctcacaaaattcccatcaacgagtaggaatgaacgaatgaatgaagccatgcatcatcctgttggagcatagtatacttgactaccacatcaatgttcatatttaattcggataattatatatgtgcaccatatatagagattaaatatatttcagtggggtccttaagtttagaaaccaacggacgagaacgatctaatcatgtacaggtatatgttaactataatatataatactcaccatcaaggttaaccctggcccgccatgatctaggtctggatcgtggttcactgtcaatgattttctctcctttaattattagctaatttgatacctgatgtctgatgatatatgtattagagtgaactgtaatttgaaccatcttttattactaatgtttcactttaaaccatccttaaaaactgatcgaatgtcactttttaaagtttggatcgcctaactctcttttctgcgatattatacctatcgaggtgctccccgtcagttgttacaacaaccatgtctagccttccttctggcaaagatatagcgtgcacgtagatgaggagttcatcggtgtgtcagagccgatgtatttaggatcattgatgtttatagaagaagtcgtttcgaatggtttaaactgtaataatgataaaaaaaatctggtctaaagcgaaaagatcggttatttaaaaatgatccaaagtgaaacttaaaaagaaaaaagttggctcgtgctgcagttcactctatatagtatttggtggcgagcatgagtattgactatgagcaaaaaaaaaactatatgtatcctataaatataggtagagctagctggtcaggaagatgctgagatgatgaaattggttaatcgacagaatgtaagttaaccgattaattttgtcaggtttcgtcgtcggacgttggttatataggacttgcaggtacatagaattatatatatgctgttgatttataatctactggttcaggttctctcaatctgatgggattagagctagttgctggataactacccttgtaatacaatctgcatctgaaatatttctgcgtggccaagtcaaactcaaactgctatataattatgtgcaaaataatcctaatatatactctctctctctctctccatttttaaatatttaaactttttaaaatatgtttgaccgttcatcttattcaaaaaatttaagtaattattaactatttttctatcatttgattcattgttaaatatacttatatgtatacgtatagttttacatattttacaaaagtttttgaataagacgaacgatcaaatatgtgctaaaaagttaacgatgtcaactatttagaaacggggggtaatatcaggtctcggtgtagccagagaccctgtttaaagcaaggaccgtcccgtagatattttaggccctgagctgtgcggaattctaacgatcgaattttaaagataaaaatgaaattagtacaatttggaggagtccagtatataattcatagcaacacaaaatggagcgaaacttagcaatgtattgtgcattgatcaatattcaataattcattaaaacactaaggtattact

SEQ ID NO: 47405 - DNA, 21251 bp, Oryza sativa
  unsure (1)..(21251): unsure at all n locations
tatctagattcattaccatcaatatgaatgtgggaaatgctagaatgacttacagtgtgaaacggaaggagtaaaagatagggacaatgttagggcacgacgacaggcagccgatcgagcacaaagtacggtaaccgtcaagagtggtcgagcatcatcgatcaagaaaacaaaactatactccctagacaaagcctcctaaggtacacttagagctttgttcgaccaaataacatccaaatctttttacatacggatgttcttttagtccgcctacaattaaatagacggtccgtaaaattcgtttttgtacgtagttgggtgggctagcatgtaccaattgtactatagacattgacccctgaggccctgaagcgatcataggattattttcctattatatgcataatatgaaaaaaaataaaacatatgctcctagatagaagatatataatgctgtaaatcatttccattattaaaaggtaaaaaaaggataattgtggaagagcctttgctggcggtggctagaaggggcttggcctcccccgtgtcttgaaattttgcgctgattttactgcagatttagcaaattttgtttaaagaaattaacactctcagcacgacagcaaggtctccagcaaataaattgtgtttggtggctccgatccgccacctttggttttctgagtgcatgtctgcatatatatcaggtggaaaccagtagagctcactaaaactaggatgtgggcctgcataagcccattcaaaacacaagctgcacctgatggggaataagtcaactttgactctcctaaatatagctctaatcatatttgtatcactcaaccgcaataccggatatctccaaccccaactatcgaaatcggtgcaacttgactttctcgttgattttaaaagtggtttttgctgacatgacacgttgacttggtccactatgctgacgtggcagcctagttacaaaaatacaagtgacacatgtaagtgaataagaaatagttttaaaaaaataactgtaggacccactggtcagcctccttcttccttctctaccttttcccctcaacaactccatgcccagtgtgttgctcatgtcgacagggctgacccggattgctgccttcctccctgttgacgtgcgggagagctatattttgagggacacaaaatggacttatgccatctgatggagacggagagaggcagagagctctctccacaggcccattcagcaccgtatcagatggaaggcccataatcctctgcagctcagttcagcccactagaggacttctgctcgagttctagtctttcatggatggggaaggtccactttagttctttcaattaagggtcgagaggaaagaaaaaaaaatggatggatgacattatgtagacgtacgatgctatttttcatatgtaacgtcctactatttttatctacatgtaaacaccatgtagacgtcacgtcagatgaagacaagtcaacatatcacgtgggtgccatatcaatcgacaccaccttaaacaactaaaccatcttgggacttatactggtttttaaagatgtgggttgcgttatattcagttttgagatactgagggatacgatctaaactttgacctatatttgagggatctaaagtaaactttttccttcatggttttttggctgtctcaggcccagaaacaaaaatggcccagctaccacctgagtttggaattcccgtgagttttgaggtactgtagcaggcaggctcgctctttgttcgtttggactttagaggaagcggcgaagtcaacgcgacgggttgacttggtcggatagatttcctgattttttttaaaaaaaaagaaagtaaaatacggtgaggcgcgcgcatggttgacgtgtcaccgtcggatcggccgtacaatcgatcgatgggtaaagtaaaaattggaacactagcgaattaaatttactgaaagtcaacggttgcaacaattgggccacacgatgtaggagccgagccgtacggcttggttcaggaatagatgatactccatttcaggttataaaacgtttttgactttaatcaaaattaaactattataaatttcattaattttgtagaaaatagtagtaatatttttaacccaagataaatatattacaaaaatttatttgttttgagttaaaaatattactacttttttctatagaattagttaaatttaaagtagtttgactttaaccaaagtcaaaacgtgttataacctgaaacggagggacgttggtgggctggtggctacttgtaattaagctggcggtcaatagtaagcaaatactagtaacatcgcaatatcttatttttaaaatgtatgacgctgttaacttctcagataatgtcttatcattcgttttattcgaaagtttagtatacatatgtaaaagtataagttaaaattacgttgaaatgaatttatggctacatcgtatacaaatatagaagtatttaatctgtgtctgaaatgattttctggctacattatgaaaagagaagattaagaaaatacgcaaaacgtaagacattagcatataattaattgagtattaactattttaaattttaaaaatagattaatatgattttttaagcaactttcctatagatttttttttcgcaaaaagcacaccgtttagtagtttgggaagcgtgcgcgtgagaaacgaggtgttttctctctcaatctcccggaaacgatatctcaaggtggactctttggataaaaaacctagttacagtcttacagatggctgcaacagctatgatgatatcctaaatgtgatcttttttttttagttgttgcattctcgatggttgtattttcgttggatcggttttgatggatatggtgatggtaagatattggtgaaagactctttgcagctaagtcatcctctgatattatcttctgctttggttcatcagtcatcgacggtgatgtgtgcacaattcggttgacactataatcagttaatcagtcacacatttcgaatattttgtttttggtttgagaatgacaatgactgcatatccaacttgtaagctattgtgaaaaaaaaagaagtgatcataatcacactaataaccataaagatgggcgaatccaacatgggtgttagagggattcaacttcgagccctccctaccccgttggatcctcatgaagaggagagggaagggggaagaaaagcagggagactgaaggagaaaatagaatatcggtattataagcatgttttatttctaatcaaaccgagattttataatttgcaaacattcattctacccggccctttttttaaagataaccttatagctaacctattatacatgttagctttaacattgacttatagtcagaagtggatcttactattaaacttgctcagctagctattgtaagcaacatctcttagagcaagtataatagagggatgtaagaaggctgaatgctaaggtggatgagagaggagaggagagagatgagaaatgagctgtaagcttacagtcggttcaaatctatgaaaccgataggtggaccgtatattatagtgaagagctaaccaccatatgagtaagctgagagatatgccataaagatctatgtagtcaataactgtctgttttattagtcttgctcttagttctatctcttgttgacacgtacatttttacagtcatcagccgactatactattaaacttgttcattagtacccgtccgcaaaaaaaaacaaatcctagctacgaacctggatatatgcgtgtctaggttcgtagctagaatttgttttttttggatggagtagtatgttatacttttggataaaagtggtacgcttttcaaatttctaaacagtgtgtttcgtgcgaaaactttctatataaaagttattataaaatataagattaatctattttttaagttcataataattaaaacacaattaatcacacgttattaccaccttattttacgtgaaacacttagggtgggttcggcaccctatttttccaacccctctccatcattttccgcgtgcacgtttttcaaactgctaaacggtgtgtattttacaaaatgtttctatacaaaagttgcttaaaaatcaaattaatccatttttgaaaaaaatggctaatacttaattagtcacgcgcagggtttaacttaccgccggtaaccgcgcggttaccgcggttaccgggcttaccgcaggggtacggtaatataaataccgcggtaacctccttaaatacaaataaatttaaaaaataatttgaatttttgataaattttgcacggttttgtacggtttttcacggttaccgcggttaccgcgcggtaaccgtgcttaccgccggggcgcggtaaccccggccccggcggtaaggtaaaccctggtcacgcgctaatggaccgttctgttttgcgtgattagtgttctgaatggcaacagcgaacaccgaacaaactcttaatctctatcttcatctccattttcattttcatgagattcaaataccacctaacctagctgaaaggatgggcgggcgtgtgggagcagtcgcagaggtcaaagtgaccaggaaaacccaaattaaggaacattggtgtacatacatgcagtgtccacggaacgggtctacgagggcggccacaaattaataaatttgtccaatccttgcacggatcgatgcaccactnnnnnnnnnnnnnnnnnnnnnatcggttgagccgcgggggcagtggactatggacctcttcttctttttattctttgttttcatggcttagaagacgtagcttaatcatatatattaatatataaaattcatctcacttaatgtagttaataatactattttttttcttatctcattaagccatatcattacaattatcactagccctggatgatcgatctatggtctaaattatctctcatttttcttctcttgtgaagtcatatcactttattttttttgatggttaatctatattatctccattattttccttctctatttgaaccacatcaccttatactttctttccaatgatcaatctatttactatttaaattgttataaaccacataattttaattgtctacagttttatttcaataaccgatcaaatacaaaaattatactaagtatgtaaggttacgtcgtctagatatcttacatgttaattatactatcatcacataaaaccccatggcaacgcgtgggatttcatctagttaaccaatactacctccatcccagaaagatcgtggttttgtatcgtttatcgccaatgtttgaccgtccatcttattttaaaaaaattatgattagtatttctgttgttattagatgataaaacataaataatactttatgtgtgactattttcttaaaaaaatttctttaaaaaattttcaaataagataaacggggatacggaaacttacaactgtactaggacgaaggatgaaggtagtaagacactatcatgtttagaggaggtttaagtattgtgttgtccagctgtgccgattggcattatgaaccgtctaacactgtactccctcggtccaataaaaaaccaacctagtatcagacgtgatactccctctatttttaaatatttgacgccgttgactttttaaaatatgtttgaccgttcgtcctattcaaaaaatttaattaattattaattcttttcctatcatttgattcattgttaaatatacttacatttatacttatagttttacatatttcataaaagtttttgaataagacgaacagtcaaatatatgctaaaaagtcaatggtgtcaaatatttagaaacggagggagtatattatagtactacgaatctagacatagtactataatatatcatatctggtactagatttttttttatgagacggatggagtatgattcaagagggtgcatcggcaaaaattgcttttgtatatatagtgccttttcattatgtgctaataattttatatatttggcatgtaatttttttttctgcgcgcctatcactgtcctcggtgcgtgcgtttgctgttctaatttctttccccactgaagattgacgacgacaccggtctctcgatcgatcaaaacttttacttttgacacggtaaatacaccggtcgtcgttcttccaacacgcgtgtcctccaatccacggcgtttgttcttcacatcagtctcgatcggttcattcattttcattactaattcctcgatctgttcccatgtcaacgatcgattcattcgagcgcgagaccgatcgagaaaacccggaccgtccgatcgatcgggtcactactagactggattttgttccatggcgtttttatgtcgtttggacgacgtcgtcaaaaccaaatcttgaccgtctagctgctgcgaccaaatcgcctactctctatgcataagtactcaatgcgttccattaaaaaaccaaattacctactctctgcttaatgggggattgtctgcagtactgcatcatactgttgatacagtagcaatgaccgacgtgtgaaccggacccacatgtcagcttctgctactgcatcagcagtattgtagaggatttgcatccctctctgctacaaccaaactatgttggttttctactctctgctgtgaccgaactatgttggttttttataagatggagggagtacgtagtagcagcagtcattctattttcaaaatgatctatcttgatcgccactagttaggctgagttcgttgcttggtgttggaaactcgtcccttcgcgcacataaaactgaagaactcactagtgcatgattaagtattagctaattctttttaaaagaataaatatgatttttaaagcaacttttgtatatattttttttgaaaaaacatattgtttagtagtttgaaaagcgcgcacgtgaaaaatgaaggagtcgagtgaaaaactttaacaaaagaacttagccttattactagtaatatgctctatccgttctataatataatcattattaaattcaggttgaatagaaacactattatgctcctcatgataattcaggcaagttgcaatctctgaattggatctagctgatcagtccaaacagcaattcattcatgatttcatccattcattgaactagaattttactgttgagctacgtgctcccaatccatattaattcattcgttcagtcaagccgcatatatgaacctacgtgtgtactgtggcagaaattctagtccaaacactcgcacgaatttaacgaaattctgctgctgccaatctctgaatcattctacaaccgacacctctgaaagtctgaactctgttcaaacctcaaatcacgcacacgtacacactagtgtaccgaagtatatccatcaatttccagggaaaaaaaacagaggaaatgtcagatgtattatatgaacaagtgaaaagaaaaacaaaggaataaaattcctgtatgcatgatgagtccctgtttggctctaacaaaacaactgcaggccagtaggtttgcaaagaaattaaagggcactgaacctgcaatacaacagctagtaaccaggagagaaaattacgtatatatataccctcaaaattaaatcaatcactttttaagtattaattattataaattaaaaaggaatttattttattttaaaaaatcttacacacacagttgtgctatacatttgtcgacaaatttttccttaaaaatttgggagatgtaaatatagtgtgatcgtaataattacatcgtaatttgcatgtaactacagtacaacttgaatgtaacttttaaaaatcttgtgataacatgctattttcatgaagcggaggtcacgagaccaaatcccctcacttacgtgtgtgttgtgactttttccttcccataaagcaaatctaatgattttaaaattacacgaaagttacatatcatgatatcaattaggagtacgcatctcatttagcagttaggaagcatatccatataatacaagagagaacagctaacccaaaactctaaaaaaaactcaggctaattaacacaaacaaattaaaaacattgtgtgaaggagcagagcagagcagagaaggctagagtgtggcgtagaggatgatgaattttgatgatgcgatgaattttgtaagcatatgcagatacagtggagagaagaaaccaagtgagattaattgagatcgatgaggtgtgcctcctccttgagatgcgaccacaccagctgttcacagcctgtggaacgcgtcgatcagcagaccaaatcgtgtattttatcatgctgcctcgtgtgccacaatattattgttaacgtaactgctctattatattagtatactattagttaattaaccatggatgacactctgctagattatgtttatttcttcagtgtctcaagaaaaagattgtgtactacgtatgtgtatgtttcaaacttacaagtaggaagttttgaattggttggggttgggcaaagttgttgtcttagctctgtgtttgtagatattagctaattgctctcatgtcactgaaaaatcgcaagttggattttttgttaaaaaaatagtaaccgtggcagcggtggaatgaaaggaaataaaagcaattaactatttcttttccttcatggcaggtcgctagttgccctcaaacatcgatgaaaataacttagtggattttagcattagtggtttccaaaaggaaaaaaagattatatatgagtagtacaaaatcacatttgctaaaatataatacccttttttaataatgggtagatcagcctttgcttccgcaaaagttacaaccaattattacagcgattatagcaactaagaaccgacaatatcaaatcagaaacaacaacatataaaaaagaaattcatggatgaaatataataccatttgtgctaaaataaccgtctttcttggttataaactgtgaacttgagcaatggtttgagagtaaatcatccgtaattctattggtcagagaagtagaccacagtcgatttaatttggaacagttcagtcaaacatctaccaaaaaatcttttaactagacaaaagcgttaagcgtatcacacaatattagttaaataaacttcctttattaaaaccatcctaatccctggcatttgacacagccaaacagtagtttgatactgatacgattcacacatcaattttccaattttgcgctgctctttcctcacatattgatcacatttgccactttttgaaaaatggaattaatcaacgtaaaattccaattaattaactaagcttcctttaataattaattccctcctaaaccctagcattaatttgacacagccaaacagttcatactaattcgattcacacaccaatttttcaaaaaaaaaaatcttagctctttccacacatcatatttatttgtctcttttttgaaaatggaactgatcaacctaaattgtaattaattaactgattaattaaactgcatgaattttgcacttttgacctagctagctagcagcctagctaggaaatcaaatcaaaccaacaaataaaactagttgatggcgatggaatcatgcaaggagatattgaatttgaaccccctgatgaaaaagtcaatgccatcagcttcttcctcttcttcaattcctccactcgttttcagatcattttccatggcgccatggcgcctatataagcacccacccccctctctccccctaaccctaaaaacatacaccatccatttttccaagcttcattccaagccactacactagcacacactacatacaatcttcttcttcttcttcttcttgagttcttggaggtcgaggggtgggtcatcaatggcggaggtggaggtgagggtgaggcaggagcaggtggcggagttcagggagacgttcgcgttcttcgacaaggacggggacgggtgcatcacgctggaggagctggacacggtggtgcggtcgctggggcagacgccgacgagggaggagctcgccgagatgatccgcgacgtcgacgtcgacggcaacggcaccatcgagttcgccgagttcctcgccctcatggcccgcaaggcctcgcgcggcggcgagaacggcggaggaggagacgactccggcgacgccgccgacgaggagctccgggaggcgttcaaggtgttcgacaaggaccaggacgggctcatctccgccgccgagctccgccacgtgatgatcagcctcggcgagaagctcaccgacgaggaggtggagcagatgatccgggaggccgacctcgacggcgacggccaggtcaacttcgacgagttcgtcaggatgatgatgctctccgaccaataattaatctcctctctactatatatccaaaatcaatatatctctctccatttcattttgttttttttcgatctcttctttctttctttcttcccaatttgattagttacctaactaattaaggtagctagctatagctactgtcatttaatttggccttggttaattagttccttgattaatgtatttgtttgtatgaccaaatcatacatacatgtatgtccattaatttttgcatgcaaatggaagtatatacatatatctccaaatatatgtcaataatttttttgttgcaagagagaaattaagaagcaatcttttatctctctttttgtttcttttggaaaatgaaaaagaaaatgagagaggaaggaaattaaattgaagcaggggtaggtcaacttgagctagctagcactagctgtccctgaccattaattttccattttttaaaagtcttttagtgtactttttttttgttggtgttgacaagaaacaatttggcaattaatgcctgaatctttctagagtatttgacctggctattttgttttgttttgcttttgttcatgtcctcttttttggacagtgactttggccgtgttggctagtagtagctttcatacgagtacttttctataaaaaaaaacagagaaagagagagagagagagagagagaaaaagagggtcggtgaggcatatagaatcggttgtgcgttcaacggttaaatgttgtgaaaccatacaacacgcggttgtgcagcaccgtgcaataaaccaaagataaaaggaaaagaaaaaggaatgtttttttttagaaaagcaaaagggaaaaagatcaaaggagattttgttgagggactctatatgatcttccgttaacacctttagaaatactgataggatcatgtatcaggaatcataattagaacacgcttgttaaccatgaatggatccaaccaaacgtctttgaagtagaaggatgcgcgtgaggccaagtttagttccaaacttttaatttttccatcacatcaaaactttcctacacatataaacttccaacttttcggtcacatcgtttcaatttcaaccaaaccttcaattttgatgtgaactaaacacaccctaagttggctttctcacgcttgcttcctcgttggcgtcctactgctcatatgtgttaccatgagtttatatctaatattgatggatttgtgcaaattcgatgcaaaaattctaatgcctcaacagaacaggttatccagtagtggagccaagttctgtaaacagagatgctgctatcctttcaacatatatttaatttgaatttaaaagttcatgaaatttcgactgtttaatttaggtttctagctcgactacttatggccatatgtggccaaattaacttcggtacaacctgaggtagactcatttttatgtttgtttgatcggattgctgagcttgcaaacaaaaaaaaagttaaaaaaaatacttgggcgacatttggacggtgcatacatacagcagccggcctgtctgactgactgtctgtcacgcgcattgctgtgtacggccgtacatacgtatatatatacatacacatttaggccatgtagctcttccaaacagttcagctttttatctagattttgagaagctgtagttgtagaatctgaatttagaaaataaactagaagccagaagttgggtttttcagcttttccagattctcagaagctagctaccaattagctacttctcggaatgttaagctccctacataaatgtactgtacaatccctttttgtctgctccattaactatgcaccatccgatacaaaatcaatggccgtgatggacgtacatgtatatatagtgtcgtgtactagtgtggatcaacaccgaacccgtgatggatgtacgtcgtattgaagcagtcgccggtcggtgatgtgtactgcaccgtctgcacgtactgcactgcatgtaggagtaaatcgcaaaggttgacgcatatggcgcaggcggctgagtctctcttttttttttccatcctctatttgatcgtaaagttgttcttataagaggaaatagttcgaataaacctctaaattataaaaccagatatttaacatttcaaatcaccccctctcccctcaactaaaaatccaccccttatagaagtattgtttggagcgattttgttgttgaccggctgacgtagaattccaacatgacaaaaatagaaaagatagacctatcttctagaacccattacatcgtcctactatttcctagtgggggagatattgcaacgccgggaaactcgtgtcgatgaaattaaggagcgatgtcgagctcactttttcccccattgggaacctcgtggatttgcgccgatctcgtcaccaaagctcattgtgcaagtgtgaagaaggcgtgggacggatggcgtgcaacgaccaagcagttttttcgggtagtgcgacgaaggttgggcggagatggcagctaccggaggaggaactcgagctcagggcagccatggaggtgggtactaaaagaaagggagaagggggcaccattgtctacgcgcgtggtcaatctccttcatgttgccacctagatctagaaagaggaagagccgagggaatcaagaagatggtcgtggcacgaagtagagggagccacatgaatgaagaggagcagatgaagcaaaagccacagttgccttcctctctcccctcgacgttgcgtcgggccccgttcgcgcatgaggacgccatctgccatgtatctatagtggctagttgcatcgtcagggttttcatcatcggccttgctgagaataagtcgcttcgtggatctacatcacttctccttccggcggcttcctccaacctccgccatgctgtatgtacttacaacatatactatccaccgctaataagacatcgctgtaagatggcacaccaccaacttgatccctttctctcttaagcataatatagatatgaagatagaggatgtcaggtggccccactaccataccatttagtatgaatgaaattcagatttttatcgtcatgttggatagcatgtagggtcaaaaccgtttcgtatttttttttcgtggtcaaaaccaccttgtattaaaatagggtcaaaacccgtcgtgcctgattttcttataagggagtatcggagtacaaatcttttttttctttttaaaaaacactctttatatatattgtgtttttctttaaaaaatcgcaccgttcaaaaaaaaacttaggaagcgtgtttacgataacagaaaatgaacagcaaagcgttaattaactaggaacccagaaaattaatgaactgggccttattagttaactacgcgagatggttttcaaagcaaattaagcgtgtacgcaagcacatgcgagtacgtacgtacaggtacaggtacagctatactattgatgtatgtatggacggagctagagcgaaatagaggatggtgtcacttgcttaatttactttattttagatcgagtttaagctgatacgggtgcccaagtttgtattgagagggtgtatacatggtgaaaatatatgaggtatagctaaaaaattttcttgatcggatacctggacaccccctaacatatactagctccgcccctggatgtactcatgtacgtttacatatgtgggggtacagcagtacagtacagtataggagtggatgggagctggggtattgaatgaatgaattgatcatcggttggtcaaaatcaaagcatgggctaagctgtgtagatagcccggcgccggccttcattgaagcctatctctgcatatctttggattttcattcatttgcagaggcccaccacccttcaaaccatccacacacattcttcccctttcttctttctctaataattctttgtgctctagccatgacttggacaacaacaaatttatgtgcatactgaataatgctacagaaactaatactccctccgttctaaaatataaaaaattttagtaggatgggacacatcctaataatattacgattctagacagagagcatgtatccaaccaaagcttcatatctaaatatatttatagtactgggatatgttccatccaactaaaatttcttatattttgggacggaacatatatttagacaagtcagatatgtgtacatctcagcgtgacacgtacgtatataggttgtccaggccggccacatgtagctagacataatttggtttgccagcttgatatatacttttatgtgttttgtgggggattatacatatgttgatgagattaattgctgaaggagttggagcctggaggtttctgcacttgaatacttgatcagttcattgtctgaagaatgcatgcatgaacattcagtgtccagcttgggctgcaagctggaattaacagcttgcagcttgtttgatccagctgtagtacatataataatttgtactacagcatatatatccatgtattaattcaaaatgatttactactactttggagaaaacagctagctatatgtatacaaacacatgcacacactctgatgggatggtattgctgggattaaatggaataataattaaggagccaactctgttgagtccaaatgcatgcatgagctagccggacaaccactcaaccagcactaagctcgttctatctgcacttttcttttatttctagaataagttcactttacgttctttatcttagacattgaatttgaattacctccttaaatcgcaatactatacatatataacacatccctcaacttatgaaaccgatgtacccaagatcctagacaatgtaatgcccgattttagctaaccaaacgagtgggacctacgtgggcccaacatgttagtggcccactcttcttccttctctccccctcgtccctctcttacccatccctcttcaggccaggaggcaggtggcgagcggcggggagaagggtgaccgccggcaggaggcgggtacgtggtggggagacgcaaacacgggaacctaaccgatggaggaagaagagttggcaactagcatgtgagatccacgtggggtcccactcatcacatcagctaaaatcgtgtattataatatcgtaggacctcgggtacaccggttttgtaagttgagaaatgtgttatatatgtttcggttcaagaacgtaactcaaacttgacatcaaaatgacagacctaaagtgaacttattcctttattattccctctcgagagaaggcccgataggcggcccatcaagaggacaaactaattaaacctaggattactactaccgtaccttattaactactaacaataaccactatataatcagctgtaaaaattgtacccgtacttaccaaaatataacaattttacaattcaaaagttgttctaaatataacaaccttttacctataaagggtgtgtttagttgacaccaaaattaaaaatttgattgaaattggaaacagaaaagttgaaagtttacgtgtgcaggaaagttttaatatgatgaaaaagttagaagtttgaagaaaaaatttagaactaaactcggccaaaaggtgacttttgttcccaaagtaatcatactatacccacagtatccattttgtttttattatgtactcctatttaactagtctcaactcccatctcatatctcacctacctcaaagacaatgcatttcttcttcttattgctcgtgacaaaagctaatattctcatattttcacttacggttatgcttattaactaaaatttaaattttcaaccttaattagtttggagctgattttggagttttcatcgaagtttatttttcagcatttactagattactattatatatatatatatatatatatatatatatatatataaaagttttatttaaaaattatttttcatttacaaatataccgtttggcttattctacaaataagcaaaatgatgggggccttaaaacttgaacagagggataggagtagtcgttctttcttttcattttgcgaggatgcaaaatgtctctctttaatttattacagtagaagaatccctgcggtttggctagctagttcatggcagcaagcagctagatttaatggcagattgcagctagctactcgtagctggtatatgcagtactccctctgtcaaaaaaaaaaaaaaaagacaaaccctggatttccgtgtccaacgtttaaccgtctgtcttatttgaaaaaattataaaaaaaataaaaatacaagttacgcataaagtattaatcatgttttatcatccaacaacaatgaaattactaattataaaaaaaatttatataaaacggacagataaacgttggacacggaaacccaagatttgactttttttaagacggagggagtacagtacacagtacagtccagctgcatgccgacctacctaagctagctataccgatcaccatttaggttttgtttagattcaaactttggatacaaacttctaacttttttcattacatcaacctgtcatacacacataacttttcagtcacatcgtactaatttcaacccaaattttcaactttggaaggaactaaacacagccttagcagcagtaatattgtacatatacggcagacacactgcatcctgacctgcagtatactgtccctgcataaacatggaccttgagagtttttatatatatatataggccagtacgtatatacagataatacaatgcctccattcttcttcttcttcttcttcttcttattcttcctgctgttgatctagctactccttttcttgagtctgaagacgactgatctggacctgattcggccatgttcttttcagttcatgtagttatgaattagtccgtaatgtaagaataagaggctgaagtcgaggatctacttctaagaaaaaatatttacgtttcaattttcttgtaaataggttgtcagcgctagtgttatttaacgtcgagacattgaacctcaacaccaataacttggcaatgagaaaaaaaagatcaattcctaaaataattttgtttcaaagatctatttgtaaagcaagttatcaaaaaagtcaaaatgtagaaattgatcgaccgaagtctccgatagttgggacaagacccggcctgatccagtgtggaatttataattccgctgtgagtaaattttaggaatgcacattcacctcttgtatgacttcaaaaccttttcaaatgatatcaaagcctaatataatgtataatgtataatgttcaatttatccatatcaacaattatccatgttatatccaatcatgtatataaagaacaatgatattctgttccaaaatacattaacttttaggggccctttgatttggaggaaaaacataggaattttagaggattttaatcctataggaaaatttcctatgaagccttttgaaacaaaggattgaatcctatccaatcctttgaaattcctatggaatggataatcctatagagattttggagaaaatttagcaagagcttcaacctcttgctaactttcctttgagtttatctctctcatccaattcctgtgtttttttgtgtggttcaatcaaacggtcattcctgtatttttcctgtgttttgcaatcctctgttttatacttacattcctatcaaaattctacgtttttcctattcctacgttttctcaatcctgcgattcaaaggggcccttagctataaatctgaatgaggacgtaggtagtagtatagcttataccgatccagcgtattccccccgtcccataaaaaaccaacctagtacgaatctgatcatagtacaaaaatatatcctagctagatttgttttttatgggatgaagagagttcatgtaagcatatgttgcttcaattctttcatatgtttcttttcgttttgattccaccacttgttgaacacgaagggtgtgtttagttcacaccaaagtttgaagtttggttgaaattggaacgatgtgacggaaaagttagaagtttatgtgtataggaaagttttgatgtgataaaaaagttgaaagttcgaagtaatagtttggaactaaacaaggccgaaattgaatactctaagctgcagtaagcaaatgcaaatgcatctagcttggtgaaggccgagtttactctcaaattttttattcaatcttccaacattttcattacatcaaaactttcctacatatacaaactttcaacttttctatcccatcgttccaatttcaaccaaacttctcattttgacctgaactaaacacacccgaactacaagtagctgagttagctatacaagtggatcagtagctgcatgtaagatcgatatatggatgacaagaataggtctagctgatatgtactgtaagagagataggcctgcatcaggcggcgacaaggcttttgtttgtcatgcgggtaaagcactgcacggctaccgaactagccacactagctactctaccaagtactactagtactgtatttaagtatatacacacatacaatttgtatttgtatacatatactatactcttctcaatgccaatgcaaaattaatactcctaccatatatatgcaatgcatatgcaagccggaccacacactaatcgatcagaactactgttttctcactccagatctctatatacattcagttgtggagcaagcgatggcgatgccctggagaccgaacgatgaagagcgttttttttttcttgccagcaactaatttttatgactattttggtgatcgagagtggcggcaccatgccaccggcatccgataaagcccgcgattgaccaccggctagcccgagagtttgctctaccaatcccatacaattcataggttttcagccgtgttcgtctaaaccgtagtctatttttcgcgaacgcgtaaaagacctaaaccatagtctaaaaggtctagatcgtgtctagatgttagacgattgtgtctgtaaggtttagggtataaattgtgaatcaaaccgtttggtcatctaatttatgggttttcgatcggtttctgtaaaaaaaacgtgaaccctaaaacagttttcttaaccgaaaccttgttaatttgaacttattggttgccaaagttaaaactatactggtgaacggtgtcaattaaaaatagaaaaatgaatgagaattttgctatagctataggtatggatagataaagatagttttcctccggctataggtgctccttttcagtagaaagggcagtagttctaactgccaaaagccttatggcaatgtgcatggtgagtagtaaatggcaccaaggagtgaaaaaataaccttaagtagacctagctatctaccactacctacacatatatagcccctgctaggatctagagatgggaccaccacttgtgtagatcatagagcaggagctagtagtgacagagatatatagaggggtcctgcatgcctgaacaagtgaaggtggttatattgctacaaatatgtgtgcatggtctgtacctgattggaaagcaaaggatgcatgctatgctagggttttgcatttcttttgttctactccctccgttgagatttggcttgcaacgtttgaccactcatcttattcaaattacttttataaatataaaaaacgaaaagttgtgcttaaagtactgtaaataataaagtaagtcacaaataaaataaataataattttaaatttttttgaataagacgagtggtcaaatgttgcaagcaaaaactcaaaatcccttatattatgggacggagagagtacaatttaatgatttgtttcttgagtattcttcttcttctccccttggcctgtgggatgtgtacatgtatgtactctctctccgtcctaagagcaggtaagccagctgtaaacatattttaagaagataaatcaggagagagaagagcagcgggctacatatttgtagccagctgtagcacggactctaagacgcagtgtgtctatgacatgtgggactaggtattaatagtgtagtatgtaactattgtatgaatgagctattaaattggctatagatgaattgaagctagtagttgactatactattgaacttgctctaaaataaaccaaactcgtatcaaaatgtaatatgtttagtttcgttgaattagaatatgttacatcgtaatacgatattggtttattttgaaatagtgtgagtatatatggaattatgtgctccattttcaggaggagaatctttgccagttatgaacaggttgctcaaatcttggcattgatgagacctttcatctatgtgcatatcactagccagccagctactacctctcatcagcttttagttacagctactagtacctggctagctatctcaaacagcttgtgttactcctagctaggagtaattagcaatgctctaatcaatttgcattcaccatattttacataaatgtacctttaagcaatgactgataaaaaagtatagaagtaaactaatttatgatcaaaatttcataaatgtacctttaagccacctaaaataatttatgatcaatttttttatgtttgtgtttttagtagtttaaaagttagggttgaaaaagagactataatgaaaaaacaaaattcactctaaaataagtttcgtcttttacattttagcggcgtc

SEQ ID NO: 47406 - DNA, 9443 bp, Oryza sativa
accctttgtaccagaatcatcatacgaaactaatcgctgaagaagtgagaaactaattgtcagataggattgaaaaaaaaatctaaattttggacacaggaaaggttcgtcaacaacaaaaaagaaacatgtcacatccatactatttggtgcaaagaaaaaagaaagttactagcaataagcaggataaaagttatgatcaaacaatgcaacactgaaagatggcaagcactggtataattcagtcagaaaaacaatataaggtggattaaaactgatcaggtagaacagtaaagggatgaacaatacttggtggatagcaaaatcattgtacttcctaagttcttgggttgctctttccaatgaacattcaaaaccgaatgcacctttagggtacagtaactttgcaattcgatcaacatctttgtcactgtaaatgcgccttataagcaatggatggttcgcaatctgtggagcaatagaaaagaacaacttttgagaacaggtataataaacattttcctgaatttaaaagagtgaattgcgctttgggccacattttgttgccaaagtttcactttggaccagcctttgactgatattatcactttggactaggtaactttacacttcttgcactttggaccaccccaactttcttctctagctagtctaaccactcctctggaaaaaatatggcttgcgcagttcattgttgtgctagagtcgatgtgctcaagaaagtggtttggggtggtccaaagtgcaacaaatgtgaagttacctggtccaaggtgaaaatatcagtcaaagggtggtcaaaagtgaaactttggcaataaaatgtggcccagagtgcaattcatttacatgtgtgatatgctgctgaccttacggaactgcatgaaatagtttgatatttgtcgttttggaatcaacccaacaacattattagaaaaattggatgtggattttgcgctacgagcttgacaagcaccacggtattcatcaatggcatagttataagcttgaaactgctctgagtccattgttacgaaattaacctgtgacacaagatcactgtaaagttgaaccatgacaacgaaaaccatatgttgatggttaggtcgacgtacatgttgtatctttggaacaagttgctgcataacatctgatttcaaacgtctaagaataaatggccccaaaatggactttatacgtgaaattagctcatgatcttctgcatttaacagcttcttcagatcaatatctccagtggcaaatatatcaggcatcataaactccaacaatgaccatagctcctgtaaatcagttgaaaacaagtggtactttaagatgaaatgaactgaacttaagtagttgaagcgcatactccaaagaactggagacagaaagctatccgaaaactgttgctatttatttcatggctttccatgtaagtagtaattaaaaactgatgaacagcaaacagcattgagaacctgacatgcaatcaccatatccaaaagaactcaatatcggtttcaagtaataaggctaaggcatacaaggtcttggtaaagccagaagcttaagtggtcgttctaccaaaaacaagtgttagttatagatctttggttgacatgctgattatgtgcttcagccctttgctaacatgtggactctggttatgcaggattattcatgtgcgaaacctaaccaacatactcctgatttttacagacagtagtatgtcttaaattttcaaataggtggatggtatataagtattgcaaagaaccacagaacgacacatgcagcaggactaacttaaaccaaccacccatcaagttatcatcaaaacttacatgcaaatcattttggaggggagttcctgtcagcattagccgttggcgggcatgttgtgcgacagccataaggtttctccatcggaagctacccttatctttcagtacatgtgcttcatccatcaacacacaactccatcgccatcttttgagtgctttgcgatcatccttttgctgagcactacattacagataaaaaggaacttaaacttatacaaacatgaactatcatcggctctctgaaaactttggtgctaaacacaaaataaataaccacaaacctccgccgctcaaagagagagtaacaaacaaggaggacattaaatggaggcggataaccagctttgcccaatgaactcaactcctttgagtaggcagtccttccagcaccatgaaacatgatgattgaaaatgaaggacaccattttttaagttccctttcccaattttccaacacagaagctgggcaaactattagatgtggacctgggtcattatatagatgccgcaacagagtaagataggtcacggcctgtcatcacaagagcaaagatcaaacagcaatagcatgagttgccactgcaagtataggatcaaacaactcagcttcatctaaaataagccatatgaggttaaattctgacaatattttatattgaaccaaaagaaattcagaaaaatctattttgattaaaaaatagtgcataggtccccataataaaaaagataactccccatttgaactagcctagcttatacatcctgataagatgtcatttcactatacttatttatttatttattagttccctttccaccacatactgcaagatatcttacctgaactgtcttaccaagacccatttcatcagccaaaattgctgcacgaaaataacatataggttaatatgaccagtttagattctttggcgtgcagaaacaataaaacataataagaaaaagcaactagcatggttattaactcaatattacttaaacaacaaaacaatgattttgcagaaaaaaaatatttaacattcaactttaatcccttggtacattatagaataagcttttcatgggaaatacatgtggatctggctcctgtatactatggatctcctggtagttaatcacatgaatacaggaatgctgtttttttttctgttgacctaccaattttcattgttccatattcagagataccctaccattatttgggtctgcttgtcataaaattacaagaaaatcaaaggtgtctagaaatgtgttctccatcgagttcattttcattgattgaagattgattgcaatttcacataacggaaatctaaacagtataaaggaataacaaatagcagcatgtttccgaagacaaaaatggcagaaataacaggacgcttgcaagtaaatttcatgctatcatgctaaagggtggagtgaagtgaattactgaactgcatagatcaattttatttcatcgtgggtgcacttaaaaaaatctcagtcatatgcatctttactgacaatatcatctaaggcaacataaatgatcaaatgcaacagtttaaaaaacacctccaccgatatttttccggtgcaagagaagaagaaaattgacccccacaagctggtagggcttcagaataggctcaaactccgactcctcgcttgtgcatgcagcatccacatcatcctgctccgacacatccattgaatcaaaactccacaccttcaagtagactgcataaaaacagataagtacatacctgggtaacaattcggacactggaatcatctatctcagcataactctcacaattccttgtcgatgagccatacagctcctgtcgcaaatcagccgaaatgcgcgcgcacttgcgcaatgccttacccactacatccccctcctccacctccaccttcgtctcaccatagtccccatcttcatcgtcctcattctccaactccgaccagttcacaccatcatcctcctctgcttctaccccatccacctcagacgcacccacatccccgtcgctgtcatcatcgtccttaatcacgaaacggcgagcggtggctcgacgcggcctcgttggccttgggtctggatggtcaaaatcatcatcagcgagctctaaatcgtcgtcttcctccgagaggtcggcgacggcggttgccaagcgccgaccagcggtacggcgcggacgcgaggtcctcgaagaagggatgtcgaaatcatcgtcttcgagatcaaagccgtcgtcgtcgtcatcggaaaccgacaccgcggcggcggccttggcgggtttagggttgtagcggaaggactcgcggggcggaagggcccgcccaggggggctgtgctgccgctgcggacgattgagcacgcgggtgctcttcccggcgcggcgcaaccgctcctcctcaccaagttcgaaatcgtcgtcgtcgtcggagaggacgacggtggcggtggcggcggcggcggcggaggaggaggaaggcctggggttgtaacggaaggagtcgatgggcgggggaggctgcgagtccggctgggcgcctcggcttggtcgcttgaggacgcgcgaaggcttgaagctgtggttcgaccactcgtcgtcgtcgatctcctcgtagcctcgccgcatcggggcggcggctgcttctgcggcggctggtgggctagggttttggaggaggcggagccaagggcggaggcgaggaggcggtggtcggggagcgcgagaatttggggggagaaggcgaggggacggaaattttgggcggcctccgaggagtgggagaactggagcgccgccgcgaagagaccgccaacagatgcttttccggaagaagggtgattcgttataaactttcccttaaaaatgggggcgtatgattttctaaaggtttttttgaatcgttttcaaaataggggattatggggcggaaggcccactcgtcagtgtgttgttttggacattgtcctataatattcaaaatacactccattttgaacaatattttttaaaaaggaaatactatgcaactcctgtaacaagtgtcgcatgcttccacacaagtctcccccacgttgcactctctttctgagcctctcacacaccacacatgccacatgtgccaagacacgagaagtcaatataaggtgttatgtgtgtcgattttgatcatatttgtgctcatgtattctaagtgggtaatattgtgtgacggttatctataacatgtatgaattctatgttgcatatctatcaggcatgtcatgtactcataccatgtggaagaatatgagattttaagcctcgatcaaacatcgttgatacacgtagcataaactatagacttacttgtatttaagatggtgctgctaaaatatttgatgatacttattgttgatttttcgcgtcaacacttatatataccatcatgatacttccaattagtaccaccgtaaaactttatgatacttattattgatatttcgcgtcaacactttatgataccctgtaattagtacctccgtaaaacttagcgacgacatgatactcatgacatttctaggttaggaccgttagaaaaaaaaacgtgaaactcacaagctgctagagctcaactcgtcacaggctcaactagtcaaagatctaaatcgagtcgtttgagcttatctcaaagcttgcgagctctaccaacccgagcttaagctatttaacggaggcttgaaattttcgctagcttactctcaatctgcccacccaaattccactggcactccaaatttaatttccaccatatgcctatgattccacagacccagcaacttctaaatttccttccacatcccgtattctcatcgtatcaaaaacctagctcgatagctctcgtcctaaacaatgttggtatccaagattcacaattccaggtttctcctctgctttagatctagttgttcttcgtctcctccatgtgatctacatgaagaccatcatagaagattgcagtagtctatgacattgcttttggacggtacatatttaggaatttccagtaactatagcttttgttcttagcagcctgtgactacttcttatcgttaatttttgtcctatgtacttctgttaagtcaagggcacatggtactgtaacgttatttatccactcttgttatgaaagtgaaatcctgacagaagtcactgttgcaaaataaagtttacactattcaaagaaaatagtgttaacaagctttatacgaaacaaacttgagtcaagtcgattcttgatcgggttcgaacctatcctatttttgagtttgaaggtcattctgagctcggctcaagtctacaccaaacttaagttcagctcattgacaatttgacatgccatcatcttaaggtatcataaaattatgatcggtgacatgccatctatgccagcatcagtgattttttataagtatcatcggtgatatgaaataccgttaatatctatagatactacttcctttatcccaaaataaatatatacttttaaattagagaagtacacttcttttgagaacaaaagaagaactgtactccactaacgataagtttccttcctacaaggaaaatcaacattaattcatcgagaaaatctattctataccactgagtttgttcgagttcaatgatttaccatcgacattgtctccttctataatataccgataactttattaattgttctacaatacgccaatgggctgggctttcttttcaaaaatacccaaaatacccttagagacatacaagattaacaattgatttatctcattagaagtttcaaaaaataataaaaaattttatgtggcctcgttacacaacatggaagtttgtgtacatgtttttaagttttttctggtatatttagattttaaaaaaaaataatatttttatgtggtatatgagagaaaatttgtttatacgagagataataacgcaaaaatatcttatgtagtgtatgaaagatgatttatattaaaaacatcaataaaatgtattttgtatagcatataacaaatgagttatatattgtttaaaaaaattataaatgtaaaaaacttgaaacttctatacaaacttccatgttgtgtaagtaggccatataatttttttatattttttttgaaacttctaataggataaatcaattggtaaccttgtatgtccataaaggtattttgggtatttttgaaaatagtgtccaacccaatgacgtattatagaataattgataaagtcagtagtatattatagaaggagacaatattaatgacaaattattaaacttgaacaaaatcagtggtacaaaatagattctctctaattcatccgatcctgatccaacaaccgaggttcatcagatcaactcgccgctcgcagccgtcccagccagacccaaaccgacccgagtccgatttcagccttcaggtcaggccgcaccatataagggtctcagcgccggccgcgcgccgcaccggcatctcgttcccccaccccccacccatgtcggacgcctacaagaaagcgaagcccggccgcctcgtcttcaagggcggcgaggccgcctccctccacaagccgccgaagaagcacaagaagaacaagaagcccgcctccgacgcccccgccgacgccgaagccgacgcggaaggcgcagcggcgccctccgcggagggcgccgccgagggcggcggcgacgagtacaccatcgacgcggcgaagcggatgaagtacgaggatctattccccgtggagtcgaagaagttcgggtacgaccccgccaacgccgccaaggcctcccgcagccgcaccgtggaggaggccctcgacgaccgcgtgcgcaagaaggccgaccgatactgcaagtgaggtgagagcccttagaagctagggtttccggctccacggagcccggcgttcgatgctttgctctagtcggatctagctccggattcaattccaatcgagttctctcgacttattgtactgccgccacacatgaatttgcttgaattagcttgaatggtggagtgggttatgtttgatcgccgaattctggtttatacactgtggaatatgaagacgtgctgtaactgcaactaactgatgattaatgtgtaacgcggtctagttgcaatgttcctattagtcgtagcaaagctgtatcgtgtgcattataatccagaattatcgaaattgctggcaaattcaatatatggaccgaccaattctttgtatagattaatcaaaagcgaatattagggaaggacctaatatcaaataaatagaaggagtgaagcttcgaacccaggctggctagtccaccaccttgtggagctagcccgaagatccctgggtgcttctctgtatagattaatcacaaaagtgacttattttgtattgggtccctactcagtgtaatataggaacctattgataagattagagataggagaaagtcataacttgctagtttctgacccctatgatactgtttctgtgctcttaagttggtttttattgctattttgttttgatagtctttgaactgagttagtgttagtggtctataatcacaatcacaacaactttggtcaggtcgctcatatagacagcatacatagttgttagatcgataagtttatatggtggatgaaggtttcttatgtcatctttatatatcatgggtttctgagacacctgctgctgctgtatacctttcttccttttgggtgttgtatttgtttgattgcagaggctgttgattcaacattgatgcagtttttttttttgcttcgctttaagttaatatttcaactagtaattttgttttccctcctaggtccgtcccctctttagctgtctctctgtctcttaactctattattccttaaacacacaatcattttttccctcctccttagaaagtgtgttggctagattgtatagttcagatattgttttgtattagcttatctgttgttcatcatttgttctgttgtatgcaaaaaaagcatcatatggctcggaaaaagtgtgtgtatctctactcactgttgagatcacattgaatgtagcttaatatattttcctacttaacaggtgattcactcatgcgagttgttcacagttcttatggatgcaggagagtaattgtgctcattgtatcagaaaggacatacaattgatatagggtccagaattcctgatggcatgttgtaaatcaagctagtttagtgagtatttccttactagcgaacggaagggtgctcttgttcactcactctcacctgttttggttaattagataaaacactatatgcttggtctctgtgttgttaaatttgcatttaatccagttataagcctgtcaacaggctgcagtggtgtactgtattctttcttttgtgcgactattttttgttttcacctgcattgtccacagttatgatgtgatgggacaccctatgtcatacaggcactttttatagctctatgtgcgagtttatgg

SEQ ID NO: 47407 - DNA, 1792 bp, Oryza sativa
ataatgctaaattatcatagtacaaaatagaatctactccaatttcacttttacaatgagaccatgggtatctgatatgtacatgaattatcctaccatgacttttcctggacttatcttgtattcttcagaaaacaagcagtttatgcattacgcttgtccttttgcagctctgccttttgacagaagacgtggtaggattgtagatcctggatcctactatatccaggttacatttttctctactttatttatagctatatatctggcctttattatttgtgtgcttttgctcaagaaagtagtaatattcaaaccgaaagtaagagaatcatatatgcttcttaatgcggttcaaaatgattactggccataggttttcagtcacagtttaactccagctaaaaaatcagaaccacagaacacaaaaacatagctgcaacttccctgatacatcactgtactacggcttggttttgttcttacagttggaaatttgtgtagtaattgtaacgctttcctttaagcatttctaatctgctcaatgcatttgactcgaacagtgtgagcatgtaccatgtcacatcagagggaaacaaatgattttgagtatgaaactttcctccctcccattttaactcttccactgaagaatagacacatcatgagaaattccgtagagtttcggttctccctccatcccattgtttatgatggaagtgcaacttttcatcagtcattctaggtctccagccctccaccaacctgtgatcgtcacttgtctgtacgaagcgtctatattattcatctttctctatggccttgtccctactctctagtgtttgacacggaagatgtcagcatagagtaaacaaatggtttgctcctcttgttgctcattttagtccacacagagctcttgacatgctttacctcttattatcctctgttagaataagcagaacgcatgcttatctaccgtgctgtactgctgtgtttcattatccttttgaaaaggctggaaaggccactatggatgcgcttgagacactttctatgcaacatttaagctgatatgcaacgtagcatcatttgttgccagaaataaaattttgaaagcaaaatctccttccaaaaggggtcataagtttgataagctgctaagcaaatacctaatgaaaaacagggtggtgtgattgtccctttcataatgctgttgttggtactctgtttcaggttataagactttctagtattgtccacatttatatagatgttaatgaatctagatacatatatatgtttagattcattaacatatatatgaacgtggacaaagctagaaagtcttataatatgaaacggatgaagtacctttttacatactctgttatcaggattacatatccacaaacctagtgaatactgaatacagatcaggctgcgttcggcagatgctgattgagagaagatttctcttattctccgcccgcatgttttctgaactaaacgttatttttttttgcaaaaaaagaggaaagttcttttaaaaaatcatattaatctatttttgaaaattgaaatagttaatatttagttaattatgtacggatggtttatcttgtttttgtgtatattctctttttctcccctctcgtacacagccaataagagtgctcccgagtccctactcccctcggacagtccaacctcttgattcaatctggtaggataaaaccatgtttggtccttagtacttactacctccgtattttagtgtatgatgccgttg

SEQ ID NO: 47408 - DNA, 3859 bp, Oryza sativa
cggcgtcatatattaaaatatggagagagtacaaattagaaatttggaacaaaggctagtcgctacctcatcagcatcagttacagcttcacgactccttcaccacttaagtaattgattttctggcgcgattaagagcttggtatatagtccagttgggtttagtttgtaccaaaatttaggtttctaccgagaaactgaaacatctcaaagtgctcacgtcatgccgacgcaggcatatcatccccgatcagaaacccccaccaccgtctacaaaaatggccacttcgattttggtccaccaccataggaatataggatacacgcatgcacgggtgtgcactgcacccagctgcatatcgtcgtatatttcataacccgagaagcacccggagccacgggctggtcgctgcagcttctcctccacttcaccaaccagccgcggcgtgcggggaaactcatcggatcatacagatgcatgcactctttgccgtcgcccgtgacacagccttctcatcgtcgccggcggccgacgagcacctccccaacgagcacccaggcggtcacctctggaaccagagcgtcctgtgagtatatgcacatctaaacaacactttgattctcgtattattattattcagttaagttacaattgacaagtcagacgagacgtgcaatgcatgttttcagtagcagggaagaagagcatgggagcaacgacgacagcttcagggagagcctcgtttctttgcttgacaacacgagagactacgtgatggctcccgaagtgttcgagggcgtccccgtggcatgcgactacctcaaggggatggacagcgacggcatggccgcatcagctgtcgccgcctatagcctggacaacaacggccagcacgctagtgttagttcaatcgagcatggcatcgctagctcgccgctgctggcgtaccagctggggaagaacagcgctgtggtgcaacggagcatccagcagcaggaggttggatctcccatggccgcatttctgcagcaactgattcccactagtgttctcgatcagtctggtatagggtttgggggagtttgtctggacggctcagcactggaggcttcgttttgcatgagaacttctccggacgtcagctctttcagtggccacaggtcagcaaccgcagaagaattgatgtctacagacacaagggagcaagaaattacacggctggtaagactgaacaattgtaatgtatcctcaaataagtagaaaccggtgtgaaaaaaccttacatgtacaattcttgcaggcaagatcttgtagtagcagtggaagtgatcgtaacaagaagaaactatcagaggtaagaggaggaggcaaagcgaagaagttcagtcagagacttcacatagtacatcttctcccaaggtaactaacaatgacaaaatagtggattgactttgcaaatcgttctgaggagttggcatttgaagaacttgtttcgaaaccacacgcagcatcaatcacccaaagtgaagctgggggagaagatcacggctttgcagcagattgtgtcacctttcgggaaggtatgaccgtatgagatcattaaacgcacactttatgcttccaaactaatgtaagaagcaaaagtattttctcttcttcaattttggccgttaatcattacatatttcattttaacagacggatacagcgtctgttctgttggaaaccataacctacatcaaatttcttcatgaacaaatacaggtgacaccgtcagcacaatccttttttgctgttttgcacatgccccctgtgtgttttgtctcagatcgaagtttctataaagtagtacggagtagaagatactgccatgagcactgcagctgagcgattcactgtatcgagatatatggatcgttcatcgttgcaccgactacttcaaccttttgccttatttcagattacgcatttgggcatttggtatattgacctcttgctttgtgccttttgccagtggacctccaagtcatgtccaagtttagtatgtcgttttcgtgacactaaagaacataaagaaagtacatttgtactggcacaactattactgatttgccaaccttttctgaacctaataagtcatgctcccacagagataagctgacgaataacccttctatttttctgatttggtgcagttattcagccaaccgtatatgacaaacagcacaaacaaggtagtttttcctattaaaacgatgtattgcaaattctaaaagcacagcgaggccaggactgaatgacggagcatatacatttaccaccatcttttcttcagggtcatattcactggggaggggaagggaagaggaaggcaggtctggagcatgatttgaggggcagagggctttgcttggtccctgtttcctggacctctcaagaatactgtgatagcatcctgccggagtgctgggctccggcgtacaggaactacttttaccgatgagccccatacacattagacagctcacagccttgtctcacttactgcccgtgcaacggctacgttgggaagatttactgtttacttactctatgtttttcagtccccatgttatatgtattgctgagtttgtagcctagaacgaataaaaagagtgaagtgtataggcggtctctaaacttataagagtgtcatatctaggtccctgaactcttaaaatgtattttaggtttttgaacttgtactgcgtgtcatatatgtccaaatggatcccatctcattccatgtattgatgtggcatgccacggtggtgcatccatgtagtggaactacatgacagtcatatagaaaaaaaaaatataacgccaccatgtagtggaactatatgacagtcatatagaaaaaatatataaattagtagagattagaaaatatgttttttatttcttaaaaaataaaattaacattaaaaaagagaagcgatagagagggagagagagggagagagagagagagagaggagaaaatgatgctttatttttttctatatatgactaagggcaagtgctataatgcttcatgtgctgtctctaaaaatgacacataggattgggtgatgaggtggagagagaagtgaggagagatatgatgaaccacccctaaatcaagaggtagcctccacaaactctaagaaaaaagtgagagtactaaaggcattgatatttgtgtattaggggtgacctgttgtatatcttacatcttaatttattggtgaatgccataaataattttagaggtagcaatcacatctattatagtacttgccctaacatgtggatcccactaatatgtacttcctccgtttcatattataagactttctagcattgcccacattcatatatatgttagtgggtttgaggttatttggacctatatgatatatctataaaagtttaagaactgataatgcatttcaacaaaaaaaaagtttttgaaagagtggtatttgagaatgcggcatccgagagagtggtataaagtccaaaattccggtttaaagtgggttagagttaatttctatactttttagcaaaagaaaaaaaattaagaacttgataagattgtaaaagaagccacctgctaccacccctagctgcagcacgtgccacggcaatatctattccgtagccacggttacacgagacggagccattttacttccatctatacgacgcaacgtcatgccatggacgatgcagcggtgcttcagtcgagatcatctcaacgagcgcttgggctcgatcgccgcaggattgcgcccatccgagcgtgggcgccaggccggcctggcgcct

SEQ ID NO: 47409 - DNA, 9371 bp, Oryza sativa
taaaagtagtatgggaggtaactgacaccacagtgggcgtgatctcgggcttggggaaaataatttccccacctaccctcgtcttctcctcgccctcccctcatccatcgctttctccccctcccggtcgcccttccagtcgcctcctccccgtctggcgtcggctccgcccgtcctccccgtccggcgccggctccgctcctcctcgccgcgccgcaccgcttctcctcgcctcgccgcgcctcctctcgtctcgcgtcttgtgcggcggcggctgttgctgctgctccggcggcggcgagttgcggcgggcgtcgggcggcggcgcgggccctggattcggccaccaccaccggcctcgccgccgcccgctgcggagatggagaagaggcgggttgcgcggactcgggagcggcgggggcggcgggagtggacgacgcgacgccgacggtggacgcctcctcttctctgatgctccggccatctctcctctctcttctcgtcgtccctgcaaccctcctcagccaaagaaccacaagagagctcaggtagcaagcagatagaacgggtcaaggtagcttcagaatcaagaagaagaagaagaggtgagatttttattttgatttttattttctctctgtttgttttgcttttggcgtggttcttgtttccccaatcgagagcctcaccccctcaagaggctcatggatgtgaggagaaatcaaaggccaaaagaagaaggagttgtttttgtgtgatttgattcctctttgctgcagggaaggagaaggaggagcaagagcaagccatggaggagccggcgacggtcgggagggcgcggccgaggaggtagtaggcggcgcagagtgccacgatggcagccatggcgggaagcgtgacgatttttttttatctgtgatgatttttcttccttttttctttttcatcttgttgagtccgatctgtgataattgttgagtccgatctatgatgacttcaatttcttcctcggctttcacttctccagccttctcttcttcctggtcttctccaccacaacacttctcgagggcgaatcggggatttcttccgggggaatcggcgcgagggcacggggcagcgaagaaacgctgcccacagcgcgcgtgcctctgcgtgctcctctgccccgcgcctcggtttcttgccgcgcgtgggttgcgagagaaggaaccgcgcgcctcagttagggggcgaggtgctctggttgggcgcgctctcgctccacgtatgcacgaatccgacgtggaggggtgtaacaccggtccagctcaccgcactgtgaccagccttagagcaggtacaatagcagactattagctagctataaacatattttaatgagataaaagatgagagagaagtgcagcgggctacagatctgtagccagctgcatcatatacttcaaaacgcagtgtgtgtatgacaggtgggaacatatattaatagtatagtaagcaactattgtatgaattgactattagattggctatagatgaattggagttagtagtggattatactactcccttcgtcccaaaataagtgcagttttagcactcttcatgtctaacatttgaccgttcgtcttatttaaaaaagattatgattattatttttattattactagatgataaaatatgaatagtactttacgtgtggctaatttttttaaatattttttataatttttttaaataaataagacggatggttgaaacgctaaacataaatatttatggctacacttattctaggaaggatatagtgttaaacaaacttgctcttacctcgccgtcaacttttcccaagaaatggaatgcatcagtgtccgcgccacgcggtgaaaaaccatgcatccacagtggccggacccccttgtgctggcgagggcgtggggcctatgaacctgaggcggatcaaattttttttatttataattttttttattaaaagttttacaaaaataattttccattttgaaaattgacggaagtagtcgcctaccgccctttgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgggggggcatggaattttgcaggcggcccccttgccgtcctgggggagggcgattttatactgtgctctatatttttgtataaatatcaatagttataaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaatggcatttgatcatatttggtttgctgccaaaatgtaaaattgtagtgaagaatgttctacataatctcaaatttagattacgtattaacaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcaccgaaagttgatagtgataactcgagctgccgcttttcatgtgtgctgttgtggactgtgcgcgctactggatctgacactaccgtgaagcaccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccaggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacaaagaggccccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaatttagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtacgaggaaggtaccagcgaaggtactcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctatgaagagaggtaaattatatggctcgatgaagtaattatcataaaaatttaaaaatgaacaatccgaactcacgagtggtcggcagggaggacggtcggctgcacgttgcccggaaacacctgcctaagtccgaactgtctcatcacacgctgcgggcagtgaggctcaacgaaaatgtcaaacaccatcggcaggatggtgagccagtaagcctggtcgcgtgtgcacaaggacgaaagtcctagcggtgctcttgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcatgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcatggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcagaccgagtaatcatcagcgtcagggtgcagaaggtccgcctacaattaagaatgaaatgttagtacaaaacactcatccggtcgcaaataagcatgtatgataataacaacttatttacttacagtgaactggagcaaccaagccttgctaggcccgactgtagagtacggaggaagggtgttggtcggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagccgacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacatgaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctacattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaaaatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcgtcatgtaatgcaccaagaggtatgggaggctcgtcaccttcaactagtggtctgcgagattgctcatctgtttgcttcattgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatattaccaacaacactgctgtacatctcacttgccacaaaagctgaagtgatgtttcggtgatacttctccaccccttgtaagtagcacttatgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatattctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatag

SEQ ID NO: 47410 - DNA, 5280 bp, Oryza sativa
tcgcgcccgcgcgcgtcttccgctatgcgaaccgtcaaacatgaacgaccatgagccgaggcccgagcatctctccattgacaggtttcctagcccaagtactatccggatgggccagatcggtggcgctagccgaacaaatcacccaaaaagaaagatactcgtggtgagacgggttgaacttagaattgtgttgactgtgtgccgtacgcctaattaataacatctctggtttggcgttgacatggcggcgctcgaattatcgatggccgtgtgagtgttcaagcacgaaacggctaatgggcgatcgctcgcctggcgatggggtagcatcaattcgctcccccctctccccctccctccctccacctggtattttttttatttggctccgtataacttttctattttagtaaatttatacacctaaagtttatacatcttaattttacacatctaaagcttagaaacccaaagtttataagacaaaagtttatatatccgattcaaatttgaatttgaatttgaatttaaatattttttatatatagtatttctatatatctaaagtttatacacataaagtttaaaaatctaaagtttataagttaaaagtttatatatccgattcaaatgtgaatttgaattcaaatattttttaatatagtatttctatgcatctaaagtttaaagtttatagacccatttcaaatttgaatttgaattcaaataatagtttatagacccaaagtttataagtaaaaagtttacatacccgtttcaaattcgaatttaaattcaaatattagtttatagacccaaagtttataggtcaaaagtttacatacccgttttaaatttgaatttgaatttgaattcaaatattagtttatagacccaaagtttataagtaaaaagtttacatacccatttcaaaattaaatttttaattcaaatttttattgttgtagtaagagaaaaggggaggtaaagtagtaagggggaggggcgggtgatcgctggggaggggagataacgatcacccgtccattaggattacccattcaagcatgcctatccatcactggtacgtagtatgctattaattagacatcagtcatcagatttcatctcaccaagcgtttggttgtaagcgtgtactgtacctcttccataattgtttgttggttttattatttcagtttttattatcgtctaagtatttgatcttttagaaagaatttcgtaataagtggttgtttcttgtttaaagcaaataccggaattttaatactattatcttaaagaaaaaacttgtactgtaccttcaagtacgtcactcgattcataaacacgtacagtaccattgtgtacggtatgaaaatgaaaaaaagtaaacaatattactccatccaagcaacaggattatatgacccaacagaggccgccaaagttcggacaatcccgtacctagctccaacagtatgacgaaatctacaaattgatacccctctattccaaaaaaattcaatcatatacataaatctggacttatatgtatctagattaatagctaaaaattcatttttttaacgtagtatatagtatacgtacgtgacaataaagaaccaccagattgcacatgggtgtactatagcttaccacatatagaagtacaaaaataaactgattaacgtctaggcatataataattaggcacgctacctgataatagtaaccagactaaaaaaatcacgcgctacgtcatacgcgagacattgactcgaacgggtattatcaactcgcaagtcctccatccatcagcaggaaacaaccaaatttaatacaccatccgtcccaaaatataacaaattttagcccttaaaatttgtcctaaaatataacaacttctacactaacattatcttcctaaccaatcacaaccctccaccattcactttttccaccaaatttcactactcaaccaattacaacccttcatcattcacttttacctatcccttctttctatatagttaagacccaaagctaagttgtggtgaagccacgtcatcatttaattgtcagccgttggatgtaatctgaatggtcgcagatggtcgcacaagcgtgaagcgcccacttctgtagggtttctcggaaaaaaaaaactctatccgcatcgctcacgcctcacggccgatgccgccgcagctgtggtgaagccacgtcatcatttaattgtcagccgttggatgtaatctgaacggtcgcagatggtcgcacacgcgtgaagcgcccacttctatagggtttctcgaaaaaaaaactctatccgcatcgctcacgcctcacggccgatgctgctgccggatgcggcgcttccctctcccttctccttcgccccttctcctcccgcgttccccgtgtgcgccagccgcgagcccacgaggccattcgcgcaccaagccatggagcgccgctcatctgtttggagacagatcggtcgtgggagggcaagcgggtgcgacggcgatccgtgcagctcgatggtggtggggggcggagtcgcgtcgcgccccggcgccatccgccccaccatggtggctcaggcggaggaggcgaaaccctagcgtggggagatgaggtaggctttgatgcatctctatttcgattcttgcgtctcgtgattgggggtatcattcgcggagcggagagggtagaaggaattgaggaggggaatcggggggtttgggtggggggtggtgggatttcaaaaccctaggtgtgagttcttgccatttttcgctagctgtgtggttcaatgaattccgaaaccctaggtgttaggtcatgtttttgcaagatcttgaatccccagttgtgttagactgtaattaggtttcgtgtaagcaattttaggagatgtatgatgcattttgtgggtgacgagtatccctggggatagggcttcatcagcctgcaaacataatataaatgaataatcgatttgaattccctttctgtttaaccaggtgaccacccttgattggtatgtctggaccaatacgcacatagacattggaaatgatctaaagtgatttatgccgtaccaggacgctaaaagtgatttatcactgtaaaacttgaaccataagtactcaatgatctgacagcatgtaatcatgtcaatctggattagaaaaaatagagaaagtaaatatcaaaaaaagtaagcttacctattgtaatgtagataagaataggaagaatatcatcagcccctgatagtggtcgatcatttgacattgacacatctagtagcagcaagttattgatgacttggcaacagcttataatgcaaactaagcttctctgccataaacatcctaccaattgaagcagataaccttgctcggtatgtctactgttcaactcaacatatatttttcatatcttctgtacatctcttctctaatttatccttgcaatattatttcatatccagttacaacttatggatatactcctaaatttagtgtcacaccccgatctggcaccgccgtacaacggcacctgataggagcgtgtcgtaagaaaaacggcgcgaaccgcttcctacgaaaccgcgatctcagtaccagtcccaggacatagcgctggtactcacagtgacaaatatgaatcattgcaatccttaaaataaatagaggacttatttatcttaacttacgttgcagctcagaacagcccgagaaatacaaccgacgacgcggacgaggaaacaccaacaacagcagcagcagcggaaccaacggactaacacccagcaccacagacgacggctgggaatcaggacgaaaccctaatcttcacttcacttcacgacggaggaactatatatatttatatagagcaaggtgagtactttcgtactcagcaagtcacgggaatttaggtgtttaatgcaagcttggagagaggcaaggttgttttgcaaatcctttgtttgaaatccattttgaaaccactaagtgatttatttctttttgagtttggatcgaaaagagacttgtgtctcgattcgacttaagagacgcttttcaacaactcaaatggtaatgtaccgacctcccgggtcagatcattacttctcggctcccagagccatttcacttgattaagcggctcccagagccttattcattttctcggactcccagagtccagctgcccagcagtacaacaatccgcttccactcgggaagcctagtctatgatgcctgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccacccatgaccgtgggcacggctgttcgaacagttagttaacctctgcagaggggtacactttacccacaagacacgaacttactccagacactggccggtgtcagaggttcacgacaaagcctttccaaaccgagtctgggttacctcatgccacatagaaggatcaaatcctcacataaatataggccattttagttttcacaaatcaaactccaaccacctcgatcggtaatctggcaagcttcgcgttcttgccttaccaggaacccgggttggctccaaccgaccccgccccggcgttccccaactattggcatgcgaggttttctcgaaccgactagatacttagctaaggtgtcccatatcaccttgtggttgcactttgttatgcttgatgagtttcccacaggaatcgatccttatatgcgaatacgggacagcgccacgcaggcaccaccctcgcatcgcgagttttcacaattcattttatttttaaacacaccgacaccacatgtcgggttttcaaggcttctcaaacccatttcccaatttttcaacaatcaacggtgtatgtgggatatttggtatacgcgcttagagagcacgaataccgaagtaccgcaagggtggagcgacaaggaatcagggtagtacaacctacaggaattagtgcgactactgggtaggtccgtcggtttggcacgcaaaccgaggccaagtaagttaagtgtgtgattctaataatgcaagttgcaaacaaagtaataatgattttccaattataggagaaattgatcaaagggtgacttgccttgctcaaggtcttcacgaagcttcgcgaatc

SEQ ID NO: 47411 - DNA, 2551 bp, Oryza sativa
gagagagagagagattataaacataggagttggaatggatttcattctctggaagctggatcagttatttggaaggggtcaatggaaggtagagagaggttaaagattgttgagattgatttcatttttggggagttggatcaatcaagggaagtttcttggaagaggtttaggaagaggatttgaatacaaagacgaggttatttttggacagggattttgagtagacgatgatgacaatggatcttgaggcaagggagggatttttgattgagatctatggcacaacttagactcagcactcaaagaacaaaattttcgcaattagggttttttgtaaattagctttttaacgcaatgcgagaatcgcggcgttacatttagcaaatatgatagttacttctgatatttgtaaatatataatcagaattagttaattctgaattgaattggttctttgccctgagtactgattttagttcctcaaaaaaagtatctgaatttattctatttggtaagcctaaatttgcatgaattttgcccacattctatttgataatacattatgatttgaaccaagtaggagcactattaaagttttgtgaatttgtttctctaaacctaagaaagaatccctaccctatgcactgactgttgtttcagtttcttaagaaaagatttatgatacttgcagtggatacttatatgtcctataactttaattaatttgagcagttagggaggagacagatgattggtatatagatgtcctgacatagcgaaactaatgttgtgattgtgaatataaatttgaaactccttgcaatccaaatgagtattctgtgttcagtacttttagcaattgatgctaatgtcacatttaattgctcaagtagcagaactattcatttatatctcgattcttccatctatatttttttatacaatttaatattatgtgtgcatatagctaaatctaaaggagtttttgttgtttctgatatttgcaggtttttgaaattgtatactacactatattcctgtttgatttttcatgcctttcaagcaataaaacagagctccacattgttggtttatgagcttgatacgatttcaagtatttcttacttgagtacatattttgccaatcaattttttttcatgttcaaacaatacaatctaattgttcatacttcaatgcacatttcatgttttctaatgtgcccgcggcaacgcgcggggctttatctagttttcttaataattatgtccacctctaaaatatattatgagacggagatagcacgtcagatcgaactcccggccggccgggtagcttcaattatcacattgcaacgatgctcgggtattacaatcagggattcagggtgtggctgtccattgtccacgattagcaaggtagcgcctgcagcttccatgagagaaagtgttaattaatcactcatccaacatgcttaattgccaccaaaccagtatatatagtgtgtattaattaccatggtcaaccataacgagaactgctatacacacacgatgttttgcttacgatagttttacgatcaaacgtctctgttaatggctgcatgttcctgtccgataaaaaaacatattccactcctagctgaatggcacggcgctagatcttacaaatatcgtaatcaattatcggatgcatagtattttcccaaggatatctatctatctattatattattaaaacagctttgaaaggaggcaccacattcgctgtgggggctagaaattcccatattaatcggagaaaaagaaaaagagagtccaagtagaaatacaatttaaaaataactaaaattcggaattaaaattaagcaatattgaaagaagagtccatataataacccaatgtgagattaattaatattcgaaataaaaaaataaaatccgaaatctctatcccttctctactacttaaaaaatagaaatatttccttcatccgtttaaatgaaaaaagtgaaaaaaaagaaagtctgattccccttggaaaaaaaaagatctgatcacttaaaaaggaaaaccaaaaaagtgagattaattaatattcgaaataaaaaaataaaatccgaaatctctatctcttccctactacttaaaaaatagaaacatttccttcatccgtttaaataaaaaaagcgaaaaaaagaaggtccgattccccttggaaaaaaatatcctatcacttaaaaaggaaaaccaaaaaagtccgagaaaaaataccgttaaaataaaaaacgaaaaaaaataaaaataaaagtccgattcccctggcaaaaaaatccgatcacttaaaaaggaaaaaaaacaaaaagtctgagaaaaaatagcgaaaaaaacaactaaaaaaatgtccgattcaaaagtggcgaaaaaacagaaaataaaccgtagatcagtttcccctaaaaagggtacggttcctgtataaggctgataaaatgtggcggacaaattaaaaatttgcgaaaaacacctaaatatggccgtccgattcaa

SEQ ID NO: 47412 - DNA, 5670 bp, Oryza sativa
gttttagcagtccatatatatcttttctctatctcaaatctaacctaatcaaactatttaaaaagaaaagttttcatcgtacaacaaaaaaagaaaaaaaacgcgtgagaaaaaaacaaaaaaaaaacatgtgagacaaaatgtcagaaaaaaagcaaaagaaacgcttaaaaaaggtttccatagtctataaaaaattagaaaagcgcgcgagaaaaaatatttccatcgtccgtaaaaaataaaaaaaaccatgcgaggaaaaaaactattagaaaaaacgtgccatttctaaaaaatggtttgaaaaaaccgctcaagaaaaaaggtaaagcaccatttataaaaaaaggttactctgaaaaactgtgagaaaaaaaatgctaaattgatctatgcttgggttggataggatccatcgattttgttcatctcctactgagcttttgtttcgccatctattttcctgtattggaaaaagcaaaaaaaacacgcgagggaaaaaatgttagaaaaacaagcaaaaaacgagcgagaaaaaaagcaaaaagaaaacatgctaggaaaaaactgtcagaaagaaatgtgccatttctgaaaaatggtttgagataactacgcatgaaaaaaatactgttcataaaaaacaagccgctctggaaaaatatcagaaaaaacactgtttatagaaaaaacccggatcgaaaacaataggattcaacgcgagaaaaaaccattgtttctaaaaacagtttgagaaaatcgtctgactcaacacgagaaaaaaaacaccatttctaaaaaagggttagcgaaaactatccgactcaacatgagaaaaaatgtcgtttgtaataagaaccgctcctaaaaaccatccaactcaacgcgagataaaattgatggacgcttgggttggataggatccattgattttttttttccatctccttcatggcttttgtttccctatctattctccagtattgaaaaccatgaacgtctctatatgcaattatcagactatttttgttaagtatagctattattcttgataacatagatataaaaataatattaaaaaataaacatattttaaattgttatttagagaagagtgcacaatgactctattttgtgtagacttgaccatgcaaggcagtgcatgatttgattgatcatgttactatttgcacgaatgagattcgctgtggaggctagaaattcccacattaatcggagaaaaaaaaagaagagtccaagtagaaatgcaatctaaaaatagctgaaattcggaattaaaaataagcaatatcgaaagaggagtccatataagaccctaatacgagattaatcaaaattcaaaataaaaataaaataaaatccaaaattagaaaataaaaggagagtccaagtaggaatatattttaaaaataaccgaaattcggaattaaaaataaggaatattgagagaagagtccatataagaacccaatacgcgattaatcaaaattcaaaataaaaataaaataaaatctgaaattagaaaataaaaggagagtccaagtaggaatatattttagaaataactgaaattcggaattaaaaataaggaatattgagataagagtccatataagaacccaatacgagattagttaatattcggaataaaaataaaaataaaatccataattagcaaaaagaaaagaagacttcaacagaaattcggaattaaaaaaagcaatattgaaagaagaattcatataagaacccaatatgagattaattaaaattcagaaaaaataaaatgatatccaaaattagaaaaaccaaaagagagttcaagtaggaatacaattttgaaacaactaaaattcaaaaaataaaaaataaaaatattaaaagaacactatacggtattaattaaaatttgaaaaaaaaattctgaaactagaaaataaaaaaaatcaattaggaatacaatttataacccacagaaattgatgataaaaaaagactattgaaaaaaaagactatctaaacacatgacaagatgaattaagtaacaagcccataaaagagtagagtggttacggttgatacgacatataaaaactattagtaaaacaccaaatataatcctaatgatgattaaaaggaggacgacaggcaggccgtaaagcaaacgggcaaggcggttgccgggacttctagaaagtaaaaaaacccattgataatcatattcgatttttaaaatctcaatgataataaaaaggagaagcagtgtgcgggtgtataggacttctagaaaataaaaaataaattccaacgatagttatattcgatttttagaatcccaatgacaataaagaataggccgtaaaggagtatagtggcatcgtttgataggacttctaaatattataaaaaagaaacccaacaagacaataaattctaaaaactacaaggtccaatttttaaaggttcggaacttctaaaaagtaaaaaaaaaaacaatgataatcatgtttgattttaaaatctcaatcacaataaagaatggaggcagcggatgagccataaaggagtacaatggcaaagccgctaacggtttgacgagacttatagaaagtaaaaaatgaacccgaacgataattatgttcgatttgtaaaattccaatgacaataaagagaaaagacaatagttgggccgtagacgagtataatggtagcgtttgatgggacttctagaaattataaaaacgaaacccaacaagataataaactcaaaaaactataagatccaatttttattggtttcaaggaaaatgtacaaggaaacagatcaccagcagattaaacagaacatctacaaggaaacagatcaccagcagattaaatagtattttgtgaaagtgaaacgagtttagcactgtgcatttactattttgcatgctaatttgcatcaacttatgaattattgggttcatcatgaaggacaaccaaccggcccagtcttgcatgatgcaagctatgactgtagtgagtctgtgagttaaagattacagagtattagaattgagcttatggcactagggtaactttattggtgttaggaaacgagtgacaaagaaacgataaaaaacaatagataaatcacagaagacacaagatttaacgtgaaaaattctctcaaagcaggagagaaaaaaccacgggcgccgacgagcaatctattcaggatagcccactggcggtggaacaccaccaactccctaaattctgacatgtgggcccattattcatcccctcttcaaataggtgtgcagggtctgaaatttgaattagaaatagccagggtttgtgaatatgagtatttcttttctatttttagtggtagaccgagcaagcaaataaagaaggatatgacagaagtaagagggagcagctggtgtgacttttagaaactatataattagaaatatggtgatagctatttaataaatctcaagtaaaatcatacttaaaaatatatatgattttgtttaggtgctagctgcgcaaatgcgcgggccacccagctagttcctttcaaaagaaaagtattttcccaaggataacttcttcgccgaaaaatagaaggcaactgtattggttaatcgagtgagcaagtgcatgcatctcctcctcctggagtaaatattgcagcatcaacgtcactgcccgtgttggctcctggcagttggcacgaacgcacacatacatgcatctggtttcctgagcagaccgcggtcctgcgtctgaccgacgcggggccccgggatcgctgctcggcataggccgtatctcgcttatttggtcaagagacattagccgggtggtggtcatctgccaagatctgccggttacttgcactttgttcggctgcactgcactgcagtctgcacccaaccaaccagccggctatagccgctagcccactcgtcaagtggtcattcacacgaaaactatagcgcgttagttgtttgactcctattgatcctaccatcaacatgttgcaaacataatttggaacatgatggagttgaaaccacaagttgcctcgcgaccacacgcgccgaagaagtggcagctcccctcccattcccaattcgagccgagaatcatcgtgcacctcgtccataaaccaatccaaagcgacgtcaccacaccacacaagtacgccacatacaaggtagtaagtcgtgaaccaggcccacgttgttttttccgaggaaaagtccacgaggcttcgtggcttcgcgcttcgccttactacaagaggggaacgcgcacgaggcgagccacgcgattcccccatctctccgacagcgagcttcgtcgtcggctgtgcgcggccgcggcggcggcgctggtcgtgtgcttcccaaattctctcattccccagcgagcgatcaccatggggctccacaaggaggcgagctcgtcgtcgtcgcggctcgacgcggcgccgctgctgccgcaccacggccacggcggcggcggcgcggggcaccacctgtcgtcgcagcccaagacgttcgccaacgtgttcatcgcggtggtcgggtcgggcgtgctggggctcccctacaccttctcccgcaccggctgggtggccgggtcggtcctcctcctcgccgtggccgcgctcaccttccactgcatgatgctgctcgtcgcctgccgccgccgcctcgcctacgaccaccccaagatcgcctccttcggggatctgggcgccaccgtgtgcggccccgcggggcggcacgtcgttgacgccatgctcgtgctcagccaggccagcttctgcgtcggctacctcatcttcatctccaacaccatggcgcacctttacccggttggggattcgtcgccctcgtcgccgctcctcaccgccaaggcgatcttcatctgggtcatgctgccgttccagctggggcttaactccatcaagacgctgacgctcctcgcgccgctcagcatcttcgccgacgtcgtcgatctcggcgccatgggcgtcgtcctcggccaggacgtgtccacctggctcgccaacaagccccccgtgttcgcctccgccggacccacggagatcctctacggcctcggcgtcgccgtctatgccttcgagggcatcggcatggtcctcccgctggaggccgaggccgccgacaagcgcaagttcggcggcacgctcgcgctgtccatggcgttcatcgccgtcatgtacgggctgttcggcgccatgggttacctcgcgttcggcgcggccacgcgggacatcatcaccaccaacctcggcaccgggtggctgtccgtcaccgtgcagctgggtctctgcatcaacctcttcttcaccatgccggtgatgatgaacccggtctacgaggtcgccgagcggctgctctgccgcaagcgctacgcctggtggctgcgctggctcctcgtcatggtcgtcgggctcatggccatgctcgtgcccaacttcgccgacttcctctccctcgtcgggagcagcgtctgcgtcctgctcgggttcgtgctgccggcggcgttccacctcaaggtgttcggcgctgaggtcgggtggcccgggctcgccggcgacgtcgccgtcatcgtcgt

SEQ ID NO: 47413 - DNA, 7753 bp, Oryza sativa
aaaaaaaatcctttttatatagaagtttctctaaaaactcaaataaacatatttttcaagttggtagtaattaatgtttttttaatcatacgctaatggttcatctcgttttatacaccgtgagttcccacgcaacacctggaatgaacttagcctaagtctggtttggttgtatactaatcttaggttgtgttcggaaggatttgttcccaacacgcacagtgcgtatgaaaaacggaacggtccattagcgcgtgattaattgagtattagcttttttttaaaaaaaagatcaatatgattttttaagcaactttcgtataaaactttttgcaaaaaaaatgcactgtttagcagtttgaaaagcgtacgcgcggaataggatagagaggggttgggaacccactgttccgaacaaagccttaaagcgttttcatgcgctatggtcatctgcccatccttggaaattttccttatgtaaattgctcatcaaaaaatctctacttgcactcaacttgataagttgataaggaagaaaggtgcatgtttctttgagctgtcaatggttgctacatctctttctggggcacaagtaataatcttcctctggcaaagatgagtgctaaatgccagtccaatgggatagttcccttgaaaaagtggccaagcatagatgaattgactgctgtttccatcataggacttggagcaccccatttgggccatgctattgtaatttggaaaaagtccactttagcccattatgtctttgatcttgcaaaaccgtttaaataaggttctttggcagaatggaaggctggttttgctgacgtggcaaattgacgcagtccactcatgctgactagacgcttacatggcaaaacaaatacagccccacatgtcatcctctcctcctcccctctctctctttctctctcccccctttctctccctctcatctcggcacccttgtgctgctcaacaccgtgttcgaggacatcgtctggcttcaccgcatctccttgtcacgctctgacggtgatgacgacaacttgtgtgggctcctcaacattacgcaaaacgagcttgtacagttgtattgttcctcatctgggaccacgtcgcgcgcctgcacaccaacgagggggaggctagcggcgccagggacgagtcattgttacccattggtttaccggcttttaaaggtagcattagtcttgcctgtttgccactgctactattgaaagatgtttttcaaccatgaaaattgtgaagacatttttgcgcaatcgcattagtgatgaaacacttgagggattgtgttgtttgctatgttgagaaacaagaattgatgaaagttaccaaagtgcaataatttgccgatttgagatcttaaaggcacgcagacaaccatcttgaaatgtattttttttcacattctcattctcaatacatatttacattatgttttttactaagtgatctcttctcttttctagacaaaacaatatgtggtattggaggtttttatcctttcttgttttgtaatggtggattaatatttcagtgagcatttcattcctatgcctttttataactctacgtggtagttaattatatactctatatgtcatattggttatcaatattgtgtgttctctagagctatgatatgcataggaccccgaatcattttcgttctaggtttgccactagacgggagggtggaggaggaggacggctggcgttgtaggcggcaccgcatctcttgggagagagttgatggcagcggccgacaggagaggtgcgtggtgactggcgaggagaagctcgaggaccggcggacgcatcctcgcccacctcaactcccaccagccgctcacgcacttcgcctctctcgaggagaaccttgtctcccactccgcattgctcgacaaggccttagccgccgcgacacctacacctccgagtccctcgtggtgttggaggcccatgaggccgctgtccccgcgtgcctcgacaagactgaggccgtgttgtccacggatcccccgctcactgattttcagggcacactccaaattgatgtgtggtttcatggacgccgccgcgcaggcgcttcatggcggcatgccaacgggagctcgtcgccgtttggaaagaggttggtccctcattgtcaccacgtcggtcgacccatcccgcctcatgcttgatgtctgtcttgcgaggtacccaacgaatggttgatggtggcgtcgtggtggtccagaacaaggaggatgtgggtgagctgtggcctatcgttgccgggggttcgctcttgttggacatggagcagcggcggtgcaacggccgacgaaacggcggtggaggaagcccgggccgtggcccgacgggcccatggtctctacttccccgctgccgccacaccaaacttctcttccttccccctcctagcaagttgctcgctgacctcctccgccgctgtcgtcgggcacgccgtagaccaaccaccatctcctcgtcctccgattgcccgtgcgcctcattgtcaccacgtccgcctccagctgccgccaggaccgaaggatggggagggagataaggaagaatatattgttttcattgacatgtgggtcccacgtgtttttttttgccacactagcgccacattggccaaaaccaccctcaatactgccttgggacagaatgtaatccggttttgtaagattagagatatgttatatatggtattccggtttagggatggttttaaaacttgacgataagatgagaaatctcaaatgagctttttccttgtaatttcattgcttaatgaaatatgcattatctagaatttttggcctttcctatggatcatgcatagatggatgttttaccggttctcttttccatcttgtcagctcttgggtgagtggagctggacgtgtttgggtctatgtgctctaggaatcaacgaaaaggaccacacattgacagtttcttcatattccttcttgtctttgtcatgtttgaacaacctgagttgcaaagttaatcagaaagttcagagcagaacactaaccagaacttcaggatagagcggagagcagcactacagcgcacaaccatgagaaatcagtgatatctatcgaacacgtacttttagtggtaagttgttttgttattttgaatattctgttagataaatccggcatatatataacacaacgtaaatgctatgagaaatgaaaatgaggaattttacagtactttttaaggatgataaaattactcaatggaaatagttggatatctgatatccccaagtttacaccaccatatgtttatttgattcaaccatagagtcacttgatttgtaggactgaaaactattttactagaccctgcttaactcaaatagtcaactattttactagaccctgcttaactcaaatagtcaaattcaatacaaactgctactactgaaaaagtttaaagctgtatttttttttgacacggggttattcttcgatcaccttgtgatgtgagcaatgaagtcctccagatcattgcgcgatgaacggacggcatcaccgagcgccttcgcgcgctgccgcaccgccaatccttcatcggaggccatcatcttcttgatcacctcctgtatagtggccgccggcaaaacctcgccgtgcttctcccatggcctcactaggagacctgccttgaagtatttgcacaccagctccgcgtcccacggctggtcggagtgcatgggccacgccagaatcggcttcccgtggctcatgctctccatggtcgagttccagccgcagtggctcatgaacgccgccgtggcgccgtgcgccaggatctccagctgcggcgcccacccagtgatcaccatccccgtgccttcggtttgcttggagaactcggacagaagcttggcgtgccgggtctcgccctcgccggtgtccgtgaatatgttgccgcggtcggcgtcgcgcatgacccagatgaaccgctgcttgctgccgcgcagtgtcgctgcgagctccgcgacctgctcaactcgaagagagcacgtcgtgccgaacgacacgtagagcacagaatccgggggctgcctgtcgagccagtcaaggcactcgtgtcgccgcctgccctgctccgacgagcccgtgttgagcagtgggttcaacggaccgattgcgaagagcttcttgccgccggcagccagagtctcagccaaatcgtcgatgaaatcgccctcgagtgctcggctcgcgttcgcgaggatgccggcgccggacaaaatcgattccgacgctcgggcacgttcgctcgcgtagtccaggaactcctgcgtcatgtaggtttccaagggggcatgattgaggccgttctcacgcaggagccgatgcccggtgtctatgtgaagggcgagggccgacacggctacgcagctcaccgggaacgcctcaccgttgggcagccgcgccgcctcctcgacagcgaaggaattgatggtgtcgcacacgacgacgacccgacggtgggaagcggatagctcgtcaaggagcgccgagagcggggcgcgcgcgtccgcggtgtacgcctcccagaggggcatgaggtgggaggggaagggcgtgtcggcggtggggtcgggaggcggagagacgtacgtggagatgccgaggtcgtggaactggacggagaggagggccttgtcgtcccagccgtgcacgcgcgcccgcgcctggcggagctgcggcgccggcgcagcgtagtggaccgcgagcccgtgcgacgacgacgcgagctggagcgacaggtgcagcacctggttgaggtgaccctgcgccgggaacggcaccgccacgatggccaccttgttcgccgggttccccttctctgccattctccgtgcctctcaatgcctgaatgactgagctgaagtctgaatgaagcctgaaaggtgttaactgttttaacgactaacgaaacgtaattggccgctgcccagtgcccactagctacactagctgcccactagtacgtgtccacgaaaaatctatcgactgaatttgtggctgatttcagtcaaattttttacaccgtccgatcggcatgcatagtgctaggcatctcatagcgtattggatctactttaatatttgtgcatgggccttccgttcagctaaagcaatgagtgggctatagttagtttggcccaaagtttttcatttagcaaaggactaagttcaatttaggtcccttagcttgacatggaatctgattttcatcctaaactgcaataccggatacaacagtccctcaactatcaaaactcaaaactagtgcaaataaggtcctaagccagttcggatggcggtttcggctgatgtggcatctacgtggctgatttgacttggtcttcgtcctatgtgacggtgatagcaaaatatcaaaattaaaattaaatcaaaaggtgggacccacatgtcatcgagtgtttagttaaaaatacagtgggacccatggccacccatcttttctccattctttttctctccccctttcctcgttgtcatcactgtagagacaacatcgtggacgccgctgcgagcgaggagacggcgtcgacgacgaggagtaagctcgcgataccggaaacgcggtcgctggcagagctctggggcggagcagaggggcgggcgggtatcgtggcgaagcaaagcggccgtgggccacgggcggagcagtcaggcggtgggggtggtccccctggtcgatggtggcggcggttgggtctagcaatgacgagggacaacgaaaaggcacccaacatcccaggcagagtgcggcgcgacgaaggggacgaggccggcatgagcagattggcttgagcggcggtggtggcgggtccccctggagcaacatcgacccaccaccgcgggagatgcggtgaccgagatccggagaggacggcgcagtggtggagaagcaatggagttgggggtgccgaagccgtggaggacgatgccagcgatgactcggatggagcaggggtggaaggcgggacgcggtgccagggacgtcgtcttccatgtcgtgcctgccgacgcggccaccgtggcaatgacgatggacgagggcgtggggtgtccacccgacgtggatccatggctctcaaggccatctctcgctgctcccttccctccgcggcggcgtagccctagatagcgttgtcgagttcaccatcgactagtgcgcttgctaccccaggtccaccgaaggcctctcctccgccgctcaccacctcagccgtgtgccacctaccgcatatggggaaggagaaagggaagaggggaggaggagaagggtaggctaaagagtagagaggggatgatgtggaggaagtgggtccactaacatgtgggtcccactattttttgttttattatttgactgatatgtggacccacatattttgctttattttttaattattaaattttgcttcatgtgccacgtcagatgaagacggagtcaaattagccacatagacgtcacgtcaactaaaaccgccatgggacctattttgcatatgttttcactgttgagggacctgttgtatgtggtgttccgattgaaggatgaaaatcggattcgttgataagttaaaggacctttaacaaaaaaaaatagaagtgggttatgaaatactgggcctaaactaagagatatattatgtatatagatatcatattagataaagtctatggtattaatcacatggtagaaagattcgatagattttgattaaaaaatataggcgcatgtcgcatagatactccatttcaaacttaccatacttaatactcactccatctacttttgatagtcatatttcatcttgtcacacagaccaaggataagtaatactacttatcatccatttaaacatgctactagtcatttctcgtaaacaagcgattcattaatatttacatttctggatactcatgtagccaatcttgtgttgaagaatggagagtcatgcattaaatccaagaaagtcattaaaatgataagttgttgaattaaaatatatctatcaattttttttcagatttgtaaatatgactatcaaaaatagatggaggaaatatttaattaaccatacgctaatttttttcaaattttacgtgtggctcataaacttaagctgcgattggttgggccagctggcggctgctgttatgcatcttctgtaccgcgctagcagcaactcggttcagtcgtagtagtagaaatagccgagcacaaatgtactcttttcgtgctaaaataagtgaaaacatgagtgtccatatctaactttaatctttttctaagtcacacgtaaattactactcatattttatattatgatgacaataaaaattctaattataattttttttaaaataagacagatgttaaagttggacacggaaactcgtcccgtgcttattttggaacggtagtaccgtagtagtagtactccataagagcatatgtagtgtggcgtcggtttgttctgacaaaaaaatcgaacgaaatattggttcgatccctgcagtgtgtaatcgattttgatggggcccacaaaaaaaagtctaagtcccacctttcctctctccttcctcccgcgaccaggcggaaaatccgtgtgcgcctgttctctccctcgttc

SEQ ID NO: 47414 - DNA, 3624 bp, Oryza sativa
ggaggagagcaaatcaggtcaaccagctatggatgcaactagatcggatccttcgccgcgctcgtgtggctcgtgctcgcgctcatgtgggctgttgcacatgtcgccgtgcaatcagtatgccgccgcatacggcgctgctagccggcggccgtggatgaaaacctcgccgagggaaaacggaggccgaggatatgcgcttccaaggcgaggatctaccacaccaagggcatcaaggtgattatttttctgtaatctgtatagtcttgttctttctttctttttttgacacccagtcttgttctttcttgctgtgacttgatggctaaatttagttgacaaatgatttcatacgaaaagaaacaacatccagtacatagatttgtaatagaactagtagtacacttgcattgtgtaaagaaaaaacaatttgaaagggatacaatactcagtacatgaaaaaacaagactagctaactagtgctcaggttggttgcctccaaatttgttccatatatgctcagtcaagtcgttttttagtcgatgatgcatgtctttattccgaatagccacacctatttcaagcaccctatcaaatccatgaattggcccttgtccatatccattcagtggtacaggagagcttccctgctcatagttaaagtcagctcggccctcatatgaatccctctcatcctcgacaatcatgttatgcaaaataatgcaagcatacataatctcaccaagagttggttttttccacatacgtgctggggtacatataatggcaaaacgagattgcaaaacaccaaatgcacactctatatcttttcttgtcgattcttgcttttgagcaaataacttgtgcttctcatattgaggcaatttgaatgttttcacaaatgctgcccactcaggatagatgccatcagctaggtagtaacccatgtcatactcattgccattgactgtaaaatgaacatccggtgctatcccttgacgttgtgctgtgaacaatgatgattggttcaacacattgatatcattgttggacccagccacaccaaaaaatgcatgccatatccacaagtcatgtgaggcaacagcttcaagcatgacagtgggcactccatgatccccacgggtatattgtcccttccatgccaccgggcaatttttccactcccaatgcatgcagtcgatacttcccaacataccggggaagccccgagcctctcccacatgaagcaacctctggatgtcttctgcagtgggcctccttaggtattttggcccaaaacaatcaataatacctttgcagaaattaaccaagctctcaatgacagtggtctcagctatttgtaaattttcatcaagtatatcagcagatgttccatatgctaacattcgcaaagcagcagtgcatttgagtaaaggagaaaatccaactttaccaaaagcatcctttctttgctgaaaaaccggagaccaatgactaagagtttgcacaatgtgtagaaatagatgctttttcatcctatacctccaacgaaactgggtatcgttgtacattgggttttctaaaaagtagtaagccttcaaccgatcctcagcatcttgacgctcccttcttatatactttctctgctgggttggtggacctctctgttgcttcttaatttgataactaatgtcctcttcaatctgagtctcaactggatcattgatgtaatcccaaatcaagtcgaatgggataacatcaaagttgctaacctcagaactatcatgttgggagctaggttgtgtggatatttttgtcgatctggtagtatagagtggatgtgggcagctggtggagtagagtgaaagttgggaatgtggagatttggtggatggaagggatctgcacccttcttttgtagacaagcttcacaacggctagtttcacaacggctagttttataacggctagttttacaacggctagtttgcttatagaatattttgcctctaactttactaatttgattcaatgttctttttttttttttgcagattcaagtgttaggccaatataaagtgtacaaccttaggctagagattcaaaaactacacaatagcacacaagattgactcaaggtaacattgggctgcattctcattcatcacaacaattagatgggtacaatataccaattagattggtacattacaataattagatgggtgcattgccaatacaacaaatacttccctacactacttctcaacaccataaatttcattagataagaagtctagcatcttttcatggcgtgctttttgtgactcactgtatgatgaggtgtcaatcattaagagttcattgaactgcttgattttttccatcttcactttctctttgtcagcttcagcctgaatagcaatggcttgagcatgttctcttgcatcagctgccattttttctattgcctcagattttttgatttacatattattgaattgtcccacactttcatctgataaccgacccttccccaacttccctttccccttccccttccgccgctcttttgctgccttctgcccttgtggtcgacaacgttcagcatcagttgcttcatcagtgtctctgtttgaagaagaagtgtaagctcctgatgaagacaccttatttctcttattcataatgtcaacagcaacgtctcgattaagccatttaggttcatccttcaccactctccaccaatactcaaatgcgaagggcttatctgtttccttcacttttttgtattcttcatgaaccaactccataagttgctaatcagaacgtccactttgatatgtcttgcttaactctgaccaacatccatgaaactttgcaacaagtgtgctgattgaattccaatggttcttgcactgcatagctgttcttttccttcctttaggggcatatgtgttgtattcttctgcgacttgcttccagtaatgaggtcccttctttgaattgccattgattgggtcattggagttgttcaaccaagcacttactagtcgcagattgtcttctttcgaccaatgcatcctcacacatttattttcctcgtctgaacatacatcgctccattcctcaattccatttggatctttgcttgtattctgtgcatgagctattggagaagtgaccggagaagctgagtcctcacatcttgatccactaccaccaccaactccaaacaaagccgcagaacccactggtgatgatggaccagtagccatactacccccatgaaagttgccatggacaggaatatcatgttgatagcttgaagctgggaattgctggtaacctggtggaaatccaaatggattgaaattttgtgggtagtactgtggttgaaagttggggctgaacttgtcggtgacatgggaccggaagtatcatgactagaggcttgggcaggagcaatcgcccacgaggcctgaccccctcgggggggtcgggcccgagggtgatgtagccgcccccctctttgtcccccaaggggtcggaccgctcccgtttcggccccgagggctggggcgccccgaccccttgtggattttgcgccgcgtgtatgggtt

SEQ ID NO: 47415 - DNA, 4763 bp, Oryza sativa
ccgatttgtgaccggtctgacaatggtcatgtcgtcagcagacagccatgttcccacgtcgcgcctgcttccggcggaagtggaggtaggtatgggccgtcccatcagaaggtcattcggacagcagccatacaaatctccgtccattaatgaagagaagtcaagttggaaggaagagaggatgagtccccacacaaaagaaagagagagagagatggtgcatgtggtatccccttgaggtataaaaggaggaccttgcccacttagaaaggggggatgatttttaggagaaaaacgatcccggaacgatcgggggcgggctcgcactttgtagcttcttcatacacagatccaccaaaacacaggagtagggtattacgcttctcagcggcccgaacctgtatacatcgcccgtgtcttgtgtgtttccactctcgcgaaccttccacactcagaccaggagcttagaatctcacccagggcccccggccgaaccggcaaaggggggcctgcgcggtctcccggtgaggagccccacgctccgtcatctggcgcgccaggtacggggttctgcgtgtgttcttctaagctctcgcactctttcgtgtgcgccaagcttttcctgttcagcccaatggccgaacaagcaaaggcgcacaacctctctccgagcgttagcggtgacgatggggagccaaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggtggtcctctgccaccaagacctctggcgctgctaccaccggctccgtgtcgtcaaggcggagggcgcggcgagcggcggctgttgctcgccattcagccgccactccttcgttagcgcctccgacccaggaagatctgcgtggggggccggatgcccgcatcagtatcgagcgccggcgtaatggccggcgtgctgcccgcgcaacggaaggcgcctcctcgtccggagtgtcacatcaacacggacgcggggatcagccctccgtgcccccggttggtggtgtcggctgtagagcctttgtggcgagccttcggaacgtctgttggcccccaaggttccggcccaccatcgccgaaaagtatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacctacacgcagtacagcgaagggatgatgagtcacttcgctcgtacattcagcggttctgtcaagtccgcaacaccataccatgcatccctgcacacgcggtgatctacgcgttcaggggggggtgtgcggcacaaccgcatgctcgaaaagatcgcctccaaagagccccagactaccgcggagctctttcagctcgcggaccgagtggctcgtaaggaggaggcatggacctggaaccccttcggttccggtgtggcagctccggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgagcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagtgccgagagggcaagtccccggcggttccttccggcaatcggcgaagtgaggccaaacagaaggcccccgccgaggacatcaatgatggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaatgtgaagctggggcgtgtcctcattgataggggagcagccctcaacatcctttcccccgcagcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggtgacctcaaagtcgcgcttgcttgtatggagcagcgcgcggaccacctcaccgccgcgtccaagcccgagggtggcgacgagaggcttggcacatccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaaatgcattcattacccccataggaacttattgttatacgacaatgcccttcgggttaaagaatgtaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctttgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctagcttggcccgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagtagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagcaaagaggatcggccccaccgaaaggtgcagcggcccgtctactttgttagtgaggccttcgggacgccaagacccgataccccaagcccagaagatgctttacgctattctgatggctttgaggaaactgcgccattattt

SEQ ID NO: 47416 - DNA, 4075 bp, Oryza sativa
cgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacgcgcctggcaggcccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccgacccaggccctgcagatcataccactttcatggccatttgctgtctgggggctcgatatcctgggaccgtttaggcgggccccgggcgggtttgagtatctatatgtcgcgatcgacaagttcactaagtggcccgaggcttatccggtcgtcaagatcgataagcactccacacttaaattcattaagggcatcacagcccggtttggagtgcctaaccgtattattacggataacggcacccaattcactagtgaacttttcggcgattactgcgaagacgtgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttcgcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagtagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggatcgcggcacaggcatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctggtggcttactccgatgcacccgggtcgccagcctcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggccccctggttggcggcgtacttcgcagtccgcccgccccagaggcccgcctgccggccggcacggtctagacgggagacggcgtcccgaagcatgccgggccctacctcgcctgccaagcggagggcctcaacctccccggcggacgagtctagcgcgccctacaaatcggcgatggtgtgttcggcagctgcgaggcgggcggttaagtcgctttcgcccgcggccgccccgccgctgcgcgccctcgcgtccagctccttctcccgcgcctcgagctcagcggcccgctggttcagcgcggccctctcggcgcgggcaccttccagattacggcgcgcttgttcctcttgcgcagcctcgcggaggacaggctgtccgccagccgttgcgccgcggcctcggcctcctcgagagctcgctcccgctcggtgagcgcgtcctcgcggaggcggagcgcggactcttcttcggcacaggcggcttcgtgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcattcatcacagtggtggcgatgagggcagccccccgctcctcctccacctccttggcgatctcccccagcaccttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgttagcgacggccaaggcctgcagaagaggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgagcccaagtgatgcgcccgcggcctcgtcgcgagctgcttcggaagtcgtcgtcgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccggacttggaatggcgggagggacgcaacgggatctcgctgaaacagaagaaagacc

SEQ ID NO: 47417 - DNA, 2149 bp, Oryza sativa
ctcgctgaaacagaagaatgaccagaagacaaacaagatggatgagtgaaattccgcgttgagggaatgaatacggccacgatgggcgtgggacgaacctgcgagggggtcggttaaacgaccaccttggaggggaaatgaggtttccccgggatggttctgtcccccccatcttgcggggccgtttcttcttccgctccccctcgagctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggacgactccttgaggaatgagggatgcctccacggagctgagattcagcacccgttggaccactatcttgaagtcctcaggagcccagtctcatctgactccctggtgggtcctcatacagtcctcggacccagtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggctggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcacaagcggcgaagacaaggggaataatggcgagaggaaggaagcaaatctcttcctcggcgactttatacccttgccaacgctatgcccggctcctcgtttctcgcgcccactatctgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggcaaaacgaaccggctcgtcccgattcgcgtgttactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtatcatgactagaggtttgggcaggagcaatcgcccacgaggcctgaccccctcgggggggtcgggcccgagggtgatgtagccgcccccctctttgtcccccgaggggtcggaccgctcccgtttcggccccgagggctggggcgccccgacccccttgtggattttgcgccgcgtgcatgggtt

SEQ ID NO: 47418 - DNA, 12879 bp, Oryza sativa
gtttggacgagcgcgtcacgccgcatgtatcgcagtgcagcgcgcttgttcatccgatctgtgatcagtcacagaccggtcagatcgtgggttaggtggcgacaggtggtctgacgcacgcctcgccccatcccgtcaggacgagagcctccaagcactcgtccctagccggagccggcgtgttagctcctggagatggctcgttggttccggtcagatatatgccaggcttcatcctaaccattacagacaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacagcagccatacaaatctccgtccattaatgaagagaagtcaagttggaaggaagagaggatgagtccccacacaaaagaaagagagagagatggtgcatgtggtatccccttgaggtataaaaggaggaccttgcccacttagaaaggggggatgatttttaggagaaaaacgatcccggaacgattgggggcgggctcgcactttgtagcttcttcatacacagatccaccaaaacacaggagtagggtattacgcttctcagcggcccgaacctgtatacatcgcccgtgtcttgtgtgtttccactctcgcgaaccttccacactcagaccaggagcttagaatctcacccagggcccccggccgaaccggcaaaggggggcctgcgcggtctcccggtgaggagccccacgctccgtcaaaactgatgggtgaaaaattcatggaaaaatagggtgagaaaccatgggattgctggttgtttgtgttttgaaaactatggggttgttggttggttgggttttgaggatctgaacttgagattgcagagttcaaaaattttgtaaaactagatgtggagttgttgtccatatttgagggtcaaatttgtggagaaatgtatgtgaatcaatctatgtaaacttgtgtatatatagcagaacacaacgccccaacggctagctaggttttacaacggtaacatgccaacaaatattatttaaatgccttctgttcgacctccaaactcaatttgatttttgctctgacacggctctgacacataccagccgactcccactatgtggttggttcggtttttttttggtctctaaatcgatttcaacgacacactacagatgctctaaaccatcagtgctagagtggtaggttgtcgtcttgtcgatgtctgcaataaaccatggcaagcgacctggctttggcggctctggtcggaggtcattgcagtgaggaaggagaaagatgcattggagcaataggtgtcgtagcagcagaggccgacacacaccccttgtcactgtgaccccgaattttaaaagtttttgttatagaaactaaaactcatttacttaaatcatgtaattcaaatagtcgcattcaaaacaaaactattactcaggctctgtttagatccaaacttcgaactttttccatcatatcaatctgttatacacacacaactcttcagtcacatcgtaccaatttcaaactaaatttccaactttgtaagcaactaaacaaagcctcacacacaaagtttgaagcccttttatttaaggtccggcgtgagcggtgcggtcgaattttattaagccaaagaaagtttaacaggagattgaatcatataccctccacatttagattgaaaaatgagggtatatgattaatttttacctttcggaacatggcgttcttcgatcatcttgtgatatgatcaacgaagtcctcaagatcattgcgcgatgaacggacggcatggccgagggccttcgcgcgctgccgcaccgccaacccttcttcagatgccatcatcttttcgatcaccgcttgtatggttgtcgccggcaccacctcaccgtgcttctcccatggccttaccaagaatccggccttgaggtagttgcacaccagctccgcgtcccacggctggtccgagtgcatgggccacgccagaatcggcttcccgtggctcaggctctccatggtggagttccagccgcagtggctcatgaacgccgccgtggcgccgtgcgccaggatctccagctgcggcgcccacccggtgatcaccaggcccgtgccttcggtttccttgcagaactcggacagaagcttggcgtaccggctctcgctctcgccggagcccgcgaatatgttgccgcggtcggcgtcgcgcagcacccagatgaaccgctgcttgctgccgcgcagtgccgcggcgagctccgcgacctgctccacccgaagagaggacgtcgtgccgaacgacacgtagagcacggattccggtggctgcctgtcgagccagtcaaggcactcgtgtcgccgccggccctgcttcaatgcgcccgtgtcgagcagtgggtttaacggcccgatcgcgaagagcttcttgctgctggcatccaatctctcggcgaaaacgtcgatgaattcaccctcgagcgcgcggcacgcgttcgcgaggatgccggcgcaggacgagatcgactgcgccgctcttgctcgctgttgctcgtagtccatgaactccttggtcaagtaggtatccatgggaatgaagcggaggccgttctcgcgcaggagccggtgcccggggtcgatgctcccggtggcggacgacacggctacgcagttacacacgaatgcctcgccgttgggcagccgcgccgcctccttgacggcgaaggagttcatgatgtcgcagatgacgacgacccggcggtaggacgcggacagctcgccaaggagcgccgagagcggggcgcgcgcgtccgcggtgtacgcctcccagaggggcatgaggtgggaggggaagggcgcgtcggcggtgggatcgggtggcggagagacgtacgtggagacgccgaggtcgtggaactggacggagaggagggccttgtcgtcccagccgtgcacgcgcgcccgcgcctggcggagctgcggcgccggcgcagcgtagtgcaccgtgagcccgtgcgacgacgacgcgagctgcagcgacaggtgcaggagctggttgaggtggccctgcgccgggaacggcacggccacgatggcgaccgcatccgctgggtttcccttcgctgccattgtcggcgtcgtccgagtgggagagcaagtaaaatgcctgaattggctggatgatgatttgctgactgcagaagtatgcgggcgtacagctataaattgtgcttggtggtgaccggtgataacaaagattggaattggctactaccccatactagctagccaacaaatcgtggatccacatgatacttgcgattcattgagcccggctggcggatgcaaccacgcaacttcggcagtgtctcgttggcagtagtgcctgtccagtgtagtagtaggctagtagaagtagccaagcgcaaagttatggtgcttttttttaacgaaaagctttttccccccggtttctccgattaaacggaagtcgcacaaacgcacggtaggcataccacacggctgtgttcgttccacctggttcccaacctctctcattcgttttccgcgtacgtttttcaaacggctaaacgttgcattttttacaaaatatttatatacgaaagttgcttaaaaaattatattgatccaattttttaagcaaatatttaattaatcacgtgctaatagaccgctctatttttccgtgcttggagggtaccgttcccaaccagggaaacgaacgcagccttaggcctggtttagttccctaaatttttttctcaaaaacatcacatcgaatcattgaacacatacatagagcattaaatatagattaaaaaaactaattgcacagttaggaggaaatcgtgagacaaatcttttgagcctaattagttcatgattagccatacgtactacagtaacccacatgtgtttgtgttaatgatggattaattaggctcaaaagattcgtctcgcggtttccagactagttatgaaattagttttttcattcgtgtctaaaaaattatcttttcacgaactaaacagcccgttacacacctgcgtgccccccccccccctccctcctccccctaaaaaaacacaagtacaaagagatgaaaaccaatgggtatatccttgttctaactcatgtaatatttgtgggtaagagaatatatgaatatgaatgaatcatagtggctgaagttacgcacaagtgactggacaatcataccaccgatgctttagaatgaaaaataattatagggaaataaagcatggaaagttgacataaatgattttagactcttaggggatgtcacctattttcttggatgtcatctaaataattatttttaataaaaaataataagtgtcagggttacggataaggtataccctctacccttggatgtatgctatacggcaatgcggtatatcggtgcatatacggatgttctctgaatacgctaaggaagtccatcacgaagtctgccaatgaaaaggttcctacccgtataggactgggttgttactatatcgtgcagggtccgatgtctccgagtcctacttggagaccgcctgacctgcgatataaaagggaacccccgggggacctaagggatcgaatctcatagcctacacaacgaccacagcctacgaagccgaagactatagtagccaagtcaccgggtgatctagtcgaatcaactcgactacgatctcgtcggtaccactgagttctactattccctttgtaatctgtggttatttccatataatcccatatcaactggattagggctattacctgctaaggggcctgaaccagtataatctttgtctcttgtttccttgatgtcgtactacgtagatcctcgtaccagcgtaccccaataccctctatatctggcctaccggtacccaccgtcgacagtggcgcgccaggtagggggacttggtgctcaaggttctactactatgacatcgagcttcgtcgacaacagagtcaacaccggccccatccaaggaatccctgcttcaacaatgctggtgtcgactcaagtcagcgaaatcgtcttcctggtttacaccacggtgccaatctcggctggtccatcaataaccggaactcaggtactcaagtcgaccatgtcgaggctccgcttgtcgcattggaccgccagcttcgcgttcccttagatagtgattgttcccttcgacccgggcatcttgagtacctgatacgcgtagtgagatgcggccatgaacttcgcgagtggcgttcttctgatgatcccttacccagacgacacctagcgttgaaacctatcctcatgtctctttacaccgtcttgacaaggcctccgaagaacctaagtgaacttcggctggggacgcccagagctgataaggccttgttggatccttcagagacgaaagaccatgtaagatctggtcgtgtaagagttctcgccgtgcgtattaaccaagccgtgtaatcggaaatggatttttccaacttcacggctaggggctaggatcagtgcttattcaactaaggcaagtcgagagtccaagagccttatctttcgagaggagttctccgacgacaaggctgggggctagggagagtgtataactcaagtgactgatcgaagtcgagaagtgagaagacactcgtgcacaccgcatccaacgtaagaaagcttagttagatagatttcctttctatttcacaagcattccttacagatcgcaaagaattccagaatatattacttttttcttaagatgtttgtcacaaatatataggcactaccaggaaggccaacgccaatccattgactggaagatcttctccgctagcggagccatcgacttcgctaggtcgtctatctccgcaagattcctccgagaacgggaaaacccttcgtgaaggaactcgaggtgcaactgcggacgatgatctcgtatacacgccagcacgtgccctccggcgtatcggctcgatcgatgacaatcctgcttcagggcctcgtcgatatgcccgccgatgccttcaagctgagcacaagccccgttcagccacgagatgtagccagccgctgattcctcgggatccccgcgaggtactcggaagctctctgcagacaacggccatggttgtgcaacaactcctaaggtacgagttgaaccataccttgcgaccttggagcgcctccagagcccggcccctcttcacctccaatatagtcctctcaagttcggcgacctcgaacttcgtcctccaatactggatgcgacggtcgcgatcagcaagcatactctcgaggtctgctcaacatgcaaacacctaagtcaagctaacctaagtcaagctaatcaagacagacgaggtaaaggaaagggaaccgtcaagaaccaacctaaagaagtcgacgccacgtccgtctcctcgggcagatcctggtctatgccgtcccacggcacgtacggctcgagctcaagtgccagagcgtataggcaattcaggctgcccgcgctgctggacatcctcgacatcgacatctctacaaacaacagacaaagtacccggaatcaaaacgccaaagaaaactaaggcaacgattgcacacacaaaagtagtcggaaccaacgaaaagttttacaaagcgcgattggttaaggggtacaggcaagcggcggccttactcttcaaaaagcgggaggacggactcccccagatcgctgacttcttccatcacatccttgcgcgcgtcgctagccgccccctgatccaggatcttctgaagatcgagtttaggatacgccagcctcacacacgcaaggacatggcacgccccggtatagctcccgttggacatctcctctccgatcctggccgcgtgcttggaggggatcgcctccatcaccatcgccagttccgcaaatgaagtcgtcagcgagaactcgttgggattcgtcgggatggtggtcttgatgccgcactccccggcgagctggtgcagaccagtataggtgacccgcagcgagccacggatttccgacaagttgttctcgagctccgacatacggtgctcgagcccttgccgttgtcgctcattgctggccaccagctccctcatcttctggaggtcctcgcgaacctccgccaagtcgcgcgttagcctgtcggcgcgctcattcgccgccgccgccgccgccgccctcgcctccgcgatctcgcgactaatgccgcaggcaccagcctcgaggatgcgccccatctcgacctggagctccacccaggtgagggaggcagccggcgggccttgaccagccgcgatatcgctagccgggccgctgggcgtcacctcacggctcctgggcacgaccacgacctcggttgaggccactgcaggagacacgctggagtttgctccagacccatcttgcgccgccttcgcccgcgccctacgaaagatggccatgtcggtcatcgcaacaagacgataaaatctgattaagtcaagagcctcaaatttcgtccacttacttctcgccgagtgtcaccagcctctgccgtcgcggaggcgggggagacgcatccgaggcctaagtaaaccgagtacgacatgaggacgacattctccgactacgtaaataaatgacctaggaagcttaccgatggagtgggcgtcttccggcggttgccaagcacagaggaaaatttcctccccgtcttcggaaccttgccgccgctggtcgttgcagcagcagcggcaacagccgcatcggacgcctcccgggcaatgttctcccgcaacgaggccgccgtctgatggtccacgagcggcccgataacgtcagtcagggggagagcctgcgcaacatgaagtcacgatgcggtctaagagttgaaagggaaaggatcgttgactacactcacgttgatcgcggcttcacgctcagccgcctccctctcgcaaagaggggtggggacgttgctcgccgtcgtgggaccgctgatcatcacctgggcaacacggtgctccacggttgcgccgctcagacctgcagatcgagaaccaagtttcgacaagtcaggaggaatgcacataaagggagaggaacctaaaatacaagaaaaataccccgaggagaaacccgggtcgtgtcctccggcccagagtagtcaaaggctgggtggactcgagcctagagcggctggatctgtctaccaacgaagtcggcagcgacttcataccctgacaacccccgtactcggaggtcatcaatgatatcgatgaaagattggagggatggggtcaaggtgggtttggtagtccaagatggagtcttgtctggttgctcctcaggaacaatgaagactgggtccgaatcttttatctgaagatagaaccacctcccccggcatttgctgcgagatgaggggcactggaaggggatgtatcgcgacttcaggccatcccgaagtcggaaaccaacacattcggacacctttttaggttccatccagcgcaactcatagtaaaagcggaagaggtcgagaaacggctctaccccaatgtaggcctaacagatatgagagaaaatgctaagaaaggctatggagttggggttcagatgaagcagagagagaccgtagaagttcaagatgagaagaaaaaactcggaaggcaggggaagaaaaccacagagaatgtagtcctcaaccgcaaccatgcggcccaggacgggttcaggctcagtacctcccggttccctctccatggtcccgcgaccggggagagcgccctcctcttgcaatttcttcaaggacgcgcggctggaggtggacttgtcaagatccattgccgagggggatcgccggagaagaagccgaagcaggcgaacttagggtttgtgtgggagcggagaagacaaagagcgtttggaggcaagaaatttctcacaaccgccggactccaaaatgtatttccaaaacgcccttaaataggcgcactaccgatggtgcgaattccaaggaaagaagagagatggccgccggagatttctgggtccgttgcgcgaggcggtgtgacatcccggcctagggcttaataggattactagaatactcatatcaacaagttgcaacttcttttccggaagccaatctctaaagaactccagggttaagcgtgcttggtttggagcaatttgggatgggtgactgaccgggatcctgggtgcgcacgagtgaggacaaaatgtgtagaaaagacttgtgttggtctgtgagggcagtctatgacttatgaaagctgccagatgtaagcgggcccggcctgggagaggtggggcgttaaaaagtggtatcagagccgactcttgcggtttcacggacacatgtgtcacagttgcgcaggcatggtgcgcatggctggtgtggaccaggagtagtcacacagcatggcatatacgctgtcactggacacacggacgttgccagagaggacgttcctggcctggggagttgatcgacgggggcgtcgatctcttttaagggggtgaggatgtaacatcccggcctaggacttaataggattactagaatactcatatgcaacttcttttccggaagccaatctctaaagaactccaggattaagcgtgtttggcttggagcaatttgggatgggtgaccgaccgggatcctgggtgcgcacgagtgaggacaaagtgtgagcaatttgggatgggtgaccgaccgggatcctgagtgcgcacgagtggggacaaagtgtgcagaaaagacttgtgttggtctgtgagggcagtctatgacctatgaaagctgccagatgtaagcgggcccggcctgggagaggcggggcgttacaggcggtttattggacttcaatttaaattcactcataaccgttggacttcgcatggtgttgtcgaacactctttgtctctacggtcctcacaccgagatcgaccagttgagaacgacaacaatttcgacatcagaagtcgcgattggttacatgagttcatttaagtagaagtcgggggctactgtcagggttacggataaggtataccctctacccttggatgtgtgctatacggcaatgcggtatatcggtgcatatacggacgttctctgaatatgctaaggaagtccatcacgaagtctgccaatggaaaggttcttacccgtataggactgggtcgttaatatatcgtgcagggtccgatgtctccgagtcctacttaaagaccgcctgacctgcgatataaaagggaccccccggggggacctaaggggtcgaatctcatagcctacacaacgtccacaacctacgaagccgaagactataggagccaagtcgccgggtgatctagtcgaatcaactcgactacgatctcatcggtaccactgagttctactattccctttgtaatctgtggttatttccatataatcccatatcaactggattagggctattacttgttaaggagcctgaaccagtataatctttgtctattgtttccttgatgtcgtactacgtaaatcctcgtaccagcgtaccccaataccctatatatccggtctacgggtacccaccgtcgacaacaagatatattaatatgtaatgtgttccacgtaaatttaaattcattgtttagggtaaccaaaaaaacaaataaaattttactccattcgttccatccgtttcatattctaagtctttctagcagtgcccacattcatatatgtctagattcattaacatatataaatatatatatatatatatatatatatatatatatatatatatatatatatatatgaatgtgggcaatgctagaaagtcttataatatgaaatgaaggaagtagctaatatgtgtattgaaaaatattagttaatttgaatttatatgtttgtaagagtgattatcacttattaaatatcatatcagatattttcaaatgcaaataggctgtactctccgtccggaaagcttgatgttccagatattctaagacaaattagcttatagtgtaaattaccgatccatcctccatttataaactgctgttagagttaatgagcatgcactcgattcaaatgagtgaaccagaatgatccaagggaaaaactaatggctcaaaaagtttgaaacaatcacctttttggaatattttgtgaggtcattctcaacccaagacactatatatagttttcataaactccacatcatcaaaaaaaatagtactagacactactcttctaatgtaaacaccactatccataaaatttaatgctacttatctcacatgatgtattggatgttgtgtgcaagatatgatttccttctctttcctcatttattcacttgcaacatcatttttttatcataggtgacagcctatttaatgctatggacactattctagtcattgggttgggaatggcatgagccgtaaaacgctattctttatagcaatgaggaagtatggcataaacgaggcatatcatagatagactaaaatagtttgccgagagtggaccgaccaaggtagttggatttatttccaacggttgtccttttttctttgggaaaatatgtagtgcaaatcacatatgtagtagaaacttggaaactgtctttggattgaaaaatggacgttcgagatttatccacgtcaccatgagtaaaaaaaattactttttactcataagcaaatctgcgagtaatttttttactcatggtgacgtggatgaatctcggatgtctatttttgatccaacagtaattttcaggttttcactgtatacgtggtttccaacatatattttcccttttccttctacctctggaacgaacgagcagcaggtgacagagctaggtaaacctgtcaatggacgaaagttacaggcaagtaaccatgtagcaaacgtgcgcaggctaccagactgagcgaccgaccacgtcaaggttggccatagcaacactgttttgccgagtacatacttccttgttcgtatgacccattgcactgggattaccttaccaatgtggcacggcaatcttattgcaagtagagtacaccagtgcatatgttagagaacacagacactaactctgaatatgttctactagttttcagaaaaaaaatgaatatgttctgaaacctgttaggaccgaccatccgtggccggtggcaggtatacccccacaaagagttagagatctacccaatcattttcaccaaatttgcaaccgacctgtacagttgtaaccattaatcattctaatcctatcttcttgcacaacgattgggggaaaaaaatcagtgcttgacacaatcgattcggggtggataaggtgagcactgaaagttcttcagatagtaccattcatgtggctatccaaaaccagcaagcactgactttactacgtttccaaagattcagccccaggttggcaacacaaactaccttccttttgaaaccgcatcatgtttagcaccttccatatactgtttccacctcatataactttgatcaagtttcaggctttcagcctaggatacacagaaaaaggcaatctcccgatttgcttcagttgcacgtcacccttggcgagatgacatggaggggcctcgaggaaaaggcacactgagacgaaccaaacaacaa

SEQ ID NO: 47419 - DNA, 1823 bp, Oryza sativa
  unsure (1)..(1823): unsure at all n locations
ttggaatatgatatattatttaaaataaatgctcagctagaatcctagaaaggctaagaaattcttgctcgaaacaatatttgaacatggctgaaactactatttcttttctaaataatgttgtgttaaccgacactggttgacattcagcaagaacattcaacctttcatttgatgttccttaaacacaggtcctgattctgaacgaagagagcgaatcacgaattgtaaagatggttttgcctctcacagaagcctgccaaggaatggaacttgtttcagggcttagtgacccaaataagcacaaacaaagtgctcttgttctcttgttgaaatctggtcaaatttgcttatatgatgattcagagattgagcgctaccttcttcatgctcagtcaagatcgccactagcacttccaaactattcatctgtgaagctaccttatggtgatccaagcatcaccgctgcaaagttttataccagtagccctacagctgcgacttctttggatgaggcatgtatagatttgtaaattacacctatcaaacaactatgaatgctttgaccagatagcgtttttaatgggctttgaccaaatagcttcatattttgatgatggacaggactatttttcatcattggccaccaaatacccatggttcctttcaatgaaagataaacatcagacttccacaggttctgccgacattcataagaccagaaatctctatgtaactggacatcttgatggaaccataaggttttgggatgcatcatgtcctcttttactgcagaatttaatgataaagcaccaggtgacttaaaactccaattatttttgctggccactctctaattatgtattttgctgaaaattctctagttatgcattttgcacacaaattactacgttttacttcgttctaacaactcattattgttattgtttcagaatgaagagaatagtccaagtggcacccctattacatcattacagtttgatatgtcatccagcattctaatctgtggggataggagtggaacggtaagctatttcatggatataaggtgaattataatatggttttaatacacttccagtgcagtaaaactttttttcttcctgttaggtccgtataatcacattcagaaaggactccagcgataacatattctcctttttacatggtataatttactctctgtcttgctaatatcaacagttggtgcttgccttactatgtggttaggtgttcattgtccaaagaatttgcactgcgatactatctatgctcgtgctagctacataatttactccatcagttaattttgtggaacatggaaactaatggaaacatgtccgatcttagaacttcttgatttcaccatctggtccaaatacctttgttaatggtacctttaacatatttttcaagtgcttgtatgttattttaacacattcatcttttacatggactggtcagcgaagcaaggggagagctataatgtcagatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47420 - DNA, 735 bp, Oryza sativa
ccggggaagaagagagggagacacaaggatgggggcggcgcagagctcctcgtagactcctcgtgctcgccggcctcctgggcacgttcggcggaagaacgagcgacgacggcagcgagcagccaggcggcagggggcggcaagggtgctgtgggtggaaacgggagggaacgagagggaggttgagacggtgagggggctcgggttttatagcggaagcgaggtcggttcgaggcgggagcgagcggcaaaggcggttcgtgggcgacgtggagacggcgacggcgtggatgcaagggacgatggaggcggtggatcggacggcgaaaaatcgggtcacgagcacgggtggggcaatatggctcggtcaaggtgggggcactggcgcggcgggacgtcgtcggtgtcctctgcctccgcgcgcaagaagacaaggacgggagagagagaggccgggcttagaagggaaaaagggagggacaacggtgaaaagggaagcctctcccttccgttttgggcggcgggcaggcaaggcgcgtgggagcggcgtccttgccgttcggctatgcgcgagcgcgcgggaaacggcgacaattttggggcggcgtcagcgggaagcgacgccgagagagagagaaaggagacggcgctgtctctcgctcccgaacaggtgcgacgcacgcgcgagagagaggcggaccggggaagggagaaacggcccagcgaccaagaggg

SEQ ID NO: 47421 - DNA, 1158 bp, Oryza sativa
ctgttacactatgtggtagtgttgcaaaagcatgttagcgttcagatgcactgaacatgaaaacatagaatcagtatcatcttaattgcttgaattatttcactgatattcttggtaggcacacatgatgaattgcactaatcaagttggttgcaataagctaaagtcataactggtctacaagttcaagaactaaaaaaacatgtgacatttacaaaaacggctaagactgaaaagtcaaaacggcatggcagtccaaacttgtgggggggataacataaaatgcactaatttagtgtttcacctgaaataggtatgcatgatcactgaatccattaacatacaaacgccctgcctttccgtcactattgacccatcgcaaagagactatagacaccctgtctagcttgtatccaaggttaagcctctgaagaggtaggttttgattgcccatcgatgagagattttgtgcatttaaaatatcaggaatagaccaaagatatatatcaccactatcaaatccaatagcaattttgcttcccttggcacaagcccagcatgccgatgttacagctttagcctcctgatgtgactgttgttgcatagatttgccggataaagataccactttgctcgtcttaatatcccacaaagacataatcccatctctgaagataatgagcactctgaagagtgtaccttaattagacatttcactacgtctatacatagaatggatgaaaagatcacctgagtactatctggcataaaatacttaactgcttgtgccaaactagtttggaagagatgtacagaatattcagaagagacaccaacctgttattttcagccaaaggctgtggcgatacaaatgcaacttcaacctcattaccaacatttgctccagaaccttcagcaagaatcaattagattccaaagttggtgctatttttatctttcatgtaaagtatgataattcaaccaatacatattggagtaaacctaccataagattcagagaaaggaatccaatatggcatgtcaactagacatgtctgacccaagtcaagcttcaacagggacacattcccaaaactatcacccacatagctgcatagacaagatcttctaatcagagcacttaactccacaggactc

SEQ ID NO: 47422 - DNA, 1680 bp, Oryza sativa
  unsure (1)..(1680): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctgaatgcagtaattttacaacatttccatgtaattagtttaacttcccagaaaatcatccgaacttatcaacttcaaataaatgacaaatgcatgtgacatgcatagtagcatggaaacttatcgtatgcacacttacttcggatacattacatcatgcacaataactaacaaatattacgatttcttttttggaaaatttacatgtactttcaatattatgatgttaaaatttattattatttagcctaaaagaataaaaaatgtcagttttaatagtatataaatatgctagaatttttctctcactccctctatgtatgatggatttaacaatgagtctttagagtagtatgcaatattattggaagttcatatacaaattcttttagaatatttgtgacaagttctcttgagccacttcatcggatcattgttgcggattatttgttctacgtatcttgaaaatatgttttttatcttgaaaatatgatttttcataaaaaaatacttctactgcattgctcatatcccttttctaagatatttgttaagtttattaacaaaatatttaatttacatctgtaatcatatggataattcagtacaatagtcttcgcaatttttctccaagagtacattaccaattattagctaggtttattcagaccaacgaaattaaatcatgtttatatgatagaggagcagattcgggatatcccacaattatcaaagcttgaaattatgtgttttaaactgaccctaccaggttatcagctggactctagaatctactgtgagctctctggtcttgggtgcttttattaggtcaataagtggttggtggtaactggtaattaagcttctaattaagcatgtgccagccatacctggatgcaccccaggattggggttagaccagactgggaaaggaaaacaatagcagaaatcagtctgatggtttcacaccacacatgatacatactccctccgtcccataaaaaactaattaatatgacatatcttagttatatgaatctggacatatctctatccagatttattgtactagaatatattacattcagttttagatttgtttttttgaatggaaagagtagacatactcctatatatcatcgtgtaacaaaacgatcagcaacaagttgcgtgtagaaatacggtagaatttagtggaagacgaagaagaatccagagaaagaattaacgactgctgttttggatccatcgaccgcatgcagctcactggagaacaaaattatggaattttatcgttgataaagtgtaagaactgttaaacattagagatcgcaggtaagaatgacctacacgtaggatatatggatctgaaacccactatttaattatgtttctga

SEQ ID NO: 47423 - DNA, 1321 bp, Oryza sativa
gttattgaagcagcacacttacagttgatcatcatgagcttcttcatccattttgaacggtgaactattaataagctacgtgcttagcttgcgttttcatttttgcgcttaatctattttatacggaatttttgccacgctgttttttttctcatttatttggttacaggaactttggttgggtagccttgatgcagaggttgaggatggagtaattcatcttccttgcaaaattgaaaccgtttttttttctaaaaatagttttaattagctaggtttttttttctgtggtaagtaaattggttccccatggagtgtcgttttttgttagtttttttcttggttggtcaggatctataaattagctttgcagaatcgttcttgggtctttgacagatcatcgtccttggaattcgtgcaagcagcagctaaaatttctgttgacgatggcgaagtcagttccgtcgtagtttacaataattaattagacttcctgatgttgctttgatcacctaattaattattctagctctttctgatgggtaagttacatcttctcatagatatcaagttcttgtcatccactgttaaattttctgcgtgctctcctattctaatacagcagagtcgtaattcaatcaacacaatcaagtttgttagccctgcaacaaatcaaccgttgccaaaatttaaaatttgaacttaattttttaattgcagtgtattttcaacgtggtttttttatattggcttttcatacacatattattaagctgtttgggccaggctataaacaaacagaaaaaaatgtgtgtttagcaatttgcaaatactcgcgaatggatcataacttatctggaagtgtggagtcttaaagaacaaaaacacccaactttttagtattatttgttcatcgacatcagccaatcagtgtggctgctgatcgatgcagatgaaaactagccctctctacctcaactcacatcagtaatcagatcattggattcaagaaaccaaaccctcttatctgcagcctgcataattgaccatgaacagttcaaatcatagcgtcaaatcacacatcatttaattcaggtcgcctttgaacattacaaccacatacaaacgcaccacaccagttaatccctcaactgtacgtactcccccgtcttaaaagaaaaaaaaacacattctaatactacgaatttagacataaatcatagtattagaatgtatcatatttagtattatattggatttttaagaaacggggagtatgtcacctcgatcgacctgcaaaatctcgttcgaaaaattcaac

SEQ ID NO: 47424 - DNA, 6835 bp, Oryza sativa
tcaagcttcgctttgggtagaagaagaaaaatatataatatgtcatataaaaaatatattttgtatcaaatatcttatcattatatggtatttacttgtttgaatcaaacgttgggctatttcataatattagaaaatattataaagtaatttacaaaaactacaaaaacaataatgaagtgacagatttactgtcaccataactactccctctgtaaaaaaccaacctcgtattaggatgtgacaatgaatctagacttcgagaatatccaaattcgttgtactatgttatgtcatatcctaattaaacgaatctcatactaggattttttttagggagtagaagtttttaaaaagatataggtcttgtttagataaaaaaaattggcaaaaaatgtcacatcaaatgtttggacacatgcatggggcattaaatgtgggaaaaaaaccaattgcacaatttgcatgtaaattgcgagacgaatcttttaagcataattatgcaatgatttgacaatgtgatgctacagtaaatatttgctaatgatggattaattagggttaataaattcgtctcgcggtttataggcagaatttgtaatttattttgttattagtctgtttaataattcaaatgtgcattcgtatactttaaaaactctacacccaaataagtaaacacacccatagataataggcaaaatttgccacaggacacacaaaaaacgtgtaattggctgggagacaccgcaaacgagcaggcggccgctccgcgcagcagcgcgctagcagggactggacgcggaggcaagcaggcaacagccacgacgggagcacgtgacaaggagccgcctacggtggagcttcgagcagtcgctagatcatgctcctccacctctcgtccctccccaaccatgtcagcctccgcgccagctacctcgccggcagctacaaaacttctgtgatttcgggtgggggaagatgacgtcaagggcaatctcgtcattttaaaaacaatttcacctctttttgactcggaaataataaaataatgcgaccggtgtcctatagccaattatatattttttgtagtgtccattagccgtgtcacgtttttgtgatatcttccaaccaattacatatttttttagtgtcctgtatcaatttttgcctagataataaactctatctcttgcaaaatactcctacctccgtatctctacgagtttccactactgtgcatgccttggtatggtatcctattcctacccgcaggtaggtcgttttccacgtctgctgctgcctgcctcctgcccttgttgccagtctgctgcggtggcacagagaccgttgcgctgcacaagcgttgaccttggattttcatggcaggcatacgtcccaaccatagcacacctccccataccaatcaatactatactggacgtactagtacatcaatactacttctacagtagagtactttttgaacgccaattgccaagacctagcaacactggagtattcttaaaagtggatcactgatttggctaattcatgatttatataaaaagatggacttaattaacacagagtaccgtttaaacttgtaactttaggtaagctctccccacattttttttacatgaagctcttcccacttgaccttagagaagtggagtactatccccgtttcaaaatataataacttttggctataaatctgcacacacagttatctagattcatagctaaaaatgcttacattttaggatggagatagtaactagcagagaagagagaaaaaaagaaattagtcgatcaagctaactttacaagtgcttcaagatattatttttagataatgaagtgattcaagatatatgtattaattaaatacataagtgaaaaaaaaggaagaggagaaaaatttgaagataaacttatagccaattaggtttgaaactaataaagatgaagattaagttgatgcacgtaaaatgagaaagccattagcacataattaagttttaattattataaatttgacaatggatatatttaatattttaaatcaatttctatatagaaagttttagcatgaaacacattatttagtagtttagaaaacatgctaacggaaactaagataaaatcttaacatgtacttataattatacatgttagtcctaatattatggttagatggatttacatacagcagtagtagtagttaactctactgttatatcttgctactacctccgtcccaaaatatagtaacttttggttagtgtctagatttatagctaaaaatgcttatattttgggacggagggagtatttctttatttctaattacgatgcagattttaccttagtttttattagcatgtttttcaaattgctaaacggtacgtttgttttaaaattgtttctatatagaagtcacttaaaaatatcaaataaatttaatttttaagtttataataattaaaaatcaattaatcataaactaataattttctcgttttgccaacgctcactttatcttcatccatctcaaaaccacgttagagcgagacaggaaaaaaaaagaaaaaaaaaacaaaatgtctgaaccttgataaggtcggacagctctgtctgcagggtgggcccagcccaccagtgtcacacccctcccgaaagcaaagtttacccccccaccagtacgcgtagcgtttccccacactccgcggcgccgcaagccaacaaaaaccaaaaccaaaaccaaaaaaaaaaaaaaaacctggcaaaaccgcggatcccaacgcaacgagagatagagaaaggcgaagacgaaaccgaagcagcgaagccaaggttgacatgtcacccgctcctcctcctcccctcttccccttcctcctctagaacacgccgccctctcctcctcctcctctacctcctccacccctcgccgcgcagggcaccgaccgtctccgcgccaccgctcgtctcggtctcacctccacctgacctgacctcacccaacgcccccctcacctaatccctccctcctccaatcgccctcgtcaaaggggtgcaagaatccaaggggggagtggttggggttgattggttcttggttgtggggggcatggcggcggcgggtcggcgtcgtcgccggtggagttcctgctgcggcggccggcgccgcggcggcggcggctgccgctggcgggggcgttcttcgcgcccacggggctcgcgggggccacgctgctccgggcggtggcgtcgctcgccgcctcgctggtcgcgggggccaggccgccgtcgcagcggcggaacgtcgacgcgctcgcccgccgcctcgcgctgctgtccgcgatcctagagtccatcctcctcgacaccgcggcggcgggcgccttctccgacgcggccaacctctgcttccgggagctatacgtcgtgctcttccgcgccgagctgctagtctcatacgtcgcctccgccggccgcgcgtgggcgctgctacggagcccgcacctcgccgcctccttccgcgacctcgacgccgagctcgccgtcgtcctcgacgtcctcccggcggcatcactccgcctctcgcacgacgccaccggcctgctcgacctcctccgcgcccactgccgctgccgcgcgcccgcgcaataccatgaccccgacgaggcggcgctccgggaacgcctcatggatgcgctccgccagttcgacctcggccagccacctgaccacccctcgctccaatcgctcctcgccgacatgggcatctccaccgcggcttcttgccgcgcagaaatcgattacctggaggagcaaatcttgagccaagaagaggacaccgacctgccgctcgtcggcagcgtcctcgccttgctccgctactgcctattcgccgtgttcgaccctagcaacgcgaaggcgctccgggattggccgttgtcgggcaacaggcagcggcttctctcgattggcggcggcgatgacacctccttctcggtgccaaaggagttctcatgcccaatttctctggatttgatgcgtgatcccgtggtggcgtccaccgggcagacgtatgaccggccgtcgatcatacagtggatcgaggagggccattccacctgccccaactccggccaaacccttgcagatcaccggcttgtgccgaaccgtgctctccgcagcttgatttcacagtggtgtggggtgtatggcttgcagtatgattcgcccgagagcaacgaggggatggcggaatgtgttgctgcatcttgcagtagtcgggctgcaatggaggcaaacaaggccacagctaggattttggtcaggatgctggaggacgggtcagaaaatgtaaaggcagtcgctgctaaggaaattcggttgctggcaaagaccgggaagcaaaaccgggctttcatcgccgacttgggtgcgattccgctgctttgcaggttgctcttgtcgaatgattggatggcacaagagaatgcagtgacagcgctgctcaatttgtcaatcttcgagccaaacaagggacggattatggaacaggaaggctgcttgcggcttatcgtcggtgttctacagaatggatggactacggaagcgaaggagaatgctgcggccactctgtttagtctatcagtggtccataatttcaaaaaactgatcatgaatgagcctggggctgttgaggagctggctagtatgctgaccaaggggacatcaagggggaagaaagatgcggtgatggcactcttcaacctctcaacacatccagaaagctcagctcggatgctcgagtcatgcgcagttgtagctttaattcagtcgctgaggaatgacaccgtgtcggaggaagctgctggtgctttggccctgctgatgaagcaaccatccatcgtgcatcttgttgggagctctgaaactgtgatcactagccttgttgggttaatgcggcggggaactccaaaaggtaaggaaaatgcagtctcagctttatatgagatttgtcgtcggggcggctctgctttggtgcagagagtagcaaagattccagggttgaacacagtaatacagaccatcaccctcaacggaacaaagcgcgccaagaagaaagcaagcctgattgtcaagatgtgccagagaagccaaatgccatcagcaatggcactagggagcacattgacagtcgttgatcgttcattggtagggaacaacacattaaggcgtgctgcgagctttggcagtggagaattgtcaaacccgatttcgatatcagtgcaggtgccctaggtgaaaggtttctaccctggattatatggatggttacatttggtgagttttgtccccaaaattctttcatttcatgctccaatgaaggtatacaaaatttaatccaaaggatttaatactcgaaatatatcagatgttcctatgtttgtgtgtgaaatgtggataactgtgcagacatatagatgtgcaattagagttccagcttgatgttcctccttggcaagctcggaaattgtccaatttttgttttatttttttataaaaaagcaccaaatatgtatgctgtatgctgtaaactgtttaaattaattagaagctttacactgaggcaacagtggaaagaaatggtatttcatttcaccaatgggattgcaatacaacatagactttcacatttactctacaaaagccagcttaaaattaattaagtatgtagtatatcttaaaaagtaactctagctattctagcataggaaatgaacaaaaaaaattgcactatcaacacagacccccccaatctgaactcttccagcatggaaattgttgggagagaatgagtggtgtagaaactgtgctactttaggacaatctctactttgttgaggagaagattgaaaggacaaagttgatcatgcaactgaagaggagggggaccatcaatccactgaaggccagaaaacactaccggtgagtaaagatgatgttctggaatacaacagctcaatggaaacagggtgcgccggcggcagtaacctgattggtatcagaaagttttatttcacaatggaacccagtttccactcaccgaggcaccgagctggtgtgttcttcgggagaagtcgtgtggaatatcacgctcctgatggaaatttccctgcttccatttgaacaaggagcacaagcctgcaacaaccataataaaaggtggatcaagtcaggatacctggactgatgaccttttgagaagaataaatcttaattggtgacttttgcagttgcatgacagttcttggcaaagttgccaaaccttcaaaattattactatatgtttatcacatatggtacagtaggatacgaacaaattatgtgtgaatcttttttagttaggttggctacaatctgaacgaagacaacaatcgaagtttgctaggtgtaggtggtgcagagaatctttctgttatatgggagtatggaactgactcctgtaccttctcaatcatctgaatttctttatcgtccgaattttcctaccatcatcagcccatcagtcttcatcacctctcttgacattttgtgcctgaaatatcttccctcatctgatgtctacctaacaaggttcctgtacaaattcacaccatgatcacgttttcgtacttaattatcctcaccgtttcgtcagcttccagggtcggtagccatgtatttcaaacgaaaacgtgtgtccagttctcgacttttcggcttgacccagaagaccgtcgcccaaaatctgcacattttcacacttggg

SEQ ID NO: 47425 - DNA, 14304 bp, Oryza sativa
ttcctgcaccccggatggttttcggcgccggatttgtggttgccttgagctcaggtcggggtcgctaacatggatgtcgcggcgaccaatcaaatcaaattcatctgtagaaaaatgagaggaaaaccacacatatcaatggcgtgagtagcgacttcagttgagtcgaaagatcaaactgggacatttcagtggttaccgctggccaacatgcttggaacgcagaaatttttatttactcatgtgagaattgaaatgtcttaaaccctgtaaaattatgcattgaaaatgggccttgaatggatcagaaacatagtaaacaaacccaacggaaaataaagataacgtctgtgcggatacaaaagggttaaaaaattgaaaagaaaaaaaaaagaaaagctgatactgcaatcaggcaaaactgaacgcagatgctgtctatacgttcatggatgcgtgaataaaaacacgtcagttaaaactctaatcggattgagatccggtgcagttataaactctaaccagcatcataggactgttatgtattttcagccgtttattttaatgatcaacagttcagattcactgctatagtactcgaacaacagtaaaataagcaatgttttatattacaacacttttgccacagtatcaaattaatctgtaccgtttaagtttgatccaacttagcagctacaactgctaaagttgcagtcaataatataattgcagctgattcggatcaaactccaatcagtcagtgtgtgcttcacattctgtaccaacaagtaacattaactatgatctgacgggacgctttggaagacgattaaaaagattaggcagaatactgtcaattacctgggtaacatcagatgcgtgtttactctttaccttcatacgcaaaagctgtggtactccctgccgaagtcttcatcaagtcataatgccacggctgatcttgattgtacgatttagaaagagtcgtgatgctagccaaccaaaactgcagcaacagacttgtatttttcagttgttcacgtcagagagtacacatgaaaaaaatcgtatcccagtcgaactaagcaagccagtcattacgagtatgagcttccaggtcaaagatgtacgaacaaggcttcttttttccatcaaacacgaaaataaaactcgaaaagtttcacttaagttccataaaataaattctagagtgaaaatcagagaaagaaaggaatgacggtcgaatagcattgcttctagtaagtagtcaccgacccagtttcttgttgaaagatacaagtacaaaatgtaagatttgcaaacaccagcatcgagattatcaaatatgtcaacgggaagaacgaccgtgcgtgcaaaattcatcaggttgctgatgtcggtgaagaagttgaacctgcacggttgcatgagtgcgctgcatgactacaattggctgctaataactagtgctctacatgactaccttccaacaatttgtttaagtctatactaacaaaccaaaggcccactgattcctgacccagtttgtgcagtaagtagtcagctgatcaaacggcaccttggtttgcagaaattacctgggttaatacactcctatcattttagcaaaaggaggcatgagaagctatatgattgactgcttcatgtagcacagaactacattgaaaggtggcagtggatatcaagtatcaacagccgtcagcagattgtttctcctgtgcaaattatattagcataatgggacttgagcaccactaactctccactcatccaattgtccaattgtttaacctgatacacgagcacctgccattgtacgatgttgcctcccaaaacaagctccatactcctagcctctcatctgaggctctgaaacctttcgtctcaaacaaaagatcacataatctgtccccatctcccatccaagaagaactcacataccaaccatgccttgggctgaaagcttgctgttcctcctcctcttgttctcgctgcccattcccttctcccattcttggtcctttgattatcccagccccattgccaacattaattctctttggacgaacaacaatgccaccatcccatacagtgcaacctacccagatggttcaacgatcagagcgattcttgttaggcagaatcctacatggtatagtccattcttcgcatgtggtttcatctgcaccgctccttgcaatgattttctctttgccatcttctcggtgtccgttggtgatccgagcaaccctgccttcaatacctcgtccatgccacggatcatgtggacagccaacaggtcccgtccagtgaaggataatgcgtcactccagttcaaggatggcaatctcatactgcgagacttcgatggttctctggtctggtcgacgaacacatcggacagccgtgttgtcggtctgaatcttgctgaaactgggaatatggttctcttcgacgcaatggggaagacggtgtgggaatcatttgagcacccaactgacacgctccttcttgggcagtcactgaggcaagggaagaggcttacttcagattccttggcaacaaactggactcaaggtcagttctatctcactgtacttgacaatggtttgtatgctttcatcgaagcagatccaccacagctctattatcaaagaagattcaatatcactgatgccatagttcagccaaatatgaacatatcctctgatggagcaaagaactacacgacttacatttccttcttaaaaggtagcctgtcagcatttgttagcttcaacaatactgatatcaatctattcgatatatcactgccgtcgccatcttcagcacagttcatgagcctcgagaatgatgggcacttgagagtttatagatgggatggtacttcgtggaaacctcaggctgatgttctgcatgtggatcttgatgattgtgcatatcccacagtatgtggagattatggtatctgttccgaaggacaatgcagttgcccgagtcggaattctggggatgaagatcaatttttccgccaattggacaaccggcaacctaacatgggctgctccctagcaattcctctgtcttgtgacttgacccaatatcaacagcttctccccctcccaaatgtcatgtacttcaatttaggacaaaattggaccaccgacgaatatagctgcaaggaggcttgcttgaaggcctgttcatgcaaagcagcctttttcaagtataacaatgtctctaatggttcttgctacctaatgccaaagcttttctcactcatgaattatcagcctgaagtagttggatacaatttatctgcatacatcaaggtgcaaatgttacctccaccaccaagaagcaaacaattaaatccattagtttaccatgttggtgctcctattatagttgcagttatctgcataattattctcatcatcagaagaataatgaaaaggaagatggatgatgacgacccatttaaaggactggctggcatgccaacacggttctcctacaaacagctgagagaggcgactaataactttagcaaaaagctgggacagggaggatttgggccagtgtatgagggaaaacttggaaatgttaaaattgccgtcaaatgcttgcgtgatattggccatggaaaagaagaattcatggccgaagtcatcaccattggaagcatccatcacatcaatcttgttagattgataggatactgttctgacaagtttcacaggctccttgtttacgagcatatgaccaatgggtctctagacaagtggatcttcagaaagaacccaagaggtacactcagttgggcaactcgatacaagattatactggatattgcaaaaggcttggcctatcttcatgaagaatgccgacagaagattgctcaccttgatatcaagcctggtaatatcctccttgatgacaagttcaatgcaaagatatctgatttcggtctagcaaagctgatcgatagggatgaaagccatgtcatgacaaaaatcagaggaacaaggggatacctagcaccagaatggttgtcatcaacaattaccgagaaggctgatatctacagttttggtgttgttgtgctggaaattgtgagcggaaggaaaaacctggataacaatcagcctgaagcgagcaacaacctaatcaatctacttcaagagaaaatcaaggtcggccaagttctagatatattggacaatcagaacgaagaaatccaattacacggggaagaaatgatagaagtgatcaagctagcagtctggtgcttgcagcgcgactgcagcaaacgaccagccatgtcacaggttgtgaaggtcctggaaggcgcgatcgacacggaaacatccgcaggctacgatgcagctagtaaagatgatattaattttgacgcttcatcccctctgtccccagcaccagtgtcagcacgatgaaactctttttaagtaggaacaccgatacttgttacagtttagttgcagtactgtgtgcagtgtgctagtgtgcatctcatgtaaatttgtcccttgtaatatgtaacatcctcatcaatgtgtgaatgaatgaaatattataacgattttattatcgagctatttcatggtttcccaagtaacaagacgaacagcaaaggtagcatgtgaagggctagggaaaaggtaacatccgaaccttgccatgctcggccacgcatttcgtcgaacacgcggagggccgacaccatctgtgcccccccgaccgccgacggggaggccacgccgagggacaccgcccccggactgtcggcgccgcgcgccgcgtgcacgctcgtgcacccaccccgtaggaatcactcgacgccgcagcccatcctcatccggcgcggcgcggcgggcgacgccggcgaggctggcatgactcacgagcgccagcgcgcggcgacgagggaagcgggagagagggaaagaattataaaataataaaataaaaatctaagcgcgactcgagcactgcacgaatctcgaggcgcacgtggcccgtgctgcggcggccacgtgggcgcccgaggactcggaagagttttgtgtggccgtggtatcctcttccctccactccactctccaacttctcccgcagcatcgccgccgtcgtcgtcgccgccgccgccgcgaggtgagggctcgtagcaccgtccgggagggcggaggaggaggagagatgagctgctgcgccgcctcgtcttcctctccggttctcgccaacccccgggtgagtacgcacgccctaccccgtcttcgccttgccggcccgccgccgccgtcctctccatcgacggcggcgtgaaattcctgcaggaatccgatgcgttccccttccgctagttcatttcagccgccatcattggtcttagcggacttagggcaagatcaatcccgccgcgaacaaacccgcgcgcttccgatttttctcacaaattcttcggttcgatgtgctcgtggaatcgaatcgtcggcgcgaattcgctagttcgttgggattccgaaagggagggaatgttccgaagagaatcgattttataatatgtctggatttatctttcaccaaggtcccatggtctagcggttaggacattggactctgaatccagtaacccgagttcaaatctcggtgggacctattttttctccattttttttctgactcgctgatccttgctaggatgtggctacatccaaaacaccatttgctgagtcgaggcgtcgagctgaatccatttgctgagtcgagctgaatttatatatgctccatgaaatctttgctacgaatttatgctttgttttcatttcaaggatgttgctgcatcaaaacaccatttgcttagttgagctaaatttataaatccccatgaaatctttgcaacgaatttatgctttgttttcattttttattttaaactttcaggggggattcgctgctagctgctcaacaagaaggaaccacagggtgatcttcctcggttcaaggcagttttctccgatcatatacagcccagcacgccgcgcgtcgtcacggctgtctcggagagaggtgatagcttttgcaggccagcaatcttgggatatcggcagatttgtcaggacgctgtatttcttcaacgggccaccgaatcctctcaaggtttactcactgtattgggattttttttcacctcttctcgttacagttatttcacatttggcattgtgctcatgttttgtctgttcaatctgtagattgtagagtccattcttagcagtttcactggctctgctcctggtgaggtgccaaagaaaatggaatcttctgatgtggtgctggtcactggagctaccggtggcgttggacgaagagtggttgatatcctgcggaataagggaatacccgttcgagtattggtacaatacttgtcaagcttatctacttttggcttctctgttttcattcattattacatggatagtccaacttctccctcttttgttggatctttgctgctcttaatgttgatctaacatttcaaatttcaattcaggctagaaatgaagagaaggcgaggagcatgctggggcccgatgtagacttggtaagccacttgtttagctggatttagattcatgttccatgtgcggtttagtttcaaccaactaggtctatttcaataccccatgtattccaatatgcattacccttacccaatacccaatgtattccagcaatatgattgcctgaggtaagtctcactgttacatttctgctaaccttctagttgtgaatgaaatgaaactagggaattttgttcttaaatgatagtgaaaatttctgtgtattttttatgacattttgtttgaagtgaccacgtatatgcaatgattcactacatataatgaaccttcctatctcattgctagtttgcatatggtttatgtggttattgaatcttccacacctgtaaagacggaagtattgaatatttatattattaaaatttctattttgtgtcagatcataggagatgtcacaaaggaaaattcacttgatcccaagtacttcaaagggattaagaaagtggtaaatgcagtgtcagttatagttgggccaaaggaaggcgatacaccagacaggcagaagtataaacaggtacgccaaatgccctatcatatgttaccaatatttcacgtactctactttacaccctacaaacttacatttaatctcatcttcatgcagggcatcaagttttttgaacctgaggtagctgcatcaatacattccttctcttgtagaatataagtaacaatggatgactgacatcctcattcccaacatacaacatggaaatattgcatcagtttgcacttttgctcgttcaaaagctagttcattatattattttgttatgcctatcagatcaagggaccttcacctgaaatggtagaataccttggaatgcaaaacttgattaatgctgtcaagaacagtgtgggtctgactgaagggaaactgctttttgggggcacaggtaaatctttcattccataccaaaatgttttttgaaagaaatatcggagatttaaatctacactcaactcaactcatattcattaggggacctccatagtacccaaaaactttggtgcaagatctgcgggaaatccagtttttagtaattatggtgatcataacagtgatttttttcaaaacaacaaaatagtgaattgcttgcaactgaatcatgtataaatttatttttccatccctacatgtgtatacatttgtatgttagttgtctttcaatatataagttttttttccttatcacaacatgttagttattttatttaggcaacttatccggaaagattgtttggggagcacttgatgatgttgtgatgggaggtgttagtgaaagcacattccaaatccaaccaacaggaagtgaaactgatggaccaaccggattgttcaaaggtattttgtttttttttaatgatccctcgactccttgtatatgcgatgtggcaattctttggaaaacctctagtctaagcaggtctgtgcaatgtattctaggtactgtctctacttcaaataacggtggcttcactagtataaggacaaaggtacctactgacatgtattttcccaaaaaaaaaaaaaacaaagttgctgccgttttgtgtgttgatttatattttatttccatgtcctaactattaggaataattaattatttgtcactcttacagatggtgataaataatttgccactggacccacatgtcatagacaaatgaggacccacatgtcataaacagcgagtggcaaataattaattgccacatcttaaaagtggtacaaagttaaatgtccctaactattattgtgatatgttactctgattgcagaattttacagtgcctgaggatctgtcagcatatgacggtattgaactacgtgttaagggtgacgggaggcggtataaacttattgtgcgcactagctttgaatgggatactgtcggctacattgcaagctttgacacgactaagggggaatggcaaagtgtatgttgtatttgttgatttattgaaaaaaatacgtccctttgtttcagcaacttacagctatgcttcttattgatggaacaggttaaattacctttctcttcactgaatcctgtattccgtgcccgcactatgcctgatgctgcaccctttgatgcaagcaatgttacttccttacaggtacaatgtgttcatgtgttggtataattttttaggaataactgaacctgaaattgctgtgataattctgtagctcatgtttagcaagtttgagtatgacggaaagctgaacccaacatttacagaaggttcatttgagctccccttttcaagtattagagcatacataaacgagccaatcactccaaggtttgttctttgtactagttttactatatgacatcatcagaataaatgagcactgtaatcgtccgattgtttggaagtcatcaagactcactagaataaatgacaattctacttgcaggtttgtccatgttagttctgcaggagttacaagacctgagagaccaggcctggatttaagtaaacaacctcctgctgttcgcatgaacaaagagctgggctccattctaacttacaagttgaaggtatgcgccatttttcctttattattgtgcatttgtgcttattgattcacatcatgtctaaatgcttatcgcatgtcctttcagggtgaggatttaatccgggaaagtggcattccatatactattgtgcggccatgtgctctaacagaggaaccagctggagctgacctcatatttgaccagggagataatatcacagtatgtagaggcagcatttgtttgttgccttcataagatgccacgccattcttcttcctccataagatcaaataaagcatcagtttcatataagtttcctgtattttttttttcagggaaagatatcaagggaagaaattgctttcatttgtgttgcagctctggcaagtccaaatgcagtagagaaaacctttgaggttaaaattctgcaactcatttgcaagacactacttgggacaacaaaacttcagaaggaaattgtggcattttatttcattttaagctaactcatgtacttttttttgttaggtcaagagcactgttccattcagtgaacctttcgtggttgatccttcaaatcctcctccagagaaagactatgatgtgtatttcaaagagctcaaagctggcataacaggtaaagaggcactagaaggaacacctgctcaggtctgaagaacatgttaaatgcagaacgcccaactgctttgacaaatcttgacatggtaattctccattgtatttaggtcttaaccacttaagatatatgagattataacgctgaatttcataaattaacttcatgataggtgcttcttgaacatgaacagaattacataaatatgcaagtctgattcataaaccaccaatagttgcagtacctgagcatatgtgccacacttaatctttgcagtcatgtggtttccaaaataccaaatgggaagtactttgtgaagtatgtgaaggaacagttgtttcttttttttatgtaaagtagtatatcctctggagtttgtgttatatttaatctgctgtatctgtatgagaagatatgcatacatcttcagaagacatatggatgtcgatcaagagctcaaaggttatggagcattggagctctttctgtagcagattctgtatattatgttgcttttattttcactgaattgtgtgctgtagatagcgtcattggaatctagatcgaccattttgtaaaatcaaatacattgtcatacagagagaagagaagtttacagttccagttttttttttcaaactttttatgtctctttttagtttgcccctctattggttactgcaacgcacccctcctttttttaatttaaaatatacgatgaagaaataggaagatgaaacccctcaaaagagagaatgaaccatgaatatgaaaacaaggtacatccatatcactagaaataaatgaacagttaaaacacaagcattcatatattttgcacagcatcaggttttctaccaaactgaaaatcagtgaacacaccactacaatccctactacacacaagtcatttgagtactaattttctacatgtttcctcgttacaaagccaaaattaaaaagaggaaggcaaggtgaaattactactccgtgaaacgcaattatacatccaatcaatattcccataattacatgaaaaactccctaaactgcagaatcatatccatgagtcctttgcctaatgatcaaagctccccatgcttcatgcatgtcagactgtcactcaccagcagcaaaacacctgcatcataagaaacaagaactgtcattagctaattaagctaggaattcagaagcagaaatttgtcaaacacatttctgcacaagtgagaagagcacatgacacaatagtgcagtgcaaaccacaaaccttcctcctccagctccggcgccggcgcttcccgccgccggcgagcacgagggcctccggccgcaccaccagcggcgaccagaggccgctcttctcgtactcgaagccgaactcgctggtgtcctggaacttgcccaggagctcctcgctgacgtccagcggcaccacctgcaccacgccggcgccggcgccaccgccgccgccgcccgccggagaagaaggtgggaggctcacgaggtccacgagcgatggtggtgaagaatggcaggtcgacatggcagcatgtcctggtcagggcagacagaatgcatgaggagaaggaagcaaaggagactgatggaatgatatggatagctgatgacgatgatgatgattcatgctgagggaaaaagattcagattggtgtgtagtttgtgtgtgtgtgtgagggacaatggcagggagcagcaagcagagaggcaagaggcaggtgagctgttgtgtttgcttggttgcagggcaagctagctgccaagatgaacaacatgcatgtgtgtgtgtttttgtggttgtggggctgggagtgagagagcagaaagaatctcatgctgccttttctgcagttggagattgtggttagaggggacttttaacggattaggattcacgtccacggtgacttaatcattgacatgtgagccaaggtttagagcaggtacaatagcagactataagctagctgcaaacatattttaagaagataaataaggagagaagggtagcgggctacagatttgtagccagctgtagcacggacttcaagacgcaatgtgtgtatgacatgtgagaccaggtattaatagagtagtatataactattgtatgaatgagctattagattggttatacatgaattggagctagtagttggctatactattaaacttgctcttatggggccaatatattagtgacaattaatgtcacctgactttgaaggttgaggatgctagtttctttaaaacatgcatgtagcatactatctctatccataaatataaatatttctagcgtttaaaatttttccttaaatataaacatttctacagtattatatcattgagtatgatgtttctcaaaatatcaagttttggggcgtatcaagcaatttcacaacaaccttaaatccttaattttcacgtaaaggcttatatttgtggacggatgaagtaactactgtctaaaatcatttaactttataactaatgtttcgagggtaacccaaatagaaacatgctcctataggattttctctttaccggtgttcagtgttgtgcatgcagggctgcatcattagtgcatgcattgtgctaggccaacttttcacatgcctgttaattttaattaactaaaagttgatgactctggttaactcctactagtacctttcagaacaggtaggcacaagatctgctggtgtgtttaattagccaggcatcagctataatggaactttgctttctttcttcctttcctttcctttccatatgcttcatgtgatgcatcgctgtgatgagatgagatgagatggagatggagtgagatatctgaatctggattggttcgtacgcatgatggcaaattttgcaacagggggatgggatcatggacggtgtccacccatgcaatggtgaccatacccatagggcattggaccataagatgcaaaaacggcctctagctagagcgattcacggttggcacgagccatgagatgcttccacgaggtaagaaggttgcgttctagaccgtccgatcgtgatccaacggtatgtaataattcgtttgaaaaatataaggtgttagatttttacagtctccaaccttacacttcgacatagtgtattatcaacaattataaaagtaacatcaaatgaaaatatcttcataaacgaatttaacgctaagtgacgtactagtcaaaattttcatatattgactttttgaaaaacaagaacgcattatattttcaaacggggagagtagcacacgataaccagagaaatgaaacccccttgccattatgcaattaactatatatggactgagactttcagtttatgggcctgagcttgattaggttagttaggaaaaagtacaagaaaagcaattggcattcatgagaataatatgatgttctactattctctgggcatcctgattcctgaagacatgaacagatgaactgccagtaggtacgtgaccctaccccaatcttttccgatccatatatataggtaggttattcagatcaacaatgctgacgagattacgagaaacgtcaaatccaaccaaactgatgtagaaaaaagttaggcgcagcgtgattaaactaatctctagttaaaatgactacatcaactccatcaagaaccttatcatatttgtatagcaagattggctcctttctaagtaatgatcatgagaagtaatgcgtgacatgtagtacattgtagccagttgatgttaacttctgagcagatatctccattccagatttttgaaagaatggacaaatggataaatagggacttgtttagttcctattttttttcccaaaaacatcacatcgaatctttagacacatgcataaagcattaaaatagataaaataaaaaattaattgcatagttttcatgaaaattgcaagacgaatcttatgagcctaattagtccatgattagctataaatgctacagtaacccacatgtactaatgacggattaattaggctttataaattcatctcgcgattttaagcgagttatgaaattagttttttcattcatgtccgaaaaacctttctgacatccagtcaaacatccgatgtgacacccaaaaaattttcttttcgcgatctacggggaatttttgaaatggtgccatgcattcaaacaactcactcaaagcctcccaatagagagcaataagggggaaatttccagaaaataagagtgaacatctcgcatgccccacatgaaacagcgtctacagtctacaacatcaagaaatctagcggtactggaaggtataaaataccccaagcttgtttcctaaacacagcaaatagtttttccatcttctgaaaaatgttagcattcacaagatacagaaataccggtactatgctagagaccagcg

SEQ ID NO: 47426 - DNA, 6511 bp, Oryza sativa
ctaaataatatagttatttgcacagcttgcaatagtaccttgatagctgtgatttgctcaggtgttggagcaactacttttggaccctgctcctccattgtggtatcttgagcatccaccacctgtccaggagtaaaagttttggctggcaccttctttgcctcttcctctgcctcctttgagtgaaacttctgtgctgctgcaattctctcctacaaaaacaaaagatctcacgcataacttcagaaattaacacaaatacatgcacactagataatattaaaaataacacgtaaactaaaaggcattcatgtatttaattcattgcgacacaaagttaaagagtcgctcttttgccctttttcctgccagcacttctgcagtccattccaaaatcattttggcagtcattccaaaggaaatgaatgaacaacctgtggggaataagtaaactaatcaagcagcaacgcagtttctgcatagatccacatatttcaaaatgcctttgtgaaaaaaatatatgtacaataatataaactatataggcttgcaatgctgtttaattttgaactcctttgaaataatcgtatgctacatacttgcataaataaaacatgcaaccttaatgagtgttatgtcaatacatgcaaaatatcacaatatgtattttatggctccattaaacatttaaaaataagaagcgattaacttatgaaacattgatataaagagagttcacagaagcaccattgcacatagagctaaacgaaaggtgtttactgtttagtgctagaaactaccattagagatcaaatggaagaaaatactgagaaatttaaataaaaataaaccattcaaaatagaagtttttacagaaacttcaagagaacaaaactaagactaaatgattaacaaatttcatacaaaaacatatttacatgaaaaagaacctcagcattgctaacctgttgtttcactttcttgaaatccagcaaccgcaaatgcttcaatttatggatcacatacaaccggtagtctggctgcttggttacagtattatcaagtaagctaagaaactgaagctttggaagagatgccaggggatcgatctccgcaagatttgtaagacgattgtttgtaagcaccaatgtatgtaactttggcaagaactctagaaacaggagcaactgaaggtaagttctggagcaaaattatgaaaatgataaacagatcataacaagataaaatatataatcttaccaccaagattgggattgatacgtgtgattctgttattgttaactaacagagtgccaagacgattcaagtacgggaagttctcaagcttgacaatctcattgtctgacaagtcaattgtgtcaaattggtcctatttgagagcaaagtaacaaaaagaagtgttaaacatgctggagaaagaagataataaaacaaaagctgggtcaaatactgaaatgagaatgagtattttttgggatatcaaatcagatcaaaatgaccatactagttatttaactatcaagtgattgacatgacaaaggaaaaccaagaaacatgtcattcataacaacagaaagtatgccgttaacatactaatgctttgaaattacatgggcacattgtacaactaaaagacagctctatcagcaaaaaacactaaaagacagctctatcagcaaaaaacaatgtgtgggacttatttcctctaaacttccatagaagaaaaacatgcagaacctcaaaaaattgccaaaaagaagagaagtgctaagctacctagcgtcagcatgtacagacaaattttaatgccccaaattttgtaaaattattatgcaaagcacttcaaatcgcagcgttgttaacacatactcaactgagaatatgagttttattccattccagagatcgaaaaagataaaattgaccatactgattatctaactataggtgattgacatgagaaaggaaaaccaagaaatgtgtcactcataacaacaaaaagtatgccgttagcatgctaacgattagaaattctatggacacattgtacatataagatagctctatcagcaaaagaaaaaaaaagttcttccagactcatgtgggacttatttcctctaaacatccatagaatagaaacatgcagagccgacagttatcaagtcctacaaaaagtgacgactggtgctacagttagtcctaaagtctttgagggaacacgacttgagggggcacgactccatgtgctggccgcagaagacgcaatggagttgagacttgagcgaatgcttgggaggcctggtgccttggcctatcaggccctgctgagtgaaagggagattgagagctcattgggtccatcaggcgcagcaagttactagtaacagactagaagtagaagcaatctatgtatgtaataacaacctgatagagtagtcaactcaacgactagtcctcaactatgctccgaccagtctactacccagtagacggtatctcaacccgactttacaacttaacaaccatggcagaacctcaacaaaatgccaaaaagaagagaagggcacactcatatgttagtaatctctcatacctatcgtcagcatgtagagacaaaatgcagtgccccgaattttgtaaaattattttgcaaaacacttcaattgcagctttattaacacaaaattgacgctacgaacttagtagcattatgtactacatttcttgcatcactacctagggcacacccatatctactaatctcccatacgctacatccaagagtaaagcatgttccaccaccaatccaagaacccatcataatacttcaaatgagacaacaatggagctaagggaagaaaaggcttgcggaagctggtggagctcacctcggtggcgcccagattctcgatgatggggatcttgttacctgccaaggaaaagaaacacaacagacaaattaaactaccgagacggagggaatgaaaaaagagggccaagaacactaaaccctagatctagcgagcagggaggaaagagcgcgcaaacctcggatgtcgagctcgcggtccttgacggcgttgaagaagtgcgggctcttccatatcaggtcggcggtgagcctcaccatggcgcggccgggagggcgggcggcggcaacagcttcgggtcagtcgggctacaaactcccccgcggcgcgaggtcgaaaccctagtgatgacgaggaggggaaggaacggcaaggcggccggagccctagcaaacgggaaggcggcgaggggaggaggtggaggagggcggccgcatgctcgctcgggatggcgaggcggcggcagcggcggcaaaggagatgtggaggcggggtgggagagggttcaagggtagggcttttgtggcggtgctttacgatgacaccctcgtagtttttattaattgaagaaagcgtggattttaagcaaaatctgctcgtttgtacggtgagaaacagctgattgttctagaaaaatagggttttcgcttatagtttattttttaattttataactatagcttctcaaaatctgaatgaaatgtagtactgtttatgagagcttctaattctcggagaaagtgcagctggcaaaagctccccaaacatggatcatatagctacgacaacctgacccaatggggacacaagtcaaaaaatgagcaaatgtcgaccacttatatgtgataaaattgtaatatctcgaaatttaactaggtgtatgaaaattcggagggatcatttgaacactaagaaaaaaaatcatttatgcaataatttaattgtattatgtggaaaaaaaataggactccatcggatggctgattgagctaggggcgtttcagccgaagcccatcagatggctgattcgattaagctcattcagccaaacgaagtgagcgcacaatggttgtgtatccaactctggcaacaaatcctatgatccttctagtgctcacagccccacacatggaaacacctaaaaagaaaaaaaaaacacgagcggttggaggtgactaggccaacggcggaggctacaactaaatagccacaaaagatcaccaacactatactggattatgtcaaagaattgcttttcatagagccgttaaaatctccgtatgccagagccgcccagtcaccactcttattagcgatctccaatgtactcttatataagaaaaccccaaagaacgatatactatcaaaagaaaatgagaagatccaaggaagaaggaagaatctgaggtctcaccaacccaattttaaaccatcataccagagtgcattacacaagacatacactcaggagagagtcatgaagcaatagaaacaaattatgctgaggaggtcttctaccatgctccaatcagctcgcaaaccaactttcagtggccgtgtttgttaatgatgcttgcatcaagcatagaaagtcaagctatatcaaattacacccagttcaattttctttgatatccattagagagttagccccgaagaacaaagagatacagaatttgcatataagaataaccaagtaaaaaaaagcataaaaccaagtgatggactgacgacacaagtaaaaccaataatggtgaaactttaaatgaaaagcaaacaacaatgtgagatcttaaaagaaaagccaaatccatcaaaacaatgatcgatgaagacaaaatgaataattaaaagggaaaacagaacaacgagagcaagcaaagaacacgaatgctatttgtcacctgccatcacatgcgtccggtgatgatgacaagaaaggatgagtggtgtggggatctactcccaccgtcccatagaaaacgaatatagaatcgaatatgacacattctagcactttgaatatagatagatatatgtttagattcgtagtactaggatatgtcaaattcggtaatagatttattttttatgggacggagggagtactattttgtggaattgtttgccccctgatgacctattatttatcgtaacaatgagataaactagtaaaatcataaaaaaaatgttccaaaaaaatttagataacatattattaggagtttaggaccacacgaaaaatttatcaacaaccaggactatctagtatttcctttttcatcagaaaaactgatttatatcaattcatatatttttagttttctgtgtggaacccagtgccttcttaaaaaaagtatcactactttttttttattttcaaaaggaccattatgcccctccgcatgcccggagcagttttcccattcagcctttctcccgtccacgcgccatatctctctccccctcaacggcgacggccgccgccctcggatcccggcgagagacaaccttctaccttcctgcccccttctctccccttcgagttccaccccttgcagcgccgctggcccgcccccttccggcctcagatctgtcaggcacggctatgattgacgcgcgggcgatacaaggtcgtgggcgcggcggcggcggcggtggccgcagcggcggcgactcgaagctgtctacgcgagcttgccggaggtcgagattatcttggtcgtgggggacccagcttcagcgcgtcgcggcctccacctaccttccctaagattccctctcgtcttctcctcctacttggtttcttgggaccaagagaaattgtacgccatgctgcaagaattcacctcaagtttgctttgatttcttaatctgattcgccgtccacacacacgatgcgatcagctaggctcggccaccgcccgttttgggattcttttccccttccccgttgtacatattgtgattaattgcccttagttcagagcagtttatttagtatcgatgttgatgcacacgctgtggttagagattgttctgctggcttatacacgagcaacggaggattgggtacgaccaattcagagaattcgttagcttatgtactttcctcttaaccgaaacagcaattgtgcttgtaaattggtggcacggtggtgttgcctagttttatggtcctagacttgtcgatccatcagttgaaaaaatgtagtggaatcttacaagttgctacttgccagaactttgctttattatcgtagacgattaaaggaccataaccttctttagtatacataagtggcggacgtaggattttataaatgggtgtacgataaactaatctacttataaaaaaaataaactatctatttgttatacaatattatctctaaataaatataaagcccaatatatcataaaagttggactagaaataaactaaatcttatttttatctttaaatctcattctaatacatagacatgtaactagtaagactttgtttgcaaatgggatagagataaatattgtccatccattcatcacacctcatttaatcctagccattcatccatttctctttcccaatccctactctcataactcatttgccaaca

SEQ ID NO: 47427 - DNA, 3696 bp, Oryza sativa
aagtaaattatagttcgtactatgtattcttaaatgttttcatattatgtcagcctttaaccattcttttcatttacagaacaactaactttacatttcaatttggaccaacctatttcatccatctccaagtccaatgactctataaccacacactaactctctctttctctccattttattttcccccgatagttggggaaccgctagatccagcaagaaggagcctggatctagcgtctccactcttcatcgggtcgactcctgcctccgtgagtcgctacaatagtatgcatgacaagagggagaggaaaaaaagatggctcatggagtgcaactagagggtgcagttgcgcatgcaaagacagagaggagaaacgatggtggctcataaagaaagagtggtggtggcggtgcgtggagtaatagttagtggttactggtagtatgaagagtttgttgtcgactcaaatcgctaactgagtttgttaatttttagaatgtggaccactagtcattataaagaaatagtcattataaagaaatagctagtcttataaagtagtaaaatattgagatatcataaaggtgagagtactcgtctagagcttttaactttttaccatttttaaaatatggtaattaagaatttactactcacaatctataatacgtggatccttatgtgtatatgacacgagaatgctccttctcggtcgcgcgaggggaggggaaaaaatcggtcgctccacccttcccccatcacgtgcgcaccagcaatctctttgggcccccaccacatgtcccctgtccccacctgccacttgtccacacacacaactctattgcaacaaatcacccacatattttgaaaaccctatattaagggaatttggtttactttttgttccaccaaaaaagtttcacgtagtgtactcataatgtttcactatgtatagatctaatgttgcagtgaactaaaatattccattgcaacaaaaaaacccacatattttggaaaccccctattaagggaatttgatttattctttgttccaccgaaaaatgtttcacctagtgtacttataatgtttcactatatatggatcaaaagttgcagtgaactgaaacattctttcactatttgctgaaacattgtttttatataaggtaaaacaacacccaattgaaacgagtgaaatattttcgatctacttagtaaaacaattccgatatacctggtggaacatcgtgcaacatttaaaaataattcaataataaggtaaattttttttcgtcgaaatatatgcctgtgtggccttgttttgaagatttaattgcagcgaatttaatgatgcaatcggattatgatatggataagtaatttaagagaaaaatcagtttaaaatagtttttcacgtaaagcgtccgatttttctccaaaccgatcagacgcacgatccgtagactcgtccgtccgtatatacatgtgggaccagcggtaaattcttaataattcccaatagtaagagtctgagcgtcttccccttccctttgtggcgtaaaagaaagaaaagaaaatctcccgtctctttgtctcctccgctccttgcgccgccgagacgagtcgcggctgaacaggggaggggcggcgatctccatcggggcgagcagagcaggggagaggattcatggtgagcatccgcatcctctttctgattcatctctctctctcccatcgggactacttttgtctggaatttgcttgcgttcgttcgttcgttcgttaaccctagcttctcttctagatctggaagaagctcttcccttaatttcagagccttaaccttaatacaagtacagtttgtttattccccgagaagtttgaacccccatgtcccaagttggatccgctcctgtacataatattggcagcttgtggcactcttgaatggaggtcttggaagatactttagtacctgttctattagattggtgtgttataggccctgtgtggaatacaagaattttgctcggttttcacctttaattttccttgtatttccaccttgttttgttagatcgctgttgctcacttgcttgcaatgtaccgttatctgaacatcatatgctttttttctacttgtggacaggtttatcactctagctttgttgatgacaccgggattaccaaagcatgcggctgtcctttgcttccactaaaaactcatataaggggcccagcgccagcattcgatcaaggtatactgacacggtgacaacataaaatacattgtgatatacttccgtggtttcactctgacagaaccatgccaagctgctgatttatgtcgtgctattacagacaaggctgacattgttgatgaagcaattacattcttccgagcaaatgtcttcttcaaaaacttcaatgtgaaaagcccagcagacaagttactgatctatctgacattttacatcaatattgccctgaaaaggctggaaggttgccgaacactggctgttgggacaaaggcaatcattaatctgggtttggagaaagttcctgtgcctggggaaccagggtttcccttccctggtcttttcactctaccccaatctcaggaggaagcaggtatatgacttcatccgccactaccacatttgtgtgcttgtattctcttttactccctccgggttgataatacttgtcgttttggacaagagcacgctttccaaaaaacaactttggccattatttttaattataatatgtataaaggtgttaacaaatatatgattttattaaagtactttttaagactaatctatacatgtagtcaccatattttaaaaatgattcataatcaaagattctaaaatttgacctcacccttgtctaaaacgataagtattatcagtccgaagggagtagtttctcaactgtgtgaaatcattgttgctttttattcctagagaaaagcttgccttatttctcgaatagttagtttttcttcttttcccccaattgtttatccatgctgcttttcttctataccatactatttgtcctggctagggaaaaaacaaaagaatgaagcctattggaaatttagcttttgtgagattacaaggggacctttccaaactacagcaatttatgtcttagatacttttattttggatttaactaaatctgtagtgaactccttatttgatgtcctgtatatatgttttttttttgtcaatttctatggtctaaactataagtctgctctgggtatagaagcaataagttgcttactgactattgacaactgtttttaggaacatccaagttgtaattgcatcagttttttttttacttctagggactaaataaaacagtaactttccatctctcatggaatgtgatctcaattaagcatttctctgttggattcagaactattgaggaattatctgaagcagataagggaggaaacaagtggaaggttgcttaactgcgcatacagagctaatggtactccaaacaaatggtggttggcttttgcaaagaggaaattcatgaacattgtcattctttgaagtataggtattttccgcgacatgtttgagcaattgagcagcttgtaggaatggtaattgcacttgcgtacttatttctgcgaatactttagagaattaaaggaacga

SEQ ID NO: 47428 - DNA, 1203 bp, Oryza sativa
ggaacttgctcaaaaaccaagtaactaacaagagatattacccattgaatggatgagataatcaatcaaagtatcaaactaacgatgttgcaaagagcatgtatgataaaattgtcaggccatcacagttggtatgtgtcacacaatctcattggttgaatttgatttgaaaagttaaatttgtttgaaatggtaggcttgtagagatatggccaaagatatccacagctttcaatggaagttatctttagtccccagtcctctacaacacatctatctaccaaggattgtacaatggagataactggcaataagaagggctaccactcagcatacagatattagtctaaatcatttggacaaaattccgctgctaaagcaaattcattggttctagcacaaggccaaggctatggcatacagcatgtgatggagttctgtcagatgctatcgcataccttcatgttcaagagccgagcaaagaaaacatatgtgcaaggaataaaacaccatagtgatctgttaagactttaagaacaaaaaggaaaagaagccagtgccagtaggtttgggaattagcaatttatgattttgagtcacatgcagtaaagtacccacatcctaagtgactaagacactggacgaaaattaactcagagtctatgtatagaaacagttgttgaccacgctacaacatgggtatgatgctatttgtctgattttccaaatttaaacttgtcagtttcctatgctgctatgaagtgattattgaatctccaaatccaaagttggtcttgtttataaggatgtagaaataattccagaggtttttgaagatccatggaagaaataccatgcgtgcattctactatatgacccaaaacggcagctacatactcaaagacattggaagatcaaagcagggtttattccaaatatctttgaagatcaaagcagggtttattccaaatagcagtgcagttcacgtctgccagggatagccatagcattgctggcagatcctcctagagccatcagcctccatgccagagaactcatgctgtgattctcacagagcaatatagtacatgctacataagaaaaatattccatttgttatttaccttatgtccacactcttctttggccacaatcttttccttgttttgttttctaacttaccaggcatttatacataattac

SEQ ID NO: 47429 - DNA, 11174 bp, Oryza sativa
caaatataagttcatcactgtaattatgatcacaaacatcttaaaatatgcttcataagtatgtctagtagtgtttcagtgaagaataacactttgtagaaacatgactcacttttcatcttgggctcttagctaattcattactatcagcatccctcttctgcccatgattgattcatcaaccagaactgttttgacacggctcagagtgctcccttttcatccagtgctagtcacgtagtgccccatatgaacctggctcagttggtatgccagttttaattgggatcactattaatatacagaaccataaaggttttaagtcatgtacacttcacccacctgcatatgtttggagctaattctactcttgaaggtgtaagcatacatttaaagcagatggagaaggcagtgcaaagattttaaattaacttgctgtattctgaactgctgggttacaatttcctattgtacttgtatgacaaaaatggcactttaatttgtactctgactcatttcaaatctaaggtttgtttttccaaacacatcctaggtggcataaacaaaatataaagtggaaaacgtccataaaacgaataaaacacacacacacacacacacacacacacagagagagagagagagagagagagagagagatttcttagattttgaatcattgctcatggccaaaccacatcaaagattgattgtaaagtttggaccttcggtggtggggtgtgtgggtgtgtgtgtgtgggtgtgggtgtgtgttggggctatggggggatgtggaaaaaatgagccaatttttaatacacctaacaacggtatgatgtttttactactgttgaaaatacaagttatatttatgttccatttcataactaacaagttctctttcatgtcactgcttgataatatcataataacattgtttcagatttcggcagtgatttgatctgatcaaaaccatatggcgagctcctcaggctgcatgtacaaagtattactttataaaagttgtcctttgctgtgaaagaatcagatgcagtaacggattcttcatatacagcttcaagagcacccagggggaagatccataagaatgtcccagaacagagcataatatcaggctatcagcaggatccacgaaatggaaaagaatatgatccagacatggcccatcgaattcaagctcatgttcaagactggttcccttttgtattagcaacagaaaccagaagggtacgggggtcagtcagttataagatgcaaacgcaaaagtgacagtttattagctgctcaagcattgtcagcttaggtagcatattccaaggcatatccagattttactcagtgatctttgtgctatatatacctgagttcaacaattaaaatacagagcaaggaaaatattggaagcaaagaatgacgagaggagcagtaatgggcagattgaataaattgtcagggtgagaatcacagtgcagttctcctctggcatggagggcaagaggagctgaatagctaatggatgataaactgctagcctttccctgccaaaggagagctgccctgccattcagtgaccctgaattcagcatgcgagcttcaagctgtgtgttctgttttcagtagaatgttgtgaagcacactgcatgaggtatgtgatcatgactctgtttttcatattctttgagcatcatccatgggtgaggccataacaacctcctgttttaatagtttatagttcatgaaactaatagttaaagagttaaggccttgagggtgtactacaaatggaaagatctagcaacaactctaagcgacacattcacataacatatccacagttaaagaaggtatcatgagtgtcaaatgacaattaagagaaaaatcactatatttaataataaaaacccaaagaaaagtaacaaaaatacatggatttaataagatatgaagtacctagatagggatgtatccgaggatttgaactggggttgtcagaccaagttggtggcatgcagccttgcaacagcaacggctatattcataaaaaaaaacagaagatgatggtaacaaaggttgttctacttcttcaccacagcatgccaccttgaagagcatcctgtccaccatcgaacctgccactgtttatagttagaactcatttatagttccatagctaacccagtcgctaatccaaatcaagcaccatagatatttggcatgttctaattaaccttcctatccaaacagtgggagcaatcatttgaaaatgtgaaccatccagtttcttgccaatcctatttaagttagacagaaaccctcatatacttaccctcaatattaagagcttcactaatcggattctccattaccacagaaaattagaattttggtacctaaattttccaattaatgaaatcatttgaaaataaaaacttaatagtggtacagcatttagcatgaggtagagcaagatttaagacatggaccaagctgtcacaagcaacagcattgctcagaaaaatgctctagaaaatcaacaaagctatcatgcatcatgatttcctaaaggattgcaattttattacttatagcaatgctactcgaaaatacaagcttcgatctaaattctatatgttagatttaaaataactcagtcttaatatgctacattatgcccgtcccagtgacagtccttatttttcttttaaaaatgtgctattatttagaaaaattctattatttagatctaacatattttaaaataactccgagctgtggccgttcagtggctgcagtgcttatttttcttttttgttataactatatttgttcagctctaatcttgtttaatttagtctaataataggaccttcccctagtatcttagtctaataataaggatccctccctccctccctccccctctctctctctctcttgatttggaggtgaatgattaatgtttatgcatgatactaataattattgttttttgcctgctctgctttttcttcttttcttagcaaaggttctcctgcttgctagctaggtggtaatagtcatggccggggacagagtcaaggccagggggagtataaatgtgcatctgtggttccacctagttctgtgactactgcagctaaactcttctttcatgatgcacgtaagagggtcaaagaacttgattttgggaacctgctcaatataaagctggagaaactgacaagtagagagcttgctgcacggctaacagatcaagctgaaattcaaacaaatcaagaccaaactgaactcaacaacaagcctggagagtcgctatgcatcacggtagaagtagtgcatctaattcttaccatgcggcgtggctctgttcaggagctcacgtcactgcctacaaatgaggcatcaaaagcattcatctcgatatacagtgtgttgaaggtcagggatgacaagttctcaaaagtaaaacccattgggatgctccttttgatgattgacactaaggtacttggtgttgtcatgtgttgtagttaacatttgtttgttcatggaattggcgcaaagtatcaaaggtgttcaaaaagagaaatagaaagagtacactaagtaacatacctaacaactggaaagaaaacattaatgaggaaaatatataatcgatgcagcaaatacgaagtaaatgatacacattgttgaaaaaatgagtttgcaatatttgacactggcacgtaaggaacacagcagaacagaaaattatgaaaatagctttctattttctaatatatagagagaaatgaagatttgtgggacaaccaggtaaaagtctaatttatagagagatgaagatttgtgggccaagcaggtaaaagtctgaaaaataatgatttagatgattgatacataatggcaactaagtggcatagctactatgcaagactgcagtccacataactactatggccattcctatatgcataaatctcattacaaaatgatcatgaaagatctatttgattcctaactaaacatatacttgcacataaagttagggccttgggggagacaaatagcatttgaaaaactagttaactacagcgcgtgaaggcaatgactacctgacatcgtgaaatgacacaatagtaccacaagggacaactaagccaccagaaaagaggtagaaaaaataccacaaaaaatttagtcaagcagttaaagcctaaagatgttatttggctgtcaatacaaaaggggcaagaacaacaaaaagcatctacaaacccaaaatacatggagagtcatccaacttgtttagatgtgtcatataggtcactctactttcaaaatgcacatttgagccatctaactatccacgtgagcacaccttgtacacctagcgtgccacataggattaaaaaaattggctgggtatccgcagccgctgtctcctaggattgcgcctccatctctgtttaagcttgtcgttgctgccacctaggattttgcctccattgctatttacattcatagcttgtcgccgcagccgccgtcaccatgtttgatggcaagcaagataaaggactgagaactagaagaactcatcaaaacaagcataagtgaaatgatttggtttccctaatttcgtgtatctccaagtgctagggttgtgagaaaggaaaaaaaaatacacatgcggttttctgcacatgtccgagagcatttttttcaattataggtggcatgccatgtgtacaaggtatgctcatgtggatagttagatgggcaaatgacttgcttaattcacattagtgacctatatgtgtattttgaaagtgaagtgacctacatgacacacctaaacaagttaggtgaccctccatgcattttactcatatatctagtactacccaccaaagaaatactgttaggcatttgcataagttatttttcatgacagaagtgtaagaactagaatccctggtttattttccaccgtaaatgacaaaagaaatgccgacataaatacattgtcggtggagtctaggagcaatatgccgaataacaggtacagcaaaggaaatacggaaccgaccggcatccaacattctataggattcaaatggtcaatatatccatcagtaaattcagtgtatcaaatgatttcagaacaacctttgtcaactaggtatttgttttatgcatctgaaaaaaaaacagtattagagaatggataaatcataccccgatgattgtcactgagagccttcaacttcatgtccaaagctcccatcatcacaaaccaaaggaagccaggccatacatatacggtctcctgaaatctctcctgaaacagtctctcaagcttcatgttctccaggcaaagtgagaagaattaagtagggggcatggccatcaggggagacctccactgttgccaagtacacataaccagccctaactcacacaactctcatgcccttgtaactgagatatgggtgtcaaagagaatatcttctgtgatgcccatctcgcaattccgttcctgacgactctagggatccagatgaggatgaggaagtctattgcatacacaatgcaaagccctcaatccttagtctccccagccataaaactgcaacccctgtgtcattaattcccatggtaattccaccctggagaattccatggccacggtgttcagcgtcattcaccatcgtaaggccagtaaatcgagccatccactagcacgccagcattgcctcatgttgctgtctccagcaaactcaacccatggatggcgatatggatgatccaattccaatcccatgggtctcggaggacgaaaagaccgcaagcacaaagcctgaattcatccctgtaaaccggaacagcgcggaagctccatgctcttcctgttccagctcgatgccaccgagcaacagcggggatgaagtacacgtcccagatcaaaggggtttaggatggcgagcctcctgtgggttcagcaggaggaggtcgccacgccacggcatgccaaccgtgggaggcgtagtcctccagctcgtggctccacggagggcgacggcggcggcggccgaagtccggggtgccggggaggatggtgaggccgccgtggtcggtgaagagcccgagggggcagggtccgggtgggtggagcaggcggcggaaccccggcgaaaagccgggcggcgcgggagcccacgagctgcaggcgaggaccgcgcggacgagagggcatggagggacgggagggcgaggaggatgtcgtcgttgagggaggcttacggtggtgctggtgctggtgctggggttcggttcggctccacggaggcggcgccgcccattgctcgaatcggaatggattgcgggggtgtgagcgcctgaacgagtggatggacggttgttgggttgtgtacaacggtatccattctctgtattagaaaaaaaagaagaagaaggtcaatcctagtcaaggtttgtaaggaatgtgtttttatggaaactccgttcgtaggactaccttgcatgacgccgttaatttttgtgtttgacgtttgaccattcgtcttatgtaaaaaatttatataattatcatttattttaatgtgacttgattcattaaatgttctttaagcatggcataaatatttttatatttacacaaaaattttgaataaaacaaatggtcaaacgttagtcgaaaagtcaacggtgtcatacattaaaatacggatggagtattgtcgacatttgatgtcgcgattccggtatttgcatagtatggggatcgttggtactaagatatacgcgagactgaggtaaaagagatggagacgatgatttttatacaggttcgggcccctgaattatcaggtaataaccctacatcctattggccgaagccggtcattgatcttattcatcataatcacaccagtacaatatttggggtagcctatctaactgttgtcaacgtggcggtctaaagatctgactcgtagtcgacaacagggtagccttcctcctcaaatctgcatccggcgagatcagagatagcgctagattcctctctttggttcccgtaggtaccatatcgggttttcctaggcttatgtctgatgtcgatatctagcagcttgtcttggcctatgtaggcttgtattggcttgtggctttgtggcgtctatgttgtccgtgtctgttggttgtgtctcctcttctcctagggggccttgtatttatacccataggtgtccccttgtccaagtagaactagggaaaccagtatggatacaatccgagtagtccttgtcgtttccatgtagaactctagtcattcttccttatgcggaactcctcctatatccgaaggttgtttccgtataagacatggtatgtggtgggtcctgccgagatttagtcgactactattaggtatgtggtatccataacactgacagtagcccctgacttcaatgcaaatgaacaaattcatattctcaaccgcagaccctggagtaactgttatcgagttcacgtgaccgttctcggtgagttcagagataacgttagacttcccttatcagcctcgtgcgggcacctatagggtttgtctgagtcaatctccggcgtcaaccaagaaaatacagagcatacgactaagtctcccgtcttgctataatcgagaatttggatggaagtcaagaaattttatctcggcgggtacaccatgtacaccatttcttcattccgtattccttgtcgagatccaccaaccgttctcgagtggtcgagaaggcacagagcttgcgacgaagccttgtcaacatctgttgtactcgccttagtcgatcttagtgtagaaccatagagacatggagttttcaacaatgtcgaatagaatttccttaaatcaatactcagaaaaggatattagatagaaatagcccccgagcaaacgctcaaagggtgacatgttataatgtgcatggaaaactgaaaatgaattaaatttacagaccaatgttttgtgtatgagcgtcttctcttttaccgacttcgatcagtcagtttgttgagtcatacactctccctaacccccagccttttcatcggagaatcgttctcggaggataagtctcttggacccttgacctgccttggttgaaaaagcgctgaccctagcccccagtcgtgaagttggaaaactcaatttccgattacacggcttggttaatacgcacggcgagaactcttacatgaccagatcttacatggccgtttgtctctataggatccgacaaggccttatccgctctgggcgtccctagccaaagttcccttaggtttctcagaggccttgtcaggacggcgtaaagggacatgaggataggtttcaactctaggtgtcgtcgtggtaagggatctctgggtaaaacacttggcgatattgtgtacctgatatcaactttgttggagtagaggtagtgggagaatcgttatacctctggtcgaggaccaggtagtagtcgtaactcgaccacttgaagtagaaatagtgggagaatcgctacaccgctggtcgaggaccaggtagtagtcataacttgaccacttgaagtagaaatagtgggagaatcgctacactgctggttgaggaccaggtagtagtcgtaactcgaccactagaagtaaatgtacgagagatcgctacgattgactggttgagaaccagtgagtaggtgtctctcgaccatttggagttgtgatacgaggaccgctacgttgccggttgaagaccagtcgtagatgttcctcaaccatctgaagtcatctgaattcgtggtgcgaggaccgctacgctattaccgtagttgtacctcgaccatctaaagttaaagcgcgagagattgctacaatttactggttcaaaaagcagcgagtagaattatctctcgaacgccaacggaggttgtagtgcgagagattgctacggtttactggttcgagaaccagcgagcgagtagaattatctctcgaacaccaatggtagttgcggtgtgagagattgctacggtttactggttcgagaaccagcgagcgagtagaattatctctcgaacaccaatggaagttgcggtgcgagagattgctactgtttactggttcgagaaccagtgagcgagtaaaattatctctcgaacaccaatgggagttgcggtgcgagagattgctacggtttactggttcgagaaccagcgagcgagtagaattatctctcgaacaccaatggaggcgctagagttggtttattacatgtgcatctcatgtgggcagcatgactcacatacccaactcgtagcatatccggatgtccgcctgcgatcatttcgggtgatcaagccgacatcgtttgcgagcaattatccgttaacaacccttttctcaaatagcctagccaaagccggcgctatgagataggtcgtcggtcttcgttggtaggttgggtgcgacagctctgcatttgccgagaacgttctcgataatgtatgtgcttgaccacaacctactcgagtgctcacttattcctgaaaaatattttctagaaggcaagatatatagcagagaatatcgagtatatactcaaaaaactgcatggatcttctagtattatcagaatataacgagcagatgtaaacatcatgcattatgtaaaccataaagaagcatgatttatacagaagaaaatagagcgagcccccagcattagactgtagtcagcctaacaccggaaacactcgcataatagatattgtataaaagacatgctctaggtaaacataataaattatagatctgacaatactgtatgatctgaataggtatgataaattacatataaaatattgcgtacctttgtagatacatgccggatgtatctatgaaattagtagattaatttaaaaaaccaatctaccaattaacttgtcgcgtactcgttcgacatcatatgatctgacgtcttttggtacgccgcttatcttgaggcctggtcgatctcgagagatcaagttgttgatgatgatggttccgatctcgtcgggagacatactccggtcgggttggatctccccacagcgaagtcgtcgagtagcttgttgtcggagaatctatctcttgaacccatctcgtcgaaatcctgaagcaccaaaatcaccctacctggcgcgccactatcgacgtttgatgtcgcgattctggtatttgcatagtatgaggattgttggtactaagatatacgtgagactgaggtaaaagagatagagacgaggatttttatacaggttcgggcccctgaattatcaggtaataaccctacatcctgttggccgaagccggtcgttgatcttattcatcataatcacaccagtacaatatttggggtagcctatctaactgttgtcgacgtggcggcctgaagatctgactcgtagtcgacaacagggtagccttcctcctcaaatccgcatccagcgagatcagagatagcgctagattcctctctttggttcccgtaggtaccatatcgggttttcctaggcttatctctgatgtcgatatctagcagcttgtcttggcctatgtaggcttgtattggcttgtggctttgtggcgtctatgttgtccgtgtctgttggttgtgtcccctcttcttctagggggccttgtatttatacctatagatgtccctttgtccaagtagaactagggaaaccagtatggatacaatccgagtagtccttgtcatttccatgtagaactctagtcattcttccttatgcggaactcctcctatatccgaaggttgtttccgtataagacatggtatgtggtgggtcctgccgagatttagtcgactactattaggtatgtggtattcataaccctgacaagtataatataagagattttgattttttttacttgcactatttgatcattcgtcttattcaaaaatttttggaattattatttattttatttgtgacttactccctccgtcccataatataagggattttaagtttttgcttgtaacgtttgatcactcgtcttattcaaatttttttaaaatt

SEQ ID NO: 47430 - DNA, 4348 bp, Oryza sativa
aactcaaaatcccttatattgtgggacggagggagtactttattatccaaagtactttaagcacaacttttcgttttttatatttgcataaatttttttaataagatgagtagtcaaacagtacaagtaaaaagtcaaaatcccttatattataggacggagagagtacaataaatacagttataaagacatactatatacattgtagagatattttttatgatattaattgctaacgtagttcttagctatatgggttgcccatctctatatcttctattataaaatttgaaaatgttttcaccaaaattttgatatatcatccgtgtttgaattggttttaatttgatgtttctgttaaattctttctttttttttttcttacgccagagtgtccctctaatccgagaagcgcgataattaattgggcccacaccttttcacatgtcccttgcgcgctgcctcaattgggcccacaacgccctcactcgcgcgattttccgcatgcctgattaggcccacgacgccctcgcacgcgcggtttgcccttgccacatgtccaatcgcgtctcccttgtccacgatttaaaaattaaaaattgaagacgacaaatcgagcttatgcttattcctaaaggcaaattttaaattttagaacttaattttaaattcaactttttggttttttttatcgtaccttattttatatcatttgcttttgagtcgcttagaacatgtttagtcgtcaacacatatatataaaagatttgcatataaatagtcttttatttggtaataagtgtctcggataagcacatgaataaacaaaacaatacgcgatgattatttatccactgacacatatgtacaatttaaattggctcctcccgttgcaaagcacatgcatcttttctagtaagaaaataaaatataatgacttttgagttaattgtgtacaaatgaatatataaaatataaaacggttggtgtgctagggatccgttgaagtagccgttgtctactgggtgctggctctccatgcggcctgttattagctcttgattttatcaggaactggatttatccaacaaaaaaatcatagaccttctaaatcaagactctccaaaccatgtataaatgcctagccacaatctcctccccaaccattccccaataaattttcccaatctcagtttacccaacttcaacccacattttttacacaatttctatccatttggttccccagtcaactatacaccatatggtcattctccttcaagctttcaagctactccatatcaatgaaattgggcacaatctaatctagccagcttacaaggttttcatttgcaagaaaatatggtgcactcaccaaatcaggccacattttgtttagaccactctctttgttgggggttatatggcccagttctttttctcaacttcaaacttcaactttctcatttttcgttaacatgttctaaaactgttaaatgatatgtttttggcaaaaatagtttatgtagaagttgtttacaaaatcaaataaatccaattttatttttagatagttaatagttaattaatcatgtgctaataagttttcttgtttcgcatgctctaaaagtatgagagaaagaacagagcgtaagttagtttatgagtctaaaatatctaaacctaaacaaatagtagtaagtagcttttccatttgacttttttaaatccataagccactcttgttgtattaagtaaaagttatgtttaacttttttaaatccataagttatccttaccgtattaagccaaaagttagttaggtttgagattttttttttgcttatttaaggtaaaggtatagctttacacttaaatttagagcttaaaattcaccgacttataaattatattagctaaaaagctatctttaaattctaaactaagctttgaaaaggccaaagcttcaatttttctcctgaggtggaggagacgagaaagaggaggcactcatgcagtgcagcgaggcaatccatacacactctaagataaaggagatagaaaaaaaatggtaaatcaaacaaaataatattattagtgttagtacatcatatattgtacatgttattttttttgataagtagcatatggataagattaatgatggcaatcatcataaaactaaaattcgctctaagagaaagctgacctggtctatatagatagctagaagtgcttatatatttcataatagagagagtatcattgtatttaaattgcactagttctaagaaattggcacatcagtatgtttgatataatagttttaagagtaaagtgcatggtcggtcccaaaacttgtgcagttgtgttatttagatttctaaactctcaaaatacaatttttttataacttgtcaaattgtgtcattttggtcctaaattgccacagctcatccaagctagatcctatgcgacgttgatgtggcatatcacataggcgttgacatagcatatcacctgtcaatttgttgtaccgtctgtgtaatttactctaaaaagaaaaaaggaggacttttttagtgggcttcaatgggtcggtccgtgtaaaattggtgaatatgccacatcagcgtctatgtggcatgccacgtcagcactatataggatctcagagggaccgtggtaattggagatcagaaaatacactttgacaagttttagaacctgaatatatattttgaaagtttagagacttatatgcataaccgtacaagttcaaggatcgaatgtgtactttactctagttttaaaattgagcatgcccatctgataattcggcaggatgtattaaagtatgacaacttaagtatgtcgatgcgacgacgtagatatgcaaaagtgctttcccggtcaaagaagaaggaggtgccatgcgtgactttttttttaaaaaaaaaaaacgcatcatcagggcacattgataaaggaatcacctcagccgcttggaactttcatgcaattttgttgcaaaattatgtgaatttgatattttcctcttttttaaaatataaaaataggaatgtggaccatttatttgcaagaggtatacatttactatttaacaaagacatacatggaatgaaagattttaaaaaaatactaaaagtttcaaaacacttacatttatgaaaaggaaaatgagaccaaaagaacacgcatttggaatgagtcgagaggatgcaaggattattttggatgggcacaagaatttaaaaagggaatgaaaataagagaaagaagatagaatgcaccatatgccaccatctatcttcaatttgcaccaacccaacaccactcttcctccctggttttctccagtcattttcctcggcaaaagtagtgccacactgcatgctttgttatgcaaatcaacaatcaggcaaaaagtatagcagtagcaatttgagttgagaaaagctagagatgagcctccatatatatataattcaactttcagcacgttgggacactagaggattttctgaatggcagggcaattctcttttggcacggcagtgcgtctcttttttaggcctctcatgccatgccagaggagaatcgcactgtgattctcaccctcatcagtcatcacacagtcactaacacaggcagagcgccagagcatgcatgtatcactttctgcaactaattgtgttcatgctctttgacgccattgttgcattggctgctagctgcttctttctttctttctttctttctttctttctttctttctttctttcatcttcgccttgagttggtactagcttggggagaactctgaaattccagctacctatatatatcctggcatggcaaggaaatcagagaggatgatcaagaaggccaggtttctggatatgccatgatatatgctaccaccaatcaggatcattcttggcctcttgggaagctcctctctctctctctctctctctctctctctctgagcttgcaattgcacaagcatggaaagcaggaaaggtcatgcaaaaaggggacggtgctttccaatattcttcgtttctttcctccaaaaacttttgttgaattgcaactgttagaagttagtagatcttaataagcttggattggaccgttgatcacctgatcggcttacctgaatgtgtgagagggtcttcatcaattaataaattctgctagttgagcctagcaattccatcatgtggtgattcgcatctcatctttgtcgatggaatatggaattggcgacagattgcggcgctgtgccttgtcgctggacattctcaaagatcttcttctt

SEQ ID NO: 47431 - DNA, 5998 bp, Oryza sativa
  unsure (1)..(5998): unsure at all n locations
attttaagcaatttgtcccagaaatttaagatacacacatcaactcactagcactcatgatcatcaatacaatatatatttatcttctcagtacaacatatattatttagagataattgcacaaccgtttattttaataaaaagaacacgatgacaaatcaaagttagtttgttgctaacgaacagcaacacatctatctatctatctatctatctatcttctattatatactaaaagtccattaaactttctacaaacgctctcaatccgccacgtgtcactcctacaaacactcctagaccgccacatggcactatataatctcaccgtcgattttcacttaaattggtggacccgatattttagaccattggattagatctattatttaagaaagtaatcccttcctctgctgtgggccaaaaaaaaggaaaaaaaacgtacgtacgtacgtgtggcttaaacttcctacatacgctttcaatctgccacgtgtcactcctacaaacactcctaaaccgccacataccactgtataatctcaccgtcgatttttagttaaattggtggacccaataaagtaatcccttcctctgctgtgggccagaaaaagaaaaaaaaacatacgtacgtacgtgtggcttcgtataaccgtgggccggaaaaagaaaaaacataagaacttagtacgctctccctgtctcttcctcttcctattcttttatatctccatctctttctcttcctaattcttttatgttatcaaattaaaaacgagttaagttgaccatttaaaataatttaaatgtacatagctaatttatattctattaaaacgttgctctatttataattaaattgacaattttacatccaatgttttgctatatataagcaatatgttattgtggtatagactgtgcattttgcaagtttgcatgccatctaaataaattaaatacttattaacaacatatattatatatctatctatctatctattattatatactaaaagtccattaaacttcctataaaccctcttaagttgccacgtgagactcctataaacactcataagccatcacgtggcactctaataaattagaaaaaaatatataacttgaactggtgggccaattggatttatctcataaaaaaaattcttcctcaactactacagtacgttctcatctccttcccctcaatcccttctcctcatctctttccttttttctgtatggtagttaagatttttgttttattacttaataattaatttcttcacttctatctaacgagaatggatgtggactcttgattgcatgtcccatgcctaaatatataaatgattaatgatttgatgcatgcttttataaataacaaatctatttttaactaacaatttagaaaaaagataatagttacatagcaaaataatcataattttaaaaagttactccctctatatcatattataagccattttaacttttttcttaattaaatttctttagatttgaccaaatatataaaaaaaattaacaacatctatcacacaaaattgttttgttagatataacgttccatatatatccataatatgttttttttgaaaattttactatattttctataaacttggtcaaacttaaaaattgacttaaaaaagtcaaaatgacttataatataaaacggatgtagtatatctgtttttatttagtttgtttgaacggttgtttcataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttagaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaacttttcattcctcttacgttcctatttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatagttatccgactggctataggggataacttatatctatggaatatgtaacagatcatgacttgggtattacgtttccctgtatattatggaacggcctanagtcctggtttgataagattgtaaagtagatttaggaaaccgataccggattggttaaggtttctatcttgtaaccctgccccccaacctatataaggagggcagggagcccctctagggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacgaccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggtcacaccaccgttcatgggcgtctacgacttcaccgccggcctgcctccgtcgccgccgactggtgcttctgcctacacggctggcctattatgccactgctgttgggcgtctacgacttcaccgccggcctgcctccgtcgccgccgactggtgtttctgcctacacagctggcccattatgccaccgctgttgggcgtctacgacttcaccgccggcctgcctccgtcgccgccgactggtgtcctcgcctatacggttggttggtcacaccaccgttcatgggcgtctacgacttcaccgccggcctgcctccatcgccgccgactgatgcctccgcctacacggctggcctattatgccaccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcatcgccggcctgcctccgtcgccgcggactggtgcctccgcctacacggctggcctattatgccgccgttgttggatgtctacgtcctcaccgttggctcaccttcgttgccatcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaagatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccaccgccgactggtgtttccgcctgcacggctggcctttatgccgccgttgttgggcgtctacgtcttcaccgactggcttgcctttgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactg

SEQ ID NO: 47432 - DNA, 12762 bp, Oryza sativa
ggtgtttccgcctgcacggctggcctttatgccgccgttgttgggcgtctacgtcttcaccgactggcttgcctttgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcgtcaccgaccggccacctcgaccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgttgttgggcatctacatcttcatcgccggtcgtctcgtctgctgctgactagtgcccttacctctacatcttcatcttccgtcgccgactgattatgctgccgccgattggtgcttttatcttcacaactacgcgtcttcactaccggtttgcttctgttgccgccgacttgtgttcacttcattacggcaatacaactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgccgttgatgggaaacttcgtcatcatagtcggctatctctgttgccgccaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattacttgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgttgtttgggtttttaagcaattgattagatacaatatcattgcttttcgccacgtaagtgtgcatttttattgaccaatattatggcttaggctgattatatattgtggtcatttttcaggcggttggtaaatcctttatgagtttatttacttggattttataccacatatgtcatatatttccgggtgtggtgaaaccatgtgtcttttagggacttaagcacatctgttaaagcagtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatacacctgactttatttttcagccctccacagtcttcgtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagatatataggcagcatcgcatcctgagatcgcaagtggcaattcctctttggtgcgaaagaacaatggcatcgcattctgcaaaactgttcacagcacaaatggcagcctacctttctctctctatctatgtgctgtctggactgcaaaatatttttacaaagaaaaaatcagacaagaagagaacaaacgctgggcatcgcatgcagcagcggcctctcgtcgcgtaacacagggtccacgtaggctgtccaggaaagacgcgagatctatctccaaaatcggaataaagctaactcggattcttggcatttcaccctctcttttcttttcccttttttttcttccatggcaatatggcatcgccgcatcggccgtcaaatatcaatacgacgaaaggggaaagggctctcgaattcagctggagaagcagcaaagcattgtgctgccggatatgccgtttccggcagcaaataaatgctgccaccgccgtcgccccttcgctcatcatcacaccaacacgatctcgagcaatcacaatatgtacaatatgtaatactacttgctactactatctgaggcattctgatgaggaaaatggttgagatcgagcctgtggatgtgcattgcagggcaactactccattggcagagggatggattggatatggatatggctgatgcttccatttgatcccatccctatctgccaaaggagatttgcccagcgattcactcctacttgctcatgttttttttttctatgtgggaaccgtgtaagagaaagaatatttaggctctacattatgatttaaaggcaggggctgacccagccttggtcaaggcctaggctagcccattgcactttgggttaagattgaacttacatgatggaattttgtactacgtagtgagatttcaatccaaatcctaggcattgacccgtggcctgggtctgcccctgtccaaaagtatgcatatgcacatgaaagcatcgaggtgatctcaattatatggaatatatatgcacgtacatgcatcactgcacatgcacatacctacgagtacatccttttaacatacaactggagagatgaaagcctgttgatacatccacaatctcagttaagtatccacacatgcataattatgaacatcagaatttagaccttgtgagtgaagtcatgcaccacatctaaggtttttctccattgtaatgattttctagtctggtttctagaatgaaatgccgttataactagcggcggcaatgcgagaaaatctaaaatttatcttgcgactagttaagctaatatgattgaaatgtactcgagctacaataattacaactagcggatattttcgtgtaattttttcgtagagcaagatttcaaaaagttgagttgtattttgagatacaactcttaggtccctcaaatatttggattgcaatcaaaatctataataatataatttgattttgattttgagattattctttgttggtcatatctctttttatgattgctcatacaaataaaattacgagtaaattttataaaactacagtactttgatcgaagtattataaaagtacagatttaaggcgtcgtattataaaactacatatttaacacaaaatttatcacaaaactatagatttaatactagagtatcacaaaactacatattttacagcttaaattcctaccactactgctatgttagagtgataaatgtgtagttttgtacttaacatgatgcaaaacatgaactgttgtgataattttattactaaatttatagtttggtgatcttccaccttaaatatgtagttctttgatgaattcggtcctaaatctgtagttttgtgatacacctttttaaatctatagttttataatagtttgtcaaagtatatgtagttttttgaaatttactcaaaaataccgaataaaatgttcttaccattagaacatttaaaatcccaaaaataatccaaaactcatcaagcgggcacatttgtacgtggtagaatttgggcttttggcccattttgtggttgcatcgaagcattgggccattcttttcgctgtcgttcaaaaggccacttaccacaattgggcccatccagaaacctcttggtcgcagccaccgcctagggttgcgctctctcttttatcccagcgccgccacgccaccttccctcctccctcctcgccgccgacgaactcccggccatctccgccatggtcgcctcctccctccctccttcccgactcatcgctgttcatctcctcaacctaacacccctcttccgcgtgcgtgtggtgagttgtggtgcaggcgtcggagaagaagcagtcgaacccgatgcgggagatcaaggtgcagaagctcgtcctcaacatctccgtcggcgagagcggcgaccgcctaacccgcgcctccaaggtcaccaacccccctccccccaaaattctcccaaccctcctctcgccaacctccatttcaacccccctctctctccggtttcttgcaggtgctggagcagctcagcgggcagaccccggtgttctccaagggtaggttaagctctccgccattgccgtctctctactctagtttactcttagcttcgttgtggtgatgacgagagtttgcggggggcgctttctttgcagcgaggtacaccgtgcggtcgttcggaatcaggcgtaacgagaagatcgcgtgctacgtgacggtgagaggggagaaggcgatgcagctgctggagagcgggctcaaggtcaaggagtacgagctgctcaggaggaacttcagtgacaccggatgcttcggcttcggtatccaggagcacattgatcttggcatcaagtaaaggccccgttactctttctcggatgaaacatttcgcttttcgtatctgcctgtttatgttagtcctgtgcctagaagattttaaagcattcattgtctccattcccttttgtgacctaggatagcgcttccaatatttgcttgaaattgcctcattcaatagatttgttttggattgatgtttacaagtgatagaattttattagttgtaagttgctaaacctgaagatggtttttttaagtgttctcgggtcattgacaattcatttggtacctaggaattgttagcatactgctaatgctatagatgtttatttgattgaggcataaacattgatgcttttgtttaagtggtgttgtgatttctaaagagcattgagctcgattttgaagcagaccatggactagatcttttataatctggtccatttgaaaacttactttataaatagaccttgacaaaacttataaaataattggacctgaatctcggctccaagatcattagcaccaatattcatggtctatttagattgtgcaattacctttgcttggcctagcaagctcaagctagcccatgaaagctatggcataaaaaagcaaaagtacaatgcttggatgtttagcccgacaaattgccatcggatgctaaccgatttggctttttgtcttgggtgagcttttctcggtagttagttggccttactaagcaatactttttttttcttttgctaatactaagcaactctccttgctaggctaggctatgcttttccttgcttgggattcaaacatcctcaatatcttgtcaccaaagatcctagcattgataccatggcacaagtggcacaaaatccacattactagatggtccgcgccaataactttggttctgggctcatatgtttctaacatattaacacacccatccacataatggtacatgaatggtgtagtggtaagatgtctaaacttgccacctagttgagttcgatccttggccagtgcaatttttttagtgatgtcattaaacaattggtatattaatcaacttattatagaatatagctcattatcaactgtcatatgagctcacatatgcattaccaggaatgcgtaacacaacatggcacaatattgatgcacaaaaattgtatctaaaatattttgttggcgatgagctcatatgagattaagaatttaatgggctatcatctataataagttgacgagtgcttaaagtggttaaatgaactcttacgttcctggaaatcatgtgatcaaatcttcatgatgggtgttttttcctgtctagtcttcttttgctggtccattcaaggtgtgcatgccacttaaaaaaaggaaaacaaaaaagattcccacccaatgttcgaactaagcttgctaggaggcaagagcaggcatctcatcaccacaccacacatgtataattgttctaatggtgtgttaatattttaagaagtatataagcccaatgcctgatggaataagccttttgttgttctgttttgtttttagcatcttaggacaacatcctttcagttttgcttttagcatcttaggacagcatcctagcgatcctaggacaacattctttcagttttgcttttagcatcttaggacatcatcctttcagtgcccgtcgatcctcgtcgtagtcgacgtcgccgtaccgaactgcctcccacatgtgccgcacctggagcctcaccctcatgaccgcagctcactcgatgtagttggtcttggtgaaggcaggccaaccaccgccggggctgacttccctgatgacggcctgaatcccgtggtgtccacggtaccggtccggggagggagagacgagccgcctgcaacggccgcgatctccgtcgaccaagccgttgccgccgggagcaccgccgtcatgcgcacccctgccaaggggtccgccaatgcgtccaagcccgtctgggctaccgctgccgcgcgcgctcctgccaggaacgccgccgacgcatccacgcccggctgggctgctgctacggcgcgtgtggggttgcgcggctgcccgttgctccacccgctcacgagctgcctccctcgtcagctcatcagcagggatgtcgtaggcggagacagagctgctggagctattgtcgcgcagagccttgagctctgccgccgccgcttgcgctgcatccgccgctgcttccacttccacccttgccgccaccaattccgccgcaggcagccttgacgccctcgctgccatcgcagcagtctctgctgccgcttgctggcgttcctcggccgcggcgagctcggcctcctgccggagccgcgcgctcgaggcgaccgagcgctaagactgtcctgcgggcatggcatgctattgggggcctgcagtgtgggggaagagtttgcctctgacgagctgctgctcgtcagtgcaggggaagagggatgagcaggaatagccgatgttccagctgccggttgaggacagaggggagctcgtgaaggggatgagcaagagatgtctagactacaggatagagtggctctagtaccaagtcatactatccgggggaggttggatacatatttatagccatagcttgctagctgcgggctagtctaaaggtgaaaggaaaacataaagcataaaagggatgctgtcctaagatgctaaagagcaaaaccgaaaggatgttgtcctaagatgctaaaagtaaaactgaaaggatgctgtcctaagatgctaaaagcaaaacagaacgacaaagaccaaaaaccaacaaggctactaagagcacaaggcttattccatcaatgccaaggttcctggagctgaccatctagtgacgtggatggttcctggagctgaccatctagtgacgtggattgcttacaacgtgtgacaaggtcttggcgccatcatctttgagataatccaagaaatgctattgacaagcgtccaaatccaaaaaatgccattagcaagtgtgagttccaagaaataccatcgtacaaacgattttgtcccaaaatgccatcgccgttagggttctgtctattttgcactgttaagtacactgttcatcctatagcacttaatgtcgcggagttaagtacattgttcatcttatagcacttaatgtcgcggaatggacggaaccctaacgacgataacggcgatggcatttttggacaaagtcgtcgtatatagtgtattgaaattcttcattgaatacccataaaaaatctttagcgaagaattcccttagaccgtagcgcaaaaactgaaattaaatccaactccagaatatctttgatacgaaaggtgttaaaaagaaaacactaaagagacaagcaatcatacaccttcacttgttttgaatttaaactcttaaaagccctgaaggctatctctcataaagaagtacacatccatgggcagaagggacactaaagagattttaagggactactccaaggggctctaaagggacactactttccctaacatccacccctctatttatagtcgaagatgacggaaatcccactacgaaaatgttcaaattgccctctgggtgaaaccctagctcagatgaaatctaggccatccgttgttccttctcaaaggaaataactcggatgtcctccatgttgttgcccgctccagatcccattttccacataaaatatgcatcgaaccactcctcccgcgcaccttgctagctaggcccacctaccagtgagatgagctgaaggctgaagcttctccggcacgagcaatctacggtggggcctgctatccgcgcgtatgctccttggccaatcaccacacgtacttggtcgtcgttgatccacgtctttgccgctcgccgaatacccgttcaccacgcgtctctgggaggcgcgctccacctatgcgaccttatgcgcttgtgcggcgagtatgagacaaccgcatgtcccgtacggctttcgcctccatgccctcgctgcgtcttgcatctagccaggcctcatctgcaactatcgtcttggaccatcacctggaccagcatggttcggcctccctgccaacaaggctgctagccggacgccttaccgcctccgtcttgggtcaacaagcaagagcctaattggcttgacctcctccaagccaagtcgatcagactcatgcacaagtgcatggcattgggccacgtgcacatatgcgcaacccaatcacttgcttgcatgagtacagtacacatacgctgtccaagtgcatgtatcgtctagcattgtacattactcttcgcgaatctcagacacttgcacacttgaccttgtgaatctcgttgcgaagtactactgacacggtgttcgttcatcgggcaccgccttgtactcaaccgtgtcaactggcatcctttactcttctggacctcaactcttccatgagtttagtcccgatctgccgttgacctagagagacctccaaggatcctgacgtcagtcccaccttgtcacatggcctcttgactgcgtcggacctccgttcctccctgagcatagtcccggtcctcgccattgaccaaggttgacttcgatcacctgcacacacacgtaaacaaaacgcccgttgttcgggcatagatatcacaaccttactcgtgttagtcagcacacatttcttgcacttccgacactcgccaattttccatcacaataaatcaaaaccacaatttgtttcacaatctcccccttgatggaaacattggcaacttcaagcaaaattttgaaaatttgattttgctccacaaagcaaataatattgcaagtcaaacttggttatttgaagagattgaaaaatcaagaccaagtgacagataaggatgcaaatgcaagcaagtgcgtgcggtgattggccgaggaggcgttcgcgcgaatcacgggttcaccctggagtgcgtgcgcatgagaagcttcggctcgtttggacatctgagatatttcctttgaggagaaggaacaacggatggcctagatttcatctgagctatgggttttgccccaagggcaattttgacattatcttagggggatttcatccatcttgggctataaatagagaggtggatgttagggtgagtaggctccctttggagccctttggagtagtcccttagagtcactttgccggcccatttgcccatgggtgtgtacctctttatgagagatgtccttttgggcttttgaagtttaaattcaaaaccacaagtgaaggtgtatggttgcttgtctttgagtgttttttttgtgacaacagtgcaattaacattgttaagaatccggttcaacattcaaggaccaagcacattgagatacggtaccactttctccgaaaatatgtttagaaatgtaccattgtgttaacgccaaaatttaccaaaatttggtaagattctttagtggatttggttaaggaaagaagtcaagcagccgatgtaattttatctagaagagatcgagtttaggaaggaatcgtgaagaccatggcataacagtttaattctatctaataattaggtagtttttagtaattttccttaagttttgtctagtgtctgatcaagacttctatctttctttttatctttaggaaacttgtaacgtgtccgattaggactcgtatcagcccgagggtataaatatgtacacttggggtcattgccatttatctctggatcaatattggcgcataacaccctcttttccgaggtttttgttacctgcagaacttggcacctaacgcggggctgcatgtctttgatcttcggtgaaggggtaacccctaagttctgccggccctggtagttgtattggttatattggtgttgttcaaggctccatcgctttgacctcttggattgctctggttcggttggtatattttacctacctgatatttgaattgtatttttaattgcattgtgtttagagacgcatcaatttagttaggactatcttggttaggtctgatcttgtcttagccgacatatctctacaatcaca

SEQ ID NO: 47433 - DNA, 17924 bp, Oryza sativa
attattaaacgcaatctcgtgctgcatcggttaggtccgacctcaattgttattaataatcaaagtcttgttaagccgataggttcgtgctaatgtttcatcggggggtttatttgatgtgttaaatttctctttgatgattttactgtcttagtcaaatttaatacatgatcactttgattggtgtcatattggcttgcttaaatctatcaggtaattatcaaccttatgctacatccagttgtgttcgccctgtagggttgtggttgtaagttagatttatttaagttagtaaacatgaatcaatgtttcattggggtttcagtcgataagttatttaaatgttgcatcggcttataaggattatatacaagttggttttagccaattgcagcaaggttttattgattgcctaatcttttggatttaaattctaatgacatcagattcccagccgatgtatgctttaaccatcagattaatatttattctatcatatcattgttggctaattggtttattggatatttatttcattatattatcatcagtcgattgtctttatatcattatttatctaagtgtcagaatctatatcggacatatagccgatgtgttcaaaatcctatcaacatcgtctggtatcgccatatcgccttattggtcgatcgactatgtgatcatcaatttatctatcctgtcagtcgcaatatcaaactgactggcacgcccgcattcgaatccaaatttttggacctgcactgaagctaagcagatctcccggcagctaagcagatctcccggcattgtgtttgtcgacatagttcgcatcaacacagatttggcaccattagctgggcgtggatttttcgtcaacacattgtgctagagtttgttaaatccgagaaacgacatgctgatatttttacaaaacctctctattgagcatgatgtgagttcttgcaaagtgagttaggggtgatccacccctgtggattgcgttgagagggagttcttttcttttgcatgcatttgtaacatttgcatcatgtttactttcttgcattgtattatacatcttttcattaaagagctttgttaacaatttactggacatctttttgatactcatctcttacttttatgcaagctagatcttttgtctaggttacacgtgcttaagtagcttgtatgttcatgctatgctcttcatgcgcattgatacttgcttaaattgaatctacacttgaacttaattaatgtgcacaacttgctctagaagtttgcttttgatgcaatatccttctcatagatatgccatgtttttatcatcttagcaatagctttcggcacatccttttgaatgctcacgcttgattgttcatgggtgcatcaattatgttctttctatgctttatgtgttttaccactgcttttgtcccaggctactgagtgtgtttacgcataagtagtgctgaagatagcactgagactacctgtaacaggagctctaactggaaaacttgtttgagatttgatgacactgtttggcgccctcatcactcgctgactgataagattaggcgtaccatcgcgattgtgctatagttttcttcaaaaatccgaaaaggaataaaatgcaaatgtgatagagctaaaagcccatgttctatgttttattaccatcttgatactctcttgaactgggcattagcatggtatcatgggttcatttttgtttttgataatgttaatcttgcatatttatgcgttggattgcttactcttaagcttcttctagaaatagcatgaaagcttgctagtgatataaccttgttgctcttgtcatgtttcatacttcttttgtatatgtctagctggtaacctccaaagttcactcaaattaaagtttgcaatgtctcattttttgcatttttgcatgtcatcattgccaaagggggagaaatattcagcaaaatgcactcattgagaatttaaaattttgctttagatcttggtgaaaaggggagttaggcacatagggggagcattcttgcatttgcatcatacattactcttcgcgaatcccgacacctgcacacttgaccttgtgaagcccgttgcgaagtcctcccaacattgtgtccgttcatcgtgcaccgcattgtattcaagcttgtcaaccggcatccctgatcgttctgacctcaactcctccctgagtttagtctcgatccgtcgttgaccccggttgacctctaaggatcctgacgtcaatcccaccttatcacatggcctcttgacctcaccggactgctcctccctgagcatagttctggtccttgccattgaccaagattgaattcgatcacatgcacacacgtaacaaaactaccgtttttcgggcacaaatatcacatcctgacctatgttagtcaacacacacattttcttcacttttgacactctccattttcccatcacaatgaatcaaaaccacactttgtttcacagttgggggtctatttataaaataagttttgtaaaagagccacattgtcaaaaatctagaaggtctggaaccacgaaacagtacaaacttcgtatttctatggtagaaacatcaccctattagtaaatgtactgtgagttagaactctagaacctctgggaagctcttctcaccatcagtgcaattttgtcatttgtctattttgtttactaattgagcagttcacttggcattcagcatcagagcatgtttactcatgatgattgttttttatacttgcagaaaaaaactatctaattgaattgtcaatttatcccttgtttcacctttggatacttgttagtactgtctttttacggacccaattacctctatccatcatggacgtattaacaactgtttagtgactggaaatgcttggttatttgaatcatagaaatgcctaccaaattagcaagtttcatactaacaaatgatctgagcaaccctttggaacttcttcacaatccaatttagaaatgatctacacgctcaccatctttgatcttgaccgtccacgaagtttgtccacatatgcaccataatagtttcgtatgtgtagtttgcattgctcttgagctgtgcatagctgatgatggagagaatgcaccaatacgatgtttggtattcgccaaaagcacattgaaataagtgtgtttttgtttttaatttataattttctgcacacatcacatggttttactatccttcgaaaaaatacggctaaaccgtctcttgtgtgctgcaggtacgacccctcaacaggtatctatggaatggacttctatgttgtgcttgagcgtgctggctaccgtgttgcccgtcgtcggaggtgcaagtctcgcgttgggatccagcaccgggtgaccaaggaggatgccatgaagtggttccaggtcaagtatgaaggagtcatcctcaacaaggcccaggcgaatacctcttaaaacattttcacctgtaggctcagctgttagaaaagcttttcccttgttgggcagaagttcaccttccaagttttatgttacttgatgaattttccggccagatgtttttgtcaattacctgaaagctaagagcatgatctgatcttacatcatcttgtccaatgtcacacttgtgcttttgcatggaaacatgtagctacctctgaatctgatcacctacttacaattgcaagttcaggaaggtagtcccttctagattagatattttcaagagattggcgttttttttttcaaatactaccattctttttccctactgctctagctggcctgtcgaaatcattcgtgacctgagttatcgttgaaagcttgatgccgtccgacagagacgtcgagctgcctctttttttctttttttttatgataatccaatggttttacatcgctctctgttaattttatgttttaatttcaagcggagtagcacagctcaaaagcttgtgttctgcgcggtggcgagacggagttgttttctggccggtcaccggctgcaagagattggcgttttctgatataccgcttttgtctcctgcttccagttggtcagtcgaaatgcttgatgcatccgacagagacatcgagctgtgtctcaagaatgaatcgggccccttttcctcttcttcccatgcggtttataaaataaatgctcgtggtccaagcgatgaaaaatgattttaaggtgatcctcactagttttaaaacatatgctctgatcatttaagaaaaatgaacaaagcaaaaaaagtaataattcacaaataaaacataaatatttgtgttattacggtttaaaagccaacgataaaaaaacagacttaaaaaaaaccctaaaattaaatctaattatgttcacaaaatttaaactttgagagaccaaggacctatttagtagggctctcaaactcataaatctaatttcaagttatggattggcccaaaccccacttcacctctttattcattttttgatcatcacaaccagctccactttctttccactgggactgaaaacgtttggttgggtctgccctgagactaaaaaaaaaaactctataatgttttttttaaaaaaagccttgaaatttagctgtgggcttaacaggaaaatttggctagttatctttcatcaattaccatcacctactagctgaataattaggagtatttttttttaaaaaaaataccacatcatgttctggttttgggggcattcttaactcaaaatcccaagttttataatttgcttcatgcaatcttacgttttagggcaaaatatttcttataacctttaggtccaagcctaaatcatccactttggctaatatttttcttttaaaactgtaaacaattgtatgagatattttgtcttcctccgtttcataatgtaagactttctagcattgcccatatacatatagatattaatgaatatgagcaatgctagaaagtcttacattgtgaaacggagggagtatataatataaatgtcagttgctttgcaactagcgttgatcatcgatggtttgataatttatgtgtatatttagcttattctcatgtcatgaattacgttaagttttttaataccacagtgcagaattgaggaaaagaagataaaatacacgagagggatgcatattttgagtcaactagtatgaatttatgtaaaaaataatcatatagtacctctattttttaatagatgacacggttaactttagaataatgtttgaccattcatcatcgggctaattcgatccatgccaccgcaactttgccaaattaaaaaaatactactactattcatcgtatcggctgggcgccactgcaattttgggaaattggatccataccactccgtcgcgttttccatccactcccgttgacgccgtctttccccgtccgaggactgagccagaggacaccaccactgactccggcttcggcgacgacaccgacgcaggcgcaagcggcggcggcggcggcggcggcttagggttctcgtggtggcgcaggcgcgagtgaaggccggaatcccgtgcggagcagcccccatgccatgacggcggttgaggacaccgcagggagcgatgcggctgctcctcgtcgcctcgccggtcgttcgctgcgaaaaggacctcgtcgtgcgcgtccttggccagggacgctgacgctgctggccggagacggtggcgcagccgcggcccactctgccgccttctccttggatgcctcggcttcctcaccacatgccccgacagcacgatggtcgccgagtcgacccgtgaggtggctttcgttgtcagcgtcgtcaacggcaaggccgacctgggtggcggcgaaggagctcggcggtggcgaaggagctcggtggcggtggcgagggagctcggcaccggagaccgcgccggagagaccccaccagggccggccgtgaccgcgccagcttgtcttccgctcgtgccggccgtcgcgcggtgtggaggggatgaggatgagacggtgtgagagatgagatggaaaaagtgacgggagtggcatggatccaattttctaaaattacagtggcacccagccgatatgatgaatagtagtggctttttttaatttggtaaagttgcagtggcatcgatccaattaacccatcatcttattagattaaaaaaataatgtaaatatgataaattataagtcatacttaaagttttttaattataaaatatgttgcaacaaaaaaaatgacatttatataatttttcagtaagacaattagtcaaacgttatgctaaaaatcaacggcgtaatttgttaagaaatgaagggagtataatagtaaaatatgaggttttttttgaaaagtataaggctttttgaaatattttatcttaaaatcggaggttccttaaaaataaatcacaataattgaggttctttctggttatggatgcctcattacgtgtagccaccaaacccaaagatcgagcaggtaggtgacccgttcgacgcagtgggagcggagctgagcaaagctccggccgcgacctcgagcaagacgacgatggagccaagccgcccgcgcctccctctcctcctcctcctcctcctccacttctcgctgctcgcctcgccgtgttccgcgcggtggcgagacggctgcggcgttggcgatctgcgcgagagcttcctccggtgcgtcgcgcggcggtcgccggcgaccgccgccgacccgtcgcggctcgtgcacgcgccgggcgacgcctcctacccgtcgctgctcgactccaccatccagaacctccgcttcgcctcgccgcggacgccccgcccggcgctggtgctcacgcccgtgaccgccgacgaggtgcgcgcctgcgtcgtctgctgccgcgcccacggcctcaccgtcgcgcgcgcagcggcgggcacgactacgagggcctctcgtaccgctcgctcggccggtccccgaggttcgccgtcgtcgacgtcgcggcgctccgggcggtgcgggtggacgcggcgaggggcgtggcgcgcgccgaggcgggggccacgctcggggagctctactacgcggtggcgaggggagcggcgggcggctcgggttccccgccggaatctgcccgacggtctgcgtcggcgggcacctcagcggcggcgggttcggcccgatgatgcgcaagtacggcctcgccgccgacaacgtggtggacgcggaggtggtggacgccgaggggaggctcctggacagggcggccatgggggagggcctcttctgggcgatcaggggcggcggcggcggcagcgtcggcatcgtcgtctcctggaccgtcaacctcgtccccgtcccggccgtcgtctccgccttcaccgtccaccgcctcctactccggcgaggtggccacgacgagcaatctctcctccgcctcctcaccaaatggcaagccgtggcgcacgctctccccgacaacctgttcgtcaaaatgtccatggaggccaagaccatcaacgacggcgacgactcaactcgtcatccattggtgacgttcaaatcattgtttcttggaaattgcagcgacatgatcacccaaatcgaccaccatttgcccgaactcggcatcaaaccaaccgattgcagggagatgaactggctgcaatccatgctgtactcctacggctacaccaatggccaaccagcagaggtgcttcttgacaggacactgcaacccaaggactactacaagatcaagctcgactacctaacctcaccaattccgacacccggcctgatcgaattgctcaccaagatcgtcgaagacgaagacggctccatcgacattgacccacaaggcggcgagatgagccggataccggaatccggcacgccgtacgctcaccggagcggatacctctacaacctgcaatactttgtcaagtggggaggtgacaagaatgtgtcctatgaggatgatcatctgagctgggtgagggggttgcatgagctgatgacaccctatgtgagcaagaaccccagggctgcatacatcaactacagggacctggatttggggcagaatgtggagggaaacacaagctatgaggaggccagggtgtggggggagaagtacttcaggggaaacttcaggaggctggcaatggtgaagggtgaggtggatcctgatcagctgttctggagtgagcagagcatccctcctctggttgtgagcacaagggatgctggattggtttcagatagctgatgatggttcagtctgcagcttgatgtatagtaagaatctgtgccttttcttcagcatatatttctccaataatgtgtgctagaaaatcaaatactcctagttcatcgaatagacaaatctttttttttatcccgagtacaatttggatgcacagatgcactcaagcgtgcacaccaagatcacgtgcgccaacaccaacgagggtgtgtcctatagcacatgtttttgaaaaatggagacttgtaacctcatgtaggctgcgttctttgccgggagttcccaactcccccacattcgttttccatgcgcacgcttttcaaactactaaacgatgtgtttttttttttgcaaaaagtttctatacgaaagttgcttgaaaaaaatcatattgatcgatttttgaaaaaaaattaactaatacttaattaatcacacgttaatgcgaacatcgttttgcgtgccgggtccaacccctcctccgaacccagccttaggctattcacggtacagtgaggtggtgttaggtacgtcacgatggagattcttctccacgtacgaagatgataggtccgtttgacacagctccagagctcagccaaataatttcagctccacttaaaatgggtacagagctgactagagcactatcataaaataaactagagatgtggagctgggtttgggcttgtcggaggacgaactcctcgagcgggggaccgtgaggcccctcctttgttggttcggccgagggcagcgagtgaaagctaaggagctgggaagattggaagctgtcaaggggatcgggcccctcaaaaaggatgagacaaagggaattataccggttcaggccgctaaaaagtgtaataccctactcctgtgtatgatgatttttctgagctttccaaatctctgaacctctggtgtacaaactagggctaagcgatccaactctttgttcttcgaccccccctcttcactggacatgaacctccttttatactccaaggggttctctcacatgcgcgggggtgtgccgcccagtgaagggagtaaatattccctatattaaatatgtgtcttgcaccacaacgtggaagtcctcttagtatcggctgttgtgcggggcccatcaaatcatgtcggctgacgcaggccgacacgggaaggatccccctcattcaccatttaatggaagtggattttgggtgtgcgaatgcaccaggaacaccatccctggtgtgtaactctggttgtctttccttatccggaactctatccatatccgaaggttatttccgtataagacatggtatgtggtgggtcctgccgagatttagtcaactactattaggtatgtggtatccataaccctgacagactttgtaaatcattgctgggaattatatttctagtaatgtcgttaagaaataccaacacattctttaaaccaaaaggcatagttgtataacaaaatgtgcctacaggagtaatgaaagcagttttttcctcatccttcctagccatgcagatttaatggtaacctgaataagcatctaggaaacacaaaaagtcgcaccccacggtggagtcaactatctgatctatgcgtggcaaagggaagggatccttagggcatgccttgttaaggtcggtgtagtcgatgcacatccagagcttgccgttcgccttggggatgaacaccaggtttgccaaccactccaaatggatgacctctcggatgaactcggcctctaggagatgcgccacctcctcgcggataaaagcttgtcgctccggggcctaccgccgcaccttctgtcggacgggtctcgcgtccggccgcacggctagatggtgctcgatcactgttaacagtgaaatttggtaagcccggagtagtcatcggcttcgaagtcctgagattagccgatgagagttgtcaagtcgtcagttgtcggattcttgctatattcggttaaggaaattgatctactaaaggaagcttatccagaagagaccgagttcaaagagaatgcggcatgacaagttatctattaattaggaatagtttgttagtttccttttatctataggaaagtgtgtttagtgtcctataaggactttatcttttacttttatctttaggaaagtttctttcttgtccgacaaggacttgtatcaacccatgggtataaatatgtacacccggggtctatgtaatctatctctacgatcaatacaattcggcgcatcgccatcttttaccttttctactttattttattgtccggcgggacatggcgcttgacgcggggctgcatcggtgttcgatcatcagctaaggggtaagtccaatgttccgtcggcccaggcaattgtctcatctacatcggcgtcgttcaaggctgcatcagcacattcgacctcttggattgctctggtttggatgatatatttgcctacctatttatcatatgtctctgttaatctagtcttagcatatcaatttacctctatcggcttctcgctttagggtttctgccggtatcggctaaatcgtgttgttagattagattagcttagacatctaccaccctaaaaactcagtcaatggcttgattgtctagatattatgtttcttttcatacttagtgctgcatcagttaagtttgatctactaagtcatgcttagaaccataatctctagcctgcttcttgattgtcaataagggtttcatcggggtttcagccgatgagttatctggacgttgcatcggttcataaggattgcacatacatataagttggatttagccgatgacaacaaaggtttcactgtttaatctaatcttgtggatttcatgacatcggacctccagccgatgtgtgctttaaccttcggatccatgcttatttatcatatcattgctagccgattggtttatactggattatattgttattttattacatcatcatcagccgattgcatttatattattatttacattggacatataaccgattgcttaaaccctatcgctatcggctggtatcggcatcggctattatcgctatcggctggaactactccatcggcttgtcagccgatcggctgttttgatctactatttgtatatcttgtcagttgcaggatcaaactgactggcacgctcgcatctcaccaatctttggacctgcactggagttaagcagatctcccaggccggtgtgttcgattttttcgtcaacaatcacctccctgtggaccccaggcatgtccaacggctttcaggcaaagacgtcggcgtttgcccgcaggaaggagacgagcgcgtcttcctatttgtcgtccaagttaccaccaatcttcggtcttggacggatcattgccaaggataatcttcttgacggacacctcgtcaccagaagtcatccgcttcttcaagagacgagaggtggaagtctcaggccccccgccgccgttctccggctgcgaggttgattgcacgttgcttcgtgcaagtcagggcgatcttgacatcgccactaatggtgatggggccgccggggctcagcatcttcatctggaggtaggcgtaatgggtgaccgccatgaacttcaccaatgcgggcctgccaaggaccgcgttgtagggcagattgagatccgccacatcaaagtcgagccgttcggtgcggaagttggtaggatcaccaaaggtgaccaggagcacaatatgaccggacggccacgtgtgtcccggggtcactcctatgatgggtagcgacgtcttaagcttcatccctggggccttgatggcgtcgaaggccgcgggggagatgatgtttagtgcgaccccgccgttgattaggacgcgcttcatcttaacgttgcagatggtttgcgataccaccagcgccaactgccctccccgggaaaccactggcgggtggtcggtttggtcgaaggtgagcttcacctccgaccagcgtgctcgccgtgtcgcctcatgggtagggacagcggccagaagctcgcgcttcatggccttaaagctacggtcggatgcgtgggcgcatgctccacagtcgacggtggcgatagtggtgtcaagctcctagaactccaggtcctcatcaccattgtcgacgggggccttcttcttggcctcctctcgccgcttgtcggccgaggtctccggggctttaccctcccggtgaccctgccgcttctcctgatgcgacttcttgacgcgcttggccaaggacttgatcgtgcgacagtcagcaaggctgtgggtggaggtattgtggatgatgcaccacttatctagtgagcggctctcacaaggggcggcggtgtccttctgtttgatgctcgcggccttttctttgtgcgggggccgcaaggtgccttcggcggtgaggacgtggtccttgtcgccggatcggaccgatctcttcttcttcctcttctctcgccgcttggagcaggaggaggactcaggggcagccgcagccgccgcgccagagctggaggagttccaagcccacgcctcctctttgcgggccacgtgatccgcgagctgaaaaagctccgcgtatgttttgtgctccttggaggcgaccttcttcagcacgcggttatgccacacgcccccctaaatgcgtagatgaccgcgtgaggagggatgcatgggatcgatggtgttgcggacctgacagaactgctagatgtatgagtggagggactcatcgtccttccgttgtaccgcacgctgttaacgacgaaatttggtaagcccaaagtcatcatcggcttagagtcagtatcggcttcagagttatggaatcagccgatgggagtcgtcaaatcaccagcaaccgtgttctcgatggagttggatcaactaaagggaatttatccagaagagtccgagttcaagaaggatgcggcatggcagtttatctattaattatgaatagtttgttagtttccttttatctttagaaagtgtgtttagtgtccgataaggattttatcttttccttttatctttagtttctttcctgtccgacaaggactagtatctccctatgggtataaatatgtacaccctgggtcattgtaatctatcaatctatcgatcaatacaactactctcggcgcatcgccaccctctttaccgaggtttttacttatcattcgatggaacttggcacctgacgcggggctgcatcggctttcgatcttcagcgaaggggtaagtcctacgttccgtcggcccaggcaattgtctcatctacatcagcgttgttcaaggctgcatcagtacattcgacctcttggattgctccggtttggatgatatatttgtctacctatttatcatatgtctctgttaatctagtcttagcatatcagtttacctctatcggccgcttctcgctttagggtttctgccggtatcggctaaatcgtgttgctagattagattagcttagacatttaccaccctaaaaatcagtcaacggcttgattgtctagatattatgtttcttttcatacttagtactgcatcagttgagtttgatctactaagtcatgtttagaaccataatctctagcctgcttcttgattgccaataagggtttcatcggggtttcagccgatgagttatctggacgttgcatgggcttacaaggactgcatatacatataagttggacttagccgatcacaacaaaggttttactgtttatctaatattgtggattttataacattggacctccagccgatgtatgctttaaccttcggatcagtgtttattctatcatctcattgctagccgattggtttatactgtattatattattgttatactatattatcatcagtcgattgcctttatatcattatttaagtcaagtgtcagactctacattggacataaagccgatagcttagaaccctatcgttatcggctggcatcggctatcggctggtatcggcatcggctggaactactccatcggcttgtcagccgatcagccgtttgatctactgtttatatatcttgtcagttgcagggtcaaactgactggcacacccgcatctcatcaagatttttggacctgcactggagttaagcagatctcccaggcctcgtgtttttcgcatcaacacgcttttggcacgcccggtgggaccatgattttatatccacatgtttgaagaagaagtcaatgccaagatcatggtcatagtggaggatttaacggaggaacaaaggcaacagatggagcagtttgtagctgattttcaaacgcgttgtcttcaatgtttcatcatgacaccagaagagccaactcagaagactcgattccccaagccgatagttgaaatacttcaagatatagttgatgaagcagttcatcgcacattgtttgatcagtttggagttttgatgagtagactacaagatgtggtcaagaagatagttcctgaaataattgttcaaaagaatcagctcgaggggcaagcatatcaatatcggccagaagaacttcgtcaatatgggcatgatgaagaatatcaatatgacaatgatttgcccgatagaattgcaaagataatagaggagaagtttggaatcaaacctaaggaacatacttctgtgtatcggctgccatatcctgagtggtttaatagggtgccattgccacaccgatacaaagttccagatttctcccagtttttagggcaagatgatacatctacaatggaacacatcagtcaattcttagcacaatgtggggaggcatcggctgaagaagctctgaaagttagatttttttccattgtctttgactggatcagctttcacatggttttcatcgctaccatcagattttatccaaggatgggccgatcttgagaagcaatttcatgactatttctttgttggaatcaaagagttgaagctttcagatttaatatcggttgagcagcaagaaggagaatcggctatggaatatattcagagattttgtaatgtccgcggtcgatgttatagtttgaatctaagtgatgagcagctcgcagatcttgcattccaaggattgtcagcacctatcagagagagattcttctgccacgagtttgacagtctagctcatttaatgcagacagtatcggcttatgaaagccgattgcaagaagcaagggaagatcaattttggagttaacaagatcagacagaagagaattttggagcatgggtcctcacactccaaaactggggggcatgtgttaacgacaaaatttggtaagcccaaagtcatcatcggcttagagtcagtatcggcttcagagttatggaatcagccgatgggagtcgtcaaatcaccaccaaccgtgttctcgatggagtcggatcaactaaagggaatttatccagaagagtccgagttcaagaaggatgcggcatgacagtttatctactaattaggaatagtttgttagtttccttttatctttagaaaagggtgtttagtgtctgataaggactttatcttttccttttatctttagtttctttcctgtccgacaaggactagtatctccctatgggtataaatatatacaccctgggtcattgtaatctatcaatctatcgatcaatacaactactctcggcgcattgccaccctctttactctcggcgcacgggcggctcaatgcacatccagccagcgctcgatgtcaagccgagcgtccggttctccgtagatacactcatggcgcccacagctccctgcgggcatcgacgaggggtgtgaggacgagtggcgggaagctgccgccacccggtgtgctctccatcttgacgacaaagagagggcaatcgtactacgtgatataccagccgccgttgtccggccgccagcggcaagctgccgctgtgcggtggtgaccaggttggccacatcgtccagccagcaccggaccgaggtctctggctctggatcgacaaggggtggcgcagaagtgcgccctgaggcgtgccaccgtcgtcgtgaggcggcagcgcactctttctcagcgtcctcccttgcctgccagcagtgagatggccgagtccccagacttatcccggccctcccctcgcctaggattgcggcgagggggagtcgaagtaggtcgtgcttggtgacgagggtcaagatcctcctcatcagccacacaccaccagcttgccgtccatgactcccgccatggatgtaccggacaaaacttggggcgcacgaagatgagtgctcctcaggtgaacacgaacgcgccccctacctagcgcgccagctgttggaggatgaactcctcgagtaggggaccgtgaggcccctcctttgttgtttcggctgggggcagcgagtgaaagctaagcagctaggaagattggaagctatcaagggggtcgggtccctcaaagaggatgagacaaagataattatacaggttcgggccactaacaagcgtaataccctactcatgtgtatgatggtttttctgagctttccaagtctctgaatctctggtgtacaaactagggctaaacgatccaactctttgttcttcgatccccctcttcattggatatgaacctccttttatactcccaggggaactcacatgcaccgggtgtgccgcccagtgaagggagtaaatattccctatattaaatgtgtgtcttgcgccacaacgtggaagtcctctgagtatcggctgtcgtgcggggcccatcaaatcatgccggtcgatgcaggctgacacggggaggattttgggtgcgaatgtgccaggaacgccgtcccgggtgtgtccaggtcggtcaagccggctctgaatggttgcaagtcactgtgcccctcatcattttgacgggataaggcatacctaccgcaccgcacgctgtctgacacacggccagggcgcgcgtggcttgccgccatctcgtctgtcactcaaccggtcatgcaccggtcacgattcggtcaagcgtgcagcacgccacattaaatgaggcgtggcacgtccgctccgtctgcactacccttgcatgatggccgcgtggtgaccgtcccaaggggtaggggcggagaggggcggctaccgctcatccatgggcccaacccctcgggggaagtgccacgtggacgtcgagggcgacctctcccctttaagcacgatatccccgggcccatatcatcgacagtagcccccggccgaaccaacaaaggaggtgcctcacggtcccccgctcgaggagttcatcctccgacagggctactccacaactctactccaaacccaactctggagctacatttaggagttggagctctaccaaacaggcccaatgtgtctcttgtgagcccctcgtcctcctgttaggatccaattaggaagggagcccgcacattcgcgtgggcattcatgaatcattgcttaaatatttgatatatcttactattaaattgttagtttataatatgtaatatttacttcatctatataatcacctatctataaagttaa

SEQ ID NO: 47434 - DNA, 7280 bp, Oryza sativa
acgaagaagcttaactttataggtaggtgattatatagatgaattaaatattacatattataaactaacaatttaatagtaagatatatcaaatatttaagcaatgattgtagagagcatgacccatctattcttctcctgcacatttgcacaacaatgctggcagcaaataggcattcagtgaaatctagcgctggagctcatgaacatgattacaacagctaagtatcttttcatctcaacttcttctttgaagctcaggcgattggttgttggcacatctggtgtagaaggaatgattttattttcaacaatgtgactatcagtttagtcaagtggaaatcagagttcaagaaggattttgctctgcatatgcacagagtaaaaaagcagacaaacccatcctgcaatcatggattgattctctctctcttaattgttttgtatttttgtaaatattgtaaaccttttatttattattaatatagcgcagtaggagcctctcctgctcctgctgtttcacgtaaaaaaaatcatttaagaagacgtaaatctttaggtttaaattttaagtctaaattaaaaagtaaggtattgtttttctttttaattgaatgttttgggctcttatttttaacaaatctaaataaaggttactgctaatagatgtgttttattccttgttttaattggttcacatctaacgcaatttgttatacgtacttacctatcaatcaataaaaatagagtagatatattctagacctcgctgcctataatatgtgtgatctatatttttcttaaatacatttagtcaacccgaatgttaaaactcaaatttaatagtaagaaatataatattaaaaccaactatctactgctatagcatagaattccctagcatagaatagagggaagtctattcatacgtagtcacttaaaaacgcagtggttctttccgtaaaagatctaaccagtaaaacaaattatatataacaagggctgaaatgaaaaaattatgttggcccaatgaagagacggcgcaccgtaggcaactagagatacgtggttatacttaagcctggtttagttgaggaaaatttttagatttgattgttatattagatatattagacatatatttgaagtattaaacgtagtatagtaacaaaataaattatagattccgccaggaaactgcgagacgaatttattaagcctaattaatccgtcattagcaccacattgttaaatcgtggcgcaattaggcttaaaagattcgtctcgcaatttcctagcgaactgtgtaattggtttttttctacatataatattctatgcatgtgtccaaatattcgattgtgacagtgtaaaaaattatgtttgggaactacttagatgtttacttgacaaaaacataaaattaaaaccgaaacataaaactaaaaccgattcaaacacaggctatgtttagttacaaaatttttcttccaacttccaaattttccattacatcaaaggtttcctacacagacaaacttccaacttttcctatcacatcgttccaattttaaccaaacttttaattttggcgtgaagtaaacgcagccacatatgactagcggaaacatcttcaatttttataattgtagagatttagtctaacttaaaaaactttaattagaaaaaaatttaaaaagactttttatgtgaataaaactaagggagtacttgctctgtggcggtggcaccgtacgaggtacccaactttttcttccacggaacataagaaaacagcgtacatatcatgcgtatggtacacacgcacacatctttttgaggtgaatttttttttgaggtggacaaatgcacacatctgccgagcctgcaattagcgtacggtacacaagccattaaggcaaggtttccgggcaagctagtaccgcgatgaaaaacacaagcgattaggccaatgtttccgggcaagcagaggccgtggcttgcagtactagtgccagtgggtgcaaggtgatcaatcgatcctaggctcaatactctgaacggtagtctagctgccacggctgcagctagagtcgtcatccgaaaatctgaaaagaacggaccctgaatcaattccaccggcaatcgaccggcaaatgatcactatcgttgagtttaattacaaacgtcggggaatagcagtgaacgtaaccttcctatacggtttacaagagtatttatagaagataaaagaaaaaataactaacaggaaaaggcatcaagtcctactcgaaaattaatctgaatatagtgtagacctaaattcggatcacatatttaacaatcgctaccttgagacgaattttctcttatagcataaaaattatcaatcaccaaaatacctcatgtaggcaaaatcaccatgcgccaaatagtatgtagaattaaagtattagaaaagttttggatggattaatttgaacaaaatcatagcgaaatgattaatcacaagttaatgccaaaaaccgaacaatctctatctccactattataaaaattaaagatgtttttgctggtactttgtttggttgtttgtttgtttgccggtattataaaaatctctatcccatgtatttttgtttgtttgtttttacactaaaatgcgacataagcgacatgttaatgacacgtgggatgaagaccgggtcaacactcccacgtaggcgccacgtcagccaaaaccgcttccaataccactaagaaatatattttgcattggttttgatagttggaggagtcgatatacccggttttttgtttggaggttttaagtcatacttggaccatagttgagggagtcgaagtatactttttccacaagtctgttccctcgctcatctctttgggccatcttatatttctagaataagtctattctgcatccctattctcttttatcatgccctgaattaagtctgttttgaatccctcgaccatatttttctttcgtgctcattggttcgtgtcatgccgggccagtccaccatgccaaggcatcaacccagacacggcccaactatcgggctaggccggcatgggctcgacaccagtcatggcatgccatgcttagaccgggccaaatagccatgctatgggccgggccgtctagcctagcttcgggccttatggccatctatatgacgtgctagtctgccgcatcaagagtgaggcaacgtcaatgtgggtgcctacacacaagcgaggagttagggtctgtcctttagccttcccgtttaaaattttacaccgtgatggtactcatgaggaaattaaatttgaaaatataccgttcatatcttttttttcttaaaaatatcctagatgcaaatctttggacacaaatataccgttggtcttgctgaaccgttgtgcaaaattgacgtgggatgaagatgcagacagtcttgtagaggggcagcgtgagaccgcgcggtgtcgagcgacgagcgtgtcaaaccgcgagcattctcgtgcaacaagtctacgaaagtgtttcgaaaattaaaggcaaaatttgctcttggacactcgaaaaatatggtctttgctgaggaacaccataagaacgtgtatttgcttgaggacacttaaaaaacatggtaatttgttgatagatacttatacgtattattttataatttttcgctattacagagagagaattttcacaaaatgacacttttgcccctgagaccaatcttcgtcgacggggatcaaatccggtcgactcagcaccaaaaccggcctcgctgcccgtcgctttgtccacccccgccatcttccacagcagttcgtcacggtgtgttctccccgcgggcgacaactccatccattcattcacaacaaagagcagcagcaagtggaaagtcgtccgtctgcccatcgcgacggcgtccttgccaccgccgctcggcgcctcgtccttcaatcattcgtccgcgacccatcctcgatgtccaatgccacgagccgtcgccagcctgtgaagtaacagcaacaggagtagcatttttgtctctgtttatgaagcaacagcagctgcgaagccaacatcctcgccggcggcaaccccatccgtttgttcaaaggctcgcaacagcagcagcagcaagctaacttcaagctcgcagcaaacaaagagcagcggtaagccatcaaacctcgtcggttctcagccgttgtcctctgccgcgagatccaaccatccgtctcggtcgcggctcgtcgtggatctgcagtcctcgtcgacggtcgtgacgctgcccctcgtcaccgcccgtcgcggttgcccctcatcgttgctcacggctgcttcgcacaacctgtgtaggaggaagaaacggaaaaggaagaagaagacgagggtagaatagacattttatgtgatttctctctcctcaactaattgaatattgtattttaatgctcgtggtgtcccgtggtaaattactatgttttttcagtgtcataggacaaattcacgttttcgagatgacccctaaccaagaccgctttctttgagtgtcatgtagcaaattttgccaaaattaaaagattagcgatcaattaatgatgattagcgattaattatcttattatttaatcactaattaattgttgattagcggcaagtgtgacggtctcgctcattgagcgtgcgagaccaatgctaattttatgcaaataaaattacatcaagtatatttctgagaaataaaaaaaaagtgaatggtatattttaaatttaattcctcgcgaggtgctcccacactgtggaactagcagtaaaacggtaaaagaaaaagaaagaaaaaaaagagttgcgtccgcgccgactggtattcgcagccatccgtccatccgtgtcagcgtcactcatcacgcacgcacccatcaaaaagcttcggaggacgacgcaaggaatcatcaaagcgagacaccttttcttttggcctccttcctcgcgaaaaccaccaaaccaaaacccacacacccacagcttttctccccctcactgctttgctctccagtctccacctcctcctcctcgctgccgcgccgcccatccgccagccatggcgatgtcgtcgtcccgctcggcggccgcgatccgggggcggcgggtcggggcgctggcgagggcgaggaggcacgcgacgagggcgatggcgtcgctgttcggccacgtcgagccggcttccaaggaccccatcctcggcgtcaccgaggccttcctcgccgacccctcccccgacaaagtcaacgtcggcgtcgtacgtctctctctctctctctctctctctctctctctctctctctctctctctctctctctctctcattgggatccccgatctcgcttgattctgacggagatgttgggcggggatgctgaaactgcagggcgcctaccgggacgacaacggcaagcccgtcgtgctcgagtgcgtgcgcgaggccgagcgccggatcgccggcaacctcaacatgtcagaacgagatccctccctgtctcttccagttagcttcaatgcttgattacttgtgcatgtgcggatctgagctatacctgctgtgttttgtagatatgagcttcaataatctttggttcttgattcatttttagttccattctgaaataaaagcatgctgataccgctggttcgttctgaagcgtgatctatcactagtattttgttttcaaacatgatctggatcatgtgtaaagcttccttttccttcttcaatcacgcaatgtatgtacgcttgatgcgaaaaaaaaaattattgttgtcccatcctgccgcggtttagacctcctgtaggcattctgtggtaaaatggtttccagatgcttctttatgctcttttgtggtgtggaagtaaacatcattgcagtacagattagacactccaatccttttttttttttgtcctgaaaaaaatgatcaactaaagcataatactgtcttgcagttgatgctacacctgttttagtgctggaccgttggaggttgccttaagttctaatttccactaattttgtaaaacagggagtaccttccaatgggaggaagtataaagatgattgaagagtcactaaagctggcatatggtgaggattctgatttcatcaaagataagaggattgctgcggtgcaggctctttcaggcacaggtgcatgccggctctttgccgatttccagaggcgtttcttgccaaattcacagatctacatacctacacctacatggtccaagtgagttggaatcctgctgagacatgaattgttgttgttttctttacatctaagaaaaatctcttaaagaaagaaataggaagagaaaacatagatgtagatggtgtgtattactgtctctacatgatatggtaggcacctgtgattcttgctctccaatattgttaacatcatcagtatctaacattctaacctcagtgtgtgtaacttctccagtcatcataacatttggagggatgctcaagtacctcaaaggacattcacctattaccatccagagtcaagagggcttgatttcgcaggactgatggatgatattaaggtgattcgtttctccagtattgttagaaagatatcttacttttaggaattattacattgttgctggtatctgtagcaagatcatggatattgtttgaaattagatatttgtagagtcaatactgatttagctttctttctcattgataaatgataagttttaggtacacttagtttttctcactttcttataggtgcttctgacctgttgatgggtttcctatagctccttttaatttatttttgttcctctcatctgcagaacgctccaaatggttcattctttttgcttcatgcttgtgcccataatcctactggagttgatcctacagaagaacaatggagagagatatcctaccaattcaaggtagcagaagtgaaaaggactggctttttgttggtgttatcaccaacgacagatatcacattttccttatgtgttttgacagataaagaatcatttcccattctttgacatggcataccaaggatttgccagcggtgatccagagagagatgctaaggcaatccgaatcttccttgaagatgggcatcaaattggatgtgctcagtcatacgcaaagaacatgggactgtatgggcaaagggcagggtgcttgaggtattcactcgcctagt

SEQ ID NO: 47435 - DNA, 941 bp, Oryza sativa
aattcctgcagccccgatttgttatcttttctttaaacaatgatcatactctaatgatcataaaactgattttgtattgctgtttcagtattctgtgtgaggatgagatgcaagcagtttctgttaagagccaattgcaacagattgcaaggccaatgtacagcaacccacctgttcatggtgcactggttgtctccataatccttaatgatccagaattaaagagtttatggttgaaagaggtcaaggtaagaagtcttaactacgtaagttcctaatagattaatctatgtgaagcatggaaaggagtttaatatcgccactgggttgtctcagggtatggctgatcgaatcattggaatgcggaaggcactccgggaaaatctcgaaggcctaggttcaccattgtcatgggatcacatcaccaatcaggtaaagaaatcatgaaaatgtaccatttctgaatatgaattcagtgacatgcaaattataccagttcaaagtagttgccagcatctccaaggcccacaatagatatagtcaggttgtaccataaacttgttggagtttggttcattgaggtattagttcatgtggactgatgtactctagtgctggtcctgttgcttgaacttccagcataattgcaaactagtcaaagtggattttgtatcataaatattgtgttctaactcgaggccttgtcaaagtggttgtcttgagtcccaactaatcaattagaaatggataattgtacaatagctattaagtcttgtctgggtatagttgattcggtaagtaacagtgtcagtcaaaaactagtaagaaccactagcttcactcgttctccttgtaagcttacaagtacagacatatccattttgtacgattgatatatgttgggcaagaattatgtgcaacttaaatgtccatttacccat

SEQ ID NO: 47436 - DNA, 6489 bp, Oryza sativa
ggtctgagtgcattgcagaattacgtcaacagaacactccaactcggcgaaatcaaatgaatatttcagatccctgtcaaccagtttatccagtttattttcttccttgacttctctaacctgcagagaattaagattaggtggtaagaaagtatacaaggatatgggcatcaaatgacagtagttaggtaattagataaagattgaactaaaaggagatacccaatctagaatcattcccttctgagattgcgcgtgcccattgctcaaggttttaggcccagtgatcagttccaacaagagaataccaaacccataaacatcggtcttttctgaagactgtcctgttgataaatactctggagcaatatgtccaatagtgcccctaactgcagtagtaacatgtgattcttgtcggtcaagaagttttgccaatccaaaatccccaacaattgcttcaaaactttcatcaagcaaaatgttagctgctttaacatccctgtgaatgattttaggattgcattgttcgtgaagatacagcagtcccctggctgccccaacagcaatccgcatacgcttgctccaatcaagagatggttttccatgatggtaatctacaaattaactttgtgttagtaagagagtgaaatggaaaagaaatgataggagaatgatgcaaaatcaaccaacacaggatcacaacacacatctttgtaaggaagctatcatagttttacataatcatcattttagcttttggatcaacaacagtctaccttcaataagaactacaactggaaactggcccagctatattaaaacataaaatcaaaatttgttttggacgattgtaattacctctcaagcgatcagcaacactgccatttggcatatatggatatacaagcaacctttcttttgaggtcatgcagaatccatataaccgcaaaaggttcctgtgcacagctagaccaatcaactccacttctgtctgaaattgaacttcaccagtaatatcaggatcttttagtctctttacagccaccaaagctccatttctcagacagcctttataaacaacaccaaagccaccttgacctaatatgttctttgagttgaaattgtcagttgcactctgaagctcgtgaaatgagaagtgctttagatggcccaattcaatttcaagatcttggtctagaagtaacaaaagaaaagaatgtttatcagatgctatatattctgaactctgcaataagagagtagatgcttaaccctttgaaaattaccagcagaagcaaaaggcaagcgccatctgcaatattttagccaacaaatgacaaacagaacaaatactgtggcacagatgatgcttaatgaaattgccagagctagttgatgatggctgtttgtttttttcgacgggctagaaattgttgattctgcaaaggaaggcaaattaggtccaacagataaatatgcaagtatatgacatcaggtaaacaattaccattagttaatactgtgagatctttgcaaccatgcataattgatgaattgcaaaggaacctgtttcctgcaatactggaaatcagaggaaagtgatcatcaggagggtattaaactgatgagaaggaattatgtgcatatgctttgggaaggaattatgtgcctacgcttagtttagcataagaacacagaaaatatgcaggtgccaaacactttggttaagcaaatggaaggaaataagcagagcttatcgtacgcactctcaccaacttacctgtagtcatgtgcatagatttttggaaccgggccgctcaaattattggatgataaatcactgaaacaattttcccatgttgggtaaaaatcaataattacgtttatacacaacatttataacagaagagagaatataaagtggtgaaaagagacatacaggaatgtgagacctggaagctttgcgacatcttcagggatctgtccagacaagttgttcttatctaggcgcctgaaggattcacaaacagaagtcatattttgggacaagcaaaatatgtggcacaaaatttgaagcaatattttggcatctgctcacagatagtttaattcagtcagccgccctagagaacttgggatttcaccaacaaactggttaccagaaagatcaagagctttcagattggtcaacttcccaatctctggaggaatgccacctgatatcatgttattctgtagtaacctgaatgaagacaataaaaatgttgagtaatcaagtaatggtattttgtttcattttatgaggacagacagatgtcaagcaaacaagttcatgggaatcagtatgaatacacgatcaacttaagtatatgacactgcaagatgtaatatgctcatgtccttacaaataggatgaagacaatcaaatgttggacaaaccatactcataaacatttcaatgttatattcaaatatgaatcaaatgaatattctatagtggtcacatagtaatagccttcaatccacatatgcagcacagttgatcattctgatttgtagggttagccaaaagaaacatgaatctctctacagattaagatacatttctactaaagcagtcagttaaggtgacaatatacttccagactatttatatactaaaaataataattgctatagaatctgcatataattttcacgtttgggtctgtagacaaactttggttatgaattctagtgctgcaaggttcagaaaaatgtttatagaacagaaaatgcactaattagtgagtcatgattatctcaactctttatatggatctatttcaatgatacttagaccaaacaaggtgagccgcacattcattattaccaggccttgaatcctgagaatgtcatttattataactaataggaagtgtgacttgctcacatgaaaatggtgttccaatgctagcattggaaatgcttcagttgtacgaaaagtgtcatttgcccacatgaaggtctataaaaaatattaaaaatggagatgccatggcatggcatctgtcccccactcttttcagatgaagaaaatgaaattttattcagaggtgccatgctatgtcagctgtcatctctcaagtgatgtattttacacatctgtcttggcctggctctggagagtaaatgttcagtgttcacggaccctacatggagttctcctaagttcaactacaagagacatagcccatagggtaatgccctcactttccagctctttaactatggagatatcaatcgatcaatcaccaatcggatggtaccaaatccaaaacaacagttggggaaaactgatcctaccaacccagctcaactaattttgcagtgctacgactatgagacaatccgtgctcactaataaatgcattaatggaacaagaacaaaacctttgcatttgataaggttcgaatgaattcgttcaagaaccccttacattgtctgcaggtggctgaggttcccgatgctcggcgacagcgtcccggccaatccgttgttcgccatctgcctgcagcagcacagcaatccaaccaaaaccgccataatcaacaccaccaccacgagcagtagcagcagcaataacaaaatcccacgaacgaatcaggagaggggaatcctcacagcgagacgacgaatccgtcgggggagcaggcgaccatggaccaggtgcacgggtcgacggagttgatgtcccaccctcccatcacccccttctcgtcccgcatcctgctcttcaccgccatcagcgccgccactgcaaaaaccccccacatcatatcaaaaccctaacccacctagggttcccgttccccaaccaaaacccacgctacccaacccacgcaccttcgtagttgagccccttgggcgacagcggcgggtccccggcggcggcgacggcccacgcggcgaccaccaccgccgccgccacggcgagggcgcggggccccgccatgagaggagtccgacggcgacgccggggagggcgaggaggaggccgcgcgggcgcagcgcagcagcggcggcggaggcggaggcggtggcttgaggtgggctacgctgcagcaggagctcgggcttggcggccatgggcgcctgcgcgagtataatactgccactgtatcgagctaagcgacgggggtgcttagcttaggcggggggtgtgattagattagagttaagattaaattagcgcaatttggttgggaattgggcatcttaattacgaaagagatcgctaattgggccttaattacgtttatcgcgagtggaggcgggtggctctctccctgcctcgggaatcgcgctcccaaaaaaggctcccgatttttatttattttcattttcgttttttttgggattcttttttgttatttgggtcggtgagaaatgtgaaattgtaaataggtcctcgaaattataagtagctagggaattggcgcttccggtctgccttgagccctcctgttgttttgctgcttgtttttttactgctcctgattgagctagctctgacacaacacaattgtttgttctctttgggaacactaaacatttgtttccttgtgacagtttctagacaatttaacattactgtatgtgtggacaagagggccattaaaacacagtttttttttttttgtagggaaggagggaagaaacaaacaaatgatggcactggtcctagacaacagtattggtagttgagaaaattgagcatgcagagaaatgccagattggtatcgagtcccatagtgcaatttggtttggatattgaagctacagagggtgataaggttaattgtgttttcattttctcgatattttatagctcaatgttctagtacattttttcattaaatctatgacttgccccgagcttaatgtatatccatatattatactcgttacgaggctggcctatattattataggtgggcgaggcatcaatagatgtaagcagcatatcgcgcatatcaaataaatttaataccataattagtcaatttttaattgtatctagattcgtgaaaaatcttagctattattctgtacacaacggacttagatatcttatatattgggcgataaacaatctgggtagcaacagctaaccactcctacggtcctatcatagcttcgatgtcaacaaagatggagccatagaggaccatctcatgtgattgcaactagatttaggtgctatccacaaggagactaacaacacctgtatttagatccaaatacatttcgtcatcactcatcagtacgatggagttaatcacaaaatcttttcctctgcatttcattgtcccctgaaattttctgtaaggcactttatcttgaaaaaacacgaacatgtaaatggagaaaatgtgtccttggaatcaaaagtttataaggaaaaagcatattttacatctttaaaaagttcactttcatccttcacctgttataaacagatgtgatttgtgccatgtcagccaccacacatcaccacaagcaccttgccatccttattgcttactttaccgtttgttctccgcagttagaacaagtgcaataagatttggctgcttcttctaaaagtaccgattaggttgtggtggagaagggaactgataaggcagagaggataagctgtttcttatgcaaatacaacatctattaatctttaaaaaagtgaaaaacaaagtgctaaagagatttatcattttccgtgtgcatgtttcccaaaatgctaaatgttactttttttgcaaacaacattctatacgaaagttgtttgaaaaaaataatattaattcattttttaagttgaaaataattaatacttaattaatcatgtgttaatggctcatctcgttttgtgtgtatcttctcactcttctcttttcccctcctctcaaatacagccagtgtgagagcaaacaaaataaataaaattataccataatattatggtttatgaattagagatgatatgttaaacgtgttgtgacatcccggcccagggcttaataggattaatagaatactcatatcaacaagttgcaacttcttttccggaagccgatctccaaagaactcctgggtgtgcacgagtgaggacaaagtgtgccaacttgtgttagtctgtgaggacagtttatgacctataaaagctatcatatgtaagcgggccgacctgggagaggataaaaaatgtgagtttttcaactttaactaatatttagattataatttatagaactacatattatcagaatctaggtgagaatatagattgcttaggggagttaaagactggattataatttatagaactacatattatcagaatctaggtgagaatatagattgcttaggagagttaaagacttgagaggctcctctcaaacatggtcatttcttctagaatctagagctcttcaaacagtctagacttt

SEQ ID NO: 47437 - DNA, 7457 bp, Oryza sativa
aaaagattaatagagcaggtgtgtcagcatgatgataataaagcaaataaatagtgttctgctcaaccacactaaacagacagcatctctattgatgaaaggaccagccgacacaaccaattggttctcaactgttgcttttattctctcaatataggattggtgcagacacctgccttaaatccttacacaactcacaaatgcagacctcaaatatattactcatttatcaacaattttatcctagtattccagtgacaatgataatcacaacattcatctttgcagccaacagatgaggaaagttctctgaaccatatggtagaggaaaccagtagggggggggggggtaaacaagtttgggcatggggtatcataacaagagatttttccattaggaacatttacacaattacatcgacaatagggcatgagaaacacttacaggggcactacaacattaatcgtgggagaaagtagtacagtacttgggatctgatccctttcaatagcttaacaatacaccatccccattccctccagctatccccacagtacttggctaatcctgaccaccatggcctcctaataatggaggagaagcattaaattaacatgggttggctgtgcctagcacacccacctcatataacacattggcgccagctcatgttcagcttcccaataatggtcagattctacaccttaaatgtgagaacatgcaagttgccctttggcacaaacaagcatcggcttcgcaaagtaaaaataccatccagctgtcctatggtccggcagcaggcaagaaattgaacccacaatgtcaccgagcatgctctggtatcaacctgttgatgagctctggcgataaattcgctagctgcaaatgaacaagcaggcacataagtcggtcttttcatcttaacttagtatttttgttcatgaaaggtatatctgcctagaaattacttacttcttgcttaaagttgaacagtggggggaatggacgtccatttggcaaccttgcgtggggttctcgcaattcatcaaagaatgaatgtgcacatgcttcgagctgtaaattgtaatggtgattaatcagcatattgcatgaagttacactggtatgaattcgaaaacactgatcatataaattcaagggcagagaatggcagcattataggaatgaaaagtaagatagattgttgtggactccatattcacaagaacatagtgaacatgagaaatccataaacctcttgttcaaaaaactgaaatcaataaactggtagaaactagaaagataaacgaatatattgattattttttttctgttcctcctcgaaaacatccacgcacatccaaaataaagggttaaacataatctttccttttgcaagaatatccgattaaatgctgtacacctttaggagagaattaacaatgacatactggtgttatccaacccaaatccaatgattgacactagttttatacccacaaaataaaggatgcgtgaacaaataaaatatattgattattgatagaagatgttaacagacgaaaactgaaagtgatgggcggaacatgaccaatcaagttgaacgaaacaactaatgccataataatttggagcaatcattaataggtagatggcttcaacagttgacttgaatcagtcaaacaaaatgagatggaaaactcacggcagtgcatcgtagatttggtgcatactggagaagacgtgatgcaaggtcaattgcttctggaggcatccgcttgtggaaaatctgcagcataggatttgcaggttgtaatatgcactagtatcataacatcaattaaaaaaatggaatgctaaagtaaacaaaacaattctaataccttgtgccatgggtgagctttaatctgaggaaatctgaattctgtgtagttgggattcatgcagcggatttcctcacgtgttggagtaccaagaacctaccaacaaagaaaattcattcagtttatgaaaatagaaaaacattaagaaattttctttagaccgcatgtactgtagagcagtgcctaacatactacctttataatctcgacaagctgatccactgcactttcaccaggaaagagaggctggaaaaatggacaaaaaagatgtttagttcaaagtttgctatagtcaacctgataaaaaaaaacagtcaaagaagccacaaacaggaaataacctggccaaggagcaactcagcaagaacacacccagctgaccatatatcaattgatgtcgtgtattcggttgccccaaatatcagttctggagcacggtaataacgtgaacatatatacgatatgtttgcttcacctttaacctgcccagcgattgaatggaaaagcagatcaaaatgaggacagtagagttgcattacagcaatataaaagaaaaaagaaatacagcaatgtgaggttgatccagaaatgcactgtttttccccagtttctaatttgtccacatgaaaacagcaagaagatattcttgcaacaaaacgaacaaaagatctaatccagtaatttaaattatgtaaatcaaactgctaaatataccctcttgaaaaccagaaagaattgtgctatacaaaaataaaataaaataaaataaaataaaatgagctacttcagtatttaaatcatgcgaattaaactgctaaactaaaccctctccaaatcataaagaaccactccaatataaatatctgtaatcaacactaaaatgtgcattaactcaccaacatttttgcgctcccaaaatcacatattttgacttggtgagtaagaggatcgacctattaaaaccaatataaagtaagaatcagcttatattcagatactgttaaccacaggttattaaaatatcaagcgtgaaatgaacataccaaaagattctgaggcttcacatccctgtggcaaactccaggtacagtatgaatgtaagccaaaccacggaatatctatacagaacagacaagcaatatcaatatcatgaatacaactatggaaactaacaaaaagtagtaagcaactgtattgtcaataacatcttacctggtaaacatacaatttgacatatataagtggcatcctttggttcatgttgctataatgcttcaacacacgatacagtgactcaggaacaaattccatgaccaggttaaggaaaagttcatctctgcttgttgtagagaagaagcaatgcttcaaagaaacaacattgcaatgatccattgatcgcataatctgcaactccctgttcttgtaacgcttgtcctgtaaaaccttcttaatggcgacagtctcaccagtctccaaacattttgcctgaatgataaaagaaataccaaataagagacaaataaactttaaaggaggacaatgttacactgcagaagtttacctgaaagacgattccaaatgatccagttcccacaactcgttctgccatgtagctaatcgtctacagagcacaaaaatcaacccaagttagataaccttacacataagattgaataacatattgtggcttccatttatgttataatttacccttttaggttctccattcttccctccaatcgttgtggagattatgtggccggtgacaggatcactcccttccataagagaagcaccgtgctgtcatgtagcaacaaccagtgaggcaaggcagaacatcaacaatcaacaaagaaagaaaaaccactaaaacaaacaggttcatgacatctactgcctcaattatctaaagcggcagcacatcactaatgattccatcccatagcactagaactataaatccaagcgatacatactatcgacaatctcctggattgcttcatttcaaggagcttggaccaaacaggtgacacaaatgtgctgacttggcacggctgattactgcaagactaactgcataccggcatttaccctacgaattcataacaataagctagcaagagtcccaacaagactaatcagatgacttacaaaccttgctaatcgccccaacaccaaacatcgcatcgcgcgctcattcaagggctcaactcaactgaatgctcaccaccaaggcgctaaccaactaattgccccctcactagaacaaattaaaccataaacaaccataaataagtactaggaaactagtatcatcaagccgtccaagtttggacgcagctggtgatgggatggagaagcgcttgcatggcgcacacgcaaaggacaaccccggaggagggcagcgcatcccctcccctcccctcccctccccgccaagcaaacgcgccatgctgcgtcaacccccaccgcccaattcagctcgcctccgacctccgagcacgagccggcgcgcaaaccagggaagcggaacacccacagatctacgacgcggaccaaaccaaccgcggagaccaaaaccacctaacgcgccgcggaagacgaagacgaagacgaagagacggcagcagcaagcaaaaccgcagatctggaacccccccccccccagagcaaaccaaccgcaagtttctccgctcaccttttcaccggcgggggcgaccgctgcggcggccgcggcggagcgcggctggtcgacctgcatcgggtccgccgcggcgccgcctccggtggggtggggcccgcccggcagcgtggccatgggggggggggcaaatggagcggcctcctctctctctctctcctcctcctcggcttctctctcctctcgtctcctctcctctcttctctctcctcggcgaggaggttggcttggcttggcttggctaggcgaccatgagatgagaccttccttttttttcctctttgtttttttattcccttcttccaccacccactacaggaagacggcgttttttcatacaagggcttggagtttcgggaaatagcaggcggggtcggcttgtccgaagcgaggtcttacatttcagcccctatagggagctatttgtgaattttgaatgttttaagggttttgtgtaagtttgtgagggggggacaaggtcaatctgtcagtctggcgcttggaatctcccatgcggggattgagaattccgtcatcttttcctttttttctggtttacccctttaggaatttggaaattggatattatgccctgaagattatttgtagctttccgttactctaggcataggtttagttcgaacgtactttgttcgtactaactcatttcctcccgtgcgaaaaacgagttatcgcacaattaagtacgtaatccctcaatccaaaaaaaggtaacctacgaaaggatgtacccgtctagtatgtgcagattcattatattagaagttttttttccggagggagtacttgttaaaatgcttgataaatataaagtaaattgcatcatcagtacacgaatttgtcagtaggtgcaatctagtgcacgaacttgtaaaatgcttgttttggtgcataaacttgtctggtgcgtgcggaggaaggcgaaaaggacgctacatgactaatcttattgatttagaggttgattaaacatatatctgagaaggttgcaattagacatgcacatcttcaataaaaaaaatagaatatgatatagtgatagtagaaaaagatgaagaaaaaccaagcaatgccaacgatattttggtcctcgtttgcacgaactagacaagttcatgtactgaaacggatatttcacaagtttatatactaaattacacacatctaacaagtttgcgtaccaccaatgcaattgactctaatattattattatgatttttgaaacaatattttatagaattttttttaaaaaaataatattgcttggtattttgggaagtagtgcgcgaaaaatgagagagtaaaagataagaaagaggagtagcgaatacatcttagaagtttcgaaagccgtgttaaaaaggatcctccttgtctgaaaggcgaaaacagtgtaggaaggtgtcatggttacggataaggtaccttatattaattctacgatttatgaaatatacagatacgtcacaccttcatatgcgtgatagatttccgtatacgataagaaaatcgacaagagattatagaaataatcctcacggatagaaaagggttaggattatactatatcatgtaaggtctgaggtttccgagttctacttggagactaaggggattcacggtataaatacatacccgctaagggtccagggtatcaaataatagcaccagccaacccgccaccatagaagcaatccagagtacttgaagcctactcgccagtagatcacgtcgagactctcttgataaggatctcgctggtagcctcagaatcagttgttttctattgtactatgtggatttttatatcaatctcatataaactagattagggctattatcttacgaggggcctgaaccagtataattcttgtctttttgtttgctcgatgtagaatcgtatagatcatcgtagcaacgtaccccaatacccatactattcggtctacgggtatccccgccgacaggaagaaaaaatgaacatgaatatggacaactatgtgaataaaagtaaggaccctttcctctggaggaaaaaacatagaaattttcaaggattttaattttcaaggattttttttatgaaagcctttgaaatagagggttgaatcctaccctatcctttgaaatacgtatggaatggacaatcttataaagatcttacagaaaacttagcaagagctccaaccttttagaaaattttctttgagtctatctctcttatctgattcttgtgttcttcttacggtccaatcaaacgggttttctacatttttcctgtagtttgcaatcatttgttttgcacttgcattttctgtcagaatcctatattttttttattcttatgttttttcattcttataattcaaaaaggtccttttgcaggtattttatcgggctaaattttactactattctaattagaatctccctaccattttacattagccggatatttctatctgcttaatgaaatattcgtggtctttaagaaaattcttcccactgttatctactccgtactcctgtattttttttcgaatataaagaagtcgcgcacgttttgcgtggtctaaggatcggtcgatttcaatacaagtacagtgaattgcgtggtcctgtttgggaagaaaacagctgcatggtctacgatttgcatttgaattattttaaaagagataaattcatgtgagaacaatatcctacgaaatctactttactactcttaaatatctacaattactttactaattcatgtgagtaggagtagtctagtactcggtgtattgcatgtcaacgtctcataggtaacgtagacaagtttttacacaaatactactgtacttcaaa

SEQ ID NO: 47438 - DNA, 2091 bp, Oryza sativa
ttagggtgggatctaaacagggcctatctctgtctcaaaagacaacgctcccttcgtcttattactccctccgtccaaaaaaaactgatacttacatcatagttatactaatactaatttcatctatcacccacctccatctcaaaatataagaacttatgatcggatgtgatcttacctactccctatctagatatattgtactaagaatattccatttgattcttatatttttgatacaaatgtagtactagattgctatattaacgaggacatagaaatcttttaacattttcttaacgtgtcttccactagctaaaactacatgaacaaagggagaggggctatgttcgaaggccagagctgccgctgccgcgcaacgccatacaaatgaacgatcgattcattgtagcagctgttgcagcgccaaccatacctatgggtaccgaacagacccttgactagcaggattttttagagtaacatactaacatgcaaattttataaaatagtatgatattcagtccaagaaattaattctaaatggtatgtataattcaacctttccttacagaggttttaccagaggttaatcagaaggtaaaaaaaaaaaaccttttcgacgagttccacgggtttgctcaaattttttattgtattattatgtaaactagaaagaaagcccacgcatatgagcgggcaccttatttattatctatagaaataatgttaatagaattaagtcatatttcactatgcatattataaatggtagatttcaacttataattaaaaaaaagtctttgtcgctaaattgaccctagactttgataaacgataagaattttcttatattcaagcaaaaatcacttttgtctagattacacgtaaattcgcctattatcaccattactaattatcattgttgcttgatgcctttttaataaatggaactacatatgtatcaccaaagtaagcctattaatcattaatacataaaacattaatctccactacatacctaaatgtttatgtcaactcttatttctaaatctataaaaaaaatattctaaaaataccgcttctattggttaaagggataacaatgttaaaaattagacatgaatataccctctaatgggtagagctaccaaggatttatttctctagtgccttcaaacatgggtttcgcagtgacgtacttgtgcctctcaaagccagtgtggagcataattctaagtcttatttcactatcagcaccctcaaagattattgcattagtatgtaggaagttgagtactattgtcaacggtgacctccattgagtctgtctcaactcaatcatatttacgtccctcctatagttgtgttaactggctaactgctcgatgcccttcaagaaagaaagagaagatagatgtgatgaaaataattctttccataaatttttttacgttttgagtagagacaatttgtttacagtgttaatcaatactgcttaaatttttatggaatagataaaatattttcttttgaaatgagtgagattgatcattaagaaatgtatcgctaaacatacatacgaccgtaacaatctttagagtatcatatcaatatttatattttgataaagatatatattttagcatctagtttattttcgtcacctattgttcataacatgtctatcaatttaaataaaaatcgatggcgagattacacagtgccacatgacggtgtaagagtgcttgtagaagcatcacgtgaccatatttgtgaagtaataaattttattttttttatagaaaatcctattttaaaaagatcgtctattttttaatgatgattctgacatgtacatatatttttctttagggttttatagcttgtttaacgtacgtccttttttttttcaaatgaacagtaggtaaatgtattttttccatcggtaaacggtacgtactttttcaaatgaatatagtacgtaaaggtatattttttccggccccatcgtacgttttcccggtatgcagactcttttattaggtaagtataaacggattctgttgttatataagagtgcttgtagga

SEQ ID NO: 47439 - DNA, 2620 bp, Oryza sativa
  unsure (1)..(2620): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatactaccaaaatttttgttgtgcactaattcaaattggcccgtgctacaccatttggattttctttttgattcactattctgatcgtaagaatgtttttttgggtgaataaccaataagatcgttgaactttcgcttcatgataaatttagttcttgaaggttcatattgccaaagaaatccccaagattagttgtggtattaatatagtccttagacctacttaaaaaaaccgcatgaacatgccatatcatctatgcatacaaagtcaacatttaaatgtacattctactcttacattttcatagtaaatcaaaaagaacggttgagaaaataacaaaaaatagtatggcaattaaccattagcaaaaaaaaaactattagtaactaaagaattaacattttcctttgttttatgatatctttcttccttttttctatttcctttttttataaaaatgtaaggataaaatggatatttaaatgttgactttggctgcaagacctcatggcattttcagtgggtcaaagccgcacgacaatgtttaggggcttatttgaaatttggataacatataacaacgaacactgattcaacccctgaataaaagttcaaggaccgaatttactattcaccccatttttaaaatttctagccgaaatgatctaccatttgtacctatcacccaccacccttagaaatagacgtttccaagacataaaaccctactgtagataaaacgccaaggccggccgcagggtgcgctggctgaacagaacaacacacatgcggatcgagatcgattcgggtgtaagtggtacacgtacgttgatgcgaacacggacgagggacgatccatcgatggatcgatgtggactgactgatcgactcgcctcgctgccctgttaaattagctggtgctcgtttggaacctacctaggttcccatcggatggcctaatcagccaaagaaaaagctaaattttaaattttcaagcttaattttgagatattttcaacgtagtttctttttcaacattggcttttaagtcaaaaaacacatttataaaagtttcacctgcaaattcatttttattttctaataagcctttttgcttattagagcatctccagtagaggttctaaacacagcccctatactaattttgagagttgagactaaaaaatcaggtccaacaagacccctactaaagcccctaaaataggaaggcctccaaattatcccctcaggcccccagtcccaggggctttctccgcagcccccatccgcggcagagacgcgcgggcacttcttttttcgcgtgaaatatcctgctagcggcgcctccacggatctacaccgctcctcctggccagcgccctcctcccctgccgacgccctcatcccgggtggcgccctcctccctgcccgtcacactcctcctcggtaggcctcctccttcccaacatcctcctcctggccggcacggcggcaccctcctcccctgcaggcgtcctccctggtgccctccttcctggccggccacctgcccacccggcaatatcctcctggatcctgacgcccttctccctggcgctagttgaaggtatcatgttttcatttttccagtggatttgtggattgagttatatggtagcacctagcgtgttagagagaaaagttgtcagtacgaaaatgtatatttggagaagaaatgggtaggaactaaccttccacgatgagatggttttggtgttttattatgtgattttgttttcctcaaatgtttgactgttaattaatacaataattaatctcataatccatatgtaattatactttctttggaatgatctgattgattttttcctgaataatctaatttattgaaagtaggttcctaatcttgtagtttcagaaatatgaaaagtagccatgcatacgcgtataggaaacatagtttggatagtaactccttcattgacaaatgaaaatctgaatccatgtataatatggtcaggtgagctcatgtaatgatgattgatttcaagtagttaaacaattgcattagtaataaggtcaacacaaaaaaaaactgtaactgaaattagcagggggaaagataaattggatcgagctaatatggttttgggaattgtaagttttggatagtgctatatggttttcagtgtgattttcaatatgcatgactttgagacactgtgccagctgaaatcttgtgatcatattctagagggtatgggtgtagtgctgcttaatttcctgagctacacaattttattta

SEQ ID NO: 47440 - DNA, 3314 bp, Oryza sativa
attgattggagaagttgtcaatttatctacttattgcagtgactagattgtgatggcaaatgaatgtgattcctttgtgtgcatgatgtccgaagagacccatgttgaggcatattccttgccaatgcaaaatgaagaccttcatacttcaacaaatggtgcaaaaggaagagccaaaagatcaagcaactttaatcgtaaggaggacattcaactgtgcatttcatggcaaagcattagctcggatcctattattggcaatgagcaaccagggaaggcatattggcaaaggattgcagagcactaccatgctaactgtgattttaagtctgataggaatgcaaactctcttgagcactttgggataacattcagaaggaagtaagcaagtttcagggctgctacgagcaaattgagcgtcgacatccaagtggcataccacatcaagagcttgtaagttaaattgtttattcattattattaataacaatcttgtatgtatgtaaactaacacttgaattttgcttcaggttcttgaagctgaggcattgtactcatccaatgcatcgaagaatagggcatttcagtttaatcattgttggctcaagttgaggaattctccaaagtttcaaactctagaatcccacaagaggccaaggtctaggaagtcttccaccccaattgagagtgctagtgaagaagatgaagaaggagatgatgctaggaagagtacaactcctgatttattacagccaagtgctaaaaaaagaccaatgggtaggaagcaagcaaaggagaagatgaagaatggagaagatggaccataaaaggaggcgatgaaagatttgcttgacgccaaagagaaagaagctaaagtgaaagaagagagatggaaggaaactaaggagattcaagagcgcaagctcttatttgctgagcataatttagtgtgggatcaagaacagaagatcatgttttgtgatgtttccacattggaaccagatgtgagaacatatgtgttggctatgaggacacaaattgcagcttcaaaggtggctgccctcaatggtggatttgatggtagtagtggctttggaggtgagtttggtgacggtaatggagaagtttgagcacttcgatggaataagttggatcgttttggatgatccacgtgtcctttgctagtaggatatatcatttccacgattggttcttggagtccttttgtgttaatttctgcaattatctaagtgtcatttgctagtaggatatgtactacttttagatttgttatttttatgatcgaaccattcattctagtagggtgtgttatttttaaattatatagtgcatctccgcaaaaaaaataatgcatcactaggttcacatagcctattgtggtgatatggagacagacaatgacatgttggtgagcaattttcgttttcattggtgaactataaattttggttgcatgttgttgtatatggcattctgcccacaccatatttacatgtttgaaaattttgattttggatttgaattgtggcgtttgaaattgtaaatttaactatggttcaattatacgcgttagaaatatttatgtttaattattgtggtgttaaacatagtgtaaagaaggattgcatgttaaaataaagagaaacatgagtaggggctaagaaataggggctattgctagagttggaggtatttttttggatccttagaagatgggggcagccctcatttgacttttaggggctttaaaataaagcatattgctggagatgctcttagaaaataagacaaacgatggggacccttactgtgatggccggcgatgggtagggagacacacacgtactaatctcactagcttcttctttcacgacctagcagtgtcggagtcagaaaattattaaaggctagcgttagttaagatagagctcaattgatagtattgaatctaaacgatgatttaacaaaatttaaactagattctggaaacatgtataaggctcaagcccccctgtctattgaagtgggattgagatttatatggtttaggagtttttatccggatcaaaattttggtgttttagtttttttatctggcttttcgatttgattttcgtatcaaaattttgggtgggtggtatttgaaggtggttatgaactactgctgtgagaaatgaggaattaggagtacgagtttgtttttaaagtagcggagataagcacttataaggatggagtttgccgaagattgatacgatcggtccatcactacaatcctatttagggcctgtttatttcacaaacaaaatttttcacgctgtcgcatcgaatgtttggatacatatatagagtattaaatatataaaaaaaactaattacaccgtttgccggaaaattgcgagacgaatcttttaaacctaattgcgtcatgatttgacaatgtggtgctacactaaacatttgctaatgattgctaatgacggattaattaagtttaataaatttgtctcgcggtttcttggaggaatgtaatttgttttgttattaaactacatttaattctttaaatgtatgtccgtatatccgtatatccgatgtgatatgcagaggtaaatttttttgccaactaattaaacccttagctttgtagctcgattgatcctatatactactgggtagggggcagatccaacatgattggctcaagccctgcccccaacctcattggatctccatctccatggtgagaaggagaagggaagggaaaagaagagtagaggaggatggaggaaaaagaagagaagataagcctccctccattcaatcctaaggtccatcccttcatcacgggcgtatagcttcgtcttgttggctagcagcaatggataattgtatatgcatggaccaacaaacgagtaactcatgcctcctttgcatggtagacgaccgatcctccctcaaaacttcccatggcgatcgaattaaaccagctgggagcagagcatcggcacatgcaacatatttggaaggttgtgaatgatcggtagtagggactagcagggagacgacataagacagaaagatctgtagatcctgtaaagagtatatatatcaggatatgcatgtgtgctacttttggctgatttgctagaaaactttcgcaagtttttttttcttccaaaacttttagatttgtgaccatttaatcgtttcgagatttgtgcatgaaggaaaaaaatgctagaaaaagaaattttcacacatgtcacgtgtaagatcgggctgcaggaatt

SEQ ID NO: 47441 - DNA, 1801 bp, Oryza sativa
tgtgacatacacagctgcaaagaggtcaagtgtgaaccgtcctgcagggacaatcgagatgaagcccattgagtcaatcacaaaggaggtaatccgaagcttcatgatagaaaaggtattgccagctgttcgggctaagtggcctcgtgaagacgctggcaaacctatatacatccagcaggataatgctcggcctcatattgcaccggacgacagaatgttttgtgaggccgcgaagcaagacggctttaacatcaaacttgtttgccagccggcaaattccccatatttgaatgtcttggatctgggtttcttcaactccattcagtccatccagtacaaatcagcctcaacaacaacagaagaacttgtagccgccatcgatcgagcatttgaagattatccagtgaggctatcaaacaggattttcttgtctcttcacgcatgcatgagggaagtcatagaagtactcggtgacaactcctatgatcttccacacataaaaaaaggagtgcttgaaaggcaaggtcgccttcctttgcaactaaggtgtgatgctaagtcagtaaataatgctaacaattatctcaggtaaactactttggttatattttattttcatgaaaatcgcttcatgtgcctaactagtttgatgtgtgctaattagtggcattctttttactccttttcaggaccatggcagatacctgatatgaatttgtttgttgctgcagcagggtgcggatatgaaattgctgctaagctaatctgaaatttttggtgttgctgctgttgctgttgctgctgttgttgatatctgaaattgttggtgttactgctgttgctgatatctgaaattgttggtgctgttgttgatctgaacagaatgaattggaggctttcttttttttctctctttttctagaaagtagcccatgtgtgcagtcattctgtgcagaacatgtcctttgatttttgagaaagcaggaggatatatggacctgaatatgtcctttgatttttttattagtatttttatttcacatgaacacattagctaagcttatctaagatcaatggtgtgaactgtcaatggtcctttgatataattacagactagctatctcaatttacaagaaatagcaactgggatggcagcagccactttacaagctctgtgtctgaatactctgtttacagactagctatctcaatttacaagaaacatcagctgggatggcagcagccactttacaagcttggtgtgcatctctgaatctgtatctcaagttccaatttttgtttccaatttctcattataacatccaaaattcccacgcatattacatcactgacagtactaagcactaatcatctgatcaaatacacaacaatcagtccccagtgaacacgaccagaatttcccagaaacagaaaaatttccccttcgatgaacatcaaatagccaagcaaatgcaatgtgcattctctaaaaaacgaacatcaacaatcaacatacggctaaccaaatcagacaatctgcaggccgttcagtagcttaatctgcaatcaagtgcacagctatcttaaccggatgaaataatcaggtaaattctggacatccagctgaagaaagaaaaaagaaaggaggagacttgtggcaatggagcttttcgaagcccggcgatctcctgcaccaacgagacgtgcaccagcaccgtcctccacgccatgtatcagcctgcgaacccgccgccgccgcgagcagcgaacgaaagaatcagggaaaagccctcgagcc

SEQ ID NO: 47442 - DNA, 1260 bp, Oryza sativa
catatgccaaatcatggacttctgatgtccttgacaaagcttttcagcaggattgtatgtcattcacaatagcaaggcatatggcttcgttttccagtgcagcggttctatcaaagtgcgaaataagctggttaaatcgcttatcccggtgctatgcccagaagcgtcatcgatcatgaggtaaatgctctcctgctttcaggaatattacttgtatatctttgtgttgtatttcttaaattgatcatgtgccatccttgatgttcggaaaaaaaaatcataccgcaggacgtgctcaaaggttttgttctgcaaattgcacaagattcacaatgtagtgatgaagttagctgaagatttgaaatcttgaagaattctagcttgcgagatgcatgaattcttctcttttaggtgagaatccagagattaaagacatcgattgatcgatcgataaatggcccaattaaaaacgtttcacatgcgctaaggcgcaaaagtcttggcgatcgtacataacataatatgtgccaacgacaaattaaacaactagagaatcatagttgcggttgacgagtacaaacctggcgctacaaataaaactgacaacaacatgctgaaggcctagctagaactgttacatggacgcttggcccatttcgccccatcagaattatggatttgtggattacattttgaggacaagaaccatcaattggtgtcgctggtggtaatcctgatgcagtaccgaacactttttcttgtttttgaaaaattgtcgtctcgtctgttagcatgcctgtctcatttcattctgtttatatagtacggagtatatgttgaatgcatcatcagttttttttgcatgtttattcatgagatgatgaaagagttatgtgatgtaacttcacatcacatgatcacatcgaactagagaatgaatgcgtgccaccactacaccatttttaattttgcaaaagaaaacaaacaagttctgccattatcatttgtagtatgtactacgtactagtataactccatatataggtactactccactatgctcggttctcgccggtctgaagcttcacagatcgatcaacgtcacagttgtcaccttggaaagttcaagcagaatgggaccaaattggcaagtagatcagcgagaggcatcggggaagatggctgggtacttcttcaccaacttccatgtggacgatcactaccaacttcttctgcaaacacaagcagtttcatctctta

SEQ ID NO: 47443 - DNA, 968 bp, Oryza sativa
cccagaaatagaagactccaacattgttcaaccggcttcatcaacagaaacaagcatctccaccacactttccatggtgggtcttctaggctctgtcttcttccagacatgaaactgcaagctccatcatcactcttgcttgcaagttgttgaatcgagtgtttaatctggcgtcaatgaagtcagcaatccatgactgttcatccccatcagacgttagattctctgctagcattctaatgattcttccgagaaccatttccacctcctcatctttgtttgtttcaaggtccgaaacacgagctccttttagtagttctagaagcaccactccaaagctgtagacatcaacctttgctgttatcggaagactagaaacccattcaggcgctaaatagcctctagttccttggatccgtgacacgtttaaattggatcctcctctatgtagcaactttgcaaggccaaagtcagctatctttggctccaaattctcatcaagcagtatattttcaggttttatgtcacagtggatgacccactccaagcactcgtgatgaagatatgccaatcccttagccacacctagagcaatcttaaatctttgctcccattctagtaaggcttgtgattcctgactgtcaaacaatattttatccaatgaaccgttctccacgtattctgaaatcaatatcctgtgtggatcatcagaacagaatccccaaaccctcactagattcatgtggtagatcctgccaatcacactcagttcatgcttgaattcttcttcgccctggtttatgtctaacaactttttcacggctactgctctcatgtcctttaagatccccttgtatacaatgcctgatgctcctcgtccaatctcatcctgaaactttctggtggctatcatcagctctctgtaggtgtatctacggaaatggtttgttaccatttcatagccaacc

SEQ ID NO: 47444 - DNA, 1639 bp, Oryza sativa
attgatcatcaaagtggaaactaaagcgaccaggggcaagtaatctattagtagatatgagcttaattcgagcagtaatgttttgagtgggtagcaaggtatcagtaggaaaagcaaagctttcccatagaatggtgtcacctttgctcttcacgatgaggtttccagtattcaagagcttagcttgaacttgctccgcatttgaagagctcacgttgttggtccacacaacctggccattataatctttcaacagcatgccgccatcggatttcaactcaaattttgattcccatgtgtacacagggtggagaggatttgcgctccagacaacagttttctcggaggagtttgagaaccagatggagaaggtggaggcattggggagatattgtagaagccacaggtgaaagtacgatctggtgagtagagcagatccaagctgcgttcaacagagagaggggagcctggcaagagggattcaagagctgaggaggagtacaaaagcagatggatcaatgtgaggagaagcagagaggtgaagattgcatccatggtggttgccgcattcaagctgatctttcaaatgacaagcaatgcaagctgttatcggaactagctgcccaaacttgcagaaaaaagtgagattctaacattctatatactactacgaaggtgataagactaaattcagtctgccagttattttgcgtcaatgggcagtttccttggaccaaactatgcaatgcaagtaccatgttggcaaatgattcgtgtatacatttccaacctgttgcacaagtggcactgtggcatgacgtgtccttgtcaggatccgtaaatctggacagtaaaataagatttgcaatatggtaatgagttcagtgtacttcaccagtccataggtccatcctaaacggctgcacatgcacatattcatcccccatttccaaagaagcctgacttctaacatgacggggaagctcaggctttgaacatttgaacacaaaaataatggcaattggccatgctaatttttatttacatgtggtacttcatgcattgtgagtttgtgattgggtccctttcagctttgagtatactcacgtggaatcttcaacgagagatttcagcaagcatacacagtaaggagagtttaataatatttttttattggctgaacaaatctgtgaagacatttcttccgatcaaatgcccattgcttgaacaaaacatttacatccttacctaaaataaacaaacttaatacgggacgtggacagattcatcgactttgttcgtttgttacctttttcagctcacatccccaattttcacatgcacgctttttaaactattaaacagtgtattttttaaaaaaatttctatacgaaaatttctttagaaaaccatattaatacatttttttaaaaaaagctaatacttaattaattatatgctaatgagtactttctgactgcaacaaacgaactcagccttaaagatataggcaacatatccagacagagtcacgaaggggatatcaatttacaccaaacaatgctgtaaaaacagcttctcagacgacacagcacagcaccagggttcataattccaataaagaccggtcaaatacagt

SEQ ID NO: 47445 - DNA, 727 bp, Oryza sativa
ggcttcttcttgtttttcttcttcttcttcttcctcctcttttcgccggggcgatgaaacctgttgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacagtagcccccgagtcctttgcagtcgaccatcgtagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaat

SEQ ID NO: 47446 - DNA, 1870 bp, Oryza sativa
tcctattcaaaataaggagcaatcttttgaagaaaatccatttcgactgcctcaactattcgtatccttttaactgtaaaatcagccatagagaggctccctcaatcactaaaaccagctcactttgcgttctgagtgtattaggttgtgtttagatgctagggtgaaaagtttttgacgtgtcacatcggatatacggacatatatttgaagtattaaccatagactaataacaaaataaattacagattccgcctttgaactgcgagacaaatttattaaacctaattaatccgacattagcaaatgtttactgtagcaccacattgtcagatcatggagtaattagtcttaaaagattcatctcgcaatttacacgcaagctatataattagttttttcctatatttaatactccatgcatgtgttcaaacattcgatgtgacagcaattaagcatatgacaacatccacacactggtcctgtatttttagaaaataagaaataaaacttgtattttacactagctctgtgatggacaaattagaaacctacatgtcccgttcatttctccaacaagagttggatgaagataaagattttcgtggcacacttttcaaactgttaaatggtatgttttgtgtgaaaactttctatatgaaagttactctaaaatattatattaatatatttttcaagtttttaataattaaaacccaatcaatcaaacgttaataccactttattttgcgtaaaaaacttaatctttatcttcatctttagaagaaaaacaccccatatgatgttgcttgtaacaaatcacatggaatgtgcactgactagtacatatatactttatttaattgtttcagatcagacaaagaaagagtaactccaacacgaatttactgagaatgaggagatggatgtccatgaataactactctctccatccaaaaaaaagacaaaccctgagtttccgtgtccaacgtttaactatccgtcttatttgaaaaaattaagaaaaaaaattaaaaaagacaagtcacgcataaagtattaatcatgttttatcatctaacaacaatgaaaatactaattataaaaaaatttcatataagacggacagtcaaacgttggacacgaaaactcaggatttggcttttttttttttctgacggagggagcacttttggaagatgttgaaactatctgttggattatgttattttactatgtaacggactgtacaaactacctgttggatgatgttattttgctatgttgacttgttgagacaatttttggactggtgatatattgttaagcacattggaatgtttgaaacctttgtaatggactgtcaaagctatgtgatgaacttgtaatggatttattggtgtatgcaattgtaatggactgattgatttgcaagatgacttatttttttttttgaaaatcatgaattatctgactgcaaaattgtgctcggagcgccccaagtttttatactccaaattttcgatcgaaattttcatatttgaattaaaaaaatttcggaagaaaaaattccgaaatttcggttctttcgcccagaaaaaaaacgttttgtaactgcaaaccctggcgcggcaaaggaggagggagacagaagggaaagaaacgcgtccgtcaacgctaggccacctaatgcaatgcggactccgacgccaagccggtttggaattggatccataatcgatcggtctatatattggcggggtggaccgtgggccgaggcgaggccagaagctgcttccattcgttgccacgaggaaattaaagcgcacgcaacggatcgatcgagaggcgcgacatccatgcagaagga

SEQ ID NO: 47447 - DNA, 1433 bp, Oryza sativa
tactacgtccattccaaaatataaccatttttatctataaatctagacatataatttttatctataaatctggacatacagttatatagattcatagttaaaaatatttacattttgggacaaagggagtagctagctagctacttcaactacaactgcatgtattataggccctgtttagattttaacttttttcttcaaactttcaacttttcaactttttcgtcagatcgaactttcctatacataaatttttcaactttttcatgctgcatacgtaggtggtgtgatgatgcacggcgtccgatatttgacgtcctacgcggagtcttttccgaagaaacgcattgtcgttcgcgcgttccgctgttccgcacgcgtgacctgatgcgacgcggacaccgacaccgagacggtttgggactggatcagagtatccgtctatatatttcattcgtcgccacgcgtcatcagatcgatcttcctagtagtgctgatccagagacgatcgatccatggagcaggtcgcgccgccgccggtgcgatactgcggcgtcacggaagactacgagcagcagttggacgaggagccaccctcaccgctgtccccgagccgggtctcttccccgctgccgctgccggagcagaaactgtccaccgcatatcttgtggagctccggccgcggcgcaagaacgccctcataaacaacggcccacgctacaggtgtggagatcatgggtatcccatatctacacggcgatggtattcgagctgggcacaggatacctaatgtagatagaatttcttatttgtatcttgggtttgtttcttaacttgtgtatcaaggaaacaccctgaaacttagtcggttacgactgtatcttacctatattttcatattccgttagggatatagattatcttttgtaacccggactccttcccatatataaggggggtccgggcgcctctaggggcatatgttgatttttctcgaatcatacaatcaataatacactcggcggattcatccccggacaggagtagggtattacttcttttataagaaggcctgaacctgtataaatcctttgtctcaaaacccatacacttttccagcttgatagccacccccttttattattgccgaaatctagtttcgacagttggcgcgccaggtaggggtagcgtcaagcttttcgccgatcagtgcaatgggtcctttctccggcatcgacgacctcgtcttcccacccgggcagacgtttcggttcggcagcctcgacttcgtcaccaacaacttcggcaagatttctctccttgactcggaatcggaccagtcgggagagaaccggatctcagtcccgtttggattcccaaacgcggctgaaacctacttcaagaccatctcaatcgagtcggcttcaaacca

SEQ ID NO: 47448 - DNA, 1484 bp, Oryza sativa
aactaggatagcatcatcaacatcagaatcgaagaaaggatcaaactgaggctgtacattctcctggccagggtcaacacctatctcctctagagtgactaggacatcatcatcagcatttgaatcgaagggatcaaatcagcctctccattgccttgagcatctatggcagcactgtgatcgaatctagcctctccattgccttgagcatctttggcagcactgtgatcaaatccagcctctccgggatctgtggcagcatatgtatctcccggttccaaatttaaatcaatatccattgttctttgctctcgaccttgacaaattccatgggttgtagcagaaggtgatgttcgttgttgtatagaaggagaccttatccgtatgctaggggacagtaacattctgctcaacggggttctaaagaatggcattgccacgcagggagacttcctttttttgcctcttttccctccaacattggacccatctagtgtaaccctgcaaaaggtgttgcaacgaagttgtcatgaatgcacattttggattataagttgcatcaaatgttaagagtgaaaagcatagtaaggttctgagaaaagataaaagcatccattctgtaagacatctagtactggttgtatagcataactggacagacaaccatgtgatctaacaagaaattatacaataacaagaactccaatttatgaagcaataagataaggaaaagacttatgctaaatgtttgcataaactagaacaaccagcaacagctccctgtaaatagaaatacagtgctatttccttgctctaattaatcgaattttgcacaagcagtagccatgaactgaactatgtgaggttagatgtgaaaattcatttaacctcgcaatagtgagcatctatagagttttcctgaaaataacacattttaggaacacaaaatacatcatcgaaaaaaaatcgaatacgaaccttggagagagagcagttgaggacaaagccgcggcagcgaggcgctcgacacgatcctctgcaccgccgtcgccgacctcctgagccgctttcttccatggtgtgacaaatttgcgacgtctacctaccctgccctcctccttcgtcatgaccaacggcgtccaggaagaacacccggtatcttccatacaaaatcaagaacggacaagaaatgaacaaccaaataaacatggtaaaaaataccagaagacaagaaacacatggtaaacaacaaccgatcaattcaaagaaactactccgtaaaccatacactgttgtccaggaatcagatagaatttatcattttaatttagttctgctggtgtagctcaactatagtgtcagcattacattaggcacaaataatgttcagataatatctactttatccactgatctagctcaactgtggtgtcagcattgcattagtcacagattacctaggtaaaactgctaattacaagtga

SEQ ID NO: 47449 - DNA, 1005 bp, Oryza sativa
cacttttgtgattagaaaaaaagggctcgatgcatcggctcgaaattaagccgatgcaccgagccaactctccatcatcatcatcatcgtcacaaatcaacatcatcccatcaactaaacacaatcaatatcatccaaacacaatcgcaaaaaatgtccaaacacaatcacaaaaagattacaatcacggtaatcccgcggcctcccatcgtcgcgtcgtggcggagaggaggccgcacccaccgtggcggagaggacagtgataaccgaagatctaggttgccccccaagtatttaatgggacgacgttggtttgtaagggtctgtttggttgctacccgaaaaagttgtgcttctggatgtacggatttaggatttatttgactcttccattgcgttctctcttttttttttcatgctttttctttcaagatttcaatcctcgtaatgtacgcaagatttgtgcttgtgcatgggaggttagagtaatagatggatcttagttggatcttgtgccaacgtcccattaatacttcatttagttgtataatgatcaaaggcataattgcgggcttaattattcactttatagccaattttatctttttaaaatttggcattgccaaaattttagcaaattagcaacattagtaagttttgataaaattggctaaatatgagatatgaccaatatttaataacaaactaaacgccaccatatatttatcaatttaccaaacaataatatggtttaaaatattgtttaaaatggtattaatctgaacagacggccatgcatatttgttgctcaggcagcaataaccaaccaaacaagcacatactcaggctgcctgaccaggctagatgcattgtcttctcatatgccactcaggcacacagaaatttcaggcatgttgctcagggtagcaagcaaacaactcgtaaagctccagggcaaacagctcgtaaagctccagggcagactggcagtgacagccggagata

SEQ ID NO: 47450 - DNA, 7074 bp, Oryza sativa
  unsure (1)..(7074): unsure at all n locations
actcataaattgaattattatactgcaagttaattattttgctatagttcaacttacaaatataaacatttcatatgaaaaatgagaaaatactcatcgatgacgggctttagttaatgcccgatagagattaagtcatgtagaagttgaatttaaacttgcatatttgtgaagtgttatatcgcatattaatacaccttctcaattatttttaatttttttataaccattttagtgacatgcaaacaacaaaaagatatctcctcgagagattaaaataatttccccgtcacggctacgaggcacttggaggcaccgcgctggacgccggagacgagccgttggggaagcccaatcatggtcaagctgaggaaaacgaggcagctcccgctgacgcctgacggacgtggcgaatgccaacaggagtgagacaatgaagcgcgtgttgtcgcgtgcttcgcctcggtggggaggcagagcgaggcggtcagcacggtgaagccgaagacgacggcgatgccgctggccttgatgttcgccttcgccttggcattgcggagctcttcttcctccttcctcctctctgtcggagcaccgccggcctgctcgtcctacattggaaagtctgtggatgaccaacgggtaatttgtaaatacagtggggaaacaattttttttaagaaaaaggaaaaaaggcaaaagaaatgaaagaaaggctgaagtgataagttcaccggccgtccctcaactttatgccgagtctgtttgaggtcccctaaccacaatatccgaaatgtgtacccctaaactatataaaaccatccaaaaaaggtcccgaggcagtatagatgcctgattttgctgacgtggcatcctagtcagcaaaaacaattaaaataaatatgtggggctcatatgtaagtgagagaaaatagtgtgggccctctcttctctccgcttctctcgagcgggcattgtggcagatgggggagaggtggccagcagtggagcaggggcagcggagagacggacggcgcaacagtgagctcagcggcgaaggagaggagcagcgcgtggcgtggcggcaggagagacgagaggactggcacgcagaggccgagctgctgcgccatagcgacggcctcagcctcggctttgccgtgatggacgatagcgccacgatgctcggtgcgctcctccatgccgcttaccgacacagcgcccgccctccccctcccccaacccggtcatctgcaacagcagcttcaacaacagcagtgggagcgagcatttcgcccccctacctgcaggaggaggcttcctcatcggagagcagcagcatgtgttgccggcgtcctacgccgcggcaggtgtccgattcatggccacgggagaagaaacgccgcagagctttggctttggcagcctcttcaatggcgatctcctgcaggaggcgaacgggagcatgtatcattatcagcagcagcagcggcagctgggcattgtgccctcgtcgcagccactgtcagggactcgagtgggctgcacatgggccgctggctgcaccacgggctggtcagcccatcgccaagaagcccaagcaaggccaagctgaaaattatatgagcagcagcagcttacaggagatggatcgaacagattcatttggccaaggcggcgaacgacggcggcggcgacctagaggctggctggcctctttgtcgatctctcctctatctcccttcttctctactagtatagaagctactagaaccttctagcccttgtatccttccatcttccacctcagaaccactccactattgtaacagacttggttgttccctgtgttggatttggcactgctatttctgaaattacattgttgagtgggtctctaacaatttggtatcagagccaatccccaccaagctcatcaagcaagctgccatgggaagtgaggacaagtttaacatgcttttaaggatgctcgaagagtgcgagcgaaggcgggaggaggcagaccaaagaaggagagcagatttcctgtctctcaaggcaacaatagactcgtggatgccccaagaatagaagaaagctgaagaccttcagtttttggttgaggatgagcagtccaaggtgacgcccaccacctgttcaatggagtgccccaatggcagcagcccgagcacaacagcgagatccatctacgacgacgagggggctactccgacgatcatcctggagcttggggatggtgaggggaaggatcgcatgcccttcatcattagcaaggacctttccgagttgacgcctatcatgtgtttgacaatatgctcaagcctcgacgtcgagcctgatttcaccgtggctgcggtggttacatgctccaacactgccatggactccaaggagttggtagccaccgatggtgcaaccggcaccaccaacattgacccccgtgtttgttccaaggagacgcacaccaagtgtttgttgtttggccccgatgtcaacggtgtcactgatagaggtgtgattgtgttccaaagtaggatgggtgtgttcaaggtcgttccgatatcaagtcagtccatggagttgatggttgacgagaaagcaacctgcactgacaccactcaccttcccaaggtgatgcacccaagccatttgatgttgggccccaacgtcaacaccggtactatccaggctggggttgcgtactcactattgcttggcgcgccagaaggaatagcatcctcgggaaaggccacactagtcatggcacaaaagcttaactccaatttctgcctaaaatgggtggcgctcaacaggtgttcgaccaaatgctccaagggctacaagaagctgttgatgagtcatcccaagagaaacccatggccacctccttgctcaggtagagtggttagaagatggaaggagtggtattgccttgggctgcgggcaattatttggggataatattttatttcatgccaccatggccaccaccaactcaaattggaaccataatactttggctgctggtaaacacatggttgacggaagtagagctgaaaccgtggcctgacccacaaccaagtcaatatagcggaggcgtgatgtgaactgagcaagtcccatagcctgcaccagtttttgcacatttgatgggatatgatttttgcagtgcaaattgcataagagaccaaacaccttctgttgcactatattgtgcacctaaaggagatttaaatcatgaaaaatctgatcgagctcataaggatacattggtggcaatatttaacttggaacagttccattatgtgggtggtgaggaaaaagttatagagggaatgttatatggcctaattacagtaaactgcaactacttgatcattcctgctgctacaatgacaacaacatctactcaaaatatatatatggagcttgttggttggaggctagagaagggttaaatgatatagctaagggaagaacttacaaaatttgtaagtccatgcgcatgacacttaatcatgttgagagctggctacagaacccaacaaacatattatacaatggtcagttgtttaactgtccagtgggggtacattttggggtcagaaggatttctgagattattgctagaggtgctggtgagaatcagaataggaaggttaagacatgtagttatgattccatttttgatttctgtgagaataatcctagtgatggtagtgctgcagcaaggttttccattgatgggattgataccaggacagattcagagatgatatatgcatcaattgcaaacagggattattggtctgttaaattattcgaggtcataaaagaggggtgcccaatacgccacttgttactaggtgatgtcaagatagaacaattgctgcaatgtgagacattcagtacaagacagacaaatatagagcaagttatcaagctacagctgagcaattccaaggaaatacaagagctacaggtaccatgggatccaggaggttttcttcatcggcttggggacaagccaaatttcaagaagaggggattgtcaaggactcgggtgggctgcacatgggccgctggctgcaccacgggctggtcagcccatcgccaagaagcccaagcaaggcagctgaaaattatatgagcagcagcagcttataggagatggatcgaacagattcatttggccaaggcggcaaatggcggcggcggtgacctggaggctgcctggcctctttgtcgatctctcgtctatctcccttcttctctactagtctagaagctactagagccttctagcccttgtatccttccatcttccacctcagaaccactccactattgtaacagacttggttgttccctgtattagatttggcactgctatttctgaaattacattgttgagtgggtctctaacagccacatcatctgaatgtgagtagtgatgacaggagcaaaaaacctaaattgaatctgacatttaccattgttcttccatcattcgtccagtggtaacattttacatgtcttgcatcaccgcttgctcgccggcctccccatctccttcctctctgcttctcgtgcctcctcttaaagcggcgttcgttgacgttggagctccctccttgccggtcgtcgacagtagccaccgtcgacaaccacgacagtcgtgcgcgggcaagaaagagggaggtaacatctgccgccggccgtatctggcgatcatccgtgcccgctgcgctgctcctctcccctgccggtgcgacacgcgctcctcctctcctgtagtagtagtcgcgccggccgccacctctcctcctctcccgccactgccatcgcgtcggcctcttctctctccctctcccgccgttggccgcctctctccccctctcccgccgcctccgctccgccgctggccgcctctctcccctctgtcaccacgccaactcgatagaatcaggagagaagaggaaaaataagaaaggagagatgtggggcccacaccattttctctcacttatatgtgggcctacatatttattttagttatttttgctgactaggataccctgtcaacgaaaccagacatctatactatgtcgggacctttttttagacggttttacatagtttgggggtacacatttctggtattgtggttaggggacctaaaagagactcggggcctgatcggttcagttggctgcggcgttttggactgcagctgtccagcctagacgatcggctgcaacccaaaattctacagcaactgttatgttttgaatgtgcacactgctgcaaagagcagctgcttgttggttgttaggaaaaagtatatacgaagtccctcatctcgtcatcggattacaaaatcatttcccaaccacaaaaccaggtatataacatctctcaaaatacaaaaccggttcactctaagtcctttgacggttttaaccgatgtgacagctgaatcattgtgggacccacgtggaccccacatgtcagggtgtccatgtcatcatctctctttcccctcttctctcccttcctcccactcttctcttgtcgtccgccacgaaggggtcgacgatgcatgccgtcgtggcgccgctgccgctggttccgggtggcgcgggcaccacaagcatcggcgccccggcagcggcattgccacgttgctcgcgctgccagagaacgcctgctcgttcgcggccgtcgacgccaccatcgcgtggctgtacatcctgtcgagcaccatcatgcgtaggccctggcccgcacgtcggcggcgatcccgttccgggacttcacgcactctatctcgtcctatttcttctcgatcaaaacacatcccaaaaatccgagaaaaatcaaggaggagcgcgggatactggcgcatcctcgtgagaaattcaggctagatcgatggcggtagagggacaggacaaaataagaaaagaaatacagtagtcttctagcaaaattgttgtgattttcgtctgatcgagacggcctctccatctcgatttgtattctatgttctagccttcagggagctccagagcatgcatgcaggcgactaggcgaggcttccagggttcgttctgctttgaattccgcctcgataaggttactaatctctacccttggtcctatgatgaggcagccgcaacgccacgcnntgcttgcgctnngccgtagaacgcatgcgcgttcgcggccgtcgactccgccgtcgagtggctgtacatcccgtcgagcaccagcatgctgaggtcgcggactggacaagcgccgtctcccggtccgtcgacgaggggtcggacgcgtcgtgcattggcgccgacccggctgggttgcctgctgcccgtgctcttcgtcgtgaacagggcgagcgccagctgctgcctgctgcccgtgctcttcgtcggacatggcatctccgttcaagttaggaagtcgggtcgccgtcgggagatgagcgggggcacctccggctcagcaggcaccgtctccccggccagtctacagtggtggacgcaggattaaaataaaaatgaggtgaagatgctcatctcaataagaacaactaaacacaaaaaaataccatatttatattgtaatcatataaacatatagtataatcaataaattaaggcaaacaaaaaacaaaaatgatattaaaatagagtaataatttttgcgccatacataattcatcatacataaaaatatactagtaaacatatcaatttgcaaatatgagttaattcataaagcatggttgatagatatcttttaaaaagtaaatatatgagaagatatcgcatacccagaataagatgattattattttgcttagattagaagggagagagagaaaaacattaggccctatagtaggggacgggggtgagcaatgttgaggaattgagtcgggaaagcatcacatacgcaggattaaaattggacacttgggctgcttatttatgggccaattgtgatatggagggttggggcggctcaaaaatgatatggagggtt

SEQ ID NO: 47451 - DNA, 726 bp, Oryza sativa
tggattggtttttggtttctgatttttggatccaaattggattcagtccatggatttctttggatgcactagacagtccagtactctccaaagtccaaacctagcgtcatcagtcgtccacggctccactccttccgccgctgccgctccctccccttgcttcgcctcctccacctctccgccaccgtccgcgaatccgccgccaagccgtcgccggtcagattccctcccccaccaccattgcttttctttttccctggtttttctcggtctttgatatatcctggttgttttgtttgtgtttttttttgggtctcttcctgatcttggtggttgcgggtacaggtgaagcagaagaagaggaaggtgcgtgcgccgccgggcgctggcgaggatgtcctcctctggcggtccggccgcgtcgccaatctccctaagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgcaaattatttaacatatcattacagattgagtcctgatatgattttgagatgcaaattaattctatggtcaatcgaattttagtgtggg

SEQ ID NO: 47452 - DNA, 951 bp, Oryza sativa
tattgctgttacctttttcaggatattacggctccgagatgtgccctctactgtcctgaaagctatgccatgttcgtgcaatgtatttgttgtgtccaggcacagattgactattaagtttgcaaatcaggctcgaacaagcagtatgttttgcccatattctctactatttcttttgggaaatgcaatggtgaggcactcattttgccttaaacctttctattttttgcagagtcaagcgcttgtgtaaggactcagtcaatcagtcataaatcattttcccgaatacagaagaactggctgctagacaaacaatctttgcatgaccaccctgaggatggaacaccaaaatcttctggagatacgagttatgcaggctctcatacctgcagctctcgtagcacttctactaatgctggtaaaagttcaggaagtcatggaagaagcctttttggaagcttagggcgaaaaacaccgggcagagatgtgaacacggatcccgatgctattggccgattgaaggaaatcccttatgttgccttgagctcaattgatgaggtcagacctgtttccagccttgaaaatattctgactagtgttggctttcataagctttccataagttgtattaattgtgattcaattcttagcaggatctgcagtctcaaccagtagatgaagtagcaaaactgagaaaggaattgcaggatacgttagtgatgtatgataaagcttgtgaagatctcgtccatgccaagaaaaaggttagtgatgtgtgataaagcttgtgatgatctaaccaagataaggttaagttcttttggctgctgtttggcttgagttactgtgaccagttttttacattactaggtacatgaagatatctatattcatatattaaaagtgaatgttttaattagcttttttccatgttactctgatgtttcagat

SEQ ID NO: 47453 - DNA, 722 bp, Oryza sativa
aaagtgaaagtaagcaagcacacatatataccaccagcagctaattaactgatcaataattaattagattcatgcaactgaagcgttttcaatatgcatctgggcaactaattaactagctaaatattaatcctgtgtgttttcttttgcaattacagattgcaccgtggagaactgcatcttctgcaccgggatgtggcaccctctgtcgggtggcttctgtggatacaagaggaagaagaagaaccggagataggctcttctgcaattatcagccactgaagctgcatgtctcgtcgtctcatctttcttctaactttgttttctagaaataaattgggtaccaattaagtttagttgttatcgatgagttgtcgctttgatagatcgcgacgtagctggctgccgtgcttgcttgcattgcttagtatacatatgtgcccaaattaatttatatgtaatttctgttgcttgcttgaagaattaattacttcatcagtgcgtttaattaatttcatgcgtgtgctacattaatttctgttgagcttttctccatttcattatgcttgcgaatgtgaatatgtgatcggttaagtagttttggcagctgtcatagacttatagtactctcaattccattatatttggagtaatacatatggtatatattaattaacgtacccttgaaccttgatttctacttcccattgagcaagctacat

SEQ ID NO: 47454 - DNA, 1076 bp, Oryza sativa
catgattgaaatacacagaacatttatggaggaatcatttatcactattataccttcagcacctggaatattgatcaaaggatcgttggctttaattaaccaatctttcgcacaaatgagagcttcaagcatttcaggtgttaacgaacttcgtgtgtcaccaagtatcctgcccccacaactgaatgctgattcggaagatacagtgctgaggggtattgctaggaaatctctggccatagatgacaatactgggaatttttgagcatgtctcttccaccagtccaaaacatcgaaactctcactatcctcctcaacatcttcttctaaatatatggcaaattctgatttcgtttgccgtgcagttctccttcgagacttgtataaagcaaactcttcctcgagttttcttttcccaagaacaggtgatccaacactgttgctgccttcacaagaatgtgaaagcatgtgttcatcatttcttcttacaaacccttcgtatttttcataataatccttcaaccaatcttcagcagaacccacttttttgacaatctctgtcacactgttagatgttttctcataaaagaaattcaaataatctccttttcttcttggatctaacattgtggcaatgacaagtgcagagttaaacccactgtcccaatatttgacaaactttgagagcatagctgcagccaatacctttaaaatatcactagtctgccaatcagggtcattcaatgcatgacgaatttgtagcaccaagggcaagaacctatgtgctgttggtttcctatctgctgacaccgataatgtagcttcttcaaaagctttaagaaaagcacaaattgattcaactttctgccattctagttcagtaggtgcaacttcaccatgtagatttgcatagctatccaggacagatatgtacattaatccttctacaatcattttataggtggaattccatctagtcggcgtatcaaaagaaaaactcaacttcgaaggaagatttttcgagtttgccatagaaatgaaatcttgcattcttgatactgaagaatctaaatgct

SEQ ID NO: 47455 - DNA, 716 bp, Oryza sativa
aaactgtcgttggggagggtttggggatccccgtgcttactgttgatgaaaaatccgcgcttggctgatggtgctagaactgtattggcgcgaactaagtcgacgaacacaacggcctgagagatctgcttagctccagtgcaagtccaaaggttcatgagatacagcgtgctaccagtttgatcctgcaactgacaagatatacaaatagcagatcaatgagccgatcggctgataagccgatggagtaattccagccgatgccgataccagccgatagcaataggattttgagctatcggctatatgtttaatgtagaatatgacacttgatgtaaataatgatataaagacaatcggttgatgatgatgtaataaaataataatataacagtattccctctattacagattataaggcattttgtcccatcatgattttttttcctttgtcctattctgattaaatcacgtccgatatctttattccaaaactaccgtcctgattaagataggagccaaaacatctcttgcctaccgcaagacctatcttgcatcttcccaactcgtgtttgtgtatccaagactcccatcctagctccaatgtcttccaatcttctcccaaatcacaataccgactagggcacgaccgatttgcctcctctgctagggactctttgtcacactcaaggagtcccgacgtcaaggtcgtgtct

SEQ ID NO: 47456 - DNA, 717 bp, Oryza sativa
tcatccaaaccagagcaatccaagaggtcgaatgtactgatgcagccttgaacaacgccgacgtagatgagacaattgcctgggccggcggaacattggacttaccccttcgccggagatcgaacaccgatggagccccgcgtcaggtgccaagtcccgttggacaataaaataaagtagaaaaggtaaaaggtggcgatgcgccgaattgtattgattgtggagattgtttacaatgaccccggtgttgatgcgaaaaacacacactggcctggaagatctgcttaactcctgtgcaggtccaaaatcttgcttttaggttcatgagcgtgccagttgatttgatcctgcaatcaacaagaataaaagacaagaaaatgaggttaaatccataaacgataaccgatcggctagttgccgatgatatatcatttatcttcgagccgatgtcatgttggaatcgatcggcagtaatgaatgaataagataagactaaatctacttggtcggctgtagatattaacgacatataatctttccttcgacgtatgtttaaactaagtgattgggatagattggtcgccatgccgagacagtataaatcacttaagtcgaaaaatacattaaagcaatgattatataggcgtttatagcatagctggtcagatagaactagcatgtatcagctaatactccgacaccactttatactaagat

SEQ ID NO: 47457 - DNA, 953 bp, Oryza sativa
atgttgtttgaagttgtcatattttcaaattcaaatttaaacggttcaaaaaatattatatagaaaaatgaccaaaataaaagttatagatcttgatgagttatacaactttgttattgatgacattttcagttgaagtcgttcactaacaaaaaattctgtttgaatttctcaaactttgaatttcaaatttcaaattgtttaaatagagtcggatggagaaatgaccaaaataaaaattttgcatctcgatgagctctacaactttggttttggtgacttttccatttgaaattatttattaaccctaatttttgttccaagttgtcaaattttgaaaattcaaaatctgaattattcaaatgaacttatttgtacaaaggaccgatacaatagttgtagatctcggtgagttatacaattttgttgtttaggatttttgatggttgtgtatgtgaatgaatgtatatgaatgagggatgttggggtgtgacgtcctagcctagggcttaataggattaatagaatactcataccgacaagttacaacttctcttccggaagctgatctccaaagaactttgatgttaagcgtgcttggcggcctgagagaggctagacggcatgcctaaaaataaaatttattttttttgggattatactcatctgtgactggcattaacttaggcccgattgagatgactcatctgtgacgggcattaacttaggcccgattgagatgactcatctgtgacgggcattaacttagacccgattgagatgactcatctgtgacgggtatagttaatgcccgtcacagataagggtcatctgtgacgggctatagtttaggcctgattgagataggtcatccgtgacaggctatagtttgactgatcgtctgggtcaaaactatcggtgacgggctttaattatggcccaattgagatagg

SEQ ID NO: 47458 - DNA, 989 bp, Oryza sativa
catattaaatgaactcatatggaaaagttatcaaaaacaaagttgtacaactcgtggagatctaccaattttcttttggtcatttttccatccgaggttgattgagctatataaaatttaaattttaaaatataagaaagtcaaataatattttaaagcaataaatgatttcaaatggaaaagttttaaacaacaaagttgtataacttaccaagatctacaacttttgttttggtcatttttctatatgactttgtttgaacagtttgaatttgaatttcaaattatgacaacttcaaacaacattttcaaatactaaatgatttcatctgaaaaagtcatcaataacaaagttgtagaactcatcaagatctataacttttattttggtcatttcttcatccgataaagtgatttataaaattgttcacaaaaatgcacatatctcttataaagtttataaaactacaagagagatgtacattttattaacaatcttataaataaccttgtcggatgaagaaatgactaaaatagaagttatagatcttgatgagttatacaactttgttggtgatgactttttcagttgaaatcaattactggttcaaaatattatttaaagttttgaaatttaaaattttaattgataaaacaaagtcacaagaaaaaataaccaaaataatagcagcaagaacacaataacatgatagagcatgattttagaaatatttagaaaaaagaatcatctaatttggagttcatagttttaaatttttgaaattttatttttgcatacggcttcttaagtggccagtataaaaaaaaataatttttccatacgggcgcttaagtgtcatttttacatgcggtcctcttaaaagacccgtatgggaaaatcgatttttccgtacgggccacttaaggggacgcatgcaaagacgccgctagttatgctccgtttgcaaaaatcaaggggtctcacaagt

SEQ ID NO: 47459 - DNA, 27318 bp, Oryza sativa
  unsure (1)..(27318): unsure at all n locations
ccccaaatgaatagtttgagggctgggattaaaggttagtacactacactactatatactgtattgtacattttacacagaataaagcatgtgtgctttattccagtagcatcttctataagtaatctcccatcaagaactggagaaatatatacatccaggaagatgggcctactgcactctgcagcagattgttcctatgctatttgtttatcagtggtccttccttgatgacctagaacctggtctagatgtcttcagtgcctctgcaaatttgtgaatcttcttggcatcttcaggaaccgtggcttcaccattgccaaggtgagaactatgcccaaaattactcactctcccctccccaaaagacacactcttgaccccaagatggaggtttcttgcatctgcgatttccttgctgagatgtcgagcactttggctgtccatagaatgccaacgggagccgtgattatcatgctgttgattgccagaattaccaggttctgtcatgaatgaagaatagctatcaattgactctcttccattgaactcgtcaaatgaacagctcgaaatcgatatcctcctctccagagtaggaatggttttgttctccttttcttttcccagtaccaatttccgaagcttcgaaaagaactttttcttcttagggttcttgtgcttgttcatcagtgagacatcgatcgacgcgtcgtcgggttcgcctaatgatgatgctcttgaggaagagtactctgaacagaactctatatgatcaaagtttttctcatccggaccagcatttgcgtactccattatcagttgcttggccttctcttcagattgggggcttagtgtcttgctaagatcccttgcaacatttttccctgatggagcatcctggttcctgagctcgtaacgcaggcaagcttgatccatttcagatataccaattcctcaacatctgaaaacctgtcagtcttgagctgttcaacctcttttgccagcttgtcattttcttgcctcaaatgatcagcttcctgcaatgcttttacctgcaaccaattttacttgttcagttcctgacagagcaacacaagctgaagtaaacactgaaaaatgagtttgaaaaatcagtagcgcttatgagaaacaattgattgctctttcaaaccaaatatcaagaacagcgtttccttctgacgagtaacaacctctatctgaagattaagattgattagtaagtgccagctacaatacagttcaagaacagtaaatattcacctccatgttattgatgggcttgggtacagggggcaggcgtgtgagctccaatcgcctggcaagatgtgcattctcctgctgcagccttgaattgacaaccctaagctctcttgcctcattttccaactcctctagcttactcaatttttcctcaacctcagcactgaatttcccctcagtaataatctccttacactgccaagaatcggccatttcctgaagtgaggcaattctctcctttgcttgttctgcatcctgtctcagcttcttcttcaacagcttgcatttcattctagctgcctcaagctctgaagccagctttgagctttcagttaactgagcctgcagcctctcattttcagactgcaaggattcgatcttcagcgtgtatagcttcgattcgacggtgttgatcttcagctgattctcgagctcccgcaccgcgacatcttgctcctgcaaaccatagctctctagaagctgtagctccagggtcttctccctttcttgaagtgatctgaccatttctctaagctcaaaaatttccggggtcttcgttgcatcttcttcgcttacccttggtgcaggtgaggttgcaatgttgcccatgtctcggccgaattctttgagaactatttcgttgaattctgggaggaggaattcttcatcatcatcaagagttctacattttgggggcagtggtactaacgcggtggtggtcatcgttgtagtggtagtggtagtgtggacagagtttccattgatgattttggccttggtatcctccttcacaatcaaaacaaaagagggtcaacataaggagaagaaaaatggaatacaatggtaacatttgaggacaagttgtattttgtcaaactgctggaatagaaacaagcagtatgagactaaaaaaatagagaagaaaaaaggttgaaattaaaaaacaaaagcaaagtccacaccccaaatgcatgtgatatggacagacttagagaatttataatataatgaggaaaatatagctggattatgaacagttcaagaccatacatccaaaactgaaccattctaaatataaatggaagtatgaaaagtacattaatatatacaatttataataattatgtgcaaacaagattcttacattcttgaggatcctcagctcatccttgagccctccaccacccttcattccatccgaatctgcaaaaaaacatcaagaaacgattcatcaccaaaattttctaactaggagtagcaatcagcaacaaacaacgggttcacaattccggaacgaaattcccaaaaattcagattgaccggtgggtccgaatgttcctccggcccaaaacgaatcaaatttatttgaaattgagccaaaatattgttcatattccaatttttcgttgaaatttcattttgttttccatctgaaaatctggaatttcttcccgaaatgaaaaaaaaacgttgaacaagacgcctctgctgttgatacctgagcgaggaggaggaggaggtaaccggagttgctgccgtggccgccgccgcgagaggagcagcccggcgacggagagcgcgacggcggcgccgaccctgaggaaaacaacgcgcaagtcctcgctcctccggccaccgccgccgccatctccggccaccttgggcatctccctcttcacctcacctcaccaccaccttcttcccaagaatccaccacatgcagactgcagcaaccaaccagcaatggaaggaacacaaataatctctcctaccttgatcaccaaaaaaaaaagataataaaaaaaatccaaacatttgagcaagaaattgagactttctttttgactgcaagaagattatggccaagaacctgaacctgttcttggaggggctgaaacttgcatcaagaaatacgagctcgctccagccccatgaagcttgcaggctatatctccatggcttcgaatcgaccagaccggggaggagattaacccagcctagccaacaaagtctctgaatttggttttgggatttgtactgcctgagacaaaatccccaaattaggctgcctaagcagcagctaaaattgggggtgtcaggcaaggctccggattcagctcacggccatcgaaaacgccaagaaaagcaaaaaagcaagaaagaaagcaccccaaagctagcaagaaccctccaatctctctcaatctctctctcctatttctgtttgagcttgtttcctttctgtcttggcctgttcttgttcagaaggcaggacaactccaaggaatctggctttgttctctagccaagatagtgctctctactcgtgcagcttgtgctgctgcttttcttaactggatggacaattggagtgttggacatggactcctctctctctctctctctctctctctcttccatccctttcttgctgcttcgacaattgattataggttattaactctgaccagtgttgttgtttacttggccatgtccatttcagctcagttttttgaggaattgctgccgttgggaggagggtggaattgatgggtggatgagacgtggattgttgctgtgggcgtttgacgtatctttcatgtgatttcgtcagaccgtgcgagaatttgccagcatgctcgagctggctacggcctacgaattgatgaaggcgtgttttgttattagtggctggttgtgttaatcacgtggttcatcctctttcagagaataattgcgcattttgcgtgtaagtcgtgcctccagcagagtcttttacccctatgccattaagaaagttgaaggttacgtgtatgccataaaaaagttttgagtctcctgtatgccatgacataaactttcgtttacccgtgcgtcactttggatggaatcagcactaacggagactaacggaggtttgaaagatctattttgcccttgctctatttcagccactttggatggaacatttagaagagaaatcggcggcggcggcggcgacgcccggcggcggcggatagacgaggcgaggcggcggcggcggcggctagagaggtggcggcggatagacgaggcgcgtcgccggataggcgaggcgaggcggcggcggctaggctagggtccgaggcacactggagaaattgcacgggagaggattagtagagatgaaaatgcttcaggggcaatttagtcattttcatacgtgggttccacatgtcagagctcattcgctaacagaaggtagatggaatggcacacgggtaaacgaaagtttgtgtcatggcatacagtagactcaaaacttttttgtggcacacgcgtaacctccaactttcttaatggcataggggtaaaagactccctccagcagggttcacaatcgcgaccctgaatcgaaatccgctcatgagcagtatcatcagatactgtgaaatccatcgaaaattgatgatactgtgaaatccatcgaaaagctgaaaaactgatgtaatccgaataaattgtgtcaaaatttaaaattcagtttgaatactttttgtttgaccgaaaaaccaagtgaattgtgtttttttggatcgaactacaagaactaagccaaccagagaggggtgaatggttggtatgctcaaaaaccgaaacttttaacggaaataaaagttaccctcaaattcgacggagatcagtctgaccgaagttgtcctgctggtctgaccgcgcctgtgccgtcggtctgaccggtgtagatcgatcggtccgaccaccctgagatcgcctgccatgcctgtcgacgtcgccggtctgaccgccttgcgcccgcaggtctgaccggtgcttgccgccggtctaaccgccggtatgccgccgaaacccgatgaaacacagatcgaagaactcttaaagtggatgacgactttattgattctctctgtgtttacaaagtgcaccaacagcactccttacaaaaatctcgactaaacacgaaacccttattcaactatcaactcaattgctttcaaaagcgatactgggaagccttacgctccccctctatttatacccgaggcaagcaacctaaagccacgaaccaaaatcatactagaaatcctaatcaccctaggaaaccctctagtagaagaaataaactttacataaccaatcataccaaatttggactccttccaaattcgactccgcatcccatacgcacacaatacctccatcgtataccatatggaatcttcaccaaccacgtgtattgaactctagtcttagtatcccgcatgatctctgaccaccacggacgtcgtcttatccccaagctgactcccggtccatcaccgcaaatactctcccggcatcccgagtcacctacacatagaacaaacaaagaaaccatattccgagaccaaactatccccaacttgactcattagtagctaacgacagtattacatacgcatagtatccatctagaagccataatcatgaaacaatcacggatatccaaacaaataacccgaaaccgaaaccgacatagagtcggccggtcagaccgcgggctgcaccggtctgaccggcagcacatgcccggtctgaccggtccaacaaacagcagtactcacatgtgaaatccaatcatctccaaaaccacttcgcaaataaattccaaataacaaaaccaataatctccaatgccaattgttcatcacagaataacaattaaaaatacctttgattttacatttttgactgatctagaaagtccggatagttgagttgtgatttaaattcatttgcacataataaaggctagcttatgccaaaatgaagcggaggcttgggccggatcattatccttttagggtttcaccttcatatatatctcttgtaagacgccgttcgacgttctaacctcacctcgatatagtgaagatattttgctggctggcgccgtagttttttcttctgttttaggagagttttccaaaatccagtgtcttctgtgattgatctattattttttatcgtttattttcctatcgtttccaaacacggatttcgtgaaactggaattgtgaacactgaccttgagagatcatctaagtttgactgttaggtggtacagatcaccgatcgagtgatgggaacttctggtgccagtaaagtaaactggattttgtttgtggtacaaaactaaaatcgcaaaattacgatgctgtagaatcagtttgcctttactatattatattattgtatgttgcggatggcttagcaatattgatttggaggaaaattttttaaaaaccatccataagtcacttaaagttgatattccatcccataagttattttgttgtaattgcccacctctactcagttccgttgtaaaatccaccttagtgcgtatgtgtttaactgaatcaacatgttttcataaattataagccatcaatgtggtgtttaccaaattaaatacttttaaagtataatctggatactttttcggagattccacaaatagaaatggtgatgagagcttaaatgttatcgcgttgagattcgctattcagctataagggatcgattcaattaagcatgagtgcattaaagtgtttttttacaacaaaactgatagggaggttgatatttgcaacaaaatgatttatgcggtgaaatgttaaatttcaagtgacttctgatgtgtgttttttttgttgtccttttgttttctgcaattttcccttgattttgtggcagctccatcctttgctttttagccacgaccaaagcttaaattttaaaacttattttagagttaattttgattgttatttcgtcataaatagtttttcaacaccagtttttaagctctatagcacacgtataaaatttttactcataaataacaaattattttgagttggcattacgacttatcagttgtagtcaaagcgattggacttacatataatgttctcatattctttaaccgaccaaaatcgcgctttacataagaactgttggaagttctttgtagtttgcttcacatcaacccactaacttaggccctgtttgtttcagctcagcttaagattattgtaatctaaaataaaatattgagttagattactataaactggattataataagccggcatagaataagctataagctgcttgtttctcagtattattagatgtttgttagttgttagccacccaataatctaaaaagcacctttaaagtggattactagattatagaaatctggcttgtagattgtaataatatatcataataagctattatttgtttcagcttactcctaataatcttaagcggaatcaaacagggtctagagcacttgcaacgcgtttggttgggggaattgttatggggaacgagagttattaaatctattgtttggttggagggcatggaagttctaggatagattgggaagaggggtttaagagcaaacgcttaccttttgagataaatcttagtcctatatcatgacttaaaattcaattcccacccattctttacatgatactcatctttattaccgaacaaaagataaaaatgaaactcccataaccaattccttcaccaactctctcttttaggtcctctataaaaaggaacgggaaaaacgtagaaattaaagtagattatagaaattgaaaatatggtaaacagagagaaaaactctttgattacaccacaagagacactcaacaaagaaaagtttcacaagaggtctaaccgcttgcttattttcctatgaaattgacggtagaaatgcaatcctatgaaaaattttctatcctcttcttatgaatcaaagggctttatagaaaataaattctctaaaattcatttgctaatcctcaatttcaaaggggctaaaaaaagccgttgtggattgtgaaattggtttgcatcttggagcatcatcactcacgccgccgcctactccttccgtcccaaagaaaaacaaaccatgggtttccgtgtacaactttgactgtccgtcttatataaaatttttttataatttatattttcattgttgttagatgataaaacatgattaacattttatgtgtgacttttctttttatttttttaaataaaatggacggtcaaacattagaccagagtttgtcttttttttttttcggagggagtacgtaggtactacagtcccagaagaaagtggatcctctcaagaaagaagaaaaaaaaataaataaaagaagacgaaaaaggaaatcgtcgtgcggcgtccgctcgtcgtcgactcgcgagttcggccgccgccaccgccgccgccgccgccgccgatccccatccatcccgcgagcaagcaagggcgcaggcatcctggtgagcgcccagcccatcctctttctcatctctagaaccacgcactttacttcttattcttctcgaatttgcgtaaaccctagcttctgttctagaaatttgccgcaaacaacagtttgtttgttaaaaaatatagtaaaagtttgcggattccccccattttagatccgcccctgggcttggctagcacaacattttttagtgggggaaggaagggaaaggaatcggtgggtggatcgatgcgagcgttcgcgcgaaatctggcggccatcatccctctcgcgcgctgcaatgcgacggcgacgaccgcggcggcgccgtcctccctcgtcctcaaggtcggcgacacgctgcgcgagcggcggcgcttcacggatggggaggtggaagcgtacgccgcggtgagcggcgaccgcaacccggtgcacctcgacgacgccttcgcccgccaggtgggagggttcggccgcggccgcgtcgtgcacggcatgcttgtcgcctcactcttccccgccctcatcgccgcccacttcgtacgccgcccctctcgtctctctctctctcgctcgctctcatgcctgccagatggtgcaccggcatttcgtcgagcactgcatcggcatgacgtgctggcctggcccttctagtatctgatgctgatgctaatgcagcctggagccgtgtatgcgaggcagtcgctcaagtttgcggcaccggtgtatgtcggcgacaaggttcttgtgcaggttcaggcgctgcacatcagggcctccacaaaacacatgtatgctcaattcatcttttcatttcctagtcatcaagactagattgtttggagtgaatcatcttctttctgacagtgtcaaattcggaaccaagtgcttcacgagtgacagtgatgacctcctagctgtcgatggtgaagctatggctgtgctcccctcgctttacctcagacaacaactgaaccaagtgcctcccatcgttgattaaagactggaagcatcgtcaggagtgggacaatatgtgatttatgttcttttgggtctgtagatgctttgacaagataggaaggctatatgttgttttgctgttctcggtagtagctggctcccttgttaagctggaattcccagccttctgtacttcatcaaacctttattccgtttccaatagaacctggggtaaatcccgttataaaaaaaaagggtacatcactgatggtagcactggctagtaactctcagtgcactccattactctaaatagaagtcccatggtttgggtcctttgttgttaaaacatttataatgtctcatgatttagtcagacagcatcttcaaaactgagcttgcagagcaatttgtttggtttgtgttgctcactttagtagaagatgatgtaaaatctgcactcgtgagcgcctgctcaacacacaataaaagttcttgacatattgttcaagtcatatgggttttaactataacatgtcaacctggttattgaacttttgcatcatgcaaagagcaacataataactagaaagagcgagtgtcccagctcctcagcattatgccactcagccgctgccactggccaccatgccttgtgcatcgttcctaggtctttggcattatgcaatgcctaccatgactctgttggtggaaatgttgatatactaggaacaccattttgaagtatcataaattgaaagtgagttagcactcagcactcaggcacatatgggcattggatcaacgccaaccaggaccagaaacaaaagtctagtgcaagtcagctagtaactgaacaggtagtttttcatctttttacaatatttttctttctctgatctctgttttttcttttcctggatgattggtatttgattgaaatgtgaaatatgaaatcaatgagttcaaagatggcctggttttatgatttagattaacttgaatcaatcaaatatgaaggggaacataggcattctgtctgtctttagcaaagtaaatatgtagttgcttgtttgtatgtcagctttgagcccaaccagctttattcttgccatgcttttctcaataagtctcaagtatgagcattatgagacttccaatttcatcttaataacttcactgataacatgtaaattgacgataggttcaagcctgtaaatattattaacttcattgagagaggcaattgcgctgcgatgagctgctctgcctctaaattctgagaacaaaccaatagcaagaacttagcaaaaagggcattgcctgccctcttgtgctaatccattggtaatgttgctactgctactgctaagtactatactgcctcactagaaatagagaaaaaaatactccatgtgacaaagctaaaactagaataatactatcacatggttttctatcattggtattcagttattgcaactgaagaatgcgaaagttggtatcatgttttagtggcatgaaattaactattacgcgtgataaggaggtggtgttaatctcgtatcaggaatatgtcaggatgatgttaagcatttaggggctgtttggtgcgttgccaaaaattatgtcccttatttggtttgtagccacaaatttggcaatgccaattattttggattggttaagtttggtagcaatccaaacaaccaactctaccaaaatttttggcttaccaaatcttgctatagcaaaaaattggcaaggctagcaatggttgagaagaaacaaacacttagatttttagcttatttccatctttcaattgctgatgttctgggtatggatgctgcatctgtggcataaactaaatgaaatcctctttctcgtaggcctcactcgtgtgccactgcccaaactggcagatcttgataggtggctttgcaatctttggccccctgaacctgtccttctccatggctggggccaccaccacctcctctcccctgcggaggatggagtctgtctgccgccacctcctcccagcatcaccgcctatcctttaccaggtacggctaccttaagaggaactactgcaacttatcctctctatagcctgcagtcccatcgagtacctttctaactagtgtttcttgggcttcagttttcttgtgttctaatttttatgttgttttctgcacagaatccgttaggtgccatcaggctggagtcatctccagtgattattggggggatggtgctggacatccatgccaagccatccatgcagccgcatcctggaacgactgtgcctgggatggtaaaccacccatccagctctttattaacttcttagcttgagcaaactgcttatttgctggtatgcaagaaggatggcatatgtgtgtgattgaatggatcagcatgaccaataatactattcaatgtaaactagtgttgaattcattatatgaggaagaaggttctgcaggatgatgtttgggttgtgatatccataagcttggtactgtatgcatcttattcatacagaggtttaggccataaatcttgtgagctttaacttcttccatttcaatcatttatgagaagttgaagtaggatgttttttttaaacctttttaatttttaattgtaaaaataaacccttccaaaacttattttcaagatctgaaccttttggccatgccaaccaggctggcgtggcaaaacaatactgtcacgcctgctacgggtggtgtgttagtgttgttttgtcatgccaggcgggctggcgtggccaaaagcttcagatggaaaaaagttttgggagggtctacttttaaaattaaaaattcaaaaagttaaaaaaattaaaaaatcaagtaataatgcatttgaatttcctaggttaagtacgtcagtgggggagtagcaagaaatattgccgagtgcatttgtaagcttgagactcgaccattcatgattagtgttgttggaaatgatatggcaggtatttcttttatctatttgtgaagatatagtttttttctaaattggtttactcattttgaattactctgtccttttctgctctctgggtagttatttgcttcaatactttccattttttctactgcaggggatttccttttgaaatactggaggtcggctggactatgtacagatggtaagtgtgaagatattcatattgttgtatacatccttgaaattacagtctaatccttgttatgtttgttaggaaaggctgtagtttttcatgtgtagtgagataataggctcattatttattttatttgcattgcgttactggttgaatatctatagatatgggcctacttttgatgcaacaaccaatgctgaaattacaacagcaacatatttaaagggtatttttttgttctctacaaaatatgtactcctttaaaagcctctagtggtggtggcagcgaatntgncaccccactattgcttttgtagttctgtttggtattcaaggggttcagataaaatgaacttatttcttataaatatatactcactttggtcataaatttttatgtttaggttaagattcagtcaaacttttgaaactttgaccatcaataatttctcaaatggcaaaaatggaaaatggtaagcacagcttgtccttgaaaattactatcataatgtcaaaaactttttagaatttataatattttaatataagattgatggtcaaaattttagaagtttggccaaatcttttcctaaatatcaaatattatgaccggagggagtacatagttttccttctgttagctaacactgttgctaataattacataggaatactgcagattgatgacgtaacaaccccaatagtatcaaatgtgtttgatgggagcggtgaattaattgctggcgttgcaagtgttggggcagttgtaagaattttgcagcacattgtgtagtgttcgatctgtatcaacgctaatgttgacaagtaatcactgtacttatctccatttctttttgggcaggaaaaatttctctctcctagctggatatgtcagttccgtcttcatatctccactgcacctctactaatgcttgatgcaaatttatctcctgattcacttgaagccgcctgcaaaagtaggttattccaccttatttctttacttaggcagtgagctcctaagcttatgtgataggctgatatagctgatactagtatgcatttgaaccaggtagaataaataaaggggttacctaatttgcatgcatgcggtgctggatctttgtgtttcctttccaacaagggttgcagccgacaccactttttcaatataatagcatctgtgtggctgcacctaaccttcccttgcctgcaaacaaggatcttttgttgtcttgtgccaaccgatgagaaagtcttctgccagaagaaatgaaaaagtaataatgtatacaagaaacatttttagagatatgctgtttgcaggctttttatttttagctctatgatataatcttacaaaaaaaacaagaaatcacgaccttacgatttgaaatttttcatctcaagaaaatcatgagctttcagcttgattccaaaaccttttagctcaagaaaacatgagctttcgacttcaccttgaaaaactttcaactcgagaaaccagcagctttctatatccatttggaaactttcaactcaatttgagtaatttggaggttttaactcaatatcaggaattctaagcatctttgaaggctagaatgaaaatttgaagtaagaaaatcaggacaatctctgcaacactgtggaaacgtgaaacctaaaaatttcaaactttcaccttaactctgaaacttttacctggaaataaactttcaaactttcaccttaactaatttaattttataactttcgaacctaataatagcagaaatctgtaattctatcaaaaggggaaatgagtgagaagaatgttcttgtcatgcactattggtgttcctaaagagatttgaaaaataggtgcctttatgttgaacctgtcaatggaacaactgccccgcagcgctcgacatcagtgtggctgatcagcagggtacgaatgagtgcctcgcaacaagcttggaatacagcagttttgagtttcttatctgattaggtgtcaatattcttaacatctaccctattatacttcctctagtcaaaactcaaaaatatttgcggttcccagtaccacataaatttaactggacggggtactaatgtatgcaattctaattgtaaacactccctaattttatagaattgtattattattgaactgcattatctctgactctgagtatactggtgcactactcatgtccctcctgaccatcgttttgaggagcttccttgacaaaaatgagaaagacagtcctgtcaattattacaccattatgtttttgtcctaatctctacattgcatcaaaaagttgatgacatgcatgctattttcttcttttttttccccagtagcacatgaatcaggagtgcctgtgttttttgagcctgtctcacttgcgaagggttcaaggattgcaccaattgcaaaatatgtgagtgcaaaggattgaattggtacttattactatgtatcatgttaaggtcttgtcacttaataatttcctggtgattcagattacttacacttccccaaatgagattgagcttgtggcaatggcaaattcattatctcctcctgagaaatatacttttgtcaaaatggagcagtccaagaacaaagccaaagctgtagagtatttgtttgaaatgctcagcccagcaatgtttttcctcctcgaaaagggcataaagtttcttctggtgacgcttggctcaaatggtgtttttgtttgttgcaaagagagcacaagtttgatggaccagcgaaagtctgaaatgatgtctttctcaactccactacttcaaaaattggagcgatgttttccatctaacatgcttgtagatttgcctagagaaggctcttccagaacatgtgtttttcattttcctgcagtatctgcctcagtggttagcctcacaggtgctggtgattgttttgttggtggagtcatttcagctctatgtggaggtttgggtatgatgcaatctgttgcggttgggattgctatagcaaaatcatcagtggaatctgaagctaatatacctgataagttttctgctgcaactatcgcaggtctgctatagtaatttgttttcatcttgtatagtgtacttctgaaatttcagattagatcttagtgctgtcaaatttattttattgcacaggtataactccttgcatttccatttctcatgcagatgatgcaagaagaacattgctatcagctaaaatgatgtggtgcaaataaccattggtgttatctcgtgaaagtcttggtgggcatgtaatttcctaataccgtttgttgattaggctatatatatatatataaggctgagtgtggattcaggtcgtgggctggtgacaacttagcaagtttaatgtagtagattaaggagcacggcaggtttctaaatttgtttgcatgtacctatgcctttatacttcgtcagtttctgtaggctagtgatgatgccacgtttgcatctgtatgataatgtcacatcagcgtcacgtaggatctcgaaaatggtcgtggcaatcttgaaccagaatgatatattttgtggtactaggagttctggtggatatcactatataaaaacaatctctgtgagacaaatcttaaaactaaaaagacaattctcttagggagtagggaaaagatgcattattttcttttctttgcttgtgatgattagttcatcaagttggtaaagtagcttgggaagtcatttgatacgaaaaagctaaatatgaggaaaataaaggattggtgccagaggactcacatgtatgtgtgtgctcatagcaagacacccttagcactttaagcataagcatttcccaaatttgatttaaaatggaacatcatactatatttttaatcttatccttgagctatgttgagatagatgagtttcaaggagttaggagcgggaaggcgaaaatgctaataaacggtcatccgcgtgcccgctcccctgcgtggcacgttggcacgcgcggaggggaggggcggggggacgcgcgcgtgggagtggacatgtgtcccgctggtttctgatatctttttttctttggttttttccttctttttttttggtttttcttttttttatacatataggatacaaagtttgtatacatgtatacaaagtttgtatacgtgatattatttctaggtttttccatatttttttaatacgtacgtatataaagtttgtatacgtatgtatacacactttatgtataaatttttatacataaaaaaaacgtatacacattaaaatatatatttttatatgtatgtatatatacgtataaagagaggagagagaggaaagactagagggaggagggttgtcgtgtagctcgtgcgtcatgcgcggcacatggatgaccgcgtatcagcaccgcctgcgggaaggtggccatcatccacgaagttgtgggtatccctttactctatacgacattttccttagctgaagggtttgatggctttaaattgacttcgccaaaaggcctcatctccaaagcccagctagcgaggtgtccctctcagtgtagagcagagttcatcacctcgctcttgtgagagagaataaggggaagctctagaggagtgttggagttgctgacactctttccactcttgtacctcgatggatgtttctttttataaaagtaagtgttcatgctttcttttggtatttactcttcttgtataagtaaaatatatgcttatcattgcaggttcatcgcttaatatttatgttaagtactctagtactaatactttggataaaaaatgaagttcttggccaaggctagagtagtaattgataatgcaaacgtagtgtttaggttataggttacatttatttgttgtgtgtttcatgggctatagaggtaggcgacaaatggtaacagccttgatcgtcttttgtagtcctccacattccggtacgtcattgggctgtaggctggattcgcttggcagaccaggggaaagtcggtgcctgaagcaagtgatagagttttaccttaacttaattgaagaattttaacccatagaaaccctccctactctccgcctaccattttgttgttgttggatgaacttgatttcttgatgttatacacatgttccttgtgattcgatacccttggaatactctgaggtgaagtgttacagcgttatccgtgcgcttgcggatttatttgtgatcgtaacaaataccaataagcatttctggtgtcgttgcttgggaatagttgttatattatctttgaacctagttctccctggtatcttttctttttatttcttcttttcttttctttcctgccatggagtagctatctattcaaaactcattctcacatttgactggctttataaccatggttcaggggcaaaatccttctcggggtgcgacagtgaaaacccctaccatcatctacgagagttagcaattgtgttcatgcctgacaatctcaggcatgacgcaagaaactttgaagtggaagttgtttccgttctctctcatggagagggcggaacaatgatactctcataccattaggaaaacaaacggtgaatgggaggaactcaaaagtaggttctatcttgcttttgtcttgttaacctatgttgtctccctacggatggaagttctcggttttcaatagtgcaagaaggaatctattgaagtagcttaggctaggatttcattgttaactcaatttgacccagatttgtctatactcgaccatgttacaatatttcggtttgggtctaaacaaggactctgcctcatatcccggaggttcgtttgcacacaaaaccacaacaaatggaaggaaactcttggatcttgtccatggaacatcttgttcgtccacaacgaaacatctcctgctccgggtactccctatgaacctctagaagataattttttcaaggaaattgtgagggaattaactatcatcatgagcgatgaatggttaagagatgtagaggtttcttccgaagtaattcggactagctccctatcgtccctaactatccaatgtctcgtgatggaggttacagtgaatgttctcgataatcccactgccggtgctaacatcatgtccacaacctttgtattaacttgcttaggtgacaagccccaaattcaagttcttgattaatcatttatctacaattgagttgctatctttcgtgttcttgcttgtgttcttcaatacgcacgtagggattagtcttcttggcaagatctatcgggtttcgacatggttgatactagaggagaagtggtgctgcgattgcagagttcggtgttcttcaatacgcacgcagggattagtcttgttagcaaggtctatcgggtttcgacatggttgatactagaggagatgtggtgctacgattgcagagttcagatcaacgaagtcagctcgtgttgccatcacgagccattagtacgaaccgacaaaacctttcggagttcctcaagtcctatcatagaagtttatgggattctacgtggagtgcctatgaggaacgagaatgtcgaagccaccctagacttccacgtgttcaaagtccctgacttcgatcttctgatcgactatcccatagaaaaacttctataatgtgcctaatccagattgtgcctaaggagttatgacggtcgttgaaaatgccaaaaacaaattgatcccacaacgaatcgtcatgggatggaggatgtgcctagattacagaaaacttagcaaggcaactaggaaggatcactccccgtcgccttccatcgacgagatgctagagcggcttacaaataatttcttctgtctccttgatgactattctggctatcaccaaagtcctattcatctcgatgatcaaagcaagaccacatttgcttatcgtcgaatgttgtacgggttgcgcaatacacccatatcattccaaaggtgcatgatgtttatcttctccgaaatgacgaatgaaatcatggacgacttctcagtctatggaaaaatcttcgatcattaactcgagaacttagacaaggccttgcaatggtgtaaagaaaagaacttgatgcttaattggagaaaaaaaatgtcatttcatggtcaagaggggatagtcctaggacagcgaatttctgaaagagggatagaggtggagagagcaaaaatagaagtaatgaagcaactttcatctctcaacaatgtaaagggaatccacagcttcctaggtcacacaaggttctatcgatgcattaaagtttttttctcaaattgctaaacccctaacttatctgctagctagatatgctccctttgaatttaatgatgagtggttaaaatctttcaatttgttaaaagaatctcatcttagcgccaatcattcaacctcctgattggttgttggcttttaaaattatgtgcgagtttagtaattatgttgttggggtcattcgtggttgaactaaaaacaggaagcactatgctattcgatatgctagtcaagcatgatagaaagcaaagtcagcctgctagatgctgaaagagacattagctcaattctactccctcctttaactaagtatataaaaaaatttagcaacatctaaaatattaaattagtttcattaaatctaacattgaatatattttgataatatatttgttttgtgttaaaaatactactatatttttctataaattggtcaaacttaaagaagtttgactagaaaaaaaagtcaaatgacttgtaatatgaaatggagggagtagaaatctgataactcgctcttttccacgtcaacatgaaggcaggagactcggagaagttctgaacaagagacattctttccccaccatctcatctctatgattagctcaggtaagtttataattctatggtgtccagatcctacaaagaatggatcaataaaacctttttatgtacaaggaaaccaaatctgagactgcacaaggttaacaaatggactataagcatgcatctgtaagaagcaatgtactttgtgtacttcgcttcctctgacgggccgaaaaagaatcaactcatcccctagccttcctttttatcaactcccaaaaactcgagttgccaaaacctctgatgatcaattcagtgatacaaatgccatcactgccaaaatatggttgggtcattgctataaactgcacgatcctggatctctaagatagagacatgccaatcgacaagtcttgcttggatgcatttacataacacaagtcctgttgggaacagccaccagctagtatcatccctgccaaaagtaccaatgcttgtgtgaaaagaacagaggcagagtttttgaggtagcaacagttatggtagagcagtagcgaaatgtcatttggttttcagctaaggttacttacccgcccaaattccaaggttgcatgcttggatgccttttggctgaagacttgtaatgcacaagtccacacgcaaaggccacgatctgcaagggatgaaccaagtgtgaatagattaagaagatccataatggaaaggattaaacttgctattaccattagcagaaagaaagatgcattgcagctgttgtaatgtccttaagaaattgaaatatagctactactgcaatgagtaagaacatcaacataattccatgcaactagttcttccaaacatcaggatttgagctcagaaaaaagatatctaaaatgcatgtattttggtacattacaggctcaaacttcgactcaataagacacatggacttcataaatgtatgctcaaaagtatatattaaaagaaccaagcttgatgggacttgagaatgagtcaagggtttgagctcaagatcagctccactgtgctcgagaaccctggataccttgatgagcccaggctttcttgacacatcaagaagtgggaaaatactgcctaactgaatacactatagcaaactgtaccaaataaaccgaaactgtgtgttactgttcttgtgattgtggatgtatgagcaatgataatagccaaccaaattatataatttccccttttttggaacctaaagcatttgaaatgaactggtaatatcaaaatataagtacagtcaaagatgagtactcacaacattaaccaatgatgtaatattccacagcgcatacacacgagcaagacctgctgaccgccgtggtccatgactaaatagagcatttatcccagcaggaaagggtgccagtatcccaagaggaagaacaaacagcactaacaacacatcgatcatagaatatgaatatagctggagaaaagtaagcaatactaagctgaaatctgcaagaagcaatatagagatcaccaaaccaacaagatcctgcaggaaagaaaaagaaccttggtaagttcaagattgtgtagatccatcataaccaaactaggggttgcaatgatgtcaggatagctgtgcaaaatggaagtcacctgatgcccaactggtttggtattgtgcaatataagagaaagagggtaaaataaatctctcttgtccttgagtgtccttaagttgtcaatgtcgagaactctgccagttattcttttaagcataacagcatcattgttccttgagtggtctagttgagaatcaacatctgtgttctgaaatctgcacagcatggtacggatcagtgggataaattttaatatgataagtgcaaaatgtgcagagctaaagcaaatgactcactgcgcatgataatcaaatttcattctagagccaccttgaaggccactactgaatggtcccacagaatgaataactagaccaaattgatagtaacctagtgctgtagcttggaaccatgcaaggtcaacacgcacgcggtatgtgttcaaagcaggatttgcatgagtttcaagccatttgagtacaggaagaaatgtggcttttagatttccacgacgagccaaacgcaactgggcgttcaatccagcaacaaggcggtgccatattgatgaaggtacaccctgtaaaaatatgttcatgttatatgctaataaaatgaattgttcacttagtgatccagtacagcttgaaatgtttcagaataaacctgactaataagacttgtgaccacactgtcactgtgaagtgaaaatggagccatgtaacttccatcgcctccaaagattaatgacattggcaacctttgatgaagacgaggggggaggtcaggccttttttcatccccaccaagaaagaaatctaaataacccagcattaaatctggtgtagcagcaacctatcaaatggaaaaccagaaagcatacctcaatcatgatgtgatgagactgataattgtataaaaattcataatacaagtgcagttctggttcttgtactggtacagttgcagataatgcacacagaatcaacacagcaatatttgtaactcaattacattcagtgttcccagaaaaaaaacaaaaaactccataaggcaacaagggatgggtgcccaacctcgtaccacgtaagcagatgggtaggctgtatgatcgctacaaggtgggttcaataataccacttaccactttttagaacctttgaacagactttttcttaacagtacagtgacaagatctatctggttattttggacgtctaatgatgctgtacaaggtacatactcttatagcaattgaagattaactaaaaagcttgaatcaaatgaagaacacttaacatacactagatgactgagaaagtaaggctaaacaacataatttcaagaaattccaagataattgatgaaattgattgtcgagctcataaaaaaccactaaagctcataccagggatttggcactgaaaagaacataccttcagcccttcataaagagcacgtgaacggcaagaccgtaaacatgaatgatcatattcagatcgaacaaattcacgtaatctttgtaattttcttcttctgcgccactgttgccaagaccatgccaaggggtatgaaagtatacacaggatactataaattgatccttcccaccactgatatgctgcgagagcatttatctcatcgacaaacttgttaaatgcatcctcatacctaacaaaaatacgataaacataatcttaaatgagacaggtaaaatttgtggcaaaaaaagcaaaaccagtaaagataaggaaaaaagaatgacaaaagagcccaaaggctgaatgcatgttgttcaaaaataatcttgatttacttgtggacagatctacgtacacaatctcagaaatctgctcaggtggggtgtgtggtagatgccaaggttcactgaaggtgttgggacccatgaaatacatcctgtgcacatgacagtgagattcttcggccctattggtttccagtacctaccacatgaggagagatttcaacgaaaaaccagaacaatcacaccacagcttaaagaaacaaattaggaatgcagaatgttctgctacctcattgagtgattcgaggaagggaaaagagtgatcaatttgggagctatgttgagttggtgctggtccaggcaactcatcagtgccaacaaacttcatccgagcgatactcaaaacaagggctaataaaaaaagaaggcctgagagaaacagaccaaacaaccaaggtccaccaaaagtgtatattaactcttcaagagcagtaaaacagtgaggcatgcggtatctatcggacacacatttgtatgggcacggggtttcagtacacctcctgtcaaaaacaatatctaaggttagaacattaaggtaaactggccgaaacatttcatatatcacatgtaaagctaacaaaagttgaagagtttgaaaatgctaaaacatgagagaacagaacttcatactctcattaaaatagtaaacaacaataattatatacagcaacaattccgtctagccattagtttacacaagacaatcagttaaaagcaaggcacttctagcagctaggccgcatggaactttgtggtatgcatacctcgtgtccacagattattgcaaataatcccattagatataggaccattgacagcctataattctttagaaaatttaaaaccatagacccaacgacatatgtatttgcagattagacgccataattctgtcactaaatttatttgatctgcacttgagacgcatacaaaaagaaacaatagaaatgacctcggatgcttatgtagacagcacgatgagggagctcatttgtagggcatggagaacacaaggacttcaaagacccagtaatgttcttatatgttcctaaaggacaggcctgcatcgtgccataaaaaccgttgcagcaaagtgagaaaataagtagtatggcaggttggactgaaaaaattgaagtgcaactatgacatgcggctatgttgataagaagacatgttatctgatttaaacaaagaaacaataagctacaaatatatcaataattcgaaaatagcaaacacacttttgctacaagttaccttgcaaaatgtgccataaagaccttttgggcaatcttttcctgtcactgttccattttcacccggaaaaccttggccatcaacggttcctcctctgcacaacaaataataggcagtatttttttggtcaaaaaggaagagtcagcatactgtttaccaatcttactgtacatggctgcccacaccacacagaatcaaggctctggaaaatgggaaggtgaggaatgggggttgctcctagtttgcttaacctgctctactaactattactccttgaaatattccagaactacgattaaggaaatgtaaggacatccaccagcaaaaagcatcataaacttagaactttaaatataagaatgcagatgtagcagcactttagcatcatgaacagatctagctagtaaaacagaaggaaaaaaatagaacaaacagagaaaacatcagaattaagatgcaccttgcaagtattgatccattaactgttgcaaagggaatataatcatctccagtgggaatgtcagaccagtggaagtgaatccggccacctccacctccgccactaccattacttccaaccccaccagcgctagaaagtacagagccctcctccaaggacaatgccctcacaaatagaagaattgtgcccccggaaccaccaccaggtccttcatttgcagcatgagtcaccgcaccagcaaaactgccaccattcgcctctattgaaccagcaagggagagtagtggaagagattgctccaaagaacccattactggaaatgtgcagatgaaaggcagtaaaaaccagtactactaagagtaacagtgactgaatagaggatgataattgacaaagatccatatgctcgatctctgttacctattataccaccaccagctgttgaagatgatgtacttacattaccactaccactgccaagttcacatggtaaatcagcactaccatatgcagttccaccccctgcatgactgccactgtagaaagcatcccctcctttaccaccatgcccacccccaccactaaggccactgcttaacattcttcctcgtccaattccacctcggcagcctgcagcagggagaaatcaaatctaaattctacaatagtttacagaaggctgcattcaaaagaaagatatcaaaagaagctatatgttactattaaatgtgtacatagaaatactgaagcttaatgaaatctccattatgaaaaataggtatactgaagcagtaactattcaaacaaaaataattttcaatgctgatgattcaccaattcacgaacaaacagagaattaagacagcttatctcagatcagacagctataaaataagactggtagatgtaagactaaaaaaatgccatatttttctagtctactcagttggagctgtgcacaagatttattcactgctataaacattatagcgtgtcatgtcatttgaaatctcgagtatacagggcaaatggataatggccatcagtgacataagcataccgatttaagcctaggtaggcttaccatatgacaaatttttgaagtgattattgcaacattgcagcaaggactagagaatagttatcatagccataggaagctatcattaaactaaataaggtttcctttcgaatatttagttaatcaatagtttgtgattgcagatcgaaagcagggctgcactgtgcaatgccacaatctggatacgggtatctttaacaactcctgtaagaagttctatctcacagcttaagaaattatgcttccaataaactgttttatccagagtagaaacaataaagtgcttctcgaaaaccaccacaatgctgaacagaatcttaatagcatttatggcaaagaagaaaaagttacctaatcctgttgcactaatggtcccagatgatctcacagt

SEQ ID NO: 47460 - DNA, 1806 bp, Oryza sativa
tccaacctaaaatggaattacttatcaattagagtagtctgaatgatcacgaaggatcagaagcatctaatagaaacaatgaaatgattgaactgtaaaaaatcaaaaacaacaaggttgcaacagggttataccagcgtacgatatgcaaggtaaaagagaaaggaaatgcatcaagggctgcactctatacctaacagttggacaaaatactgatcttgtatataatgaacaacactctatatcttaagggcttcgagaaaatattgatcttgtatatcatgaacagcagcataattcatctcaaagataagtttagaacattaaatttagtgtatcgagttagatgagatatgaataagtaaataacagaatggagaacactacagatagatcacgcaaactactgatgtcacacgatggcctcataacatgtcaaatttaaggcaatatcaaaggcatattcatcattccaactctgaaaacaatccgaatccataaaaatgtgcctaagccacaaaaggtatgcagaaagaaataaagcaattcagactcataactgattgtgaataaacaaaccaaaatgaacttattttaccactatgttgtagaaaagtgataaaataagacgttgcgcctgaatcgtatctccatctccagataaattcaggatgccttgaccatgaattccaagattgccaatagaatgtataactgatgattcctgacaagcatgggaacaaaataaatcatacagaagagaaggcagaggaggagaagggccatatcttgcaattttgaacaaataacataccttcaacactatcaaattgctaccctctagtaaagaagtcgcaactcctgactctctgccaccatcaatcaacattctagagttccacataagaagcatctttacagacattcgtaaagcaccaaacacctgaatgtgatttaagaatcgtgaggtgcagatacaccacataatgggttaaaattgagcaaaaggaatacaacatctgcatgaagtaacagcagataaataccttaattgtagaatcactcataagaagttcctcagccaacaattcaaactctgaatatggatagtgtgtcaagccaaaagttaatgtagcgcgagatagaaggctaatttgtccttgagcctgaaaatcagaaaacattgaaaaaagggtaactgaaatatctatagtgactagaatgaaagaaacatttagttaaagaaaatactagtccaatatcagctgcaagctgcagcaaatgtatccctgttgacctatacctgccagtcccaataaggacagaaaaatagctcaacagcagggaacagcaactcatgttatttaccaaggtgacatgcagtaaaaaagaacattttttcccataatggaagtcaccagaataatagcattcctcctcccaatttaagaaagaaaaagaggctcagatcctttttaaagaaaataatttatgtctttgcaatttcatctccacaaaaacgaaacaaatgaagtgtttatggacaagcaatcagaatagactttaaaactaagtgcctcacacctgaatacgactccaacgcaagggaagagaaactttggcatgattcttgataaaaacatttgtccagagtggatcatatgggggttctagaaaaactgtatcagtttgtgtgctcaagttattgttgctaacagtaatactcttaggcacttcttcataaagagtcccagctgccctgcattgtccagacaacctgagctcctcccacctgataaggcaaca

SEQ ID NO: 47461 - DNA, 38736 bp, Oryza sativa
  unsure (1)..(38736): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccttatagcgaaggtcgttcgtggacccctgcatcgactctaaagctctacaagcctgggatgtttggtgaagcctttgccatctttgttccattcttgtttatggtgtagaaccagctttcttagtttgtttctgctaggtggagtcggagttgctttgttgttgagggtgtgttgaagcttggcaatgataacatattattctctctttctaagggtgctggtgctaaccatgtataggaagtggcacttgttggcttaggcttatgtccatggtgggaaatcggtggtgtttattcgttttgacaatgcctctggcaacgatgacacgatcactgtagagtcaaagctgttgtgtcgttaggtggcaagctcagcaacaatgacacatgtttgcaaagttggagctgttgtgttgtactctttacgacaagtttgatgttgatccttacattgggttccgtagttatttagttgttagtttagctagggttaagggttgtttagttgttccgtatgctgtaaaggccacgattctttttcttgaggtgttttgcgagtctcttctatttgaggagatgcttttctttttcatgtaaccccatttgggtttttatttccgcttaattgaaatataattttcttctcctacggttccgtttaaaacaacaaatacctttcatctacagagctatttaaaaatgctttatttgagacttcaattagagtaatttccactgtcatctattgaacatgtgaattttccttaacgctacacattttcaatttcaattttaatccagaaaatcttgtagtattctgttagatcaagagtaatagaggactcacattcatcctagagtacattaggaaaaaaaaactcgattttgcatttgtgagatatgactttggcaaaaaaaaaatgaggagcttataaaaatgtgtttatactcttagtgcaaaatggaaaaaaaagagattatattcttcagagcatgcagaggaggagcttaaatccataaatttggaccgacctacttgctatagataagttgttgatttatatatgtgtactatatagagttaaaaagctcgtttcatatctaagcagagaaggctgtgaagaggacttgtcgccagaaccaggattgcgttgagagagagtcatctagtgacatttgagagggaagcacgcacgcatatatgcaagtagggtttaacactaattaataaaaatgcaagcttggatgggataagataagctcagcactagcatgacaactttacatgtatgtatgtcactttgttagtttatttaattaatctgtctccaacctcagggaaaacatgcctgcatcttgctatacctatagatatgcaactaaattactccatccatttaaaaatatatagcgtcgttgacttttcacataacatttgattattcatcttattaaaaaaaaacttatataaatattttttatttcattatgacttgttttatcatcaaataaaatataaccttaacttatacttttacactctttacatatttatactaaatttttgaataaaacaaattgataaatattatgtgaaaaatcaacgacgtcatacatcttgaaacgggggaattagtaatagatggaaatatataataatagatgtccatatggggaagatgcattgtgatgtcatgcaaatctctagcaaaaaagtgcatgggcaatagtggatgtatgtatggcttggctgcatgcttatttggttgctcttgacttttttatggaatcatcaggcattgctcatgggcggttagtgtgtgtagtggtaagtggtgactggtgactgtcaagaacaagcattgaatcaagacatggataacatggatcatgatgatgatatatactactactactaccttgtacagtttatcaaacgtgatgaattgtctgaaattaaccttgctagtagctgcctgaactggacatcactttgaggccaagtgacgtctactgtggtgggtgctgcatttgctggagaatggatagaagtattcatttaaggaaaatgcgccccacccagatttaacaagatgtctgaaagttttcttaaaaaattccatttgtcccattttaagtgtggttgtgagtttatgtgttcaacgcttgaccatccgttttatttgaaattttattaaaaaataataaaaataagtcatgcataaaatattattcatgttttatcatctaattacaacaaagatactaattatataaaaaaaatcaaataagacggatggtcaaacgctggacacggaaatccacaactgcacttattttgggacggagggagtatttcaattgtcaatcgactatcacttttgagggctaggattgttcgaagatgtatgcacacatttggccctgaataagagagcgactaaggatcaaacgtccgatcccagtcaaaacccaaatggtgtttcaccttatatatgaaaaatgttttcagatatttaccgcttagtaaatttgtttgagcaaaaaaggttttagatatttcattgctcaataaaaaaatgttccatcacttggtgaaaattattttaatcagatgcaatattgaaaaaaaattgattgcaacatcacgacccttctatgtccaagaaaatgtcttgtacatcatgtgcaacatcccaatgaaaaagagtgaaacactcaaataagcaacaaaagagatgaatggactgcaacatataattccttttttttatagaaaatataatcacgtgatatctttcttagaagatttagttagaaccaatataacagtgtaatttaactttccgatatgcacttgacagtgaagtggtaaaaggagtggtttcaaccgtgaggcccatatttaattcttttccaattttttcttcattactctttggttgtttagctttttttttaaccccaaccgtgatagcgaaaaaagtgaccttttagtaaattcccaatccaaatttgaaccttttgaaaccgtttgaaattctgaaggcatatctaattctggcccatgtcgagagggtcgaatttcacaagatttgaacccatttcgacaaatttgtgaaccccgtcaagcaagtaccctagcatcatctctcttcgtcgtctccgatagctcccgcagccaaatccagatcattttatcctcagagtagccttatctattttttttcatagatgaccacaggctgcgtttagttccccttcaaacttccaaaaatttcgtcacatcaaatgtttggacacatgcatagagcattaaatgtggacgaaaaaaaaccaattgcacagtttgcatgtaaattgcgagacgaatcttttgagcccaattatgtcatgatttaggccatgtttagttccaaagtttttttccaaacttccaactttctatcacatcaaacctttcatacacacaacttttctatcatatcatatcgtactaatttcaatcaaacttccaaacttcaatgtgaactttcaaacaatgtggtgctacagtaaacatttggtaatgatggattaattaagcttaataaattcgtctcacagtttatatgcggaatctataatttattttgttattagtctatgtttaatactttaagtatgtatccatataattttaaaaaaaattggctgtggacctaatacggccacagacagagaacactttggatgaagaagaaaacagggagaaattcaaacttctgtgaggaggaagagcatgtatttgttcctcgtgttctctcctgagcggacagaaagacgcctgcctcgctagaaatgattgcattcttcgtcctgctgttcgcagtcgcagggatgcagtagttgggcggtggcatacgtactccagtacagtacagagtaagaggtctgtttgttttgtcaggtttcgcaaagtctaaacttgaccaggacccaaatgtccaaaacctcttcttttgcagccttccagtaagacagtaattatacctactagatgctgcagaagccggtgctcctttcccagaggttgaaagggaagaaagagagcatcatgagttctacctcctgttgaccacacatccactccctctctctctgcctcatgcagaggtaagggcgttcacagtgcatcccgctgtcgttcagcctgaactatccacgtcggtgttcatatgcaattcgatgccacgtttgcaggtgggcccacaaaattgaggaccgcatgaccaaagatggtcactctgttcttcggcatgttcgagggttggcagtgtggggagagaaggaaggagatgcgttgtggagggcgtggcttcgcttcgcatcgtctttgcccacgtcgcctggaaacagagagagggagaagggagatggagggaagggagctcatcagcggtcggagaggaagcccgtcgtagcctgtggcaaggagctagccgtcatcctcctctccgcgctgccaagaagatcgcgacactcagctctgcgccaccgcggggctcgtcgccatcctcgctgctcgccatccacctcgtcgccgtctccctcttctccgccgccttgatctagaggctcccagcagaggacgctcgcaacgaggacaggacagccgaggcacgctggcgcccccgatctagtcgtcgtcgaagctccaatgcctgcctcgtggtcgtcgccggagggggagggtaaggcagcggcgatggggaggggaaggaaaagccggcggaggcgttggggaggccggtctcagctagctcgccggtcgcgcctagcctcggtcctttcccgccgatgaggcccgcctcaatccgcgccgctgggagctcaccggccgtgctaggcttgatccgcgcccgccgcgcgaggccactccatggacaccgccgccgccgacgtggggagtggggactggcgccggccggggaaggggaggagaggcgtcggccagggaagaggaggagaggcgccgctcgagggcatcggccagggaaggggaggagaggcaccgctcgcggcgccggattgaggggaagagaggtagtgggcgtgaggataagggaaagaggggaaatgggggattttatattcttttctggatttaagggtgttaagtgtaaattttggatctccacaaattaaagaaaatatgagaactgaaacaaaaggtactaggggctgaaatacaaaattaaagccactcgcagagccacttgtagtgtgaagaattcaaatttaggactcgtagctctagcctacgtgacacactgaggctcctcatacgagagtgacacactgtaaatgccctaagaaaggaagaattgaagtgttcgactgttggttacttgttactccatcggtttcataatatgtttatttttaactcattttatttttcttaaaataagtttacttaatattgaaagtagataaggggggaatagttatattggaatttgataaagtatggatgttgtagtatttttgttttgtattagtttgggatggatgaaaaaaaaatattatggaatggagggagtagtagtttttccttgtcacaaaaataaattacctatgtctacgaagtgtgggccaacgtaaaaaaaaagtatgtgtcagggttatagataccacataactaatagtagttgactaaatctcggcaggacccaccacataccttgtcctatacggaaacaacctgcggatatagaagaagttccggataaggaaagacaaccagagttctacatggaaacgacaaggactactcggattgtatccatattggtttccctagttctacttggacaaggggacacctatgggtataaatacaaggccccctaggaggagaggggacacacccaccatagaggacacggaacaacagaagccacaacatacaagccaacatacgtcaagacaagccgccggatatcgacatcagagatatgcctagatcgaccctatccggtacctacagaggccggccgtagggatctagcgctgtctctgatctcgccgagcacaaactcgaagaggaagactaccatgttgtcgactacgagttagaacttcagaccgccatgtcgacaacagttagataggctaccccaaatattgtactggtgtgattatggtgaataagagcaataccggcttcggccaacatgatgtagggttataacctgacaattcaggggctcgaacctgtataaaaatcctcgcctccatctcttttacctcaatctcgcatatatcatagtaccaacgatccccataccatacaaataccggaatcgcgacatcaaacatcgacagtggtgcgccaggtaggggatcttttggtgcttcaaagtttcgacgagatgggtttaagagacggattctccaacaacaagctactcgacgacttcgaaccagggagatccgacatgaccagagtacgtgccccgacaagatcagaaccatcgtcgtcagatctataatttattatggtcacctagagcatgtttttttatacaatatctattgtgtgagtgtttcggatgttaaattgactacggtttaacgctgggggctcgttctattttcttcagtataaatcatgcttgtttacgatttacataatccctgatatttacatctgctcgttatgtcctgataatactagaagatctatgcagttttttgagtacatactcgatattctctgctatatatcttgccttctagaaaatatttttcagaaacaattgagcacttgagtaggttgtggtcaagcacaccccattatcgagaacgttctcgacaaatacggagttgtcgcacccaacctaccaacgaagaccgacgacctatctcatagcgccgaccaaggctgggctattcgagaaaaggttgttaacgaataaattctcgtgaacgttgtcggcttgatcacccgacatgattgcgagcggacatccggatatgctataagttgggtatatgagtcatgctggctacatgagatgcacatgtaacaaaccaaatttagcacccctataggtgattaagaggctcctactcctggttctcaaaccagtaggacgtagcgatctctcgcacctctacttctagtggtcgagttaaggctacacctggttttcgaccagtagtgtagcaatactcccagtggctttacttctcgtggtcgagttaagactactacctggtcctcgaccagaggtgtagcgattctcccactatttctacttcaagtggtcgagttacgactactacctggtccttgaccagaggtgtagcgattctcccactatttccactttaactggtcgagttacggctactacctggtcctcgaccagaggtgtaacgattctcccgctattttcactttaagtggtcgagttacgactactacctggtcctcgaccagtggtgtagcgattctcccactacctttgcttcaagtggtcgagttggggctacaactggttttcgaccagtggcgtagcgattctctcattacctctactccaacaaagttgatatcaggtacataatatcgccaagtgttttacccagagatcccttaccacgacgacacctagagttgaaacctatcctcatgtccctttacgccgtcctgacaaggcctctgaggaacctaagggaacttcggctggggacgcccagagcggataaggccttgtcggatcatgtagagacaaacgaccatgtaagacctgatcatgtaagagttctcgccgtgcgtattaaccaagccgtgtaatcggaaattgagttttccaacttcatggctgggggctaggatcagtgctttttcaaccaaggcaggtaaagggtccaagagccttatcatccaagaacgattctccgacgacaaggctaggagctagggagagtgtatgattcaacaaactgactgatcgaagtcggtaaaagagtagatgctcatatataaaacattggtctgtaaatttaattcattttcagttttccatacatattataacatgttaccctttgagcattcgctcgggggctatttctatctaatactaggtgaaaccccacgcattgctgcgggaatttagtatgataacaataaaaaaataacgtgtaagatagctagataacatcagattaagtaaattaatgtggtttatgataatttaaatttaaatagtatgtagaatggtgattcaaacgtaaaaagtaaggtgatataactttatggaagaagaaaagtagagagatactagttggtaccatagattaatcatctaaaggctaaaaacaattgatgtgatatgacttaattataggaaaaaaggagaaagataatttggaccatagattaatcatttaagcactaattaagtgaggatgaactatataggatatcataaaatataataaaaatatgcattgaaacattatgtgaattatgttagatgataatttaacatgtttgtattcgaaaagctcttaaattataaaaactataaagatatagcatgtttgcatgatgtttaaatgtgatgattgttagtggatgatgatgtggcatctttgcatgttaagcttaaggagttagtgggggataactttatagtaagataggattcttttctgagtattgatttcaggaaaattctattcctagggggccttttatttgtacccatagatgtccccttgtccaagtagaactagggaaaccaatatggatacaatccgagtagtccttgtcgttttcatgcagaactctggttgtctttccttatccggaactctttctatatccgcaggttgttttcgtataggacatggtatgtggtgggccatgtctctatggttctacaccaagatcgactaaggcgagtacaacaaatgttgacaaggcttcgtcgcaggctctgcgccttctcggtcactcgagaacggttggtggatctcgacaaggaatacggaatgaagagatggtgtacgcgccgagataaaatttcttgacttcaattcaaattctcgattacagcaagacgggagacttagtcgtatgctctgtaatttcttggttgacgtcggagattgactcagacaaacactataggtgcccgcttgagactgataagggaagtctaacgttatctctgaactcaccgagaacggtcacatgagctcgataacagttactccaaggtctgcacgcggttgagaatatgaattcgttcatttgtatcgaagtcgggggctactgtcagggttatggataccacatacctaatagtagttttacatactaaattaaaagtttaaatattaatctatcatcctatctatttgtctatttattttttttgatatcgtgtcttggctaggattcgaacccaagacctatcctccacgcgtgctctcctttaccaactcacctacacatcaattctgttggaaaatacatatcattccatttaagcctacctaactaagatttgaatcatagatttgaatatctaaaagatttcaaatgaaaaatttatcacctataaaattgtagatctcgtcgagagctataatttccatataaaatttgtctcaatccatgtccatataaaaaaataaattaaattatgagacgacaatttttttattgcaacgaatttgttgattgtggcaacaaaaaatagtgaaaagtacatgtactatgtaaattgccacaaaaattaaaattgtggtgagagaacatgtttttacaacagtacgactttttgtggcgatatctcattttctattacaacaaaagtactaaataaaacaacgattgtagatcattgcaataaaatataattatttgccacagaaaagttatcattgcaatagtacaatatattgctacgaattattttttgttgtaataatttggtggcaatagctcaattattttgtagtgtcagtgatctcatttagtattggtgttgaatccttagacctgagattatcatggttcccaacatatgtagtagcttacttagggactgctaaatgctactccataattggttagttataaaagtagttttcgggtatgctatgaaatatgtagtgggatatgaataattaagatagaatttgcccctcctatggagagatatctctgggcccctcgatgttgtagattatggaagtacatggccatgccaaaggtgattgaggagtcaatcacaagttatataatctatcaacaggttcgagtgaatgattgagctaatagaggatggcacatatctagccttgagcttaatcgatatcgtgaggcaaaggggttcatacaagtatacactagaggttcagccgatatgatctttatgtatgcccggtgggtcaatacgttctgctaggggccgctgttgacgcgtggaccgaaaatgagtttttgggttacagccgagtatatatgaacctatagggtcgcacgcttaatggaccgtaataaggggattggatggagatccaatatgagcttacttcggatagggatctgaataagagttctacgggccttggaagcccgagtgatggatcctatatattcgtgaggggtgtgaccggcggaggcattgcatcacgtgagaaaccctagccgtcacttccctccccgagcaaaaccctagccgcgcacgggtgctagcacatatgtgcgtggtgttccgtccctgtacgtgtggataccggtagaggtgtcgctggtttgcggtgctgatcgacgtgggagtacggcgaggagaacgcacgaggaggagaaggtcgagccggtgcgatcgactacttcgtctacattgacgcgcgctacttcgcgagagttcctttgacttctcagcgtctttttccgctgcgcagcacgtcgaatggtaacgatctatgatctaatacttgcatggttcctggttcacgcgatagaaaattttgatttatgctatcgtagcctacgcgtatcccatcagtactcacgagtaatgagacattagctaaacccaacggcctgtttggttggggagagtttttagaagggattaggagtttagagggatgagtctattaactgttttgagtaatgaactccctcattttcaatatctgagtaggggtgtggtaattgggaggaaattcttcctttacctaaacaaatctcaaccattcattttcattaatgacctaatctccaactaaactttctgtcaaataccacattctctaccaaacaagatattaagattaaaaatcaaatttctatcttaatctcaccattaattttggctcttaacttaccaatcccctcctcgcctttccaaacaagctgcaaatggagatccgaagttccgaacgcagccaagctgatccgaccttggggtgggcccgcgccgtacgcgctccacagccggagacacgtcagcgccgctgtgctccggggcccaccgcgcaggcgtgctccctgcagccaacgggggagcaacacgcgtggtatattcctgtcgctgtcaggtgggcccggctcccccgtggccgaatcgtggttggctcgtgactggacttgccgccatccgacaagcccctaaacctggcgccatcatccatcctccttaaaattaagcaaaatggagataaggtgatttcgttaccagtttatggacctgtttaagggagcttaatattcttaaaagcagccgctgaaaagctaacagctgagaatctggagaagctggaaacccagtttctggcttctagtacattttccagattctacaactatatattctcagaatctggataaaaaactgaactgtttgggggaacttctggtaactacagattctaggagaagctgcagctgttagaaactccccaaacaggccctatgctaggacagacagccaatcggatggaggatgttggcagccagccgatgaattttgatgttctgtactgtgccatgatgcataagcaaagtttattttttaaaaaaatatttgtatttttttatctctaagttatattttgtttttttccctcgaccattggatgagcaaatggatgccttggattattgattgatgatggcttggcgaggtccttgcagcaacaggatgggctgtagatgttgggcctgtttcggggagcttctagctatagccgtttctcccaaaatcagaagctcccccaaacagtccagctttatatccagattcctagaagctgtaattgtagaatccagaaaataaactaaaagacagaagctggaaaacccagtttttttagattctcagaagctggctaccaatcagctctatctcaaaatcttaagctccccccaaacagacctgttgttgtagtcgtgagccacgcagagcatttctaaacaagtttggtcatgtgtttttctagatgtggtagcatttggttctcctgggggccaggatgcggatggtttatatgtacttgttgacaataattgttgagagaaacctcttatggccattggatggctcactgttttttccttgttaagattcatgaggttgacatgaactatggtgcgcataattatctattcaacttaattcttccctgtaacaaaaacataaatgtctgataggtattacctccatttcatattattaattactttgaatttcttttaagtcaaacttttatagctctatcaaatttatagaaaaaaaatataataatacttttaacataaaacaaagaaactatcaaaatatcaaaatatatttaatgttagatttaataaaactaattaggtgatataaatattgctattttttataaacttatcaaattttgaagaaatttgatttttaaaaatcaaaacgaataataatataaaacgtgaaacggccgggggagcagcacattatttatgttactatcaaaagaggcaaggggtcatcagtcatcactatctctttctagtcctagaaattacaacacattaatcagaggaaagaaaataaaaactttgatcatagtgcatccaaattataacggcgtagactcgattgaaaacagaaaataaaagttgtgtattaaattgaaatctatttttaaatatatgatatgaagccacgagttgtatatcaattaaaatctagctccgcgaaaggggaaatccgctagttttcataattaaaaacagtttcaacaccggttcatctactttttacaactaaggcattttaattcgtatgacaaaataaagggaaaaacacaaccgacaggtgttacatctaagcgtgctgcgaaattttgcgagtgactgttggaaaacagaaaacgcaagtggaggtcatttcaggatgaaaaaagggttcctggagaaaattttgggtgggtgatgtgaaccaaaaagggataacaatcaacaaggtacatagatgcttttgcaagttctacatggaaattatgttgagaggacgttaatggagatcagatcaccacaattatttacagtgtcctccttttctccatcaattctgtacagatagatgcaggtaccaaccatttccaaacgaacggcgacgcgaaggacaaaaggataatggagagcgtctcaaatcaaagataaaaaaaaggttgatacaacatttaaatttttaaacttaattttaaagtgttttcatagaaagtgattttttttcagcattagcttataaccaggatatggctaacctgtaggggacataagtagtaccatatttcagtataaatgtgacacttgtggcattttactatcatgttagttggtgaccttgtgatttggacttctatttttaatagttttgcatatgttacgggacacattcgtgactcgtgagggtgtgagtgtagtgttgtgtgtacagtggtatgtgtgcgcgtatgcgtgtaccgcacactgaaaaaagaaaattgaaccaaaagaatcccttgtgactattcattttgggttaattttgaactgttagaaagtgtgtgaaagttaaagagttgttataataggatttgatgattactaggacaggattgatatcaagtcgctcttattaagaatattattaccttatactccctccgtttcacaatgcaagttattctagcatttttcacattcatattgatgctaatgaatctagacatatatatctatttagattcattagcatcaatatgaatgtggaaaatattaaaatgacttacattgtgaaacggaggaagtgctataataataacagcaactaagttatttgcatgctatgtacagcatgaaaatatcagtgtttaaaccccaatgcggggagcaaaatgtctgggggagaacgtttcaacggcacatatcgttgttcaaaacaaagatagacttaccgtggaaatgattggagcaggccacttctattactaggcaccatgcatgtatgttcccctcccctgtaatgtgtacattgtacatagaaaattaatggaagtgttgccttcagaactagtattcccttcggatttgccttcacatgttgcaacaatccaaatactttacaataaattggttaaaatgctggaattcaatatccgtttggttggtgtgccaaggtcgtcaaacttaatttgtcttattttctaggcaaacttgactaatataatactccctccattttatattataagtcatttgagtaattaggaaaaaaattaaatgacttataatatgaaacggaagaagtactagttaaccagtaaaattagagccacacttacacaagtacgaaaaaggcaacgaaagtcttcacattccatggttgtggccgctccaagctagaaagacatctagttatttatagttggtgttttggttcctactactttgcttctttcgacatctctgattgattgtccgctgtgaaatgacattattcagtagcaaacaataaagttcattacagttttggcaaaaacaatttattaatgcatgctagccaaataggaaaatagtaggcggaaaacaccaccggtgtggtggtgaagtcgtggatgtatgactccacccaccagggttcaaaattctagcattcacaaatattatacacatgcatgtgagctttcaaaagatatttagtgagattagttatgtgccgttggtttctgtctcttacaacatgatttaggggcacgtttatgagggtggagtatgatgttgcgtatacagttgtgtacgtatgcgtgtctgtcttgtaatgacaaaaaaaagagagaaaatagtagagtggatagatatggattgggcatctaatctaagtcattttattggacggtcaaatattttattatatggtcaaaatatttcattggatgcatgatgtagtgaaacattaatttaaacaatatactcccttcgtctctaaatatttgacaccgttgaattgttttaaacatgtttgaccgttcgttttatttaaaaacttgtgtgaaatatgtaaaactatgtatacgtaaaagtatatttaacaatgaatcaaatgataggaaaaataataattacttaaattttttaaataagacgaacagtcaaatatatttaaaaaagtcaatggcatcaaatatttcactgaatgtttgttgcaacatttctagtagcgtgaaacatcactgtaaactatgtgcaacacttgaaaagaatatgtctgccatgtaatcgaaaaaacacagaaaatagtacatgacaaagatatggattggacatctagcctcagtcattttattggatggtcaaatattttttacatggtcaaaatatttcattatatacctgatgttagtggagaaaaagtgaaacattactttaaacaatataacaatgaaatgttttattaaatgtttggtgtaacatttttagcagcgtgaaacatcactagcagcgtgaaacatcactctaaactagtgtaacgctcaaaaatagttagggtgatgcaatatgtactaacacacaaagaaaaagagtgaaatgttagaaaacaacagatccaacagatcgataaaagggactgtaataaattattgaaaggaaaatactttgccccctttctaatgatcaacaccattgatttttagatcatttgttttattcaaaaatttatgcaaatatacttatgatgataaaacaattcataacaaaatatattataattatatgatttttttttaataatatcaatagtcaaacttacgtctaaaagttaaccgtgttaaatattaaacaacacaaagtgcataataattaggccattcccaacccaatgactaggatggtgcccattgcattaaataagctgccacataggatgaaaagtgatgtggcaagtgaataaataaggaaagagaaagaaaccatgtcttacataagacatggtttctacacaatatccaagacatcatgtgagataagtagcattaaatttaagtatggaatagtggtgtttgcattagaagagtggtgtttagtactagtttcttggtgatgtggagtttatggaaactatatccagtgtcatgagttgggaatggccttaagaggagggtagttctatctgctcacctcggtaacctgatcaaattaagatccatcaacatcatcaacactaataaatggacagaatagagtgtgatggatagaatagagtatgagcaagagaaatgtgaatgtgaatgaactatcgtggccaaacatgcaagtgatgcctcttccactcttgtgttgctccaaggtatggacaccaacacatcgaaacaaagttaaaataatggacattgaaatgaagataattatatcaaatagtcccatattgattgtgaaaagacaagggacctaatatataagtggggtccttatctcgttggataacttttaggatgaaatgtcatttacgattatacaattagtatcacagccacgtccagtggctactcaagatcgattggataactttctcatcccaaaagcatccaaaaaatgatagcccccacttatataaataggtcacttacccttctaaatatgatcctacaatcagtattagagtcaccttttacttctctttggaatttgatcaaattttgcatcttgaaactgcgcattgaaactgnnnnnnnnnnnnnnnnnnnncaatactctccgtggcctcaagcaacgcctgcacatgaacaacaacaaaaacatatccaagtacaagttcacaccatcttgtggagatagtgcgagaggagaagtgggagtgatatgggacgttggatttgagtgaaacaatcctgaccgatcaatgaagtgtgaagtatgtagaatgtaggactgttgttggtgaattatagggtagaagattgtaccgatagtgctaagattttggtaattttggtttcgaaatatttttgaattttcaaaaaattggaacaattttaccaaactcataaaaatgaaaaaagaattaaaaaaatggccaaattcatttcgtatctgggagaaggggatgttcatgtagactcaaaacttagagaaatctcagtttcagtctgaaactttgaaccctgattctgacacaacctggctccatgcatgaatagaatgagacatttcatgtacgtattttttttagaaaaaaaatcccaaaaataacttcatttttcaccatcttattttctcaaaataacttgtaaaattgtaatattgggtcaccaattgattccatgcagcgggaaccgtggaaaaggagagagagagagagagatagatagagaaaaggagggtcataatttggactttgtaggtttcggcccatgagatgcaagcaaggaaaggaataagttcacacccgccgtccctcaacttgacgacgagtttgtttgacatccctaaatcccaattctaaaaatcttcacccctaaactatacaaaacagtgcaatttagattccacagcactacaacagtatagatacatagtttcgctgacgtggtatcctagtcagcattttttttaaaaaaatatgggacccacatgtcagcctttctttcttctcttttctatatttcttccatggtgcacatcgaggaggttgagggcgtcgttctcggcgccgctgcgggtgatcgagcgcggcagcagcagcagtagccggccgcctttcccctcctccatctcccgcccattccacacatcgtgccggcgggagaggggggagtggcgggggtgcggcaggcggagcggtggtggaggagggggaacaccattttcggccggcgagcttgcttggcgctgccgagggctggctcgaggaggccatcgccaacgagcttctccgctcgccgccgccagcctagaccgtcccgctggagagggggagaggatgccggccggctgctgttgaaccagtatgagccgctcttgtgcatgctccacgccactgtgcccaacggttggaccactgccaacgtcgccactcgccaccatagccgactccggcgactcgtcctcgcactccgccgcagccatcgatgacatgcaccaccagctctcgtacgccaacggatcctttcgctcgagaggccgctcgctttgacaacttcaccacgcggttggtcggccggtggctgccgcgcttgcctgccgctcacgtgtgcatcgtcgtcatcaggtgtggcggccacctcctccctctctgccgccgatgaagagaagagaaaagaggaaaagaaaagagaaaaagaagatatgcgggccttataatttttctattctcacttacatgtgggtcccataactgtttattttttattttgctaactagaatgccatgtcagcgaaaccatggatcatactgccatgagaccgaaattgcatggttttgtatagtttagaggtgaagatttctggtattagatagtagggaacttagacagactcgatgtaaagttaaagaacggtatgtgaacttattccgcaagggaatgaaattacgaaacggacaccgtacaatttggccgccctgcctgctccacggtccaaagcgccaactatgcattcttcaatcttgaaaaaaaaaatttaaaccaaaatcggaattttggaaacatggacttgttccttgttctaatctccttccgatcgtactacggaacttcacatgattttcttaaaatcagttcaaattcccgtaaaattctttcaaaataccgcactaattccttcttgtccacctaaacataacagacacacacaacccggcagcgcacatagatacctcagcatcagcaccggcagtgtacgtaccctgctgcttctttctagtagtatacaatcggcagctgaaaactgttggatccaaagtatatatcgagcgtacaccaacaaccagcagtgccgcccgccggaaaaagccgtgccttttttgcgtgcgctcaccggaaaagttgtcggcgtccaccggaacgaggccgctcaccgccggcggtacacagatcgatcgatttaatactaaagcaacgcaagtacaaccaaagacatgtgatatgtccatttacatagatagaatcccgtcgcatgatcggttggtccagatgcacgtaaagttgctatgagcaataaaataaactaagggtgtatttagttcacgttaaaattataagtttggttgaaattggaatgatgtgatggaaaagttagaagtttatgtgtgtatgaaagttttaatatgatggaaaagttaaaaatttgaagaaaaagttgggaactaaaccaggcctaatcactccgttcctaaataatatttgacgtagttggcccttctaaacatgttttactgttcgtcttattttaaaaaattaagtaattattaattcttttcctatcatttgattcattgttaaatatatttttatgtatacatatagttttatatatttcacaaaagttttttttaataagacgaactgttaaacatatttagaaaagtcaacaacatcaaatatttagagacggagggagtatatataaatatgagagaattaaaaaaaataagtgccgcctttcatgtgagagctagttcttcacatactcgataaaatacattaaatgtataggtgagattaaaagagagaggagtaaaaaaaattaaagacagtcttgaagctaatctgttatacatattaatctaatactatatatgttaatagctaatagttcttttctatattatattaaacttgctttaacccaacagtattatactacacgcagatcaactaaacgtatgctaccaacttccctaaatatatgtggttgaactaaccaacgtcataaaaaaaacagagggaataccagggtatgttcttttctaaaataattgaataaatatgcgcgcttaattcccaggctcttcaacggtgcgatctttaaaaatcaccggttaatcgggcgctccatatataaaaaaattttatatatcgggcgcttaaagcttgggctagctaggttctctaattaattatcgcgcttaaggattttttttcttctcaaatcgtcccacatattcttaatccttcgcagttataattagagagaagccgataattaaccggtgatcactagattttggataacatgagaaacgcctatgggtcttttggctagctttataaggtggtgagatcgtcacaaggtggtgggctatacgctctaaagtttaaagcctcatctttttttaattatttaatattagatcttccctaatattcacgtctttttagtttggatagcatattgtccacgacatcggattaggccaatcgatcgagcagctgcgcgtcgttctcacgtcggattgaatgaatttaattgcaggagttaacatagcccaaacgtgcaaagtgagtatagctcaactggttaggttccttgtagtggaaccagcccacacgggtgctcgtatttacggctaattattctttcagtggtaggcgacgtacccgtcgacagcgagacgcctgtggtgacttcgtcaatctctgcgttcatagggatgtttttctaaaaaaaaaaacatagtccaagcgtaccggcagcatcaggaaccacacacgctcttgtgtggccgtgaagcgtcggatacatgatacatcgatcggatggctacgcatgcattcaattcattgcttgctggtgtacgtttcagaagctactggagtagtaggtagcgtaaacctaacttaactaattactggtccctaattatttaggtttgcattgatagtattagcagcctcgagttaacatcactgatgcactgatgcacctgtcactctgccgtcaccagcaattcagatacttgaaagggacatgtaccatttctctccaagagattaggagctttaattaatcaccctacaactactatttttttttaccgactcgcaccagacagtgtgaagtttatattgaatgagcagaaaaaattataagattacaacaatggaacatcgtaactaggaaaacaaaaggaataagcaccacccacacacaccgacaacaccaaaccacagacccaagaaaaagttaacaccggaccgaccgtcggtaagcgtgaccgactgccgttaggtcaataaagaaactgccactgggaccacccaaaatacaaccctaacaactactatgtgagtggtactgtttggcaatggttaaactacacaaaaaatttaagtttggaatttttgtttgctggaatgctgggtagaattgagctagcattataatatgtcatagattttattccattatatcagaaaaatattaagggttattttgtaaaaaccatgttaggatggcagtaatgctttttaaagaagtacggataaattttacacataaattactttttaagtcgttaataaaccaatacgtcttacaataaatcttgggcaatcgacaagtccctaaatcccccatttatttatgctaagcttcgtaaagtattttaaatctatttttagcttttatttgtattctaatcatctagtagagcaggtacaatagcagactattagccaactataaacatattttaatgagataaaagatgagagagaagagcagcgggctacagatctgtagctagttacagtacggactccaagacgcaatgtgtgtatgacatgtgagaccatatattaatagtatagtaagtaactattgtatgaattggctatagatgaattggagctagtagtgggctatactattgaacttgctcttagtattccatatataccattcaaccgaaccgaatagaacactcccgacgggaatgtgagatcgactagcagcaaacttctggtgttgattgtccctttgcttccacgcatcaacaaatgtttgctatcagttcgaactatcaggttctggaatctagataccaacaattgggtgcaatgtaagcactatcccatcagaaaaacattgctcataatatgaagagcccttattgtatacgataatattttgtgaaaattttggtggcacaacactagcagtaacaactatcgttggagttgtttgttatgcattgttaattaatcaatataattaagtaaccgaaaaatagaagtagtaacttttgatttaacaaaggttaaggctgtgttaattacagttaggatgtgttcgaaaacttttctccttacacctgaaacggaacagtggattaccgtatgatttattaaatattagcttagaaatatttaaaaatttaaattaatataattttccaagtaatttttttataatttatttaaaaaacaaataccatttaattagtagtacagaaaacatgcacataaaataagcaagggactgtacgttaaaaaattagtgtaaaacacagcataaaacttgctcacagcacttaattaattttgatggcgatgaacagctatcgtatcgtctgacttgtgtctatggaaaagggagcagtggcacccgcacgccgcatgtccaagaaatagaaaaacgcgtgcgctttgaccgcccaggtgcgacccggggcaggtcatgacctgaccggcttaaactatctcccgcaccgcaccgcacccacccacccacccacccacccaccaactagagtctcttaccttcactgcaacgtgggccacccaccgaccaacctggcccacgcgcagtgagggtgcggcatgcgcgcgactgggccgagccagtcagcgtcgcggtcaaagacgtgggggtgggtgtggtgtggtgtggtggcggccgctaccggagtcaggtcaggtcaggtgctaacccgacgcggcgctcgaggaggaaaccgacaccaacgtataataatatagccagctgccgactctaatatcatgtcacctatagccatcactaatataataggatagctgttaggttagctgtttgtttatctctattgaagatttagatatttaatattcacatgtacacctcatcttctcgcttctggttggaagaaaacagctttttctcgtgtgttgcgctttagccgggcgatagatggaatgcccgctccatcctttttcttcccttctcactcctccacgtcagatttggctgacgcatagtgtgctagcgccggctgattaggatctattaaacctgctctaagggcaagtgctataatactccatacttcaagaggggtgtgagagtataagagacattgatatttgtttactagaggtgacatattgtataggttacctcttaatttatgagtgaatgatgtggataaatttagatggggtagtcacatctaccatatcacttgccctaacacccacaccaccagcggaaattggattttatgttatttttttatgacggagttgcatgcacccacccacgtttgcctacgattaaataaactagcaataggcacgcgctacgctgcatgtggacattaaaagataacgaaataagatacagagattctatcgaaactattggtaccgtaaggtaacatttacaacatgtaagtaaacaaataacccaagatataagaaacacaatactttgatacaacattgctgagatatctaaaccatatagagatgtccaaaccactgtccgtttctctttcttgacacaatggcaatttggaaagacaacagataaatgggccactctacccaggtttctttgaagtacaaaatgcatatatattctctagccctaagagaaacaaacataatattggaattagtacaaaacttatcaactttgagataaacttcagatatcttgcaagaagtgcaacataaattctgaagcaatgatatagcatgaatcacgaagaaattaaaaaatatagaatcatttcagccatttgcacaaaagtgcaatcaatatgtgacaacatataataatcattgaaatagtttcgccaaactaaatataatatctcagtgatacgtgatatgggatgccaactttgaatctttacaacatagattaacctggaactcaccagaactcagagtcaatttttagcctcaacaatactatagaagtaactcatagaccaactgaatcccaccagattgtttaaaaccattggttcaggcaaaaggctaatccagaatagaaagttgcattaactttcaaatgaacagttcaaggatgaaatgttggatttggacccatggtcagcaagtgcatgcttcctgttgaaatattccattttttattcacattgatattataggtaggtttgaacacttaccaaacctggagtgacacataatactaaaaggatgtaggctagaagtgtagctggaaatatgggtccattaattttacaatctaaatttgctagtgtacacagccatgagcaaactatagaaaacacatatctgattgatcccaataacaataagaaaacctaattcccccattataattgaacaatttgtgagtggcacctgaagtaaatggaaacaaaatagattacttacgttgtctatgtttaacaattggcattaccttaaaagtgttatcttcataaacttgaagataccttcttgtcatgcataaccttcttaggacatggcatagtaaattcgtccatggtgttgaagataaagcgccaacatggtaattgaactctagaaagaagcaactcacaggagccttccgggaaggaagggaaccaaataaggggcaaaaagcatgtaatataatatatatactatggcctacaaaagcaatcagaacatttactatactccacagtgtaattggaatctagatagtattatacttcatatttacgtaacctcatcatagaatcaataatttgcagagatcacatcgaaacacttaacctcttcagaagagcatgaaaagaagacctgctcaatttgtctgcatactattacatatacaaagaataagaagaaatatatcacaaatgcatttcatgtcaaactaaaacaacagagggagaaataatatatgacactaaacgacactatttggagaaacacaagcatatgcattaatcagcttgaacttcatactgtagacaacgaaggaactgggaatttcataccgtagccatatgcatcctgagtagtggagacatctgcaattaagaataaataatacaacgtagaaattagcaatttagcatatataacacatgcaaaagaaaagtatgatgggctgcaactcgcttaaatggacagcaagacctaaagcaagggacgctcagccctgttgacctccaccttctgtcttcttaccaaattgggtggcgcaataggctcaatatgaacccatggcaacaattcatattagtactgaaagcacactcatttgtacacaggtaaaatgatcttatataaattaccaaccagagaatcaataaggttacctagacataaccatatgagccaagaaaagaaaaactaaacacaacctacctacatgatatatgttgcataaacattcatgaaaaactctagctttgttcatgtatcttggacaatggacatgcaaattgggatttcagatatccataaaattagacatcacaatgaactaagcatgcatattgcttaagagagagaatggaagattaatctgggatcctcgatgtggctccaatgcaactatcaacaggtgatccacatgttatttcagcacaaatggtccacgggttggctctcctggagaaaaataaaatgaaaaagagagaaaatgaaccagtccttgtcgccatcctgaccaagccatcatcatgaccgagacatagccattatcatgaccgttcaggggtaattcggacgaccgcgatagttcggggggtaattcgtactttttccttctaataaatatgaagcggagggagtagccatgcatccaccaatttaaagtgaaaattcgatctataacaaagaaacaacattgtgggacatgtagattgattttatagcattacaggtttgtgaagttgacgtagtagggcatattgaattttgtcgtgaccgtttacacaactcgtagtaagaatgagttcatacgtaactaaatcataaattgacttttcctacattatgtattcttgaattagagtctaattgtgcttaggtaaataatgtttaccatggttattaaaacagattactcttactttatgtttgaaaaaatacattttataaaaaaacatttgtcaactacattatttagactactttttttttgttttaagtgatatgttaactttatttattaaaatatttaatttacctctataatgccacaatccatccaataaacatctgttttcagattgagcattactatactgctagttgtacccctgtgtgcggatgaggggttctcgtattctgcgcgcacgtttttcaaactactaaacggtgtattttttgtaaaatatttatatacgaaagttgtttaaaaaatcaaattgatccattttttgaaaaaaaaaaggtaataattaattaatcacgtgctaatggactgctctgttttccgtgcggggagatgggttcccaaccccgtattatactttttcatgcccacatttcccaaactgctaacagtatattttttgcaaattctttttatagaataattgtttaaaacattatattaatcttttttaagaaataattaatatgaactaatgaaccgtttagttttacatgcacgagggattagtctccacctccaacaatccaactcagccatagatatgctggctaccacttcttcggttcttccttccacgtttgcagtgttcagtccttgtatacactaggagtgaaaacggtacggaaacggacggaaattatttttatcgttttcgttttcatatttttttcggaatcgaaatcggaatcggaaaccccggatacgaaaacggaatcgaatattatcgaaaccgaaaacggagcgaaaacgaaccggcacgaatacggtaacgaaaatttatcggaataaaaaaaaaccccttaaactgataaacccaattctcaagtctcaatggtcaacaatttatcataaaacacaatcatataagttcaattgttaagtatcaataatacatcataaaacacaatctatggaataaattagtaatgatattgataaatcccaatacagaaaaaaatattcttatgtaattttaaatttgcaaaataaatattttttaaaaaaataacagccaaacaccatggtattaactattcagtgctttaaaaaaagaattcaaggtattttgtgatttctagaaattccgagaaaatttccgtaaagtttccgaccgattccgagttccgacggaaactgccattatcattttcgattgtgtttccgagaaaatatttccgaatctgtttccgtttccaaaaatttccgaaaaaatttcgaccgataaattctgttttcgaaaatagatccggaatccagaaagtttccataccgttttcaaccctagtatacactgaccaagagtccgtaataatctgttggttggtgtactatacacgttttcagtgaccaccatgtataacagacaattaaaagtaagcaacgactccggagatgcggcgaacgaacaaaggcattttggtctcaaagccttgcacttttggagaaaagatacgagtaaacaagtctgatcgaattgggtttgtagtttgaccatgcctggggctaatagtagctgccaggtaccctgtggaccattgaaaagtcaacgttgaagttgaattctagtgtgaaacctgaatatgccctaaaatagtaaaaactctgaaacttgactggttgccaggacggtgagctagggcatggttagttcgtgaaaagaaattttttgagtgtcacatcatatatttaatcggacgttggatggaatttttagatacgaataaaaaaactaatttcataactcgtctgaaaaccgcgagacgaatcttttgagcctaattaatccgtcattagcacatgtggattactgtagtacttatggctaattatggactaattaagctcaaaagatttgtttcacgattttccctctaattatgcaattagtttttttaatatatatttaatgctccatttgtgtattcaaagattcgatgtgatgttttttaaaaaaaaatagagaaataaacaggccttagccggcgtcccgcgaatggacgaagaatcaatggcatgttatacggtcgagatacattgacaagtggtatgtttgttttaatttcgagatcccgtgcttataatttatttttaaaacttgtttggagggacttctcttcctcttcctttgaatttcgttttttttttttcatgatgaactgtccgtacatcgccgatcctttgacgacattcctcgtatgcaggcagggtatgctgacgtggctggtcggcccatgtgctcccgcgaaaacagaccgactttagacggactaacacttttaagcccctatcacatcgaatgtttggatactaattataaatattaaacgtagactattaataaaacccatccataatcttgtactaatttgcgagatgaatctattgagcctaattaatccatgattagcctatgtgatgctacggtaaacattctctaattatggattaattaggcttaaaaaatttgtctcacgaattagttttcatttatataattaattttgtaagtagtctatatttaatactctaaattagtgtctaaatgtagggactaaagttaagtctctggatccaaacaccacctgaaccaaacctacgtgcgataaaggggttgtttagatgcagggagtaaagttttagcgtgtcacatcggatattatataaggtgtagcatagggtgttcgggtattagtaaaaaaactaattacagcatccgtcagtaagccgtgaaacaaatttattaagcataattaatccatcattagtaaatgtttactgtagcaccatattgtcaaattatggagcaattaggattaaaagattcgtctcgcaaattagtcgcaatctgtgcaactagttattttttaagcatatatttaatgctttatacaggtgttcaaatgttcgatgatgaaaaaatttatggtgtaatctaaacaggccgtagtactcaaaatgcaggcacgtaaaagccagctgcgaaggacccggtgcagtttatttaaagtttcaaatatacttatatctttaattgtttatgatggatagaaacactatataaaggatagatgtccacaacacgtgtataattatctctataaacacacatttaatttttatgagtagatatgattagataagcatattttaaaattgacgaaattatcacgggttatcaacattgataagtactacatccataagaaaaatacgccatcaaatctaacttaggctgcgttcgtttggagaacaaagggagtttgtttgtttcgtttttcgcgcgcacgcttcctaaactacttaacggtgcgttttttgcaaaaattttctatataaaagttgctttaaaaaatcatattaattcatttttaaagtttaaaatagttaatactcaattaatcatgtgctaatggctcacctcgttttacgtatcttcccacttttctcaatcccctatctttcaaacacagccttataatcggatgggttagttccacacttccactaaatgaaaacctaaaccagctacactctttttattgtttttctaccaatgctgctactacacatacaattttatttcacttttataataagcaataaaaaatagaaaagggaaatggtggggtcgcaccgttccaggtacggagccacaggcaaacgggtaagcccgaaaaccaggtgcaaaaccaatcacccccaccattgcaccatccaccggtacccacccgtgcacttgcccgcccatcgcaaaaacaacagacgcacatacccccgccgccggttcgccgctcgccggcgacggccgccacgacgacgactcgtcttccgtcacctacctccgctttcccactattcaatcccctcccgtttcccaccaccttcccccctttcgctccatgggaaaaccacccgtcctacgaattaaatgccaccacccgcgcgactcctccgacccgacgtttcctccctttcacacgcgggcccccaccttctctctataaataccccgtctcctctcctcctcgccgcatcccatccacgcaaatatttcttcctataacaggacaagagcagatcgatcgtttcctttttatttctgaggagaagaggatcgatcgtttcgttcgatcgtttggtttttgaattttgaggagaagagaagagaagaggatcggaagagatggccggcggcggcgtggaggacacgtacgcgaggacagggccaccgaggatcagctcatcaccccatggtccttctccgtcgccaggttagagacatcatctccttcgagttcgtcttcttcttcgaattcggcatccatcaatcccttgttctatctcaagcctctgctttttatttccttccgtttttgttcccaactttctctacacccaccataaagttccgtttgttttactccgccggtttcctgactcgcttcagttacaagcttgtccggcctaaaaaaaaactgattcgtgtcgttcattgcatcaaatccatgaaaatctacattaatttgagaattgagtctttccgaatcgcaaccgatcgttcggtggccataacaaaaaatttgaatttgaattcgaatttcttgcgctgtgatgtgatgtgatgcagcgggtacacgctgctgagagacccgcggcacaacaagggtttggccttctcggaggcggagcgcgacgcgcactacctccgcggcctcctcccgccatccatcgtctcgcaggagctccaggagaagaagctcatgcacaacctccgcaactacaccgtccccctccagcgctacatcgccatgatggacctccaggtacaatcacaaacaccaccaccaccaccaccaaaagtttgatcacccactcaaatcaaatgcattgataatgttcatgcagcaagaactgtggattacttctttttttttttttgagaagggtatttttactcgagctctacattcaatcggatacatgcagcctttttaaattagaaacttagcttaccaaacagagaacttagcccttagataacccaacatgaaatttgttcctatggagatttgaactcaacacctacatgccctttcactagaactgtggattactgaacactgtcatgtttcttggtttttttgtgcttttctttttcaggagaggaatgagaggctgttctacaagctcctgatcgacaacgtggaggagctgctgccggtggtgtacacgccgacggtcggggaggcctgccagaagtacggcagcatctacaggcggccacagggcctgtacatcagcctcaaggacaagtgcggtttttgttgctaggattctgctttccttctgatgatggtgaggttgattaggaatttgcagcctgacaggaatctgtgtttgtttgtttggtggattcagggggaagatccttgaggtgctcaagaactggccggagaggagcatccaggtgatcgtcgtcaccgacggcgagcgcattcttggccttggagatcttggttgtcaggtagtgcatttttcccccatttcctgccctgattttgctgtcatgaatgtgtcgaaagaatttagatgtgatgatgtatgtttacctggaagcatttgctgatatgtgctgctgttactatgtcagggaatgggtattcctgtcggcaaactgtctctgtacactgcccttggaggagttcgcccatcagctgtgagtgttcttgtcttcatgaaatgatcaaagtatttttagtctgttgatggatttgctttgctgactataaatgtgaatatatgtatgatgcagtgccttccaatcacaattgatgttggtaccaacaatgagtcactgctcaacgacgaattctacattggactcaagcaacgccgtgctaccggagaggtaagccacagtttctgcacacgtagttcacctgcaattaattggtgaaacagaaaactctttttaccatagaatttcttttttatcttatctctgttatcatggttatcaggaataccacgagcttcttgaggagtttatgaccgcagttaagcaaaactacggcgagaaagtgctcgttcaggtcagtctgcatagaagaattaattaagttacatgtgcacactctgtttttacctttatcaggattcaggagatgactgaataacatcaaatttcctttccacagtttgaagactttgccaaccacaatgcttttgacttgcttgcaaagtacagcaagagccaccttgtcttcaacgacgacattcaggtacaagaaagcgaaacttttgtgaacctcttctggtttcacgcccatataatttgtctgaatcagtagccacaaaaatactaatgtgatgaatttggtctacaacgatggatggcagggaacagcatcagtggtcctcgcaggtctgattgcggcgctcaaggtggtcggtggaactcttgcagatcacacttacctgttccttggcgccggtgaggctggaactggcatcgcagagctcattgccctcgagatgtcaaagcaggtaactgaatgaaaacacactgcaaactctgaatattgcctcactcactttcactgaatatgataaacaacaatatggagtgtgatttgattgtgtgttattcgtgtagacggagattccgatcaatgattgccggaagaaggtgtggctggtggactcgagggggctgatcgtggagtcgaggaaggagtcgctgcagcacttcaagcagccattcgcgcacgagcacgagccggtgaagacgctgctggaggccgtgcagtccatcaagccgaccgtgctcatcggcacttccggcgtcggcaagacattcacccaggaggtcgtcgaggccatggccgccttcaacgaggtaaccaatgcacacatcatggtggctgcatatgtgcgctcctcttcttgatgatgatgatcaagtgcactaacatgaaatcaaatgcagaaacctgtcatcttcgcgctctccaacccgacgtcgcactcggaatgcaccgcggaggaggcatacacctggaccaaggtgagagatcaatagagctgaatcgaaatcgtcaatggcgatctgaatcgaaatgtttgtgcagggaagtgcggtgttcgcgagcgggagcccgttcgacgcggtggagtacgaggggaagacgtacgtgccggggcaatcgaacaacgcctacatcttcccggggttcgggctgggcgtggtgatctcgggcgccatccgcgtccacgacgacatgctgctggcggcgtcggaggcgctggcggagcaggtgagcgaggacaacttcgccagggggctcatcttcccgcccttcaccaacatccgcaagatctccgcacacatcgccgccaaggtcgccgccaaggcgtacgagctcggcctcgccagccgcctcccgcgccccgacgacctcgtcaagtacgccgagagctgcatgtacaccccggcctaccgctgctaccgctgatcgagcacgagcccaccgaggaggaagacgatcgatcgaattaagcaataaaatttttattcaaatcttggcgcgagcgttagctgccattagaggggttttcatttttaattttttttgtgtacccatacatatacgtatacgtgtactgcatacatactagagcacctgatggtgcttgtcgtcgtcgattcttttgaccgatttgaagtttggtagggtgtaatagcacttacttttgagttttccacattgagttgattcggtgtaataggagtcaaatttgagtttcttatgatggttgttcatgatcagtttctgatgcaatgcgtcgtgtcatttttacccaataaaagcagagatgcttacttagtggaataagttcactttgtgactctcaaaagtgatcgaaatctaatccgtgaaccccctaactcttaaaaccggtgtaatttgtctccctcggcggttttgctgacgtggcacctacgtggtggtgttgacagggtcttccttacacatggtgcttgcgtgatattagaattaaaaaatatatagggcccatttatcattcacataaaggatgacatgtggggtccacatgtcatcctctcacctccccttcctcatccccctccctctctcccttctctctttctctccccaaactctcttcaccaccggagcggcagtggggacagcggcggttgggcggtgaggagcggcggctgtggcggtgggagtcggcagcggccatgggtgggggaagagagaggctggccgtgggagcagcgtgccccgagggggagcgtgtgggcagcgggcgcgggcctggagaggaggcggagtgggcacgccgcccccattccgccgtctctcctcctgcagtcctcctgccgctcgtcctcttgcagtcctactggccaccgaggacgagacccacgccctcatgccgccatggacgctgatgacaatggcttcgacgagcttgcctcctcccgtgcggccccaggagctacacccaccaccactaccactgcgccgcctcacccctattgtctacgtcgtcatcgcagcagcagtcgccgccgcagttgcgctccttcgctcgctcgttcttcgcccggctgccgaggacgagatccacaccttcatgccgccatggacacggacggcaacggcttcgatgagctcacttcctcccgccacggccccgcgcgctacgcccaccactacaaccgtcgtcatccagattcatcggtcatggtggcgggcgacaacaactgagccggacgccaccgccactcccgaccgccagttcccctctacgccgttgccgtccccactgccgctctggtgaagagagtttgggggagagaaaaagagaagggagagagggagggggacgaggaagaaggggaggtgagaggatgacatgtgggccccacatgtcagtgggtcccacatgtcatcctttatgtgaatgataaatgggccatatatatatatatatttttaattctgatgccacgcaagcgccacgtcaacgccacgtgtaaggaagaccctgtcaacaccgccacttaggcgttacgtcagcaaaaccgccctccaaaaccgcgagagagtcaaattgcaccggttttaagagttgggggtcgagatatcttgttttgcggtttagggtcacggattagatttcaatcacttttagggtcacagagtgaacttattccttacttagttgcaatgctattcttctttcccctcgtgaattgcactaaggatcagagtaaaattatttcttggacaaattattattttttctctcaaggccctgctttaattcaggtccatcaacagggaatgggccggaattgaggcctgctggacaaggcctaaagttggccgcatccttcctcttcaaaattgcctttcccatagagtaagtccattatgacccccctcaaatatatgtccaatttgatttgtatccctaaaccataatatcggatgtcttcaccctaactattaaaccgatataatttaactcccttagcggttttcatagtgtttttcgttgacatggcaatctaatcacaaaatagaaaatggcccatatataagtgactaggaaaaaatataaaaaatatggagcccacttatcagccctcttcctttcccctaacttcttcatgcttggaaccactcaaagtctagaaccagcggccttgccacttagcttggcatcaccggcgacggaggagggggaggggtttggtgtccggtggaagaggaactggaggcggcaacaacctcgttggcggcggcggcggttggcgaaacctgggagagatatgaaggacaagatccctgcggggaggtgaaggaggggtgggcagcgaggaggcgggatgggacagcaacagggaggactaagtgaaaaggggagtggtggcgccgcactcagcaatgggagctcgagcttggagaagccatcaaggtaggaggcgagggtggagtcgaacttggtgaagctatggaggcaggcgaagagccgctagtcccccagccccctccttgacattggtggcacgccattcccatagtccccgaaccccctctccaacaccagtggcacgacattcccccagccccctctctggcaccaacggcaagccatcacacagcccctctctggtgccggttactactaccatcgccctgagcccctgccaccactccctccctcgccacttccgacaggggaatagtgaagggagagagggatagggagagggaggaaggaggaaaaagagagataatgagtataacaagtgggcctcatttatcttttttatttttttctagtcacttacatatggattcacttttattttgtgattggactaccacgtccttacatggttgactaagtcaatgagccacgtcagtgaaaaccgctctcaaaactcatcaagtggccatgtcactgaagttgtttcccaagttatgactacaacgtttctttctttctatgttctattgctcggttaataaaagatcacgctaatattaacaatttattagctacataggctataaattaaaagttaatgaaatactatctctcttcataagtataaacattactagaaaaggcatttttcccgacgcgaggtcttttttcgcaggcggacatgacctttggaaccaaataaccgcctacaaaaatataaatcggggtgaagttcattgtccgctttattttcgcaggcggaccacttaaccggattttcgcaggtgacccttatgtggtccgcctgcaaaaatcgtactaaaaaaaatcttaactccttatctcctcctcccaccccctccccaccactcatttctctctctccctcaacacttctcctcccggcctcccctccacacctctcctctctcatcggcccctctcctcccctcacctctcctggccgccggccagaggcggcggtggcggcgcgtgctcctggcggcagcggcgacgggcggtggcggcggcggccggcgaggagggttgaggcggcacggctcccggcccctccctcccagatctggccggagggggtggggggaggacggtggccggcggcgcggatgacagcggagtgtggccgtgcggtggcggcggcggcggacgacggcggggcgcggccgtgaggcagcggcggcagacgatggctcccggcctctccctccctcccggcgatgtgggagtttttgctgatgaagatggatgagctatatgtataaagtgattttaggaatgattttacatgtgattttgtttgctttctttgcttgaattgattcttgtgaaactgaaatatggctggtgtgtgtgaaactgaattttggatgaactggtgacttctttgttgaatttggattcactggattggatgggaaatgtgtgggaactggattgggaacgggaatctactgccggaaacggcggtgggtgcctttttttagcgctggaagctattttcacaggcgaaccaattacacgcctgcaaaaatcaactatttttacaatcgttgagttgcaggaggaccgcttgcccgccagtgaaatggtgattggcccgcctggaaaaacactttttccagtagtgaaaggatcctaaccattcatccggacaaagatcctttaaatgccatcgtacaaacgattttgtccc

SEQ ID NO: 47462 - DNA, 5598 bp, Oryza sativa
gatggtatttttgggacaaaatcatttgtacgatggcatttcttggaaatcacacttgtcgatgatatttctgggacttagacgcttgtcaatggcattttatggattatctattatatttatggatgaaaagagtagtgtgatgaagaaggatgagagtgaatccgaatcttccgccattcatcaaaccatgtggtcaaactggtggccaacgccttccttcccatacgctgaactgctacatatggcactactctgctcgtgttgccgcatgcacatgtagcgtcgctgcctgtatgtgcttgtcgatcgctcacctagtccagataaccaacaggagatagatggcgagagatgtggctacttaaaaggccttgtttggttaatgagccacagaaattattttccacatattcaaagacacctttaaaattctaaccattcgctctctctcttctatttaatattaatccttgatttttcttttcaggaatacgcaaaaggattgtgcacctttgtgttaagactttaagagaaataaaatttacgcaaacggcaaaacaaagaaatgaagagggatttgggaagaaaaggaggaaaaggaggaaaaagaggacttaagcctattctcgcgattacaatgggacgaccaaacgacctagcacgctaagaaggtagcgttggcgacaggggatgggcgagatgccaaagggcagcctcttgcgccatgcctactaccacctcggaccagggccaagaacagttgttgaacacgcggttgttccgttccttccaaatggaccacgccccaagggtcacgaccgtgtcgaatccacaacgatgctccctcggaactttgagtcggcgggagcagtgccactcgtggaaggaaacatcgctagagaggaagcaatgtgggagcccgaggctcgagaggacggtccaccacagctgtagggacttggggcacctaattagaatgtgatcaattggctcatcctgttggtcacagaagacacaacaggtaggatgcggcaagccacgtttctccaagcggtcagccatccagcagtggcgatgagcaaccaaccatagaaagtagcgatatcgaggaggggcgaaagaacgccagataggtagatgccgggatggaatccttcctcagaagaggacaagataggccgagtgggtggaatacgaccccaagtctcatctcattcatttttcaattccaatcctatctctcatttttctattatctaaacatactgtaggggtgatttgtacttcctccgtttaatattataagactttctaacattaccaacatttatatatatgttaatgaatctagacatatatgtgtgactagattcattaacatctatattaatatgagaaatgctagaaagtcttataacctgaaacggggtagtagatattatagatacttcaatttgttttttaatggatatagctaaaggaagaggtgtgggcattaccaatgttcggtaacaacctactagtaaatacatctatatatttattaattttacaaaaaaaattatggttaaaatgatcctacgtcttacgtttttttaaaccaaacggttaaaatcttgtttgcaagaattttcgaagaaaatttagtaaagcacccctgctcttttagaaactaagctcagcgcaaaattgctcagaaatataaattcctctctttctctcttcaaattcctctctttctctcttccacaagctgtgcgacggcgtggtggcgagaatgcgaggcgccgcccacctcgcgcgttccgccgacgagcgcgtggacggcctccccgcgccctagccttctcccctgtgcggccgcggcggcctggccttaccctcctcgcgcgaacggcggcaggtgagcaggttctggagggtgccacgcggccggacgacctccttcctttcccttcccttttgcccgcctgaatccctcacgtttcgaatcgaatagaaatatagaatagcagctcgtgttctttctccccgcaaaataaaataaaatagaataaattattttgtggggttcggccgctgaatgatccccattccccgtgttaggtcctttactgttgattggatggatgccttcttgccatgataaatcgcgtctcgtttatgtcatatatgtggcctgttttcattttgttgttaatgaaatttggaatgccgcttcaggaaaattagtaagattagtgttaatgctattgtgttatccctgtcagccagtaagcaaaatctagaatggtatgatgttcttgaaggtagtaacttttttttttcttttcaaagaatgttcttgaaggttacttgatcttactatgcagagaaatatagtagtaccgtgttcttgattacagatggtgtgtctttgcttcaaatttgtaaatattctagttttgtttggacctgagactgtagttgagctgattctgcctatgcccatttctgaaagaagctatctggagtaatctgttcgttagtataaaagcagcatgggttgcatttttctgtgtgaagctgtctatggttagtgcaatagcataactggttgccttttttgttttcgtgaaggatgagttgattcttcttatgtcatttttgtgtcaagtttgtatggttactataaaagcacaattggtttccatttttgttttcgtggagaaggatgagttgattcttcttatgtcatttgtgcgtgatgctgtccatggttagtacaagggcatcattggctgaatggctgtcatttttcttcccaggtgaaaggatttgcgtccacctgcaaaggcagcaactggagataccgagaaatgggaggggcacttaacaagttcacaagcactctggaaactgctgcgttatcactactctgggaaccgtatgatattcatgattaacctctgcggcaaatggatttgaagcattttccacgcaggtcagcaaactgaatttcgaccatcgcactattcattttattgaagaattgaaagttgttgggcacttagactaactaagtgaagtgcttaattgctgattatcgggtgtgtgaatctgcagcaacgagttgaattgattaaattcataaaagataaaggctgcaattgatcattgtaattaagatcttgtgtgcatcttgtctcctttaataattcactaggtgaggtctctaccttttcagagataacataagatatgacatattgcacatgttctaccattggcccatagataaccatatcgtatggcatactacaacttcaaaaccctttttcacaacactaaagtagggaatagggtagagaagaaatatgttatagctacacatttgatttcctgaatggaggaccatggtgaaacaacacaacaacagaaatggataaacattgcaaaaaggagacctgtttgtgctcataaactagtatctcatgctatacgcacatgaaaacaggagtgaagaacacagcacccaccctgacgtggaaacatgcttttttgacttaggatggaagacatttagtacatcaataaaaggcactttgctatagcaatattagactgtctggattgattctatttatctacaaggatgatcttaccaatgtcacgtaccaattgttactgctaattttctatgctgttggaaaggaaaacaaggttcatgtaggcatcgtatagtgactatatttaagtctctgttaaactgtaagcaattcaacatagtactatttgcttatcaaattagtggactgtgctagtttttctaatgtcacccaagcacagtagcaacgattttggtctactttgtagatttatatcaccaaaggaattgaaaattcagaatttggggatccaaaacccagactcttgaaatgtgaacaggtgcatatgtcatgactttatggagccaaggacccatatgcatttcttgtggttatccatgctcagaagaatatatcagtcagagaaacattaagacaaagtaagacagaagagtcagttaattttgtttaacgtggcttcaaagttcaaaaatattgtggtattcctacttcaactgctctgcattagtggtgttctgcagcttgtttctatagcatgtaaggtggatacctgctgctagttatcaagaagcagcctatgtttgaacagttctcctagtgcatgcacaacttcaaatcaacccctaagattacttatttgagaataccaggatctaacttcactaaagaggcatcaactttacatatagtgcagcatgaggaatccgatttcaggaagccttagtaacatatgttcgacattagggataaatacacatatattcttcaagagcaccactgctcgacagtgctaacattctatccttcaaatgctgtaaacaggaaggaaacagcctcagccttgtagcttaaatcccaatgatttgatggcagcggtcttcacagtaggtatcttggtgaaacagtgctctctggtctccaatagtctattcataaaacagtgctggcttgaaattgacacatctgctctctctctctctctctctctctctctctctctccactttcttcaggttattggtaaaacaattagcatgttgtatgaaccaaccttgcaatgatgaggtttgtcttgaggaatagcagcagtactgcaagtaattcaatatagacaagcatgcaatagccatatttccagctcaaactttatggatgtatataattatatagattggtgtgctccagcattttgtcatcagcttctgggcatcctcttgctctaaacactaaagatgatcatgtgccttgtttatgttctttgtccaaaaaggcatgtacgcgaactgtcaactacaatatattttattattttacctgtcaacagtctaggaatatgcgtttctgtagaatatgcattggaccttgatcttcctatattatttcatatctcctatgtagcaaaataaatgattttagactatggcaaataaattccaaaattacctttgatatttggaaattatgtgttgttatcctatcttttgctaactacaaaggtacaagtaaaatgagctcacaaagtgccaattttagtgttgctgtgctctggaatataattatctaagagaatctttaccagttctagtagtattttttttggtggctccagataagtggttattaattatttaacatttttataactagtaaaattgcagattaaatactatcgcaatgccaaattaaacctaattttactgtgtaaaaacacttgcagatgtatagttcttcatttcctcaaaacatcaaatgatgcatagaaggatatggacataattggttggtctattaggtgatataagcgattttgatctagggcaaatttttttcccatagataatttcctaaggtgttgatatgattatatgaatatggctaaaactagggcacgatgcatgacatacagtttcccttctattttcctaacaaatatgaacaataatatgactataaccgagatcattacaaagtgttacaatgagcatag

SEQ ID NO: 47463 - DNA, 10257 bp, Oryza sativa
  unsure (1)..(10257): unsure at all n locations
taagacctttactgacactaaccatttaaacaagtatctatcatttttttttgagaaagtacaattggatgcacacacccacacacgccacactaacaccaccagacgtgtgcatttcctctgcacacgcttcacacgccacctagagcgcaggcccacgcatgctcactaaaagcacaagtgcgtgtgtacttctgacattagtgggtaccaacgtcaaatttaggatttgaaccttggtggcctaggtgcacagcttcaccacctagccatttagccatatgcaagcttccagtatgtcattttaatatactgttccaggttaggattctcttatcactatccagctgagataccaataagtcattatctttgctccaattatacattttattcctcttttcagcatctactgaaagtagtggatgggaccagctaataaaatatacaactataactgaaaaaccacgggaagtagctactagaaagatttatccatccttttctgcatgaagtggaataaaggtagaatttcctgcccaccatgcatcttcctttttatcatccagttttcatttggtttcagtgtgaaagcatagggatgccactgtttctcttctttctttttagtaggatgcctccttcggccatttgatggttatgtcttatttccaatctttgctgttagctttttttctgacaatctttcagatatgtgagatgtggcgaaaaggagcagatagtagagctcctttggttcatcagatgatagatctgcctgagcggtccaggccttgtggtcttgcatgttagatacccctagatgtttttatccatctgattgtctttgagaaatttattggtctgatttagctagaggaagggcacagctctaactgattgaacagtggtgttgctaataatagatattacacatatgaatttgattattgaaaatacatacattgttgttggtagatgtacttttatttaatttacttaccattgttctgagttcgtaacttcctgttgttcctatatttttgtgaagtggctttttaacagttggcttattggctagtgactttgtaagtcactttcattacctctctcttttctttgaacgaaccagcagagtgctaattcatacattcaaaaaaaaaggagaatgaaagtgacttacgaaatcactagccaactcactttcattctcaaatacatagaaaataaatgattctccagtcgttatctgattctgttatgtgttttgtgcacaaggttgtggccaagggctgctacacccttgtttttgttttgtcaagtatccgtttctgttcaaccagtgcaagtccaagcataacaccggaatgacatagctgtaaactcgttgaaaatggaaaattattatactgcaaggaagttcaactatgttagttgtgatagttggtgaccctgagtggacaagtactggctgattgtataattttttgttcccctgagaaatggaattccggggtacccattgtaaggaagaaaaaaaaggttcatttgtatttgggattactctgtcctggcgcagtgttatcctatgaaaaacaaatatcattgttgggcgaacaatttttgggtgcttgttcatatttcatgtccatggtaattttcattatttattttacaggatgttagtcctatcatctttgattttttttcatggttgattgtataaatcctaattgaaatatgccaattttgtcatctgcatagcatgcaacctcaattttgttcaatgaaatcaactgagttgtacggaggcagagtttggtggaaggttgccaatggtttgtactctgattatctatataattcaggaaataggataattactttctgttaaatactcaatgcagaatttcaacggttgatgtcattctagggaggcatgaaaatctctcccgaaactcatgtttagtataagatatcttgtaaagtttaaatttgctagatttagtgaatctgtcctccttaaaacattaagtggtcatcagtcactaacgaactttgtcggcttgcgttgtgtgacattcagataggctgtttcccaactctgttacagttacttgcacacactctggagtatttgaattgtagaaataacttctttgtctataaataatgtaatttcataaaatatatattagcaatataatactgttaaaatatttatttattacatctatacagttgcttcttcgggaacaaaccttgttctaggtgctactgttctacaaacctctgctgtgcagtgtcacaaatattcttaaatatctcttgctgtctaggatataaaccacagaaaccaaatgaaatacagagctcagcaacttgtagcattggtactcgagttattgttcaacagtttcatgaaagaaaagtactctgtccttttgttatgctttattcacaggagggcattatcaatgtagaataaaggttttgcatgttataagaaaaatccttttttcctctatatatacaccccccctcttgtgcatggctcattgtgtctcagctctctccacctgcttgaactgatctctaaagcttagccatatatggagtattcaaatttgcgtcgccaaatcatctttatgaagaaaaatcttttcgatcaggtttcatgccttcacttttgttcctttgagaaatgagatcgtaattaattagtgtattgcactagacactagttgatgttttattgcttctcagttcctgagctgcaatattagatgagatagttaactaggagagagagttagtttcttcagtttttgtcttacatgtaagtatataacaaagtttgattgcacccttggacatcccctgagggcacactgaacccctggagaaaagcattatcaatcaatggtcagatatgtggtcatgtggagcttatatcattcatgcactctgtttcaattgtgaatttcatttgcaacagcataactcagttttgtagtgtagtctactagtctgggatgatgcaataatgctcacttagcagttggcacccatcttatcttatctaaaagttatacaactttcttttacatcacatatgcatgcattatgataatgagtttaagcagatcgtcaaggatgtaatatgccatagacaatagcaaaccactttcttaatttcctttgtactattccattgagaatatacaaaaagtcaggtctttcaacctttagagagtaatcatagagtagcatcaatttgatgatacattagtatctcctaggcaaatactagatttcctttatacttaactagggtgaagcctactccctccatcccataaaaaaccaacctagtaccggatgcgacacatcctagtactacgaatctagacatatatacgtccagattcatagtactagaaaatatcacatccggttctagattcgttttttatgggacgaagggagtaagtcacttgctggaacctgactttttttttaatctttgactaattatatagatttacccttgtaaattagtacacttatttgtattatatggactgcacaaaagttttttttttggttgtgtatttcatgcttctttcttttgcctataatctacctcgtggttttcctgcagggttaccttgatgaacagtttaatcagctggaagaactgcaggatgaatcaagccccaattttgttgaggaagttgcggctctgttcttcaaagattcatcaagactgttgacaaatatagaacaagcaatgtaagtaatatgtctgcatccacgatatgaatagataattgattttttgtacaatgattacccatgatttgaaagacatgacaattacatttacttccatttcttttgatgcagtgataaataccctcaggatttctacagattagattctcttgtgcaacaactcaaaggcagcggatccaggtataaaactggggcatatgcccagaacacagagtgaacaatattcttttacaggtctcatcagtgtaaaatcatgtcttaggtcttaaataaccaatataaaaacattcaaacttaagaatgcttattgatgtgaaatgaacaaatattatttgttaatatgaatgttctcaccgaaagcttgtcatctttgcctgctttatgtgttcaaaattcgctaaagttggcctgtgtttggcgcagcattggtgcactgaggatgaagaatgagtgctctgtgttcaaagtaaactgcaatgacaggaatctggaagggtatgcatttcattgactcgtccaacttgttcttcacatactatccaatcatcatgcaatttcctcacatgatgtgatgaggccatgttctctttcagatgccgcaggtctcttcagaagatgaagagggagcatgccactctgaagcagaagctggaatcatattttcaggtatgttgtactacatccttgtctctctctctttctgtttaccttattttcagcattgctacatggctaaacaacttggttatctcctgttccttctgctgatgcagttactgaggcaagttggtccccgtgattatgcagtgagctcaaggaagtaagaagaacagtatgagttccaaggaaaataaagaacatatacatagcagctatcagtctcttgaaaattctgtcgctgaaaagtttttgtgccaatcagatactcataatgcttaatggtgcctttttgttgtgtttggattgcatctgtagctccataatccatatatactgtatgaagttatgtaaagccctgcttatgcacactctccttgcctgtctacaaagtgccatgaacttgtgttattagtcagtaattgtagcagaaagtgtcatggtactaatatgagcttttaatgtttgaaactagtaatatgtaaactagttttttgggttaattaattgcccaggtgccatcatggaaaactatttgtttgtactttgtatactcaacaaacgctatagtcacattcccagaaccaaagacacttaaaaacactggtttttcatctcttccactaatattcataacagtgtttgagctttaaccatcaatatcattttgaacgtttcgatttctaaaatcttaaaaacgttatgctagatttgtcttcagaagtcctaaaaatattcaataactttgnnctnatattcttncataagttttatactagtagtaataatttaatcataaaaaaatgattatctatagaaaaagaaatgagaggacaaaaaaaaaagaaagagaaacatcagaattgcagagggccaagccaatcatgggcttggtccataggcccaagagacaaagcccaatccatgggcctgggcttccctttccctccgttttatctactccgatgcacgcacagcttatccgattccatccattcctcaagctctcactcctctctcgcttccatggcgctcctcgccgtccacgccatggccgcgtccccggccaccttcccctcctcccaccaccacgccgccgtctcctcctactgcgcgctccccgccgccgccgcattctcccgctcccgctctcgcgtcgccgccgccgccgccgccaccctctcggccccgctcactccagttcttgaaggtaactgacatgcctacctaacctccctgtctctgttttgttcgtcaattcggattagtctggtgtgaaattggctcgatgatcttatatgaaactgcttttcaaatcgtattgcacgaattcaattgatacagcaccaaaacatagattgaaacaaaaacctcgcagtttgaaccaattacgattccaactcaaattactccatttggtgtgaccagtttactgcgggagaggggacaagaagaccaagaggggaaaaaggttcaaccactcgtacggaaatgtgagtctctagcacaaaaataaaattaataaaaaaatcatatgcttattgcttcctgtgctgctgtttgctgcaattcttcagacttgccatctgctgactgctgtttgctcatctcaggcgaggccgcgcaacaagaagaagggaactggccctgcacggctgttcgcgccgcctgcgcctccgaggaaggaccagttcgacgacggcgaggtcaccccgatcgacatcgacgatgacatcctggaataggttgtctgaatttccccccttgaattatggtttaccttgagcttaccttttgtctagtctgtaccaaacactgtttcttgaaattaattacagtacattacatggtctcattctacataatgtagatgcctatgatttctttccttgtaatatatatgaatggtgctgcttagagtcattttttatgcattaccagctgaagcagaacataagtacagatacaatcaccaaactttcatgttcttgctagaaaccagggaagatgcagtatctcttttttttttcttttctagctgtgtccctgaattcaagcaccttttgacatgcttcgaatttgttgtgatgatctgggaagcagttcttaagaatcaactaataaaccagtccatcagatcgggtcagaaatctgccccttttttgttgttttgtctgttgactctgttatgcgcttgagttttgacacaagaaattgttttgatgatctgcaaaacatattcctttaaagctggacaacaaaccagttcaactggtcagcttggtggtaattgtatgttaaaattctgtcattttttgttgtttcgtctgcaagtttgttgtgagctgctccccccgcccacaagggtaagcaactatctcgcccgaaatatactacaattttggcccaaactggaagtgtaaaccctgctacgcaatggctttaagaaccctaaaccctgaagcatgttttgtttgctaccatttcaagccatcacaaattttggtaagataacgaaccaaatatgttcgagtatccctaccttaccaaaatttggtaacgtacgaaacaaacccgccatctgttcaaaaatttggtgaagtaacaaaccaaacattttcccacagtcctaacatttgataagttcacacctctacagcatataaaaaatagagggggataaatagagcagttgtcagttgtcacttttactcaacttctgttactgttatctctccgaacctagaggcaacatcacttgtcttccactggactgaaaccagggtccagtgtgatgccaacctgctgcaaggctgcaacctattacaacaactgaacctcatgaaacaagacattttgcttttcattttgatgcattttgatttgaagaataaggttttaccctgattctgttaatgaaaccatcatttggattacagagtttgcaaccaatgcactagatttttatattaagaaatactagggttcattctcatttttttcaatcaacaggacaacatccatagtggtaacttgacaagatgagacaaacaatgcacaaaacatatattcttgaaaaaggaaaaatagtaacaatacatactcgatgttgccgtgcaagtttctagtactacttatatgtaccttaagcaaacattgcatattaatggaaaacatgtctcagctattttcgcaatgcagaggtggttctgaataattctgatcctccatatacattttggcaatgcggtatcttttttgagacagcagttaaaatttcatcaatctagccaccaaaaaatgtctcctcaaatcaatactcagagaacttaaggaaaaagaacatgaagttttttggataagccagatgcacatctgcactacacaaaagttgagccctaaaaatctcatatttagaccacctcatgagcccaaagctccaaaagcttggggttccgagttgcaattcctactatgagttccgctcaaagcataagttataaaacccaaccaagaaattgtattatggtcagttgctgaattgttcagattgcgtacagcgtacattttggtgtaaaaaggtgctctgctacactgccttttgctaagttgctggagcatccaacagtatagattcacttaactgctctttgttgtgctcattccaacaaaatcatgaaaccatgggttatcgcaagtgcagcaaggcatcgtgtagtggagaaaaggaattcagtgtgatttggttttcacattgctatctatttgctagagttagtggaataattttaattgatgagcatgataccgaggaggatttattaatgctatatttttcagttacaaattggggatttttggcccacggcaatacttgagatctcaatatataatgggtgcaatacatgcatgatattaggactgatggatgataaggttagtcaatggtgttttctcatggacaaaagatgctcaggtttttttaggaattcaatcattgatggatgggatttagatagaacttcatcaattgccatgtaaatctgagcttatgctttggtggaatcaacttgagcagacatatgagttgatggatgggatttagatagaacttcatcaattgccatgtaaatctgagcttatgctttggtggaatcaacttgagcagacatatgagttattattgttaaggagggagaaactattaaaccttgatgtggtcaatttcggtttgaactatctttcagatcatctaattgagctaaggaaggtggtcaacaacagttatcagatggcagctgccctagacttaagtggtgccgaccctgcacggttgaatcaaggactaataagccgtatggtgtattagcaaaacaatgataatttgtgggtagcgattttaaagccaactagaaaggtagcccgcggattcgcgtgggcatgtatcgtgggctgcgttgagaacggatcatattaatcagatagcctctgccatctttcggaagtacgtttcctcgacaaatattcttcatcaacatcactttgataatttctctaagttatatactatataatatttaattcatcagtataaccaaatatctataatctttatcattatataaaaaatagtagacttagtttgtttagaacatgtttaacaaattaagtgcatattaaaatcaaggtggtttttattttcattagttttggggggttggtgaaaatgtaagacctagctaaactcattgttccttttcccctaccatacggttttctcacagctcctagtcattgtgtcctacaactgagatgtggtcgttgcacctatgaaggtttccttgtgattcatcgtgattcatcgtagtggtgatctcatttttgtcaagcttagttagtccactttccatgtttttggtatagcctaaaatctaaatggactccaaagttaatgcttcaagtgtatattcatagacgattaatgctcatatagttgattcaccttttgactggtctatgcacaaagaaaataaatagagttaccgggaaggtgtagaaagccacaaccacacgcttgaatatatatatatatatatatatacatatacatatatatatatatatatatatacatatacatatatatatatatatacatatacatacatacatacatacatatacatacatatacatacatacatacatacatacatatatatacatatacatacatacatacatacatatacatacatacatacatacatacatatacatatacatacatacatacatacatacatacatatacatatacatacatacatacatacatacatacatatacatatacatacatacatacatacatatatatacatatatgcatacatacatgtacatatacatacatatatgcatacatacatgtacatatgtacatacatatatgcatacatacatgtacatatgtacatacatatatgcatacatacatgtacatatacatatatacatatatgtatacatatatgtatatatatatatatatatatgtatatatatgtatatatatatatgtatatatgtgtatatatatatatgtatatatatatatatgtatatatgtgtatatgtatatatgtatatatgtatatgtatatatgtatatatgtatatatgtatatgtatatatgtatatgtatatgtgtatatgtatatatgtatatatgtatatgtatatatatatgtatatatgtatatatgtatatgtatatatatatgtatatatgtatatgt

SEQ ID NO: 47464 - DNA, 11192 bp, Oryza sativa
tgaaacttctttgaattgttgagggcaatcacttacaaaaccaaaaaatctctgaagaaacaacgttgttgaggctcatcatccatgggtttcatctcaaaaatatattcggtgtcataacagcaacatgttaatgcaagatcttcaacctgtgtaattattactatcctgctgctcagaattacctctggaaaagcttgattgataagatcccatacggaggcagcccataagtcatcaataataattaaatacctggcaatattttatgcatattagatacattttttcagctaatatagtaacattcatgagaaatatataaatcgaataagtaaataaatgaggaagcaagttttacaggaagagatgtaatggaaaagatgttcaaattttgacccttcctataaatgttgggttcactatagagtccaaactgttatgcaatagtgtctgtctacgtattgcttgacggtatatgcaatagaattcaaatgggccagctaaagtggccaaattggcttattatcaaaaaccacatccccattaacatagctgtaggtatggcccttgagaatatgtatccccaataatcaatggtcaacggtcattctattgagcagttttgcaagaatcattaaaaatagtaccatcattaaacagaataaataagagtggataactagtgtatgcacccctgtgagtaattgaatgaaaataaagaactcgatttcggaatgtacattagtttcagtttggataatctatatataagcataggattatatacttcaaacaaattagaatctcaagatggggaaatcattgcaattatcatagggaagtctagagacttagaccatatcctatttattctctagattattttgcttagtactccttccgtttcatattataagtcgtttgattttttttctagtcaaactttgttgagtttgaccaagtttataaaaaaattagcaatatctaaaatatcaaattagtttcattaaatctaacatgtaatatattttgataatatgcttgttttgtgttgataatcctaatatatttttctataaaattggtcaaacttaaagaagtttgactaggaaaaaagtcaaacgacttataatatgaaacggagggagtactatctatgtacagaattgatgcatggactattggcaaccaaaggatctgatgcattttgtgatggattggtttctttggcatgttccaagttctagcactgatataaaaatggacacaagaggcactacttagtaaagtataccttctatcttgaagatactccctgatgctgtcaataagcgcaagctccttataatcgtcaggtggctgcttccgctggagttgaaagaacatctcgcggaaaaccctcttcatatcaggcttccgggagatccggacgaaagctcgacagtcaaattgtcccccaattctgttgtacaacagtttggcaagtgtggtcttaccaatacctgaagatccaacaacagacaccaccttgagcttctgatcctcatcattggcgagccgctcgatgaactcgctcacccggccatcaatcactagctgggcatcttcttccccatacggcctagatggcaacatagggccaaatgacacatatctccgcctgtggtcgcagcaatccagaccatacctcccatgccgctcaatggcctcctcaacataaatcctgaactgcgacaccatcttccccatctgctggtgcctcttgagcctcttgggaagacgagcaaccttgacacggccgattctgcagacgaatctggccatggtgttcgcgcggcggccaggccgcggcgctgcgcagaactcgtcgatgtagtcctcgatgtcgtaggacagctcgcgcacctctctcatccagcgcttggccgtcgggggagggtcctccagctccgacagatcggcgaggtacgcggcgaccactccaaggtcgcctcccaggaggagcatccgatccttcacccccttgggtagcctgctgccatcgggagccacaagcagctcctccatcttcccaagaagggatcccatggctccctgtgaagcacaaatcggggcggcgaggggcggggcctccatccctgaggacggagatcgaatcaaccatggagtacagattgaagaactgggaaaatggggagaacgatgatggatatactcaccgagctgcttgtatcaagcaatatagagaaaagcaaattggatgagattcatcctggacggtatcgagaaaatcgcagcccaatgaagatacgaacccagctatcggaacttggaagttggaagagcactggtgaaggccgcagagaccaaagacggatcggcgcaagacacagcaagagcttttcgttcccgagggacatgatcatctaccttatcagcatgttttgacccagtacaatgggtcaacgtctattactttcaatataagacgctttgatatttttttaattaacttttttttcaaaatttgatcaagtgtatataaaattttaatgatatctatgacaagaaattagttcaattaaatataaactaatgtatatattgcttggtctttttttgacagagcgagtaggagagatagcaagataaccacagtcagatcgccagatcaatactacactcagcggatacaatacctaaacaagagtaggatattacctctcattgagagagtatgaacatgtctaaatccttatctccgcatccatacacttttaggtatcgagggctaccccttttattattgccgatttctagaatcaacagttggcgcaccaactaggggttgcgccgagtttcctgtcgacaagtgcgacggagccaatcatcgacgtcgttggattcaatttcgccctagggcgaaccttccactttgggagcttcgacttctttgccggcgacttaggcgagcttcccctctctaactcggattctgttactgcaaaatacgacagcccgggagatttgcttaactccagtgcaggtacaagacttgtctcaagtgtcaagagcgtgctagctgatttgatcctacaactagcaatgaaacaacaaatatagttagatgaacgatagccgatcgaccgataagccgatgtcgtatcgttagggtttagccgatgcagttaaaccaaattggctcaatctttatgatgaactgaacaaagcaaaccctaaatatgtcccatcggctataataccatctatcttgtttttatcaatcacgtttcagattgtatggtataagtcacctcttgttgagagatcgcaaccgatgccccgacttgaagcaagaactcgtcgaaaaacttaaaagaaaaaagggggcaatgcgccgaaagttgtattgattggatgttcgtccctttttacatgatcttgggtttatatttatacccaaattacaaaacctgtccattatagacacgactcaaactttcctaaagacaaaaggaaaaacaaaaagactcaaatttaggagataaaaggaaaaaaacaaaaaaaaagtccatatggcggactcttaccatatctctaattcaagccggtatcaatatcctaattaatagatataattgcgttaaatggactctatctctatacggcaatacatcagctatcttaatctaggcccaaaccgagcccaagtgaaaccgtatcggctgtcttcccatatcggctcatttgaatccgactctgcttccagccgatgcgctctctatctcaaatctgctttgattttcctcttcatctctgaatctgatgctaattttcgtggttaacaaattcaaactagtcaggaaggctcacgatcacttcaatcttgtttggtttcccgtatgtcatgaggacttgctccaagctcgttctctccaactcggattcaatccagttatggagatcaatcttggcgagttcgaatatttaatttccgatattcctgggtttttttcccttccactttatcattgttcattagattgatttctaatcaccgattaatcacatgtgatgttgcggcattattgctgtcgacaagtggcttcacctccatggttggtggactccgccgccatgggagtcttcgtcttaaccgccggccgccttcacctccgccaactagtgtttttgccttcatggctagcttataatgccaccgactagtgatcttgccttcacggctggcctattaagttgccgttgatgggcgtcttcgtcttcacagccgaccgccttcgcctccgccgactagtatcttcgcttttactactgccctattctgtcgccgactagtaatctcaccttcatggctggcctattacgttgccgttgatgggcatctttgtcttcaccgccagctaccttcgtcgctgcagactggtgtctttaccttcacgattggcctattatgcccccgctgatgggtgtcttcatcttcactgccgtccactgctgactggtgcctttgcctctgtggctgcatgatttcatcgttgctatgcgtcttcatcttcaccgcccgcctcctttgccgccaccgactagtgacctcgccttcacggctggcatattacgttgttgctgatgggcttcttcgtataaaccaccggccgcctttgcctccgctgactggagtcttcgctttcaggtcctctcgatcatctgccgttgatttgcatcctcgcctccacggttggtggactgcgccaccgccgttgatgggcaacctcgtcttcactgtcggtcgcctctaccaccatcaattggtcttctcgcctccatggttttgcgactttgccgtcattgcttgataactttatctttgccgccggccgccacaactgcttctacggttggtgtcttgaacctgtctaaattattgtcttcacatccatcaacttttagtctcatgtgctatccccttttattattatcgatttcctgaatcgagggtgcgtttggtgggaaaattataaagagggaatggaattttgagatgcggttgggggaattgaggagtgaccccttgctttttaatacctgctttggggtgggagttgggagactatctcagcccttgatcatcacaaaaaatctagacccatcgaatctctttagaaattctaggcattcctagcaaacaagggatcgagactagggtcctatttaatttgtaatcaaaacattcgaatttttgagaatttcaatccagcagagaaaaatatattatgaaggcatttgatacaaaatatttaaacttttatggattggataatcgtattgagattttgaaggatagttagtatgagctccaacctgcctaattaaataccatccctataagtttttcctgtgttctgtaaccttatattttttttaaaatcctatggtttttcatgtgttttataacattgtattttgcacttgtatttctcttaaaatcctatgtttttctattaattcgtttttttttccaatcccactttttaaaggagaataaaagaaaaaaaaatcttgcctacgaccaaggtgttgagacttgagcgttctgtctgttgcccgttgacgagcttaggaattaggattaaggtgtcaagagtcaactctagcaggcatggtttcctagagagaggtcttcgttgctgcctatcgttcttgtgtgtcctaaaaaattcgagtggagagggaagaaccagtagcgctagcgcaagcagattgtggttggcggccatggagaccgcggtgctgagcgccgtgctcagaacgctggggccgaagctctacgcgttcctccgtgacgggcacgacctgttgcggcgggacctggagcgcgacgtccactacatccggaacgagctcgccatgatcgccgccgcgatcgaggagcacgaccgccgcccgccgcccgccgcaggcgacgtgcggagcgcctggatccgcggcgtgcgcgacctggcctgcgacatggaggactgcgtcgaccgcttcgtgcaccgcgccaccggccacggcctggcctccatgggcgcccgcgccaagttcgccgccgtgatccaggagctcaggaggaaatccgaggagctgtcccgcctcagagccagttacgccgccgccgccggcgagcccagctgctgggtggctacaggatcatccgcgttgaccctgccggcgtcgtcgtctgaggcgcacacccttgcatctgacatcgtggggatggacgggccccgggacgagattcttgagctgataggggaaacccagggccagctcaaggtgatctccattgttgggtttggtgggttagggaagacgcttcttgccaggcaaatctacgagagcgacgccgtcgccgcgcaattccatccacggatttgggttcgtgccgcggggaagaacgcagaggatgtcctcatggacattctccagcagctggggatgccggtacatcactgccatgccagcaatctcgttgtaaatctcagaaattgccttgaatccaagaggtaagaaaccaaccactgacatgttcaactgttgttactgtttgttaccaaatcaatctctgttgtgtgtccttcatcctacaccttttgcggcctctgaaagcaattgcttccaagaactacgagggattgaggagcactagagttgtttttcttgatttgttttatactcaacttaaacgaagtatcagaaggtacaacgtattttagtactaatctacatttcagtcatacagagtaaggtgagtacaaaaagttagccctcaagtgcagaaagaatcacatgtatgcggtatccctcaagttcagtttcgccttaatccgtgtgatagaaagccagaataggagtaaacaaaagatgtatgaattgctgtgtgcatgcattaacagttctgatttccctgtatatgcatcacgcatgtagatctggtcaccttattgatgtagtttttcagaaaactgtcctttgactctgcaccaagtgacccattctgaatgcttattttcaggttctttgttgtaattgacgacatgcagagggaatattggaacagctctttcagaaatgcctttccttctgatacgggactgagcagcattgtgatcgtaacgacggccatccagtccatagcaaatgcctgcagctctcgcaacagccatgtgtacgtgatgagaaccctgaatgaggaacactcaagacagctattcttgaaagaagcatcatggaaagattacccaccaggttcagaagcaatcctgaagaaatgtgatggtctgccgcttgctctcgtcacaacagcccaattcttgcaaagcagatgtcagcagcagcctctgggatgcgcaaagctgtgcgacaacctgggtaagcatcttgtgacagaagacaccttagcaagaatgaagcgtgtgcttgttcaccattacagcagcctccctggccatgtcatcaaggcctgcttgctctacctgggaattttccccagtggtcatcctgtcaggagaaaaactctgataaggagatggtcagctgaaggattcgtgggagcagaccatcaccggagctctctagatgtcgccatcgacagcttcgaggagctcgttaaccggagcatcatccagcctgttgatgtgagcagcaacactgaggtgaagacctgccaaactcacggtatgatgcttgagttcatcctgcacaaatccatatgtgacaacttcatcacatttctgtacggtcaggctcgcctgcctgacaagatccgttgcgtttccatacaacagaacagtggtagtaagaccagagtggattcagacattgatctgtcccttgtccggtctctgacgatcttcggaaaagcgcacaagtctttcctgaatttctccaggtataaacttctccgggttttggatctcgaagagtgtgatgaattggaggacgagcatctgaagaagatatgcaagcggttgcttctcaagtacctaagcctcggccgtggaattacagtgcttccaaaggagatcgcaaagctgaaatttcttgagacgctcgatttacggcgaacggtgattaagtttcttcccatacaagtgctcgagctgccatgtctgattcatctgtttggagtgttcaagatccaagatgctgaccagcaaatgaggaagctcaaatccttcctgacggagaaaagcaagttggagacactggccggatttgtcaccgataggtgccaaacatttcctcagctcatgaaacatatgaccaacttggcaaaggtgaaaatatggtgcgagaacaccgcagatgccagcagcagcagcaactctgatgttcacctgtcagaggccattcaggagttcatccagagaggcacagatgtgaacgatgtccgatcactctctctcgatgtcggcgaatgctcccaagaatttctcaacttctctttaggagattcatgctacctaagctccctgaagctgaaaggaaacaagatatgcaggttgccaccgttcgtcacctcgctggccgttctcactgatctgtgcctctcatcctctgatcgcctcagctctgatgttcttgcggccctgagcaacgtccgcgcgctgcgttacctgaagctgatcgcgcgtcacctggacaggttcgtgatcgaacgcggcgatctgcagagcctgcgacgcctgcacatcgtggtggtgtccatgacgacgatgagcaagcagcagccagagatccaggagggagccctgccgaatctggagtcgttccatctcctctgcaaggatctggatggcccctgcggccatggaggcatcaggatcgactccctcgggctcgggtgcctcagggagattgttcttgacgacggagttcgtgagacggcgaaggagcagtggaaggacgcggcgaggcggcacccgaagcggcccaaggtggtgttcgtcggagcgggagacgtcgtcgatcggcggcgggtgggtgctgctgctgctgccgcgcctgcagcaggagagagcaattctgcgatggcaccggcggcggtggcttcggtggtggccgccggcgacgtcaagaggccggctagggaggaatccgatatctccgccgcgctggcgagccttccggcgaagatggcgaggctgctcggcgctgcgagcatccaccagagtagtgggactcagggcgagctgtcctgcggcgggaacggagcatcacagcgccatttcagctagacagagatacagagagcatagcgtggtaacgggtaactatctctgttacctctgttccatattacatgtcgtttttagttatattctaagttgaacttgtatagttttgatcgagttacatataaaagtaaatactactccactataagagcaggtacaatagcaaattataagctagctatacacatattttaagaagataaaataggggagagaaaagcagtcggctacatatttgtagccagctatagtatggactctgagacacattgtgtgtgtatgatagatgagaccagatttaatagggtagtatgtaactgttgtatgaattagctattaaattaactatagatgatttaaagctattagttggctatactattaaacttgctctaaaacatgttaattaaaatccactataaaacatgttgttctgatagtgtatttatttagtattggagatgttaattattttttactgtataaatttgctcttaaaaataaatttgaccgagtataatactagaacacctcccgttgtggaactaaacctccaattaatgtaagcatctaggaagaagaatctttatttctttaattcagcttcacaagagaaagttacactcaacctgagtacctgacgttttatctgcgcttccgcaacgtcttatttgctcacggattacatatgactgcaagtacatacacatttccaattattaggcaacagtaattactcactaattggccttggttaggcttatttacgtgttctaattggtgataactagagacatatttaattattagtcattatttctagcttttgagagagatgatcccattctggatattccactgcatgctccagtggttgttgacgttcttgtaagtccaataggcccatccgaaggtagctcgtccataaacatctagctgggcttgtgcaaacctctgataatcctggttagatgctccctgcacattccactcagccacccactctcctgcatatataattaagcaacatatatgtatcgatcacgttcaagaacttgtaatcttcatgtataaacagtactcactccctctctaggttggttgaaagtaattgtcattttggatatggccaatattaaatttcaagaatttcgactacaaatatcttctaaaatatttttttcttctgaatatgaagaccatatatataaattaatcttaaaatacactttaataaaataatatatttgttaatatttacatatattgtagtaaaaaatactgattagaattatttctttgagaccgtgtcctccaaaacgacatttactttcaacatgaagcgagtgctccatgttgaaagtaattaaattcgctagagaaacttgcaaatgaacttacccacgaacgtcagcggcccattcggccttgtgacggtgctgagttcgtcggagcggttggtcctgacgtagtcgatgttctggtcgacggtgaggccgttgaagctgctggtgaagaggttgtagtagtggacgtcgaggacggcgccggggaagccggcggcgaagccgaggagctccgtgttgctggcggagaggcggttggacatgaccacgtacgccgtcgaggtgtacttgcggacggcgttgtagccgtccttgtagtatctcatgagagccgggagagtcaccccgggtgccagtggctcgttcaggagctccacggccaggaggctggggctactcgcgtatctgtgtagagtaatttaattatttgagagtaaagttcagcaaactataataattatttgaatgaaactatcatttcgctcaactttagttttgtgctgtatttcacaacgggtttatcatacaactatgagcaatttta

SEQ ID NO: 47465 - DNA, 15925 bp, Oryza sativa
atagaataaaatatgttatttgtctctatttcctctctcctcctaatactagttgctatctatatacattgtgaagataacaatagttatagtccatatatgtgggtcccatctatatggactacttttgctatatacattgttgttgccctaactgtagctcattgagatagagaagaaactgttattcacatgaccaactgcttcctgtagcctccaataatacaatgatttatgtacttgtaaaaggaagctatcctatcctaattaagctaacagacccttgttgattacatgtttaaaccagtatttcataaagtttaggcagcttggcaatctcaacaagaaaggaacatatatatatcaaaggcagtttgttattttgttgggtcatcatccatattacgaaacggcaaaacttaaccaatcaaccaaactttggcgctccagccctctgaagcaacatcaggtagcttaggtcaaaaccatttcagaatgcataaccacaattgcacacatactagataacagaagaattgcctgatagaaagcacaacatgtcgatttagtaactgatgagttttgcagttcagctgcagacgaacatacatataacatactcaagtgctaagctatatcacaacttatcaagcacgcaacatctgatgctgatagttttgctctcagtaaaaggtatatagaagtcttcttagagtatttcaacaacgtacgaatattgatacataactcacatccttcaaacgcggtcgtccacttcctcgtacatcttgaggatttgtgcgcacgcagcaagaggagcatccttctggaagcccagagcgttcgccaaccgaacattagatgtcacaccattgttgttggtgaggaagacaggagccctctcccgtccagcaacaatcttgccacactttgcgtccgggctgctcacaaggacagactcgcagagctcgtgctcatgctcatcgttgacagggatgttgtaggtgccagtgtggtcagtctggccctcgaagctgcatgtcttggcgccagtggatttcgatctgcactcaacctttaccttcgctcctgtggatggatggatagaaggaaagtcaacatacaaatatttagccatagaaggttactgataagattttagtcacctatgtgactataatatactaaaaaaattgcaagctgacttaaaccccatcaggcgttgcagaggttatcaaaaacatgcatttagtttctattatgtcatcaagagttagcttatgatttaataaaaaaattctgctcaaattaatatggttcccttattctacagcccagttgtggtttccttatttcctaatgtagcacatagcagcaaccacaaattgacaacatttttgcagataagatttgtaactgatgtcttgcaggttcacgtaaccatgtattttcacataaaagtgcaccagaccccacagtacctggtttatcttaaaagttgttactttagtcataatgcaaaaccttggtcatctagattgcaaatgttgagtaaaatagccatggatgtcacacttcggtttacaaatatgcagagtttctagcccttgatagttgatacaacaatgaatcatgcaatacattaggcagaacaggcttggagaatggaatatatgaaacacatgcaacattttggcaggtattacaagcatggctctaaacttttcatagtcaggaatgttgatccagcccagcattttgtgaaagtcggcatagttcagtacccaaaaatttccatctagtatggctagaagaaaccgagcactaacccatgagacaactgattgttgcttgatttcagaactatggttataaatgattcagtgaaggaaatctggagggaaaccatggttacaaactgattcatgacaggtctagtttgttcagtagcagatccatcagcacacagcctgtgatcacacatgtttagaccctgtttagatgggactaaaacttttaagtccctattacatcgaatgtttggacattaattataaatattaaacgtagactattaataaaacccatccataatcttggactaattcacgagacgaatctattgagcctaattaatccatgattagcctatgtgatgctacagtaaacattctctaattatagattaattaggcttaaaaaatttgtctcgtaaattagctttcatttatgtaattagttttgtaagtagtctatatttaatactctaaattagtgtctaaatacatggactaaagttaagtccctggatccaaacaccaccttaatcttctgagggaccatccaacctgaaggtaatgagccttaagatgtttatattattttacccttcagcaccaccttgaaactaagggcttgttttgttcattcccatgcacatttcaaaagatttggcaacaaaccaaatgagcaaccttgccatctcttctttttttggcaatgcacaaccttgccattcccagaattttggtatggtttgagcttggcaaagaaccaaacacaccctaaatcagtaccgtcttgcgcagatcccaccacccactacacaaaaaagactcaagtctggtgcgaatagtataggtactgttcatatacttccgaatttgtcttctattcctctatgtgcgagttaagtccaggctcaagaatctgtggagtggtacatgtatgttgtatgaatgctgacaatttttttgagaaatttccgtaaccatctggatggtatttgaacaaatgttcaaaacagtttctccaaccgaagattgcagactcgaattcggcagttccggtcttggaatctaaagatctagcacctctaccaaaccataggttctagcatttatactagacacgcacgtcacttagcttagatttgcagatctactcgaacaaactccacattccgcaagccgatctgaaaataactaaccaccagcagaaaaaaggccaatgctggcatcctgcaggcaagaacacacaacacacggtggcagagtgataacttcagcattaagcgagatcctactgcaggctacaactgctgagctcccggctcaccgacgggggaccgagtccgtacacagaccgggagggagtggagtaagtgtggtttagttaccggcgatgtaggtggaggcgggggtctcgaagccggcgaggcaggtgtcgcaccagacgcggccgcggacgacgaagcccgcgcggcgggggcggaggtcgcgggaggcggaggcggcggaggggaacgacgcgagggccatgcccaggaggacgaggaggagggagagcgcgcggggggacgccattgccgccggcgccaacgacgagctcgcgagtgaagcggcggagtggggcgagtgaggagtgaggagaggagactagactccagagaggaggaggaataatggtcgtgtggggtcgcgtgatggggtggatggatttatgcgcagcatgtgaccggttttgtgggggtgcgagcaccgcacggtgagtcggtgatggccaggacccaggagaatcaaaggcaaagctcgttgctaatcattttctgaaaatctaacaaattgggtttctcggtttctatcgtacaattatttttatttgactatatattttttaatttgaacgaaaatctaaattttttgagaaagctttttttttcgacgaatacaaggagctttattaattcataaaagattacagtctgagaaagattacagttttaagcaagatgacaaatagctgaggacttataacctaaggccagataggaaactacaggaccataaactctctcaaatagactctttatctgatctggtctctcgcattcttttttttatgattctacttaggggtttgagattttctccataatctatcgagttgctccaagacgaaatttgatgtttttcgattggaaccgctacagcagcaataatttgtgaggttatatgacattgtaacgttgaatgttgtagacatagtttttgaacttacgtgtattattacaaaatagttttcgaacttaggaaatgtggaataacgccatataccaaagttattacttactcgctcttaaagatatacttagtgtcggtttggttgtctactgttaaactttggctaagttttaacacaagcaatgtttaataagatattgtaaatataagtcatattaagattgttttagcacaacactggatctaagttttcttgaactctataaatttataatgtcgacgggattcccacggaccgtattctatgggtatcggggtatgttggtacgaggatctacacgatacgacatcgagcacataaaaagataggaattatactggttcaggcacctcacaaggtaatattcttaatccagtttatatgggattatagaagaatccacagagtacaacagagaacaacataactccaagattaccgacgagattcttgtcgagagagcctcgacgagatctatcgatgaattggcttcaagtcctccggattgcttatgtggtggcgggtgtcttgcactaagattcgatgccctatacctctcagggggtatctatttataccgcagatcaccttggtctccaagtagaacttggagacaacagaccccgcacgatatgacaacgtcattaattatcccctataagtaggactctgatatcccctgttcgtagatattattttcgtaaggactcatcaatttccttaattcaaatggatcctttccgtttacttgaagatataatgtatccgcatactttatgacttctaggatagaaggtatgtcttattcgtaaccctgacacacaattacgttgataatatttggataaaatattttcttccaattttaatgaaatctaaaattttaaactgtacaaagttcaaatctcctgtggatttgagaaccggggttgcgccaaacacgagtttggtaaaaagttggtggcaattcaaacatgaagcatataccaaagttaccaaatatttggtaggcaagttttggtttaaaatggtataagccatcaacttttatattattgtagctcacatgttaagttcaagatactgtacgtataagttgataaaaagaatgatattctcgtctattgtcttacatgttgtaatgccataagtcatgtattagtttgaatcaagtgatgctaaataatatatactactccctctattcttttttaatttaactataacttaaaaagttattatttctaaatacttgacattgtacacaagctaacctacgctactagtggagaaggtctagatacaagttcacgtatgacctttaggctgtgtttagtttcatgttaaaaatggaagtttgaagaaattggaacgatgtgatataaaagttggaagtttgtgtgtgtagtaaagttcgatgtaacggaaaagttgaaagtttgaagaaaaaatttaaaatctaaacaaggcattagaacatgagaatgtctcgtgctctcgccgaagatttccgtccaggacgaagcatatatctccctgaaatcaaattggatttgatgaagatagcgacacgcatccgttcaaattcaatgtgagcaaggatggagtagcaatgttctcaaaaaagcaaggatgacagtaggagcgatcgccatttcgtgcggctttggacgtttgccggtccatccatccagccccgttcacgggccgtcgactgctgcagtgcagctggggcggcagcgtcggtgcggaggatcacatgcgccgtttcccgtattccccgtatgcgcgcaccggcggttcgcttacctacacagctactccctccgtctcaaaagacttaggcagtgtttggcaaatatctaaggaaaatgatttccaacccatctttaaattctaaccattcattcttcgtcatccatttaatcctaaccctttatttatttcctaatcccaattccacctctcatttcctattatccaaacacacccttaattcttgagttttttgtccaatgtttgaccacctcttcttatatgaaattattttaattattattagatgataaaatatgaataatattttatgcatgatttatctttttaattttttttataatttttttaaataaaacgtacggtcaaacgttaaaattgagtttttggacggtgggattacacagccatacctcgctcgccgtgctactgctggaggaggaccccaacccgacgcggttttgcactttttccgtggccacctcaccttttcactggtggtgaatgatagaagagcttttcgctctaaaaaataaaaaatagtaatctatttatgaaatttaaaatagttaatataattatgcgttaatgcatcacctcgttttacgtatattctcaacttttttaaaaaaaaatgaaagggagatattaagattaagaagatatgtaaattatttcgaattttcttaaaaaaaattaatttgattttgtcaagcaactttttctaaaagcgcgcgcacaaaaacaagagagttttaatctttgtgctactgccagacgcagcctaacgctactttcatttgtataaatggagtgagctattttcctcgcctactaaatggtatatttttttaaaaaaaaactttctatatcgaagtggttttaaaaaattaaataaatatatttattaagtttatactggttaatatacttaattaattatatattaattatctgtaacatgaagggcccagccggacatggattttactttctaggtttcccgtagacccgtacaaattttgtggaaagaaatagtgctaagttccaagctggatgggctccaaggccatttataactagcacaatcgggttggtttatatatggtccacgtgtaaatttaagtttcgtaatttgtaggttatagtactcctgccgtggtgacccatgcataaatgtgaaagtggttaagtaatatcattttagtttgctccttttcttaacaaattggccgttttcaaaaccttattttgaagcttaaaaaaaaaaaagaccgcgggctcaacgccagaaccgttggcgctgaggttagccgtctccgcatcaaggtggttggcggtaacgccctgccagcatggcggccgagccgatctcctgccgacgtggcagggagcgctattttttttttctcaacccaaaactcagcgtcagccgtaatggcgctgagatttgcgactttgccaccaattcagttggctttctaatccagtaaattgaatgcatccagcatcatataactattccgctataattgatttttgacaaggaatgtatgctcatgatgtatatagcttattgcataccaatatgttactacacattttgatcgatcatgtcacaccgcacatggttgtgataaatagcggacggaccattcaggatagccataggaatggttaggttcgatctacttattccttacatcgatgcataaatttagtccaataaatttttaggaacgctacaaaacataaatggatcaaaccgaaccaaaccatcagaacctagctctgaatgcatgattcaacccaaaatgactccacatatataaatagccaaaaatttgtacaaagttgtctctctatataatagatcattcctataaaattgaattgaatttatcaagtttttatagtgtgaatttgagtttaaaaattttgggctagagtagaatttctttgtctattagtaatgcaatgtgtgccgacatgtataaatagctcataatttatttacgcatctaaatcccgtagatctcgtagtttatactacctccgtttttttaatagatgacgccgttgacttattctcacatgtttgatcattcatcttatttaaaaaatttacgtaattataatttatttttgttatgagttgttttatcactcatagtactttaagtgtgatttatatcttatatatttgtataaaatttttgaataagatgaatggtcaaacatataagaaaaagtcaacagcgtcatctattaaaaaacggagggagtacatccaaatgatgtcttcacgtctgcccgtttgagctttcttattacgtcttacaaactgaagatacgcgaccaaagcaacaaaaactttggagtacacgcgacatccatggtactgtacccccgttgttgcttgcactctctttccctattcacgtgggccaagcccaaatgttcattgtccatatattgccaaaggaataagttcaccagccgtgcctcaacttaacatcgagtttatttgacatcccttatcctcaataccagaaatcttcacctctaaactatataaaaccatccaatttagtcagcaaaaccaagtgtctatatgtggcaaatttgacccggtccactcgtgttggctagacgctgatgtggcaaaaacgaaagtgggccccacatgtcatcctcagtctccaccttatctcttcccctgctctctagtctatcccatgctcgtggtctctcctccctcgatgaggtgatggtggcggcggctgttgcagccggggtggtgaggaggtggcgtgggggtgtcggctggggcccacagcaacgacaagccgacgacggtcgacggcttgggctgacgaggaggcggcaccgactagaggcgggtgaggagacggtgtcagcagctgggtggcagggaggtggtggcggagcagggctagggtggaatggccggtggagcagagcgggggcgatggtgggcgagcacgggcgaccaacggttggcaggcggagcagtggagatccgaggaccgaggagcatgcacgagagacggcacaagagatcatgcatgaccgcaccgagcgcgcatgcgtgctaggcgaggaagaagccgacgagggcgtgccacaccccgagcaccaccgcgccggcatcgcacacttggcgttgcgatggacaccgccgcccaaaacaagctcgcagagtacggcgacacggcgacagagaagctcgaaagaggctacctgacgcagctctacccctcctgctccacattcctgcctagccgcgtcggctgcagagaaggcccacaaccgctccatgatgccaccttcaccaagcgatcgattggaaagggggagaggaagccggctggagtagggggacatgaggtcagtaggagagtggggtgaggatgccggtcatgccggcggagagggggaaagaggcggctactgccaccgctactctcgcacgctgctcgccgcccgtcgccaactgccacctccgctcggctgaagagaggagaggagaggagaagagaagagaaaagaagagaataaaagaaaagagaaaagagaagggaaaaaaagatgtggaccctacaatttttttcttgtcacttacatgtgggctgtcccttacatgtgggctccacgtacttgttttaattttttttttgcttactaggatgccacttcagcaaaaggaaaaagatgatgctaacacatggaccccacatttttcttctcacttacatgtgggccccacatttttatttttttattttttactaactaggatgccacatcagtgaaaccagatatttatactgtctcaggaccttttttagacggttttacatagttcagggtacatatttctaatattgttgttagggacctcaacagacttggcatacaattgagggaggatgttaggttaacttattccattgccaaatgctctagttcagatcacaacctgacgatggtccattttggctgaagtccattttgattccttcaactatttgccgaatctgattcatatctcttaaccgtaaaactaaatataaaggctctctctcaactattaaaaccggctcattttacctcctcaagtagtgtgagaaaccgaatctgattcattttggctctctctatccaatgtggcatctacatatgccattacagtgtgagaaaataatacggtacgattatggggcccacatgtcagtgacctctcttcctctaccctttcctctcttctcttccctgtttctctctatctctctcttttctcccagtggtttctagcttctaggggccacgactaacgaaagaggagctggatccagaggccgaggcaacaacgaccttgttagtgggagagctgtggcccgacccgggggatagtagccaggcggagcctagggatggttgtgttgaagaaaaggatggggtcacagaggatcttagtgtttgacaggtggtgctctctggagccatgcgggttgggaggggtccaacaaggacaaggaggctaattaggcggtcactagatgcggagatgaggagggagtgggagtagttgtgggcacggaagcaaccgtggtgcgggaaggcgggagagcaatacaactcaaaggtgccaaatctatcacgagtcccgacgaccgaacgatgacacccttgttggcttccgctggatacgcctccccatctcattctcttgtctctcgctaaccaacccatgctctaggtgatacacctccccgttgactcctgtgatctctccatcgccagctacctgcctccacagtccctaacaccagcgtgggagaaagagaggaggagcacgatgggtcaccgcaaggctctcggatcggtggcgctagattgagggttgttgccattacacgctctgctagtttcctttttggaccaacctcctcgccgagatctgcaggccattgcctttctccttccgtgccctcccgtctctgatggccttggcacctcaacccatcgagggaaagaagaggggaggagccgctaatgccttccctggctttggctctgccttactgccatcctcccaacctagctctctactactgctagaaggtgagacttgagagctgaggaagagggaagggaggagagaggagagaggagaaaggggagagtttacgaagaaattggttaagggtggatcaaggtgggagaggatgacacatgggtctcacttttccttattattttgtcaactttaatgtcatgtagtacatagctacatagctactccatgtagtacaaagactatgttaatgtgtcacgttggtgccacaccagtctaaaccaccatcactgcacatattatcctgctcctcttgtggaagcatcaagatcaaagaatataggaaaggtgatttattgatagagttgtgaatacgtaactccccctatcaagatttaaatcctagtatccacaaatatcacgcacaaacaaatactctttcaatgaatttcaatccaggtcttttctaagcactttgtcctcactcatgcgcactcgggaagaatttcccgatcggtcccgcttacatctagcagccaaactgtaacatcccgcctctcccaggccgggcccacttacatctagcagctctcataggtcatagactgccctcacagatcaacacaggtcttttctgcgcactttgtcctcactcttgcgcactccggaagaatttcccgatcggataaggtataccctctatccttggatgtacgatgggtaccgatacggtatacccacgcgtatacgaatagtttcagtatacgttaaggaaatctatcacgtgatagaagcagaatctacggacggaaggagtcctactcggacaagactgggtcattaccatatcgtgaggggtccgatatctccgagtcctacttggagatcaactgacccgcggtatataagggaccccctaggcatgacctaaggcatcgaatacgactgccaacacacccaccacagactacggagctggagcctacaggagccaagtcgccgggagatctagtcggaccaactcgactacagtctcgccggtatcatcgagttctgctattccctttgtaatctgtggtctctatcatataatcccataccaactggattagggctattacctaccaaggggcctgaaccagtataatccttgtcttctgtttgcttgatgtcgtactacgtagatcctcgtaccaacggaccccaataccctctatatccggtctacgggtattccccgtcgacaggaacatcttaccttttttttttaagaagggtattttttttacccagcctctatatccaaccgatatatgcagctttcttaaataaaaaacttagctatcaaataacccaatctaaaatccgctcgatcctatggagatttgaactcaggaccttagggaatatatgcagccttcttaaatcaaaaacttagccctcaaatgacccaatctaaaatccgctcgatcctatggagatttgaacttaggacattggggtgctacttaggtcactacaaccactagattgcatatcccttacactcttcaagaacatcttacctgtaataaaagaatgttataataaaaattagacaagttattttacgaggaaatcaaatgagttgtttcatacttgacgaatgaaaaatccatgattagacaaactttgaatttagcattgtatacgtatctttagtaatcacaccagatcacgttgtcatccgtgtgagagctaaagcacaggtaactaggcatttgaacggagatcagatctgcgagcttgtcgtcaaaagcgtgcgtccacacacagccagcgggtcaccggtgtgtctgtgggagaaaccggcggccggaggtgtggaatttcgtttaattcagcggcaatgcttcataatcatcgatcacaaactaagtactagtagttgagtatgcagagtgagatagatgcatctgccagtaatgtagctaactcggagagcaacatctcatatgtgtatatttgtgtactgatgtaccatgcattcacatatatatatatcctcatctcaatgatgttttttctgtacatgatcttacttacaagtcaagtcaagacatgcatgcatggagaaattagattatatagattaaacgcgacgcatgtgcctacctagtagaggattagtaaactgttaaaagtacatagcaagcaggccaatttggtctgacactcttatcttcaaaggacaaaattagaatgatcactcatatttgattaattaagccaagttgacgatggaaaattgtctagtggcgagctaaacctacaattaattggaatggcaactcagcgccctctagctaactgtgggtgtcagcttatctatataagtgcctctccttctcttctcctccaggcctactagctagctatagccaccatacctctctctttatctcgtctccagctgcgatcgatagtacaccgaccatggccacgccgagcagctcgtcaccgccggtgccgcccatccggtcggtgaacctcggcggctggctcgtgaccgagggctggatcctgccgtccctcttcgacgacattccaaacaacgacttcctcgtacttcctcccctctctttctctagtggagaaaaacgatttttcatggtgttggtctaatattttctctgacggtaaaatatgaaaaccgccagcaatgttttaacgaggggtgggaggcaacgaccgccaatgaaaaaatattttcattggcggccgagtaatacgggctgcctgcgaagatttttttattttcgctggcggtaccttctgagcgccgccagcgaaaataggtttatcttcactggcggtatgatgagctattttcgctggcagcgctctttggaacggaacattttagaacggaacgagtgtttgtcaatatttcttgagtccgtgcaatcaacatttgtaacctaattaactatgaacctgatatttgaaactcttatgtgtgttgcaggatggaacaaagctccagttcaagtcggtggtccacaacacgtacctctgcgccgaacatggcggcggcgacatcgtcgtcgccgaccggacggccgcatcgggatgggagaccttcaagctgtggagggtcgacgagaacacgttcaacctcaaggcgatcgacgacagcgccgtgcacttcgtgggcgtcgacggcaatggcgtggtcgtcgcgacggcggccactccggggccgtcagagacgttcgtgatcgtgcgcagcgaccgtgacaatagcaggatccgcatcagggcgtcaaatgggaaattcctgcaggtatataatggttatttggtaaaaaaaaaggaaatatttatgagatcatgaacgaaaaacctgctccctattatttttgagtttgtcttaactcaaacttcttaacaagtttataggataatattatataatatctacgaccttaagttagttccattcaatctattttatagtatatccgtatggaatggaggtttaaatgtttagattaagctttgcgagcaaaatatatagcatggatacgaataagctgttaggacggtagaccaaataatccatggtttgtgtgtacgagctagctcagtctaagttagaaatattatttcctatatgcgctactccctctacgtgacatgcatttgacttttctttatatccaagctacaactttgacataacttttatgaaaataagtttataaatgtaacaaattatgatatcatggaaataattttcaagacaaatctgcacatgttatttttatattttaacttaatatttaaaatgttttattatttaaattttcataaatttaaaaagtcaaacgccaagtatttttaacagaggccggcagtaacatttacaaagatgaagattattgtagtgtgtctaaatatggaaattctgatttatcagttattattcgatccattttaagctactacttcatccgtcccaaaatatggcaacttactattgaattagaaacagcttaatagcatgaatttggacaatctaaattcatactaatttaatactccctccatttcatattataagactttctagcattacatatattcttgaatatagatgttaataaatctatatgaatgtggagaatgctagaaagtcttataatatgaaacggatgaagtataagttagctatattttgaaacatatggagtatttatttttgtgaaagatagggttttgtcactaaataaaaggtcgaaatttctttcggaaatgttaggcgaagaccacggtttcagtgacggcagaccatggtgagggtacaagctggggtgatgatgatccttcagtatttgccataaaccggggggagaaacttcaaggagagtatcaactatgcaacggctatggcatgaagaaggccacggaagtactcagggtaagatatgaatccttggttcagctccacttgaccacttgttagatgaattatggaaaatacttgaaatttgatttataaaaatatatgagtttgcagatgggatgttcctaactagtacgacaaggcatgtgatgtgccatgacaatagaaaaaaaccgaactggcccaatggaaaaagcagcaccatatgtttcacttgttcggtttactagaaagaccgtccatactactgaccattctcacacaatttttttttacggacattctcacacaaattagtaaataataacagtgcccttaattaatactttttgtacgttaattaaagggaccacctatacatttgtcgacaaattttctactaaaaatttgacagatgtaattatagtacaatcgtagtataattacactggacctaggttgagatgacactgtgtcgaccattgatgtggtgggccccttaattagcgtccaaaaggtattcagatgggcactgttattacataataatttgtgtgaga

SEQ ID NO: 47466 - DNA, 3083 bp, Oryza sativa
ggattcttgaaacgaacatgcaagatacatgacagcaacagtctccccccatacaagttacagtgtaattacactacgattgtactgtaattacatctgacaaatatcagggggagaaatttgatgacaaatatctagcaaaatcgttaattaaatacacacatcttaatccgattagctacaattcctagcaataaagtctttaagggataaattaattttggagtgaattgcactttgggccaccttttattgctgtagtttcactttagatcaccctagtcaattttttcactttgtactagctaaatttatgcttattgcactttggatcatctcaactctcttcattagccatgtctacctatactccggcaaatgtacgacctgctcatagacggagaattttgctagctgttataaccgatgtcttcaaggttattgatgtgataaagaagtgattttaggtggtctaaaataaaacaaatgtaaacttagttagtctaaaataaaaagattagaccaaacgtaatccaaaataaaactacgacaataaaatgcggaaactctaatgggcaattgatcgccgtggcgatcgggtagcgatcgccccccctccctccctccacctggtttccgtttttggcaccgtattactttcctattttagtaaatttatgcacctaaagtttatacacctcaagtttacacatttaaagtttagagaccaaaagtttataagtcaaaagtttatatatccgattcaaatttgaatttaaattcaattttttttatatatagtatttctatacatctaaagtttatagacttaaaatttataagtcaaaagtttatataccgttttaaatttgaatttgaattatatcatattcaaatttgaatttgaattcaaatattttctatatatagtatttctatacatctaaaatttatatacctaaagtttatagatctaaagtttataagtcaaaagtttacatacccgattcaaatttgaatttaaattcaaattttttatatatagtatttctatatataaatttttctaactttttgttttttttaaaaaatattttgtggtgtactgtagtaggaagggaaaaatggaaggaggaagggggagaagagggaggagcgtatcgctatagggggtgctgatcgttttttttatcgcttgaccctccctccagcgagtgatcgcgtactaggaccacccaataaaatgtggccaaaagtgtaattcactcttaattttagttgtcaatggagcacgaaagaatagagagagtactatttcgttgaaaatatcatttatttgcactctggatgtcacggaattcgtaaacatgtaattgctacagtcataaaaacttcgtagaaatgaatggaaatttttagatttagttgttgctgccaaaaaaaaaaaaaactgaggggaaaagacgcctctaccctcgcaaccgatacatcagacagacttgtcttcgttagttcgttccctttgcccgagggtgccaccgaggctcgccgccgctctccgcttccaccgccggcgggagggggaggggggctcgatcgatctcgatagctcggctgggccggcgaatcagcctcggtagtggtaggcgagggagaggatccccgtggcggcgttgctggcgtcctcggtggaggcatcgagatggaggggcttcgtcgccggcgacctcggtggcaggtggcctcggcggcggcgggaaggggttccgtggccggtgacctcggtggtgtggtgtcatgggggacacgacgttgccggtgcctgggtggcggctgagtgggggaggcttggccggcgacttcgacttcgttgccggtaccaagcatttttgacatttgtgactttggatggtatattcgtaatttctaagtaaatcttccaaaacaatacttggtgaagaacagaaacctggtgctggttagtccaagccttacttggtgaacttttcagaaaacaatactttgcccttcaaatctatttttttagggaatccaaatcatgtccagttatttttcaacaatgctagataggtgtaatgtgtatttctactcaaccatgtcatttgtacgctcaaaattagcaaatttgaacgatttgcaagggaaaaaccatctggcctagaaaacttgcttcgacttgctcagaattgaagtttattagacacccttaatttatgtgtgcagaacgaaacctatatgaaatcagattattttcttcaaactaggaaatactatgacaatataactattatccttgctctcaatttgttccttgttttgcaggaacactggagcacatacatacttgagaacgacttcaagtttatctcatcaaatggattaaatgctgtaagaatccctgttggatggtggatcgccagtgacccaaaccctcctgcaccctttgttggcggatctctagaagcattggataatgcatttcgatgggcagagtaagaatatttacttttccatgtcaccacagtatagtagtttcttttttttttttagcaaaaccaccgtaatttcttcatcattaaataaattctcttagcttggattgaaaaaaggatgtcatatacgtaataagcgatctttgttgttgtgcacaggaagtacaatttaggtgtcattgtggacttgcatgctgcacctggatcgcagaatccatgggaacacagtggtagtagagatggttcacagacatggggcaccaccgatgaaaccatcatccaaactgttcaagtgattgatttccttgcatccaggtctgacaaagatatcaataaataatattttccttatcattatcttaaaaccggaaaagaaaaaccaaagggatctcatctttcgtcttaattggtctacagatatgccaaaagcccaagtctcctggcagttgaactactaaacgaaccgttggcaccaaaagtatcagctggaatgctaaagaaatactaccaagatgcgtacaatgctgtgcgaaaatatacatcagatgcatatgtgatcgggctgcagga

SEQ ID NO: 47467 - DNA, 3303 bp, Oryza sativa
tcctgcagcctgacaacacaacagcggagtggaatatacagtttgtgagaaatgatcgttctgctgagctcaggagtgtcacaaagcagaacgggcctctcacatatgtaggtaagttgtcgctctaacatgtctgctggtgtgctttactcctccattggatcaacagcgacaattatattcaatcaattgatcaataatacaatagctaagtgattctccgttccaaaatgtggtgttttacttttgtcctaagtcaaagtaatctaactttgatcaagtttatagaaaaagtgcaaaataattacaacattaagctaagacatatttcatcgtgcatttgaatgaaactaaattgatgatgtcgttgtagatgttggtgcattttttctataaactttaccaaagttagagaagtttgatttagtacgaaacaccttaattacaatatggaacagagtgagtagtatttgtcaaaactatatagtttgttgacactcgacactatctaaatgttattactcagtggtatattgtctggtatgagctcttgattgctacaggggaatgggtggctgagtggaaagtgaataatgcatccgaggaagattacaagaggtttgcgcaagcacaattggatgtgtacagccaagctacctttggatgggcctattggagcttcaagcatgtccagaaccattggagcttggagtggatgatcaagaatggttacatctcactaaatcagcctaagttacccatccgagcagtgaaccttggcggctggctcgtgacggagggctggattaagccatcactctttgatggcatttccaacaaagatctcctggtatatctattgaccaaaactatctgataccctctttctttcattttgtgctcaccctaccacgtaatgataagtaatcctaattgctgagatactataccacaattagctagctattttcatgtcctatattatatttccattattgatctcttggttaggatggcacccagctccaattcaaatcggtcaccaacaatatgtaccttgccgctgagaacggaggtggcagtgctattgttgccaaccgggagaaagcgtctggttgggagaccttcaaactgtggaggatcaacgagactacattcaatctcagggttttcaacaaccagtttgtgagcattggtggcaatggggcagttattgcaacagcaaccgtgccggggccgaatgaaacatttcagatcattcgccttgacagcgacaaaagcaggatgcgcataagggcacccaatgggaaattcttgcaggtaaggttaatttgcaaaacgaaaaatgccttgtcagtgtgcatctagttgttacctgctactatcatgtatgcattctctcaatatctgcggaacatatgtgattatttcaatttactgatgaatgtctattgatttaacaatcgtctagtttcaaggagtgatttttttttaattcaagttgttagtgtagtggttgtattatgctcatgcacctttggtagagctcaggtgctagatttctatactattaactagtttgcgcagcggtggaaattattattatgttcaaggactagagccaccacctaagtaatacacaccttaaatctagtgacagagcctacacgcatacaagattttaggacgcaaacggtgcaagggtgaaaatgtacttagtttgggaagttctatagcgacatactccctctgtcccattttaagtgcaaccatgattttccgtacccaactttaatcatccgtgttatttgaaaattttttgaaaaaatttaaaaacataagtcacacataaagtactattcatgttttatcatctaataacaataaaaatattaatcataaaaaactataaataagacggacaatcaaagttagatacaaaaacacatggttgcacttaaaataggacggagggagtatttctatggaaattctgcagccacctgtttttatggaaatgctattagccccatcttttcacttatgtttatgctttttaaccaaaatttaaattttcaaccttaaatttggaattgattttgggtttttttatcaaagtttatttttcagcctttgcttttagatcgctaagaacgcgtatataaaagttttattcacaaattatttttcttttgcaaatatgtcgtagccacctttaatttccatatgtaacaccatatcttaaattcatcttttttttaagggagatgtctaaaattcagataaaacagtcttcaggttagatttgtgaaatcttcaggttagtcgatcttaaaaaaactttttttatcatggttatctggtttaacctaacttaatttgttagtgttttttattgtgtgtgtctggcaacacagtgtggctattcgagaactgcatttggtttgataaagcgggcaagttgtgtagtagttatgcaaatcattttttttaaggtttctttcagtcgcacgtacttctattagattaactgcatcgtcaattgtaaatatatttctccttttgagatgttaggtgaaggccatgggttcagtcactgcagatcatggtgctagcacaaattggggaaatgatgacccatcagtctttgtagtaaataatatttatggcttgcaaggggaataccagatttgcaatggctacagtgcaggcaatgccacagaggtgctcagggtaagatgtgacactgttgtttctattctatttttgttgagacactgaatggataactgtaggcatacgatgtttagatcacttgttttttctatccttaaaaaccaaagtgttatatttgtatcactgttattattggttcaacaattccttttggttttgttcaatagtaatcttcaacaattaatatatgctgagttccttccaattttgtactagttaaagaaatggtagaacctcactgaatagagttattgtctttcttatgaagaaatctttcgaagaaagagaagctagcacttacatagtttatttatggtattcattactaattctagttgtcaaatgggcaagccaaaaaacagagcaatatgcatatccttttttgaaataaattactattgtagtgtataaaaatactcttcttcttgagacgaaaatatagtcataattgcagttcaatatctaaagttctttgtttgcaggagcactggaacacatttatagttgaggatgacttcaaattcatctcatcaaatgggctaaatgcagtgaggatcccagttggat

SEQ ID NO: 47468 - DNA, 721 bp, Oryza sativa
aattgacaaaaaaaaattatatttggtcagatctattgaaaatttgaaaatgctggagtgctcaactgatacattgtttggtatgcgctcttctttgcaacaggagaatgggtggccgagtggtacgtggataatgcatccaaggaagactaccaaaattttgcgcaagcgcagctagacctgtatgggaaagctacttttggatggtcctattggacattcaagaacgtcaagaaccactggagcatggagtggatgatcaagaatgggtacatctccctcaataatctgcctccatcatcaccacccatccggtcggtgaaccttggcggctggcttgtgacagagggctggattctaccgtcactatttgacggtatacccaacaatgacctcctggtatgtctatactcaatttcatggtaccttcagttagaacattagccatttggatggttccctgttgtgttttggcagtgatctcatggtgtttcaaaaatcatgtaactttataggacggtaccactctccatatcaagtctgtgatccaggacaagtaccttgcagccgaacagggcggcggccaaaccattgttgccaaccgagtagtggcctctgattgggagagcttcacactgtggagggtagacgagacaacattcaatctcagggtgttcaaaaagcaattcatgggcattgacagcaatgggggtgcaggaat

SEQ ID NO: 47469 - DNA, 782 bp, Oryza sativa
ccatatccattgcatatttggtactccccttgtagaccgcctaccctagtgaccacaaacacagaggggtcatcgtcgccccaatttgtctccccatcataatctgctgtaactgagtcgcttgtcttcgcctagcatcatcacaagagaaaaaggattcagattttgcatcaaaccaaaagaaataatcttggtaaggattagaataaatttagcaaggcatactaaaaatttattttgacttgctgaatttaattagcaatatttcgtttctatttaaattcagctacaagagatatattgtattccacctatgctatgcatccaagcaaagaaaacgagtggctatggtttgtaagggattaagaaacctaaattaatcctcaaaactaggactcaagtggaacccttaacctaccactacaaaggcatatggcttttaatcttactagttaagaatatttgctgatacaaaagagagaaaatgagtggatagataaatattgttgctacatgatggttggaaaaagaacagaacagtaatagttttatattatattaatggtcagtctttattaattgttatgaccgttgtaagtacaatcatttaatgtgtattgtttaagagtttttatcgggttctacctttacacttgacataagttaaccagtaaagaagcaaattgactaactaaccttctactcttaaatataccttctcaggttagactaaatatgtaattagtcaacaaaaaccgaaaaatgtttcaagctaatatata

SEQ ID NO: 47470 - DNA, 4952 bp, Oryza sativa
tttgttgtctcaactgtcacatgggatgacagtcttgcatagtttaagggctcataacaggctttaactttaaacatgccatccctaactttatcacttattattactaagtactaattaactatcttttagcactacattatttgatcctccagctagcttgatctttattgatctgcatgaaatgcgctggccacatttgtcgttgtcaccaatattgttcaaagaacaatacaagccaacatgcatatggaccatgctcgcaagttggcagctatcatcagcacatgtatatatctatcccagcctaatccactactaacttagctatagctacttgttgccattggagtactattatgcaatgcaagaggtgactcttgtacagtgacatcaatcaatttttcggcgtcctaattacctgcaggaacatgccattgggtgccctgatgcgcgcgcgagtcttgtcgccgttgcgcacgatctggaacgcctccccgggccccggcgacgccaccgtcgccacgacggtgaccccgtcgccggcgacggtgacgaacaggttgtcgaacaccctgaggtcgaacgtgtcctcgtcgatcctccacagcttgaaggtctcccaccccgaggcgctcgtccggttcgccaccaggatggtgccgccgccctgctcggcgcacaggtacatgttctgcgtcaccgacttgaattgcagctgggttccatcctaaaatgcatagaaaagcgtgttctctgatcataaatgtttgatgtttagaataagatttgataagatttttgaagtttttaatcatccaaatgtacttaccaggaggtctttgtttggaatgtcgtcgaagagggagggaaggatccagccctccgtgacgagccaacctccaaggttcaccgcccgaatggggggcgacggggcgccccgtttcgcgggccgcaccgtcctcccatcggagactgagaagaggcacggcgagcagaggaggaggaagaggaggagctcaaaatggcgcatgatgaagacgaagatttttcagctcttgatgactatcttagctcagcttgccaatgtatatatatacacaacgtagtgcagcgatcgatgcatgtgcgtgtacgaactgcgtaattaatggatagacgtgcgtgcttagaataaaaatgtggacatccagagttgaatagcttgatgcctacgtgcgacgttgttggcgtcctgcacgcttaataatgaagctgctttgacgtttgaccgcagccgtccgatcgatggtgcggctggccggatgccatttggtttgacccgtcaaactccgccggtggccgtcggatgctcatcgaacggatatcgcatcgatcttcagataatcgtcagattggataacgtatacggattagttccgatccaggggtgtggattcagcggcgcgggcaaattctattggctgcgtgagcttcttaattttgtcaggtagacatatatatagtcagtccggcgctgatacgtagaaatgatgaatgaatttggataaaaatattgtgagaatgacatgagaaataacgatttaacatgttcatatactgagctttaaaatgtaataatatgtagatgatgtatgtagttatatttatgttttagtgtttggtgcgtttgacttccttgcatgcttcttactccgttttaggttataacatgttttgactttggttaaagccaaactgttctaagtttgactaagtttatagataaatataacaatttttataatactaagttagtttcatcatactaataattgaatatattttcataataaatttgtattgggttcaaaaagttactaatttttttataaacttgatcgaacttaaagcaatttgactttgaccaaagtcaaaacgtcttataacccgaaacagagggagtaattaataattgttatgcttgcatcttaagctttaggtttttagtgtgttacgtagatatgaaaggtatcgctttgtttaaaatataataaactttgagtctggatacacgatattaaatattaagagagtatgtgtaattaaatgaagcgagtttgtgattgaccaaggaaaaaaaagagaagacgaagaaattaaacatgaaaaaggttatgattggttaagaagcgtttgttggtggaaaagttgttatgttttagataaattttaaaatcttttaaattactatattttgcaacgagggagattttttttaaaaatcaatctctaagagaaaaactattcgcatgtgcagcgtactacaccctggcggaagaaacatgcatgcaaagcttctatcaaaaaatgcaaggaatctcagatactgacaggcttgaacatatatatgtgcgatcgcgacgatatgtcgatcgatcaggcgccatccgtgccgttcgattttgtgtgtcagaaaatctcggccctccattccgcgccagcggtatgctatgagcctatatggaatgatggatgctcccccggcccgtgaggccataagacgtgcacgtctccgccatgacccgtgagacgtgcacgatcccatgcatgcatccggagagtggagacaagccagacagagtggctgaaaatttgacgttttgtcgctctaactatttgcccctttgattacttatcgttacaatcagaggaaggatcactaccatcaaattgattttttgcacatggccaaaatcgattttcactgacggctggacagcctgcatgcaccaaaatatatgtgaaaatcggatttttcatgtggatagagcaaccgtttatgcaaatccgattttggcatgtgtatgtataagccgttcgactgtgaaaacgaagagtcgcaaaaaaaaaaacccaaaattcaatttcctgttgccctgaaaccccaacactagaattttagaagccgccgacactgtcgacgcttgaagccactgtcgctaccgtcatcatcgctcgaaaccaccggcaaatctgtgcgtgtgggtggtggagaggcagcgggatccatgcggaagggggagggggcatcggacccgtctttcccatcgctgccgtcggtggattcgcacacatgggaggtggagcggcgaccggatcagcaccagagggggagggggcgccggatttcgtcacagattaaatagattcttgtagtgccctcccgttgccaccgacggtgggatccctctcgcccaagcccgccaccctcgtccgccatcacctcgttggggaaggaggtccccgcgcctaatcgacaccaaccgaggtaccccatgattgatacaacgccgctaagcctcccgccgccaacaagctctccactgccgccaccctccccatcgttgtatccactgccaccgccggatccgttgcatccgccctccctattgcccggcgctcccacccatccgtcaccgaatccctccggcgtaggccactcccgtctgcccacttgctgccatcgtcattttcgtggctgtcaccaccgtcatcgcgaccacggtgaaggaaggagagggggagccacgatcgctttgaggagaggacaagagaagataagggaggagtgagaagagagttgaggagtggggagaggcgtgcgagtggagtggacgggaggaattaatgggacttagtgagagagaggaggggagaaaaaaaaagagcggggagagagatgtattttcacatgcgggtctcttagtaggggccttttaagaggcttgcctgcgaaaattgattttcacacgcggttcttgatctatgcttggaaaatcgatttttacatacatgagaattatggtccgtctacaattttaaggggtctcatttaaaaagtcgattctatgatagtggatatataggtgaatgatacgtggatcaaaatggcaaataattgagacccattctatgtaagcccctgcactccaccctaagctcttgattaagcttccgatgccacggcccttcgctctgcctctccacaactagcatcgccataccagccttgatggttcccgcgttcgtcgcctttagcaatgtagcctcgatctcgccactatcgctagctgacctcaaaccgtgatgttgccgtctctctatgccaccatagctggtctaagagcgagtgacttcaagcatatatgaagaagataagagagatcctgtcactgcattgacagagctatccttgagcagccgaactatctgactacctatatatatatagttggattgttcaacgtagttccggactatcctattaggcttaattccactccaagtttttaaaatttcaagaaacgcctattcacacctcctccctctagatgacatatccgattgacggagcgtggggctcctcaccgggagaccgcgcaggcccccctttgctggttcggccgggggcgctaagtgaggttcttcaccctcgatctgtggaaagttcgcgagagaacaaatgcgcaagacacgggcgacgtagacaggttcgggccgctgagaagcgtaataccctactcctgtgttctggtggatctgtgtgtgaaggagttacagagagctggagagcaagagtcgtctgagagtcccctcctcgtccccccttttttcggtgggcaaggtcctccttttatatctcaaggggataccacatgcaccacttctacctactcttcttttgggtggggacccaccctatcttcaccaaaacttggcttgcgccttcgcctggaagctaaatcacagcttgtccttgagtgaggctcagcgccgtcactcgcctgacacaggggataaccctgtcatttcctcattaatgggtggagatttgcaatggccgctgtccgaatgactctctgatgggatgggtcatacctacctccactccgccgaaagcagatgcaacg

SEQ ID NO: 47471 - DNA, 18291 bp, Oryza sativa
  unsure (1)..(18291): unsure at all n locations
ggggagacagagggaggggtgaccatgtcaccctcgggcccgacctccccgagggggtcaggccacgggggtgaccgcggctactcaagcctctagtcacgatacccccggtcccatgtcaccgacagtagcccccggcgttacgccagggcgatcgcccccctcgagggaagcgctcgggcgtgacgccactccttaggcccggtgacaggttgggccggtctctacaggcgggcagaaacccagcggtcgcaaatcgcgcgcatcggcaagggaaaaccgaccgacaataatgagcagcctcttcaagaccgcaacattactcgagcagcgtgcgaatcgggacgagccggttcgtttcgcctggagacatgatgatggcgcttttcacgattggcaagcgcagttaatgcgcgcacaatctgccccatctcaaccgccacggccgcacatctgccgcgtgcgctgcaaacgggcgagtggggttagtggaggcgtgggcgcgagaaacgagggggcgaggtagtgggcgcgggaagcgaggagccaggcatagcaagggtacaaagacgccaaggaagggattcgtttccttcctctcgccactcttccccttgccttcgccacttgtgctctgactcttcgtttcctgcgccctacccttgccatactcgctcgctctcaagctcctcctccgccggcgtcatggcacggggctccgcaccgctcgatggtagcgtgctgctgccttcccgcatcgtgagcgagaggcaggctgggctgccgcgccgattcatgccggaatctgccaccggccgggaggtggtcgcgctgggcgagggacgcccggcgccacactacccagggcggtccgtcttcttcctctctttcgcaatggctaggctggtcccgccattctctaattttttcatggatattctggagttttatgatctccagatggcgcacctcacccccaacgcgataatgacattggccatcttcgcgcacctgtgcgagatgtttatcggggtgcgcccatctctccggctgttccggtggttcttcaccgtgcagccggtgtcgccgccgacgatagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcctccagcgcaggcctccagctggcgggcggcggtagatctgggagacggctacgacgccgttcgtgaccgcttggcgggtctgcgatcccaggggctcacgggggccatggtgttcggcgactatcttcgtcgccggatcgcgccgctccagcggcgcgcccggggcgcctgggagtacacctggcccgaggactccatgaggacccaccaggggcgcacatgggactgggaccctgaggacttcaggatggtggtccaacgggtgctaaatctcagctccgtggaggcatccctcatcccccaagaggtcctccccctctgctgcgatccagagcgcgccaacatcctgaccatcatgcaggaggtcggggcgtcgggggagcgggccctccgaggccacgatggcgcgggcgggagccgcaggggggaacaatctaccccaggagggggtcgtgcttctgggccccgcgacgggggcccggggggcagccgcccggccgacgcccgggggaagaggaagcaggagggtaccccttccccatctcctccccgagggggcggggcggtgcgtgccagcagcaggcgcccggagggtgccgtgccgacgtcgcagcccgagggggagcgaaagaagaaacggctctgcaagatggggggaccgagccatgccgggggaacctcatctcgtctccgaggtggtcgtttagccgacctccccgcaggttcgtccctgcgctcgccgcggccgtattcattctcccatctcccaaggcgagttttcactcacccgtttctttttgtcttctggtttttcttctgcctcagcgagatcccgtcgcgcccctcccgccattccaagtccggccggtctgaggccgaggagacggcgaccgcggaagcccggaggcgggaagctgaccggcgagaagccgcggaccgcctccgggaagccgaggaggccgcccaggacgccgtccgggttcgccaggctgaggaggccgctcgggaggaggccagacttcgccgggccggggagtccgtccgggaggcagaggcggcgcgcgcacgccaggcggcctgccaagcccccgacccgactccgcccgaggcgacgacgacttccgaggccacccacgacgaggccgcgggcgcgccgctcgggcccgacccctcgggcgacgcttgggacgagccagcttcagggggcgcccccgactccggcacgtcgattggcgggccgagccgcgcggcacccacaccgaggcggctctcccctctgccttccgctgccccactgagcgcggagcccctcctgcaggccttggccgccacgaacaccacggtgctggacgggttaagtgcccagatggaggtcctgcaggcagagcgggcagagctcgacgcggcgtgggcgcgcgtcgaggaggggcggcgctcggtggaggccatggtggaggcgggccgcaaggcacaccgccggcacacctcagagctcgaggcccgtcgtagggacctggcggagatcgccagggaggtggaggaggagcgggagactgccctcatcgccaccaccgtgctcaacgaggcgcgggacgacctccgcctccaatacgggagccgggcggcggagctagagaagaagctcgacgccgctcggggagtccttgacgccgctgctgcacgggaacggcgggcggcggagaacgaggcagcgtcccggcagcgcgaagaggcccttgaggctcgcgccacggcgctggaggagcgcgcccgcgcgaaggagagggacatggcggaccgcgaggccgccgtcgccatccgggaggcaacactggcggcgcacgaggccgcctgcgctgaagaggaatctgcactccgcctccgcgaggacacgctcaccgagcgggggcgagctctcgaggaggccgaggccgcggcgcagcggctggcggatagcctgttcctccgcgaggcagcgcgggaggagcaggcgcgccgcaatctggaaggcgcccgcgccaagagggccgcactggatcagcgggtcgctgagctcgaggctcgggcgaaggagctggatgcgagagcgcatagcggcggggcggccgtgggcgacggcgacctagccgcccgcctcgcagccgccgaacacagcatcgccgagctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgggcggtgcgcgaagtatgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctccccgtgggcggcgctggaagagttccctcccggaaccgaggacggcgcgcgcgcacaggtccgggacgccgccaaccacattgtccacagcttcgacggtacggcccctcgactcgcgttcgcgcttgactccgacgaggagggcggtgacgacggtgcgggcgatggcgacgacgaggctggcgacccgggcgcgtcggagtgagcctccaggcccccgccaattttaatagcttttcctttttcttccgaggccttcgggcccccttcttgtatagactgatttaacctgtaatcaaataaagaggaaatttctgcgtcagttctgtttattgcgtatatgagacgaggatggtctgtgtcgcgatccttctgtgtcttggcttgaacaagggctcgtgcccaggtcccaacctcaaacagcgcgggtcggggctagtgcctggggagatccacgtgtcgagattggccaggccgggagcgcggtgaccgagggttatggattacccgattgtgggcctttgccgattccccctcggagttcaccacgccccggggcacggctcggttctgggccccgtttggcgatttccgccggcccgggccaccgagggcagggtcgagcacgagtgtgctaattcaagccaagattcttcaaaaggaaacaatggcacaggcatagtccttaggaaatcgaaaaaacttttattgaaatacggaagagaaaaaagataagtatatgcatgtggtggcccccggccaaccctgcacgcccgagggggtgcggggttggcccgagcccgagacctgacacccgacccccactaggggtagaagcgacgaaggtgttcgatgttccatgggttaggcaactctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcgtctctgcgaagctgatcttgatcagcctcgcaatacatggtggcccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccacgttggcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttatcgacagcgacatagagatactcgaacccgcccggggcccgcctgaacggacccaggatatcgagcccccagacagcaaacggccatgaaagaggtatgatctgcagggcctgggccggctgatgggtttgcctggcgtgaaactggcacgccctgcaacgccggaacaggtcgaccgcatcgttgagagccgtcggccaatagaaaccctggcgaaaggccttgccaaccaaggtgcgtgaggcggagtgggctccgcactcgccttcatggatatcggcgagaagctcgacgccttgttcccgaggaatgcacttcaggaggactccgctagccgcgcgccgatagagggtcccttccaccagcacgtagcgcttggagatgcgttggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggtgcgtccgtctcccctagggggttgggtcgcgccgacggctggacaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcatcggtagtccttacagacctggttaacgaccagctgggagtcgcctaacaccaggaggcggcggatccccagtccagctgccactctgagtcccgcaaggagtccctcatactctgccatattgttggtcgcccgaaagtcgaggcggaccaggtatctgaggacgtctccgctcggcgaggtcaacgtgacccccgctccggcgccctgaagagacagggagccgtcgaactgcatcacccagtaggcggtgtgaggcagttgtgaggggctcgagctggcctcggggacggagacgggctcaggagctggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagacgtaaccactgtgacccgatgcgcctggaaataatggcgcaactttctcgaagccatcagaatagcgtaaagcatcttctgggcctgagggtatcgggtcttggcgtcccggagggccttgctaatgaagtagacgggccgctgcacctttcggcagggccgatcctcttcgccaggggccgcatctccagggcgctcttcgtccgagaggccacgcggggcgcactcggcttctgtgccgacgacctcggggtcagagggcgacaggtgcggccttcccgcagtggccccggggccatcatgggggtcgggggcgcctggcaccatcagacaagcgggcggagggccagctccggccgtcgggggcctcgggccgccgttcggctcgggggcctctcctccctgctctctcccgggtcgagtcgacacagggtggggatgcgcggagtgagggttgtcctcgttgcgctccacgaccaacgccgcgctgaccacctgcggggttgccgccaggtagagtagcaacggctcatctggctccggggcgaccaggactgggggagaactgaggtacgccttcaactgagtgaaggcctgctcagcctcctccgtccaggtaaacggcccggagcgtttgaggagcttaaatagggatagcgccttctctcccagcctcgatatgaaccgacttagggcggccatgcagccggtgacgcactgcacatccctaagcttgctgggggggcgcatccgctctatagctcgtatcttctcgggattggcctcgatgcctcgggcagaaaccaagaacccgagaagcttgcccgtaggcacgccgaacacgcatttatcggggttcagctttatgcgggtggagcggagactttcgaaagtttccgctaaatccgagagtaaggtctcttggttgcgcgttttcacaaccaagtcatcaacataggcctcaacattgcgtcctagctggctacccaaagaaattcgagtagtacgttgaaaagtaggaccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcacttactgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggttttggacgggccgtcgcccagggcaacctccttgaccgggacttcgtcgcaggtgaccatccgctgcctcggggcggccgggacggaggtgctgagcctctcgtcgctgcccgcgggcttggacgccgcggcgaggtggtccgcgcgctgctccatacaagcaagcgcgactttgaggtcgccatggacggtgatggggccaccggggcccggcatcttcatctggagataggcatagtggaccgccaccatgaacttcaccaacgtgggcctccccaggaccgcgttgtagggcagactgaggtccgccacatcgaagtccacccgctccgtgcggaagttggcgggaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctctgaggacacgccccaacttcacattgcaaacggtgggggaaaccatcatcgcgatctgtcctccccgggcaacgcacggcgggtggtcggtctggtcgaaggtgagggcaacctccgaccatcgcgcccgccgcgtcgccttatgggtaggggccgcggccagaagctctcgcttcatggccttgaggctccagcgagaagcgtgagcgcacgctcccccatcgacggtggcgacggtggccccaggctcctggaaccccaggtcatcgtcgccatcgtcgacgtcctcggcggtggccttctgcttggcctcacctcgccggttgccggcgggagccgccggggccttgccctcacgacgctcctgcctcctctcctcctcccacttcctcgtccgctcagccaaacttttgaccacggcagtccgcgaggtcgtggagggaggtgttgtgcacggaacaccacttgccggtcgggcgctccctgctgggagcgccggcctccttctttttgtcgctcgcaggcctcccctttcgggtggcccgcgatgcgccctcgacggcgaggacgtgaccctcgtcgtcggaatgggccgacctcttcttcctcctcctgtcccgccgctctgaccgagcggcggacccgggggcggccggagctgccacaccggaaccggaggagttccaggtccaggcctcctccttgcgagccacacggtccgcgagctggaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccctcgctgtaccgcatgcaagtctgcttcttcacctgggcgcggatatgtgccctggaagttcatggtgaactgctggcacaaatcctcccaagagtggaccgacgcgggtggcaagttcattagccaaccccgcgcctgacctttcagggccatggggaagaaatttgccatgaccctgtcatcacccccggcggcctcgatcccggtcgtgtagatctgaagaaactcggcggggttgacgcttccgtcgtatttttcggtgatggtgggccggaaccttgggggccaacggacgttccgaaggctcgccacaaaggctcgacagccggcaccgccaaccggggacacgggaggctggcccccgtgcccggaccgaagtggcgctccggacgaggaagcgcccttcgttgcatgggcagcacgacgaccattgcgccggcgctcgatattgaggcgggcatccggccccccacgcacatcttcttgggtcggaggcgttgacgagggaatggcggacgaacggcgggtaacggccgccgctcgccgcgccctccgcctcgacgacctggagccggcggcggcagcgccagaggtcccggtggcggaggaccgcccgccggcacctaggcgctgctgcgtcgtcatgaccaagtcggccacgtcatccagccaacgtcgggctggagtctctggatcggagacgacgggcgggtgacgcaggagcgcgcccgcagcctggagcgcgccctggggcgtgccgccatcgccgtagacgaggaggcgacgctccccgtcttgccgtccttctccattgcccgcgggcggcgaagtcacggatctttcgacctcctcgagcgcctcctcccgcccaagatttcggcgagagggggacggtggagtacgagctcgacggcgcgggttctgctccccgtcgtcaccgctagcgctcggagagaggttgtgcgccactgcccgttcggccattttggctgagcgggagaagcttggcgcacacgaaagaggacgaggacttcgaaagacacttgcgccccctacctggcgcgccagatgacggagcatggggctcctcaccgggagaccgcgcaggcccccctgtgccggttccgccgggggcgctaagtgaggttcttcaccctcgatctgtggaaagttcgcgagagaacaaatgcgcaagacacgggcgacgtagacaggttcgggccgctgagaagcgtaataccctactcctgtgttctggtggatctgtgtgtgaaggagttacagagagctggagagcaagagtcgtctgagagtcccctcctcgtccccccttttttcggtgggcaaggtcctccttttatatctcaaggggataccacatgcaccacttctacctactcttcttttgggtggggacccaccctatcttcaccaaaacttggcttgcgccttcgcctggaagctaaatcacagcttgtccttgagtgaggctcagtgccgtcactcgcctgacacaggggataaccctgtcatttcctcattaatgggtggagatttgcaatggccgctgtccgaatgactctccgatgggatgggtcatacctacctccactccgccgaaagcagatgcaacgtgggagcatggttgtctgccgatgacgtgaccggcgtcagaccagtcacaaaccggtcattcttgtccaccacgcgtcagtttagcatgccgcacgtctgcccttcttcatacaatgacttccttgccatggttgcgatgaagcctggaatgaatctggccgggactgacgtgccaactccaggagttaacacgccggctccggctagggacgagcgcctggaggctctcatcattccgacgggacggggcgaggcgtgtgacaggccgcctgttgccacctaacccgcgatctgaccggtctgtgaccggtcacacactgcgaccggtcacggaccggataagcgcgcgctgcgctgcattaaatgcggcgtggcgcgctcgtccaaaccgcaataaatgcggttaggtgagccctgccgtgctcacctaacccacacgtggcgccaaaaccacagggggtcggggcgtcccanccctcggggccgaaacgggaacggcccgacccctcggggagacagagggaggggtggccatgtcaccctcgggcccgacccccccgagggggtcaggccacgggggtgaccgcggctactcaagcctctagtcacgatacccccggtcccatgtcaccgacaccgatcctcaagaacctttcagaccatatggtcatatgctagctttccagtctttatctcaattcttctatgaaattcgggtaaagtacctccactagcctagattttcttagaaaatctgcatttagcatccccaatacattactttgatttgaaagaaaacatggaattctgtaggattccaatcctgtaggactttttctatacgatagtttgtaacaaaggatgagatagtattgaaacctacgtgttagcgtttcggtcaaggagtccctactttaccagtttgcttaattagaaaggcaagtcgatgtatctacgcgattagtgggccatcacatcctcgccacactttaagccaaaaaccttacgcagagattcacatgttctcttgccgtccaattctacaattaaggaaaagctggaattgttcgagagtctggtaggtggccctagacctgctcggagacgactacgtgtcctctgctggagcatgggactatctggttttctacccatgaacaaggttgttacatcatttggaggtgagacccatatcctggcttgcccgagaactaccaagggtgttgcgtctttcatgtagctaaccatagcaagtggctcagtcctctttggggcttagcacgtggctcagtcctctccagggcttagcacgtgactgtcccataaaggaggccagtcccacacttcaagtgtgaagtgtttcaccgtgggaacccctcattagcccgggaagggctagcatgatgttctcgttagctagagaatggtggaggcgtatcttacaggatgctacgcctccatcggatgtgttgtgctggctctcgtgtctatctatattattgaatttctcgagttgtctcattgtattaacatggatagataacctatatatatatgggcatctcgttttcacactaccataatggaaacaataatgataaccttgtagatgggcccgacgtgaagtttcacaggcgggttacatcggtggctaaatcggtgtggagctcgaagggcagaaagtgatctaatgattgtaaatagtgtaatgcgcttctcagatataaaaacccaaccgggactcttagaaagtgttaggttcttcataatcggcaaggactagatctgctagctcgagagctcccagcttgtacgaacattcatctcatagtgatgtactcccttcttccctaaacttttgatgccgttgacattttcaaacatgtttgaccgttcgtcttattaaaaaacttttgtgaaatgtgtaaaactatatgtatacgtaaaagtatatttaataataaatcaaatgataggaaaagaattaataattacttaaattttttaaataagacgaacggtcaaacatttttaaaaaaaagttaacggcgtcaaatattttgggatggagggagtaaatactagtaggcttgttatccttcaacaggcccaaaccagtatagttgttccgtgttctttgcttccgagcacactcaggctcaccatctcggttagaacccctggttcatctaaactcgaggtctcctacatctgccggagctcatccctccaacattgcgaaattcataaggaatgcctcaattcatataagttaggaatgccttgatccatataagttttagaggaatttatacatgaggatcattcctgtattacttttgatccatataagttttagaggaatttaaacatgagtatcattcctgtattactttagtctagttaatcgatcattcttgtgttactcttatattataaaattatttgttttgcacttacatttctgttaaaataaaatccggggcttcctgttactccgttttctcaatcctggagacagaacaagaaatgagaacacatttgcaggagtatatacgcagggcatgagcccttgagacggaagaatggagtacgtcacgatgatgacagtgtgttgttgcctctgaatctgattgagcagtgcaggaactgcagcaggttgagcacgctgagtgcagccatcatccagaagaagtagtccagatggccctcgtcgagcttgtccgggatccacccggcgccgccgccgcgcgccgtggccgccgccaccaccctgagcatgccggagttgaggtagttggcgacggcgacggcgagctgcacgagcgccgtgccgaggctcttcatcgacgccggcgactgctcgtagcagaactccagcatgccgatgacggcgaacacctccccggcgcccagcacgaagaaggacggcacctgccacgcgatgctcatccgcgtccccgccgccgccgccgccatcgccagacgccgcgcctcgaccagcgccgagtacgccatggccaccgcggacagcgcgaggccgacgccgatgcgctgcatgtgcgagacgcccctgtccctgccggtgacgcgccgcgccagcggcaccagcgcggcgtcgtagaccgggatcagggcgaggacggcgacgacgtcgaaggtggcgagcgaggccggcggcacggtgaagcggccgacgcggccgtccatggcgacgccctgctcgatcagggtcgacgtcatctgcgcggtcaccatgaagaagccgaccagcgacgcccagaccgggaacgtccgcagcagcatcttgagctcctccacctgcgacacggtgcacagcctccatgggctcgacggcgccgccggcgcgcagttcttgtccgacaagatggcagccttgtccaaaaacctggacatcatggaaatgttaaagttaaataatcaatttatagaaacttacacaatttaacataacaagatttactacgtttttagatttaccatcataatcgaagtatatcatttatttccttttataactatggaaagtccatattacccttgattgataagtgatggcacactcatacatgataggagtcaaatcaaccattggaacttctaaaacattatggtctagaataacatggcaatatcttaaaagaatctttcttgacagtggaatttgttcctactaattcacttagtttgttctatagtaaattaaaacaggtttgactattttgtccgacaactcttgtggtaattttgatgcaatgagcaatacctgaattgataggtatgttgagttctgtagtcaccttcagtcactcctggaagctcatgcaggagtgagctatcatcaggcaagttcagcctatgatttcttacagctgcaaccagcacctgaaagacccttgtcagagggctccctcccagtttcttgtacctgtacgccctcctaccggcgatgaacatggcgaggccgaaccccaagagtagcattgggccagcaaaaccgacactccaccctatgttgtcctgaacccagacaaccacggtggacgacagcagcgagcccacgttgattgagaagtagtaccagttgaagaatgagccctttgtcacccgctccaccgggtcggcgccgtcgaattgatcagctccgaaggccggaatgtttggctttatacctccagttccaagggcaaaaaggtagagccctaggtagacagttagacgagaaatacccccattgtagaaagaagcattcaggaacaatggtgatgccgaaaccgtcagaacgatcattccctgacaaaatagaactgtttcagagttgcaaatgacacatgaaactaactacagattgtatctttcagttgctgctctgcttgttggccttacaaggatgataacaaggatggacattactactgtccagtatcttccccaatatgtgtcagccaagaaggctccaatgagtggtgtgaagaagcaactgccgatccagatcgacacactttgtgcagcattgacgttgctttcatggagcacacttgtgaggtatgtgactaagttctttgaaaccccgtagaagcagatgcattcagtgaattcaacacctaggacatgttcaggactcaataggtcagttgtgtatgttgaagaaggaagtttatgagcatcaacagaataattttgtgaacttctcagaagtacctaaaatgaagaaacatgctctccaattccccgtactctgcttcagcgcgggcttactgtcaatattaaccgttccatcgcatgtgtattttgaacattgttcctgaatgacaaatgccaaaactaatgtatgttgcacaggatttaacattaaatatatgcaaagattcgctgaagaacaagaaactgcaagaactcattttttttgtttctgtgtaacaaactgaagccaaagtggcaaagtatcaactgtacatgtcatggggtcacatggagatacaaaagtttggtacctacctaggcaaaaaaaaaaaaaagataatgggaaggttatcgattaatacctgtggaggcaggtgatgaatcagtggcctgtcctcatcagatgcctccatttgagcctctggcttcttcagcaattttgttggaagaaaaccgacgactctaagctacttgcaattaattcagtataatcttgcacctaaggaatttttcgtaagccatctatgtgggcaatgatgagataagaaattgttagaagataaataagaaattatctaacaaattgcatcacatacccgacaacacccatttgtgctgtcttggtcttctgaaaattcagtgacattaggccactagcatatcactcgcactttttctgattgattactcatatccaattctgcattttgattagcacaatcacgcaattttggtactggaagttatatatgaactctattgactacataattctgtaaacaactatttcttgcaagcaacacccttctgtcagctgggaaattaggaaagtaattatcataaaaacagaagaggacaaactgacctttttttggggggtcagaccgtcagacttcctactttctagagaaggaagcattccatgcaaatttttttgacaattattacaatctttttaacttgggcatttaaattgagagctaacccctatgtcttgtcctattcaatcttgaacacaaacacaccaaaaacctaagaaatgaagtgtcaaaacaaaattagccttgaaccatcaggtccatcccacaatttcttttatttctttgaagcaaacatccatcccacaatttaaccaggggaaaatgaccacacactactcataaagaactagtaggcttcattcaaagctgatacactttcttttttatccaaaaaaagttcaggtgcagtattaattccaaaaatgaagaaagatttggcctgcaacaagcatgcttatatctatccctaaaatcctctaaaaacatatgtaagccatcgattccagcaaaagtaccaggtggagagagagagagagagagatgagacctgaggagagtgagcgatggacgattggagagggaagggcaaaagcggcggtgggaggtcggtctgggagggagatggagatggggttggtgtggttgccgctccccaatcgtagctcacactatagcagtactagccagtagcacaggaaagccaaaagcagttaaggtgagtgagacagtagaggcatcgaaatgattccggttcttggacagcaatcaatcacgtgacggatatatttattgtggcatgaatattttattcgtatgacctaaatctgcggagaatacaaatagagggcgttcgatgttttacttgaaaaatctttttgaccgttgtttcatcgcaacttaaaaaaaattcattattaaatgaaaaatatttcagattatcaaaatggtgaaacacatgttaatcacgattgaaacatattattctcacatatgaaacatcaagcttcaagagctgaaacatcaccaaactacaagagtcatgtactaaaatatgaaacaccatcaaaacatgaagtgcaacattagctgaaacatcacatactcataaaaaagtatcggttcaaacctaattttatttcttctcttcgatgggcttctcaagtttctactacatattcatgtagagacgttattcttctactccatcgatgtgggtagccgctgctcccaagctttcttcacctcgtcgtcattggtatcaggccctcgttgtgtcatcttcgctggcgaacgacacctccaattccacataaggtcatcatctttctctagctaatcaatgagcactagagcacaacgtcggcgctccgcatggccccacaaaacccacaacctgtgcatcccaaacttctttgccacctcgtcggaagccatccctccggccggccgcgccaccatgttcattgcaccaaagcatgccgcagtaatgcccacaacatctaagggcaaaagaaccgcttgcagaaaaataagggtgaaaacggattggataatatccgatccgaatccgtccaaaacgaggatatggtatgagcttttagaaatccggcggatacggttgcggatgcggatagtatgaggcggatgcggatgcggatatggtatctctaaaatccggcggatgcggattatccgacatttttgtcgaattatccgataagttgtttcccagataatccgaaattatcaacatatataaccactctatctattgcatataacataagttgtacaaccagtgccctcattca

SEQ ID NO: 47472 - DNA, 4794 bp, Oryza sativa
aagattttttttttgaggaaaccatataaaaagatataatccactttttcttcaccttcgatcttctacatgacttcctatgcattcctacgtgttcaaccctaactttactgtggtgaaatggttgctgttgtcaagtctgtatcatcaatgtatccgaggcatctgaagtttctagggaatcttcttgcatttcttagtccgttgcttctaactgattctggctgtcaatgttgtattcatatgcagaaacattagcattttgtacataaactagtagagtggcctgctcaattatacattcaaaattcatttctgtgtctctactgatcatggacaaccacgatcatgaaactgacttcgtttactcctagagtctttctggaataagaaaaaaaacattccccaactatgaaaccatttattttactcccccctaaacatttgataaaaagctgacgaccaatgaattatagcttcttacagaaaatgagagatgtagctattctaatcaaatgacttttttaaaaggtatggatgtgtcaaatttgaatggtacgtctgcctcatagtgaaattcctctctttaccaagggagaaaagatctcaacaatttcgcactaatttaactagaaattgaatgtacaaaatttttaatggaaattagcagtgtatcttgtgtcaccgcatggataaatttgttactcatattgtttttaatagttaacacttttgtccaagaaactttcctgcaaaaacttggcactgataacaaagttttttagataactgaaatggagtacatctccagcctctgccattaggcatgtagtcattgtgtttactaataaggaagtttagaaaccaaaatagttcttagtttaattaccttcttgggaatttagtttgaccacttgccaaattatcaacaaaactagctcaatttgcaccacaccaatttacaattgatcatgatcattttttctggtaggaatgccacccttcaaactaatttttgcatcttgttttatttcttcattgtacaaatccaataagtgtgtaaaagtcacacaatttctttccccttcatgttgccataactcgttttaaagggcaaattgatctgcagcatatgttttccataggaaacgatatgatcgattttgactcattgcctgttagcttgacaaaattattgcaaactcttgcactccgaatagagcatcaaacattgcctgaaatcacttgtatttgcacaatttaggcaagttagttttcacagaagaaatgaaaccagcaattgagttaaagcatttcttgttaaaaaaagttagtcgatatagcggaacgacgactaaccttcccgatcgcttcagtcattgatcgcccaagacataccagatgacgacataggaacacacgatatttgttaacgaggttcagccgaagcctacatccccggggctttgattatggacgctcctccccaaccaatatactccctccgtttcacaatgtaagtcaatctagcatttcccacattgatattgatgttaatgaatctagacatatatctatctagattcattaacattaatatgaatgtgggaaatgctagaatgacttacattgtgaaacggaggaagtagctcctaaccgctacgagtccatggccacgccgccatcatctccctgcgtgtctacgctgcattgtagtcgccatggttacgttgtggtgctcccctctctatttaagatagttctgctgcatcgaatcttcctaggttctgctttaccgagcccaagttcccgtcggattctgttccaacaaccgagtctaactcaattcaagtacacacctttggttctaatgaccgcataaacagaaaccaactcaacagtcgtgtctgcttgggtctcttctgctttcccttgctcacgtacctcttcctcctagcaaaaaccctgccgcatcatgctcatgcaaaaatacacccatgtgcctcaacgtcctcatctagcctcccatgctttaatctcagcaatgtagtatatgcatgtgcttgacaacatgtcatgatcaccttgcacaggccactctttattagtgcatgcagccatgatgattttgtgtacatcgtgtcgcatgaaggcatttccatgcgatgtgctcgactccatccaagttgtacgcaaagaacaatacctcgtactattcgtccatgcctccgcacgcaccgcagtcgcagccctcgtgttcactgtccacgaccttgtcgccatcggccctgcacgtctgccgcgctgcgccacgctcgtcggttttgccctttcgccgctagcctccttgccgctgcggatccacgaccaccgcgtgcgtcaggcgtgccgtccatgacgctacccctccgatctctccggtcgcctttggccacgcccggccccgtcttccggtcacgttccgccatcgccggtctgatcgcgagcaaggtcatcgcctccgcgacgtcctcgttgtcgccatcgatctcatcgtcacagctgacaatctcctgctgatgcgtgatccccacctcgtgtttcctcctccacatgtcttcttgatccaatactgaaaccttctgctctgatactacttgttataaaagttagtcaatatagcggaacgacgactaaccttcccgatcgcttcagtcattgatcgcccaagacatgccagatgacgacacaggaacacatggtatttgttaacgaggttcagccgaagcctacatccccgggctctgattataggcgctcctccctaaccaatatagctcctaaccgctacgagtccatggccacgccgtgatcatctccctgcgtgtctacgctacattgtagtcgccatgattacattgtggtgcctccccctatttaagagagttgctgggttacagagtccgactctaactctaccccctaccacctatttcaactccaataggactgtatatttgatacctattctaacatttcttttccatgctccaacttgagttgaacatgtatgccatatatctttttttgatattgtcgttggggaagtactcgtgtaaagtagaacctttttagcctcaaggtgctaccgagaggtaccacattgacacattctgtagtataaaatttagtactacctccgtcccataaaaattgaaattttacctttgaacctttgtcccataaaagttatatttctactgatgtgggacccattaaactgattacatttccttgtaatcttctttccttccatcccatctctaacccattgtctcaacattccttttaatcaagtttatatatggaatgtgtgcatgtattgtgtttattaaatagggttactgtagtcatttgtctatcctgctaatatatccttaattccctagaaattcaatttttatgggatggaggtagtacctcttttggtgaaaaaaaaaaagaaggtacctcttggtatgtccatagtgttgaggtaccaggaggtaccacagattaatactaaaaaaacgcccagtaagaattgcaaagtcactcactagtgcatgtgttatgcctctgttgtctgatttggtgatttggtctgccttggaacatttgtgggtctttgatctagctacatttacgaccaccatgattgacaattaacatcaatcacgagcactctggctggttgggggtcaagccaagatgtcaatgatgccactggaaaagattgacctagctcgtgtggttgttactttagcagtgcttctggttatttaaacaatgtgttggctgtttcgcgagcaaatgtggtgatatgtgtcatgttgcaattactgtcatcttaaaatgaacacatgcatgttttcctaacaaattcaactcttctgaacaattcttgactgaaatttcatgtactatgaatttggaacattttaatccactttattgagaaatttttatgaccttcctatgcaaaataggtgccttatcaatccatggaggcacaagacttgcaacagcaccaagaaaggcagaagatgcatacatctcatatgccatgaaggggaatatgcaagactcggtgcacatgcctgattctagctgctacctctcaatgcttgtcctacccatggcgttggacatgaagtcacatctatacgagtccttcgaggtcaccttggctcgtgccaacacatggctctatgcctcgcaggcctctggtgtccccatcaagttgatgagtgtgcagagtgatgatcttctcaccaaggtgcagatacaagatttcaatttcatgcattacacatggacacataatctcacacaagattcgacttggtttgattctacatggttttaatcttcactctccataatgtacagatatcgagagttggagacgccacatctgcaactgtcaattcagggttgttgcctgatctgtcaaatgcaaccttggaggattaccaaggctataacactgaggtggtgaaggcagcccgactttggtacagctccataggaggagaaatgccactggagatcactcctaaagtaggtgacacaaaactaggatttgcaatcagccgtactgaggaggtaagctttctgtcgccacttccagaatatcgacaatattatgcttcatcaattaagaacaaaagagttatacatcaaacattccatgacacaatgtttctttcagggttttatctacatatcttcagtgttgcaagatgacaatgacagcgagacaccgtcaacacg

SEQ ID NO: 47473 - DNA, 2315 bp, Oryza sativa
tcctgcagcccattactcaatttacttattagtctgatagatcttgtccatatcttaacgaattttaagatactatatatctgattcaggagtggaaattagattgctttggaacttttggttatcgagaatcttggtccactcatgtttatcattagattacaaaatcgatcgtttcttatgatataagataacaggtattctaattaatctattcacactaggtataggtaacagaacaaaaaagtagttatttggctatctttattggtcaaagtattggaggttcctgttcctttctatttcatgaaaagttcatttaccactttattcttttttcctgctctacataaactgaaacgtttatatatcctggatatacattttttcctttattgtgtggctccttgtgcagattcttcgctctatgcgtatccattgtactctataaaatttcatagttacagccacctagtatctcttttgactaataattgaaccgcacacgtgtaaatttataccatacatcttttatatcaagaatacgtttcaaccgatgagttatcatgttgctccacacatttttttatagaaaaaaaaaccctatgggttggtatgctcaaaagaaaaaaaaatccaaaacttgcaactcttgcaaaattgcgacatttggttcgaagatgaccctagaattacaacatatagcatatttttccctttctacttgctaaaaggatcaaaaatcatcatggagatgcattattaaaataacacggagagaatataacaagtgaacaaaaagaggggggatttttatttgcattgccttttggctttctgtacgcctggctgaggatgaaacgatgaactgttggcctacattccttatgctgacacattgatggatcacgccatgtccaatcaaattgcaaaccgtcgaccagaaaaggtctccctgcatcaaatcaaattgtaccggcggcttctacatcaccatcgcatcactatttgctcacacttatttttttctttcttggtatttgatttcattcttccacgatcatataccttggacttaaaccaacaattttggaactccatggaaagcaagagttttgtacacgtacctccgccctaaaatatactactccctttgtcccaaaatataagtattttttgccactgacatggtctctgagatgttactttgaccaacaatatttataaaattaagatgttttaaataaaaagagttgcattttatgatagtttgtttaatgataaatctagtaacatcaattttatatgtaatcttttttttattattattaatagtcaaagttaaaaatgtttgacttgtcactatactaaaaatgcttatattttgagattgagggagtagctattattaaaatatacttagctacctagtaactgtattttaagatggagggagtagaactttcacaaaaattagtagttcaattctgacccaataaacatccttcaaaatttattcatccatcgtcataattttaattatatgcacaaaaatgtttttttaagaaaaagtgataataattaaagtgataaaatatgcttttcatccggcccaagcttcattgacaaattgtcttgaatttgtacagtacagcatgtgccaatatcatctgaatgaacaacacattgtacttgtccatatcgaattcaatattgaaatcataggacaacaagtacatggaggaaatttgtgcaaatagaaaaaaaatcagcatgcaaaaatacaacttgccatgaaaaaaaaatcacatcattcgtcgtcaggttcttccgccattggagctccatttctcagccaatccccagctcacacgtgccaactcttccacatatgttggttaggacagtggacacgtggcaggagaggtgccacttggcactttcccattgggtgagatcactactccctctctgcctataaaaacaccatggagctagatagcaagctttgcttattcactcattcaacttccaaattaacacgattcttcttgctgcgtttgctgatcgatcgcaaggtagaagaagaagaagaagaagcagccatggatcgccaatggcgttgcctcgctgctgcggcttctactagtggtaatagtaagcttcctccgctgccgatggcgctgggcggcgccgtggagtacgggcagctcgtccatggcgcggcggcgcccgtggcgccgttcttcgtggacgccgagcagcagagcctgtcgccggcgacggccatggttcttggcgccgggtggtataac

SEQ ID NO: 47474 - DNA, 4289 bp, Oryza sativa
gaacaccacgccgccgccgtcgccgcgcgtcgtcaagaccgagccgggctgctgctccgtctccgaagcctccacgacgacgacggccgacgccgccgacgtctcgtccacagggtcttccccatccccgacctcatcgaatcaggccgccaccgccacgccgccggcgccgcggccgccgccgccgttgccggagacgattcagcagctggacttcacggaggcgccatgggacgaggccgacggcttcgcgctgcgccggtatccgtcgtgggagatcgactgggacgccatcctctcctgattaatttcctgacggcttcatgcatgacgtcagcatctgtgttgttgtattagtttttgttcccgagtgtattggcctttgcagctactagctttgatctatcatcagtgtctcctggcctctgctgagtttgttttttggtagatggcattgtccaggaggagatagactgaagattactcaggctgaattgatttgtgtgcatgtgtgtggtcagtttgtggctgttgctctcatgaacaaatgctatgtgcaatatgccaaagacatagatactgctgctactcttgtgtgatacatgttgttgtttgtggcatgtgtgtaattagaaatgcagtgattgatgcatctgcataccttgaattgacacattggatggaaaggaatggctgttggtttgtgtttgtgttcctggtcagagaaccctttaatttgatatcaaattttattgggaccagttttatctcaacatgcatgactaagggtgtatttagttcataaaaacaaaattttttggtgtcacatcagacatttgaccggatgtcggttggggttttcggacatgaatgaaaaaactaatttcataactcgcctagaaaccgcgagacgaatttattaagcctgattaatctgtcattagcacatgtggtttactgtagcacttatagttaattatggactaattaggctaaaaaaattcgtctcgcgatttccatgcaaattgtgcaattagtttttttatctatatttaatgttccatgcatgtgtccaaagattcgatgtgacgtttttgggaaaatttgttgggaactaaagaaagcctaaggctgtgtttagatctaggggtgtaaagttttggcgtgtcacattggatatccgacacacatttgaagtattaaacatagtccaataacaaaatattacataatccgcctgtaaaccgggagacgaatttattaagcctaattaatccgtcattagcaaatatttactgtagcaccacattgtcaaatcatggtgcaattaggcttaaaagattcgtctcgcaatttacgcacaatctgtgtaattagtttttttatttatatttaatactccatggatgtgtccaaacatttgatgtgatagggtgtaaaattttgctaggtgatctaaacagaccctaattaatttagaaccttatcagtcacaaaaagaaccataaaattggcattcaattaaaatgcaatgaaaaatatgtgcggtaatgtttcttgagcaaatgctccttccatattaaatttgaagttacatatctctactttatatagagacttttaaaaaacaacagaattttacttataaagtcagtaaaactcattagaacgggattggttatctctaacggacctaaagcctcatctctttcagacagagcctccgtcactaagcaaagattactgatgtgagaaaatatcttaattgggcatccggccatcacgaatgacaaacatctcaatcaggccaacactatagccccatcacggatgactctcatatctaacgggccaacactatagctcgtcacggataactctcatctctaacgggccaacattatagcccgtcatgaatgactctcatttctaacgcgcctaaactatagcccatcacggatgactgtcatctcaattgggtctaaattatagcatgtcaaggatgagtataatccaaaaaaaaatattttttggctagcctcaggcctttgggggccacgcccttgggccggtcttttctgcgcactttgtcctcacttgtgtgaacccggtcggtcaccatcccgaaattgctccacccgggaagaatttcctggtcggttctccaccctaatctcgcttaacctcagagttctttggagatcagcttccaaagaagaagttgtacattcattcacatacacaaccattaatatatttaacataaccacattcacataacatccatttttttgaaatgacacgtaacattcattttgatcacatatttcacatccattcacatatttcaccagcaaaaccaagttaattggatcaaatatgtaagtattaacatgatgaggaggcaaatcaaatttctaggaaaaaaaaattttgaattgaattttatgatactaaatgaactcatatgaaaaagttgtcaaagacaaagttgtagaactcattgagatctaccaattttattttggtcatttctccattcgggtttgattgaactatataaaatttaaattttaaaatataagaaatttaaataatttttcgggtagtaaatgatttcaaatagaaaaattgtcaacaacaaagttgtataactcatcaagatctataacttttattttggtcattttttcacgtaacattttttgaacagtttgaatttgaatttgaaaatatgacaacttcaaacaacaatttcaaatactaaatgattttaactgaaaaagttatcaacaaccaagttgtataactcatcaagatctataacttttattttagtcatttcgtcatccgacaaagtgataataacattgttcataaaattcacatatctcttatctggttttataaatgaatgaagggatacacggtttagcgtgctgccaagttgctcaaccgatcagctccttcgaactcgcccttcttttatgggaagcaaaaagggtacccaagaatgaagggatatacggtttagcgtgctgccaagttgctcagccgagcagctccttcgaatttgcccttcttttatggaaagcaacaaggtaccaagaatgaagggatagacggtttagcgtgctgccaagttgctcagctgagcagctcctttgaactcgcccatcttttatgggaagcaaaacaggtacccatgcatgaaggaatacacgtgcaagaatcacataaatggaactagggaagcctacatgaggagaagtttttctattaccagttatatgcccgaattcggagatatcaatatattccagtttcttttgtgctggttttttcacgatatataggttgggttttggggaggatttaggagcagttttttttttcagagaagggatcgtctttttttctttggggcggagggaggagaataactgtatttttcaagttgttagataacacacttgggttattaactaatgaatggaaagtttcatttacatctagtatatcagaaaattcctgttctcgtgttgcaagcctaattaatctggtttctcttattttggagtaacttgtaatatgaactatcttttcgttcaaacagctagctttaaactaaacacaattagttatattttgaaaatcccactacacaatttatagaatgcatgacaggtcagactatcatctcagcagagttggtgtatagctcgttttgagtcttgcacttttcctttctcaagggaaaaagtgcagagggctttctgcagacaacgaaatataaaactagagttgaaagcaacggagtattttgtgacaagaaaaaagagtgaaagcatgtaagcaactaacctgacactgacatatgtgtattaacaattttctgtatatttacactccaatcagttactccacgcgcacactaaattatttagaacagtaaattaataacatgcactatactactatgaagactgaatagtatatacacatactgtgcaggggaagcagcatccaaattttactacttgttttcaatatatagataaagttatggatatttggacataatgtttgatcatttaataaacacttggaagtatcaatattttgttgacttgttgtttcatctttaaagttactttaaatatgacttatagtttttttgttagagtttgtatccaatatgtatacaaagtcggttatagattacgacttcgagttatcgtactaggtgtaggaatagagtaagagctggactcgatcctaagctctct

SEQ ID NO: 47475 - DNA, 13090 bp, Oryza sativa
ttacattgtgaaacggaggaagtaattaagtatttagtatatgaaatgtaatgtgggtcaattgtacaatcgatgtttgccatgtgtcacgcatgaaccatgagaaatgcattggttgagaacttttgatgcaaacttgaagatgcagctccatatttattatgaattcaataagactgatattcttaaaaactttatcacgtattacattgtataaaacgtgaacagaaacctatttaacaggcaaagttgatattgaaatggcattgcaaaagaaataccatatagaacgcaatcctcgtacttaaggaactgattcgataaacgacctgcattactaatttgctgattcgataaacattgataatatattttgtttgttgatatatgtttcattacttgttcaattcaaattttgcaggccagaattaatctagtatatatatgctggttgatcatggtactttacatgtcatgtttatcctcagccatcttccttttactatggcgtttgtatactatatattagccatgtgattccaactcggtgttgacctttcttaatacatactccctccatcctaaaatgtttgacgccgttgacttttttaaaaatgtttgaccattcgtcttattcaaaaaatttaagtaattattaattcttttcctatcatttgattcattgttaaatatacttttatgtatacatatagttttacacatttcacaaaagtttttaaataagacgaacggttaaacatgtttaaaaaagtcaacggtgtcaaatatttagggaaggagggagtataatatatagacatatcctctgatcatggagcttagatatgtatatctagcacttgcataaaagcaagacaaacatatgccattagcttataagtctcccccccaaaaaaaattatttacaggtcaacctgggccatccactcagttaaaatatagtggacaccaatagagcttggacaaacaaaccctctccattacattgtgtatatctttatgttgtcaaatccctgatagttttttagttgactttgtttttaattaagggtgtgtttagttcgcgaaaaaaaaatttgggtgtcacatttggacgtttgaccggatgtcggaaggggtttttggacacgaataaaaaaactaattttataactcgtctggaaaccgcgagacaaatttattaagcctaattaatccgtcattagcacatgtgagctacttagcacttatggctaatcatagattaattaggctcaaaagattcgtctcgcgatttacatgtaaactgtgtaattagtttttattttcatatatatttaatgctttatgtatgtgaatttttgggaactaaacaaggcctaaacaaggcctaaggtcatggtaacatgcaatccaagctgaagaacattgactatgactgcatatatgcaaaaagctccaccaccggctgcggtgggcggttgtgcccatttgaattcacattaacgggcggaaggtgaatcacaagcaggagcaactgcatatgtctgccagggatggcattggcatgatccattgatccgtggaaatctgtgcggcttatatagaagttgatttcaatagagagaaaatttgcccccaaaaactttcagttcgagagttgctcagttctcctctgttttttatccatttgctctgttattgctggatttgatacagtactatcttaagatgttcgatatgccgcctttgccaacaagtggtatcagacctccatccagcgacgtagagcgtgttgaagacgagctcggtgtcacagatcagggtggtggcccaacgagaacgatgccacaacagcgcgtcgttagaagatgctttgtctcattgcgtttttttttttaatgagacaactatcatttcggcccgtattccataacgagtcagctcgagctggctcgcaagctcaatgagccaagcgcaatcaaaagaagcacaacactcattaggccaacaacccacttgacggcccaggcacccaacccaattctgcaataggcaaaaaaaaaaaaagaaaaaaaagaaacactctgaagctaactccaaaaagaccagcgacaatcagttcgcatcgtggcattgtcattgtgcccccatcggctcctctgcagcttgcatggcggccctggcacctttgcactccactcatcgggagcgatggtgcattgcagagcatggctacgtaaaaccaagcaatggtgacgatggagtcaaagcaacacgtgctccacgactcatgtcgtcacgcttgttgggctcacttccccaatcgtcacccaatgcgccgctatcccccggcgtcatcatacaatgcactcctcttgttgctctcgctggccagcacactcctctcgtcgtgtccattaccgtctcattccatgcccctatccgtgtttgccaaagaggaggaagacaaggtggaagagatgaaggaacactggctcgcaagctaaaacaagctagattgaaaaggggaacgtgggcatcaccgcattgacatcggattgggatggacttaggcttcgtcgaagcggctgaatcagtgagctaatttgtttgacgtaaaacgaatgtagcatatgattaattaagtattactaataattatatattttaaaataaatttatttgattttaaaaagaagagtaaagtacacggccagtccttaaagttggagcgaggtgtcacttaggtccatgatctagataaatcgttattcaggtccatgatcttgtttaagtaaattatttaggtccaaagcacctctgattgggttgactggcttacatggctatccacggtggcagcatatttgcattttagccccccccccccccaatcttggctcccccttgtctctatctcatttctctatttccacatgctgctagctgctgaccaccacgcgtgcatgcatgagccatgcatggcggcggcgggcaagcagctcacagcaccttaccaagaatcgccgccgccattgctgcttccgttgccgagcatgctgctattccagaaccctggggtctcatggccaccgatgacgccgcctccgccaccttggttcttgccgtggtcgaactgatgatcgccgctgctgtttgcgtcgctagccgtggcgctcgccaccagcttcaggttctcgaacgggaacaacaacctgccccaccgcgctctcttgcaacccagcgctgcacgcgccaaacaccctggagctgccgcctgcacccgccatgcgtgtcctgggagaaaccgagcgcagtctgagcttgttgctgatgctactgtggcggtggcggcatgcggaactcgccaagatggaaccccacaactgcatattccaccggcatccctagcggccccatctgaggcagaggaacgtagtagccgatgctcctcagcaactccatcgccgagaacacgcgcccacgctgcccctgccaccggcgccgttcgccgccgccaggttgcctccggggttgcacatggtgctgctcttcaagctcgggaatgccgtgaactccggtgactgcagggcatgaccatggtgatgagggaacgccaggttgaggtcctgcgcgccctcatgcatcagcttcgggttcttagccgccagccccacggggaccgagccggacaccgccgcggaggtggaggcctacgcggccgccgacgacaccatgaggacgacgagcgcttgttctcccgtgccgttgccgtcgtacgcgcctccctcctcttcatcgttgtcgtcctcgcggccgccgccacgtctccaccgccaccccaatcgacgctgcaatcgctaaccctagaaatcacacaggaggaggatttcggggagaatggttggatcggaaatggggaagccaagatgtgggggggctaaaatgcaaatatgctgcctccgtggacggccacgtaagccagtcaacccggtcagaggtgctttggacctaaatgattcacttaaacaagatcgtggacccgaatgacgattttcctagatcatgtatctaagtgaaacctcgcttcaactttaaggaccggtcgtgtgttttactctaaaaagaaatttctatatatatatattatttttcacgaaaaactcaatttagcagtttgataagcgtgttcctgataaatgaggaaatagtctagctcaatggttctttgtaactcacctttatcccattcagaaacaagctgcgtttttttcatcggatgggttaggtcgaacccatttctaaagtgtttaatttgaggatatgtgagatgggttgatctccaaaggggaatatttccctaatattcgtgttagattcacacctcaaaatctaagggtccaattcaacccacctcctctctctccctcgaaaaaatggaaccaatccattcttaatgccaaatagtaaaactatcccattaaaaaatacggatgattttaacccatttcacctgatctctaaactaaacgcacacaagtgttctctttcaaggatggatcacgtgaagctacgaagagctagagctctagccaatggatgattttaacccatttcaccttatctctaaattaaagcattgctagttctctattatttttggacgtattgacgatcgaaattggtctataacgaccatcaatagtatgcaggtgattacttgttccaattgagagaaaacactagtaagaaagcacaactccaaccaatcagaggagagtacacgaattaaagggcccacacaaggaggagaacaacctaaacttgaggacgcaccaagcggtgaccctgacagaaaacggcgcgaacaggatcggccgaaccctggctggctcccctcggcctcagcttccacgtggcgacgattactgatctcctgaagtaagtggcgtaagtcccaaggtaggaaaccaccatctaatgtcggttgtggataggtggaggtttgagaggagctggagggagaatattcccttagcatccccactctctcaagtcacttccacaccataaataggcctccactcctcactctcaaacacacaccaaggtagaaatcaatgccacattccaaaggtgaagctctctgcaagcgcacagataccgttgtagctttcacccaagagtattccagggtgtcatatccgcagggaacgtgtgtgaactagttttctaactaaattacccaaggacacaacataaatggtaggtgaagatatgagaggaattccaatggcttacttatcttagtttaagttaaagtaaaattctatcaattgcttcgggcaccggcttacccctgatctgccaaggagactctggccttatgatgtacccgaacgtggaggattacgaaggatggacatggctatcaccaccagtcatctacctctacaacccgtggggcacacaaaaaacaatggtaatctctagcctagacaccacatctatgctattaattactaccttaatctcagtacaaagttaagattaatgtactctaccgaagcagcgcaatgaacccacaacgatgagaatatatcttacttaaataagaagagtgaataccataatgaatacttacttatactagaaaaaatgtccgtgcgttgcaacgggtaagatgtttttgaatccattctttggcccaacctgcaggtggagccgtgggtctccatcttctacctccacgagatggtgccatgcacatatgatgtttgagctgattctccccatcaaatctggccgaatgtttttcgatctcctaaaattggtttagggcttttgatctactcgatcttctctttccattttttccaaaattggagcgaacaaaactcgggatcaaaacggttgaggaagcttactggccggccatcatcgacgacactggccggccatcatcgacgacagttaaatggagattaaatccgcccaagccgaattgtaggggaaaatcatgggaaaaatgatgagggatgagtggagaatcgatttttgtaatcaattagaggaggaaacgcatggggaggcagattgacatggcgacggagctagggttcggcctagcgaaggaaaaacacggattggtgacagccaacgtgattaatttatgtaggactaacaatgcacttcttcttgttgctgggtgtaacaattttgttcagttttaatatttctaattaatgtaatttaaattagctggacttataaattttttacccattagttgaaagggtaagttaacctgaggtaaccaaactctaatatatgcaaccaaccaaacaagattttccctcatgtgcattcatccaaccactataccattgcatccaagatcaactgatctaaccagccaaacaacatcaattgtacacacttatccatgacacggtaagccaggatgatccatacgggctatgctagactagtgcagataaacaaacacatcttagtggttcattccttgtgtatacataaaggtatatagtttaaggaaacatagtagccaagggaacctattaagctgctaactaacggaagaaaaatctgctaactaagggaagaaaatcttttatagttaaagaaaaaaaatactgctagcttaccacctaaccctctagactaactcacaaactatagtaaggattatactaacaaattattcttttgtggaaaataatatatatttttttatgtagctagctagctagaagttctccttgaatattttgtcaatgcaatctaaagacgcatatggtcatgatcttcaatcacttttaagacctacatttaatatcttgtattgaagatgtcacttctcgcgttgtagattagcatctaactgaagacatagattctcaatattgaataaggtataggatatttccaactagaatcaagtatctgagatcaccttcaggtatgtgccacttagcatggtaatctccaccacaaacacattagttatatcaatattaacatatatacctaaaagagtgaattaattttaagaccaaggacaatcatatgcagtgattctacatatactgagtggataatataaatggataaaatgttgttttttgattgtttcgaagaggtgcatcttcaatgtcatcagaaaactcgagcatccacagtgacaaaaggatgtaatgctgcctagcttattatcctcaactattgtcatcgacgaactcgatgttaatgatgcaagactcgtgagcatatctctattttatagcccacagatttttaaaatcaataaaaagcataaagtatgataggttgatatattagaaactaaattgcatgttagttctaacactctacgaatacacaaaataacataatcttacatacttacaaatccatcataataataacgttacatacttacaaaagaaaagaaaacagcagcggaattaacggtctagcgatggcttcagctccactcccacaggcagctcaactggggtataagccaaatggtcaaactttaaggacgaatttttccgacaaaaatgatttgtgaaaatttctcctttcttccttatctagaattctttgcaaatcgtttcattgtctactctcctctctctttcaacttgagtagttctaaaactagtggtggaaacttgaagatattgatgtggacaatttatggaggtcagtcaagtggatcgaggaagaaccgaagtgccaagtggtcaagatagagtgaagtttggaacctatcttagaacctatgccgccaaagtgtctttgaagaatagttagtagggtagaacgcttgttgtttgctttgtgtgtaggtatggttgcatttccatcattggagaagttcattgatgagtgtgtgactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagttccgggcacttaagcaaaaggatcgtaccgtggcagagtatcttcatgagttcaatcgtctggcacgttatgctccagaagatgtgtgtactgacgaggaaaggcaggagaagttcttggaaggcctgaaggatgaactgtcagttatgttgatctcccatgactatgttgattttcagcagctggttgacaaagcaattcgacttgaagacaagaataacaggatggataaccgtaaaaggaaaatgattgtattccaggaggcacaggatagtagccagaggcagcgtatcaagccactccaaattggtgaatctttttctgcaggtcaagaacagtcacaacaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattatcggagttatggaataagatagactgcagtttacctatgcccttttctttctagccgttccgaatctcgggacgagattctttgtaaggggggtagatttgtcacatcctgattttcgtttcaggatttataaattatttaataaattattaatagaatttatattaaatgttcattaatttacaagtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtattcttaacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgacctttccccttgtgtttttctaaaattagttgaggggaaatattcctcttatcctcctctatctttacctccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgtgccgtcgcctccgtcgtcgccgccggtcgccgtcaccgccgtaaggtgcgccgaggtgtggagaagcccggccgctctctccccgctgtcgccggtcaccggagccccgtcgccgccgtcgaccgaagccgtgccgccgctagacctcgtcgccggccgtcgtcgttcgtcgtttggttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctttcacaataattatggatgttataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgcttattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacacgccgtcacagaagatcctaggcgctatccttcgtccatgttgtgctgcccaaccaggaacagccacgcgtcccgcgccgtctcctagcctcagaacttatctgcatcctcctactttgcaccaatagccaattgacatgttgttgcctcgatcccttgcgtcgtatggctccagcatgagtgcgtccacaggcgaggcgagacgcctctcccgcacccccactttgtcgtgcgcccatcaatctgaggcactgctgacggtcgttatagacaaattttgactgtcaatatacccagaataaaggagaattaggaatgcttgcatgcatatttgtttaagaataatctatttccgacaatttccgatcgccacaaccatcattggcagcctatttaaggacctcactctctccattccaaagtgcaccaagaaggatcaaatccaagaagctctctagtttatttacattgttctagtgctagtggagtaggatagaatagtttctttagttcttcaagtcttcaggagattttgggtatgtctctagtagcttttccttctattttaagacactcattaatgaaatattcttctttatatagttttggtcttatacttcactcatattattattcagctgccgactttaattagttcatatttatcttgtaataattatgtagctagcttactggaaatatgcaatggtgttggtttaatgttcatttatatgattgctctgtgtcatttgcaaagatgtagagtagtatttagtaatgtaagtgctgtgcttttattattagataccattaaatggtgttatatgccacgggtctatagaggtaggccactgatgggagactaggactttcccaaaaagaaaaacaatgcaatgccgtttcaggaaaagaacggaaacggtcccgcgaactgacatggatacggttcgtcatgcaaaacaaaatcgcggactgagaggggagtgaattgggcacaattcatgaccaaagcaaaggaagaaaactattagcttgacacttttaccttagcaacattgcctccggtgatctgatatttaatctccggtgacctaagtcatgttagtgattttcggagcaaagagaactcgaaaaaaaaattatccctgacaattccaattatt

SEQ ID NO: 47476 - DNA, 3095 bp, Oryza sativa
  unsure (1)..(3095): unsure at all n locations
attcctgcagccctaaaggaaatatttggatggactcaaaaggattgtaaaggaaatatgacaacatagtatatcaataggcctaaggagattagtagaattgttgatggcagcagcaagcaaacatagcaaatgtagaagaaaaaagtagatctgttgatggaatacgattagaggctaacaaatcaacactactctttgtgggtaggactgtgagactgagaccctagatgcttcatccaaatcatggcatatcaatggaagagaaccatttcgaactaaaggttgaagatcatctactaatcaagaagccaatttcaattagaaatatcccaagtaatccactggtttatgctattgctgtgttgcagcacatgatagaagcatgatgcgggaggttttagaacttgtgccaactgatcttaggtataaatcaaggagctagcagtgcacaaaatgatgatgagcaatcaagcttatagcatggcaatctgatactagcaaaatataggataggaaacaaaggatgttgatgatagtgcacaaaatggagttccaggacaacaagcagaggctcaaactgaagcctaaatgcaacagatccacttagatttggtgagaatgtagaagaaagcagaggagtttcctcagctgcttgaggatgaaatggatcaagatgacttgctgctgctgacacatgctgctgcaagtctgcaactagctcaatggctgctgcttcttaatgatttgctgcttgaagacgacgaaagcagggctgctgctgttggtttgcttgacgaatactgcgagtggtgatgaaaggacgagaccagtgattgaggcggcgaggctgcgacggccgacgacgacggtttgcccgccggcagaggatacggcggccgcgactagcggtgggatgaggtagtcaatgtctagacgatctgctgctggctgctgctactggctgctacttgaagatgaatgggacgatgacgagaagctaatgcatcttgacagagctgacggcttgatggtgtggctgcctgcggcggcgtccgccgccggcgcaccggggaggacgtcggattgaggctagggttaggatctctgctctgataccatgtcaaaatcagtgagtgaattggggatttaactatttattcattgagttggcccttagggctaatatgagatgaatacaacgtgaaaagacagaaataccccttaacacatacacactaatacatatatattcttaacagtgaaaacatgattgagtccttttgtttccatctttttttaaaagaacaatactgggaattacatggtcagctttacagtgctctttgatctataggcattagaagatgttgtttcggttgaccttgcaatggctcgaaaccatgactcttcagttgggaaaagacgtctaaatcgaggctttgcatttgtgcgattttcttctcatgcagtaagtcttattccttatttttgttaattccatcacccattggattctacgatggaaatgttgaccttatattattgatggttatacttaaacctcctttaatcattcattttctgtttgatttatctttttctttacatttaagtgcagtaattcagctttcctttgtcatattttgttgcgccaaacttagctatgcctttttatcattattttcttaattccaagtttacttatagtttaccaaacccttgccaattggtttatcttgcaggtattgaccaatatatagcctcttgtcttaaaacaatctttattggataaaaccatctgactgaaatatagggatatgtantaaagtagcttctttctcttctcctggattcctgatgaatgattctatccttttgtggtgtgccttaaatctatctgctacaaaagaagcgcattatcaagtaattgcatatctaagtaattttgtctcctttatgagatgaggggccagatgatggtgcattgtcacaatgttaccaacatatccttatcatctactgacaagaaaatcaatccatatcttttactcagtgttggttatgacgtaatggaatgcacttttatcatctgatcttttaaatgactgattggtgttgcaaagggcatcttctatggttagttttcatatggaaatggaaacattgcattgttgatttgtgtaaccatgaaaaagaaaacaaatagttttatacttctgaaggagtcgatcatattcaatatcccctagaatcaattgttgggcacacttgttaagaaaaagaagtatagactggtattatattgcttgccagattttctataattccatctcatgcatattctatctcacatccatccccaatcttcacaaggattctgtccgttactgaaattcatttacaaatcataggataaagctatggtgattattggtgagctttcatttttatgtgaatccataacctcccttattcaatagatggcccatagtgacaatttctatatctggtgaggcaatttcatgggattatagtttaacaagatgagcgaaagaatatctgtctgctctccttttctgatctgcaacattctgaagttttctgttagtaaagaaaatctcaatttatggggtcacagtcaccttggcaattttagtgacaccaagtttgttggctcctggtaccttaagttctgaactatccatttctagtggcctaactccaattcatgctactatagctatactactctttttttatcatatacgcttttctcattagcaatggtatgcaaaactacataacaattttctcctgataccagttctgtaggatttgtcatgtcacttttgtagaggaaggacttaggaatcttatgtttagcatatccagttgaagaggtggtttcaccaaaatccagtaaaactatttaacttcatgaaagtttttttattcttcattttgtccagagatcaaatactttgcctctaagatctgatcattatcttttgacagtatatataaagttcatgggatttgcatcccttgatgaatgtttttactgccttagttgctattgtatttatccagaa

SEQ ID NO: 47477 - DNA, 7608 bp, Oryza sativa
tcctgcagcccggtagaaatatgatcttttctgattttttttatagttacgccctcttgatatttatcaattcagcatccatttcagatattactgaaagcaactataagtctgacaacaaaactaatctagattcaagaggctacaactgttcatcatacagcattatcatataaacacctactgctaatgttcctgaatttgagagaaaaaaatgttatcttttccttaataaatcattctaaaagctgtggtaacaaatccccaattttcattgggtgtaacagcaagcttatcttaataaatcattctaaactgtggtaacaaatccccaattttcattgggtataagagcaagcttacggtttgccgtgatggctgaagaaacaaggctgtctaatttcatcaagatttggagagagttacgataagttacaatttacatcgacagtaggccaagctaaggttgacttctccttaacagattgtcttgaaatatgatcactgatgacagcctgtaaaacataacttgtctagacatgcttatctaagcatagcaaacaatgaaatgactatgttaaagaagttttgaatgacacgagaatcttttcgacgcaagattatgtatttagtgacattagtttcatcatgaactgaaatttttgttaatttcatgcaggcacagaagcaggaagaactccctgagaatgtcctatgctgtgtaaggctgaacagagtcgatttcgtcgatcatgggcagataccgacgctcttgccttgcgacgacgactgacattttaaccggcatgctaatttaactggatctgatgcttcagtcaagagcagtaggccagtagcaggcgaccacaagttctgtcctgtgaaacttgatgaactcaccttggttttgggagggtgaacatggcatggttgcttcttcgctctggtccatgagatcaacggctctacttcagagttctgtaaaaaccagcgtacatagtcatgcatgttgtttggaaatctggtttgtggatgaattctatgggaaatttgttctgcaaatcaggaattggctggtaccaatcaatctattcattcaattcatctgttctcattccatatgtgatcatttacattcatgtttcgattttgtgtattgtggaagtttaatcctgtcaccaacattactttgtttggatgacaaaaaaaaaacagcaattttttaaacttacaattttcaacatctgataaaatctagtggggttaacaaaaccaggaaaccattaaaaacaaaaagcagcagttttctgatgatcataaactattgttgcagttttctaaaatgtctaattgagtttgtagttattattagttttgacagaatagttgcagttttctgaagttcaaaatctagtgagggtgttttcaacaaaactagaaagcctttgtcacaaaagaaaagtcaaaaggtccaataaaacagacaaaaccaggagcctaaaccagattatctcccatatcaacaacaacagcaacagcaacagtataatcagaaacaggtgccagagcagaaaatgcagcaattgctgtttccagcccataactaatgatggaagaagctaaggcagtgttgcaggtaaactgacagacagcagcattatgagtttgcaaactctatacaatcttttgctatacagaagtgctttggacagcatcattttcatcctggagttgtccatccattaatctttttatcttgttgaagttttttttagcacatcaagtgttactccagataattcagaaaaaattcagagatgctgacagcaacactgcaccaccagtttgtctcccctgatctgatggcatcatgctgctgcaagccatgtcctaacaaaagcttggctgcttgttcatcttcttccttgtgatgacaacaagtacacttgatgatgctcctcttgtgctctttgtgtttgtgtgtggtgtgtgatcatgccatgtctgtcttcctcattgctgctccttcttgctgcctgccaagaacaacaatgcatgagatcctgctccttttcggctactttataaacacacagtaattttatagaattttcttaggaagttcctctaaaattccattgaaatttctccgttccaaataggccccaaacaagtatagtacgattttcccgtgaacttttcatcagcatttcttagaaaattattttatttgttttcgaattttaatatttaattcatttgattgtgttctgaactcgcgaataattttcataaaatcagttccctccatcatatccatcggtcatggcatttcggtttcggatttaaagaggtcagcaatggcatgtgccatgttgtgtggtgtagaaatagatcctctacaatactgttctttgacgttgagtgactgacatgtgaaccctttactcagatggtccacatgtcaggaacttaagtcagagggcagggcagtactgcagaggagactcatcatccgtgtggtgtgtggatcacctttgcggaaccacgagtggcggccagctcgccggatctgctgctcgtggttctggaggagctcctcgatgcgccgcggctgcgacagcaacggcccggagaatcccaccctgtgcaacctcccgccgccgaccttgtgcttctgccaatggcgggaaaatcgtcagtgagatggccggtgaggaaggattacgacaatggtggaagtgatcggagggagacgagaccttgctgctcttgacctccttggtggcggcggcggcgccggcgccggcggtggccgtgggctccttgaaccggttgttgtaggattccgacgaggtgaacgcgtcggcgacctgcgcccactgcttcatcgcctcctgcttctccgcctcgtaggcgccgccattgctgttggttcttggcaccttggaggagctccgcttcgccgccgccgccgccgtcgtggtggagtctggtcgtggcatcttggcccaggcgaagccggtggaggcggtgagctgcaccggcccggagagcgggaggcggtcgccggcgtcgtcctggtagctccgggacatcggcggcggaggcggcggcggcgtcgggtcgtcgtggcgcttgctggcgatcaccggcacgggttgcatgtcgacgaacagcctcgcctcgccgccgttggcgcgggggagcgactcctcggcgtggacgtggccgtggccgtgcctctggctggcgacgacggcggccgcggtggcggcggcggtggtgtcctgcatgctcttgtgcccccgtgacagccgcttcgtcgcctcgccgccgccgacgccgccgtggttcctgccgccgacattgaccctccttctagaatcttctcgaagcttggcgtccatctccttgttgggcgcgtacttgggcaagctcgatggctcgcaggcgtacggctccgtcctgaaatactgagcaaatcgacacgaaaaagaaaattcagccacgaatgcccacggacgaacaccttggcggcatggtcacctacctcggaggcgagggcttcggtggcggtgccacgggcggagggctcgacggagaggagcttggagaggagcgcgaacgcgtcgtcgcccatcatgcccccgaacgtctccctgagccggctctcgtacggctgctgcggccggaacccggcgccgccgccgccgcccgccgccgcgcggcgccagtacgcgtcccccggcgagccgcagagcttgaagatcctgtggatctgctccacctccgtcctcccctgcaggatcggccgccgcgcgtgcatctcggcgaacacgcacccggcgctccacaggtcgacgctggcgtcgtacgccgtggcgcccagcagcagctccggtggccggtaccacagcgtcaccaccctgctcgtcatcgccgccgccgacgacgcgtcgaacacgttggcgagcccgaagtcggcgaccttgagctcgccgccgccgctcaccagcaggttcgcgcacttgatgtcgcggtgcatcacccccctcgcatggcagtgctcgagccccagcagcagctgccgcatgtagcacttgatctgcaccgtccacgtgtcggttagagcccacgtgtcgcgatctcagccgttgaatgtgttgggggggtcgtcgtctacctcgggaagggagaaggagagggaggggtcggaggagaggccggcgaggtcgtggtcggagtagtcgaagacgaggtagaggttgggggaggagcgggaggtgatgaggccgtcgagggagacgacgttggggtggcggtggaggcggcgaaggatgaggatctcgcgcgccatgaaccgcacgctctccggctcgccgctgtcgaaccgcaccttcttcagcgccaccatcctccccgtctccacgttccgcgccctgaacacgctgctgtacgtcccctgcccaatctggatcatggacgcgccgccattgccgccgccattgattgttagcttaattgagaaggagaggtgttcgacggtttgagttcttgcttgccttgtcgagcttctcgtagttggcggccttgagggggacccagccgtggacggcctcggcggcagcggcgctgagccacgacggccacccggcggcgacctgctccgcctcgacgtacctgtggatgttcccgagccgcacgccaccgccgacgacgacgacggacgaacactcaccacccccacgcgccgccgccttcttcttcccgtcgccatcatcctcgtacgcgtcgagccgcaccggccggctccaaatcgacgccacctccgccgccgccgcgcccgtcgacgcgctcctcgacacgctgtacgccgccgacgccgacgacgacgacgtcgtggtcgcctcgtacgccggcgacgccaccgccgcgcccttggacgccgcgcaccccatcgccgccgccgggaacacaggggaggagcaagaaacaggggattgcctcctctgtttcctcctcctccaccaccaccaccacctcctcctcttcttcttccaaagcaatggaaatgtaagctcgagctcctcctaaagatagctaagcttagctgcttctgcttcctttaattggcagaaaaatatatatgttttttttttactttttttttgttgttggcaaaatttgtccttccttttgctttaattcttgtgctggtattgagctagggattgggctggattagattagccaataaaagattagggaggagtgtagtgtaattatgggttatggcttaattgctctccctaatcaccttctaaagatagccaaaaaggttgttgatgtgctctggttaagtgcaatgcaactacctctacataagctgaacaggtgcaactgatccagcaatgatcaggctattttgacgtgttaatttttgggggttttttagttgttgttttgatgtaactttttttagaaatttgggagaaatttaaaatatgttttgaaaaagatttggataggagaatatactattgatgtgtgcattggtcaaagaatatttgtttttggagaaagtacatcagagggaattgatgtgcatgcaagtataggaacatggtgtccgggttttaggcgggaaaaatgttcatgtgattttattatggcgctagaggagtacaagtttgtactagccgttcatatttaaaatccctagccgccttgtgtgtgtgtctctctctctctcatttatccgtatatttgtgctgcattttgaatgctttgatttgtttatggataatgcatgggtttagcagcactgtttgcaatgatgttgttgatgcaaagatgagcagatgaacaatgatggtttgtttgggagaaacatggcaactactataaagttgccagttaattaggaacaagaaagtggtgattaagcactttaactggccttgtgtttttttttcttctcttttttacttttctcatgtctggagaaagggatatatgcccactatgttgcatgctaccccacaaatcaactgcatgagaaagggaaatgtgtgagagagggaatgtttgactattgtaatacctgtggatatttggtgaggggatttaagatagggattgttcattgtttgtccaatgcatagttaatttcagatccagttttgttggtagaatttgctgttttaatgactagcaaatctgtactcccttttattctcttgttctgtttgactctctgttttctaccatacctcctatttatttttgtaaggccacgggttcttttaactcctatttactcataatttcttcgacaactctaacatcgcttcacaaatattgactttaacaagagaaatactatcttcgtctcatgaagactttatttctagttacgaatttgataaatatttgcctagatgtagctctttttgggagggaggtagtaacaatgtgaaaggttgtatgatgttatagggcatgtgaaaatttttgaaattttgaggaatcaaatgcagcaaactccaatttggtgtgatttatgacctgcattgcatgcattgtgctttcatggttggttggctagccaatgcagcagcatgttcattctttctgtagaaaggaatttatgttggtgttgactataccaataaccatgctgtccctattctctgcctcttataaagacagtacaatataaatgggcccattgacatagagaggtgtgcaatggaccacaggatgaccccatggaaattcatcactttctttttgcatccaaggcaaaaaagaaaaaatatggccagagaagaggaaagaaaatactagcataacaaaagtctactcattatatgaagtggttggcagttcttttgaggaggtaagctgttgttgcctctttgctttttgtagtgtatcctatggctggattatattgtgtaaaatcaatctttcactacaattatatgtttcctaaaaaaattcttaaaaagtttattaccactgtaaagtttcatgatggaactccattgcatttatgagattttttttatgtaaagaaggacaaatggttactgcaattgtgttggaatagtgttttcactgttgcactaagcatttcatatttggctaaaattttctcttggtgggacctagttgcacgactgtaaaaacaaaaaagaacttgcctaaagaaaaaactcacaccaatgggcactagtctatgtgcatgcagatccatgggcaaatgcaaggagatagataggatcataagatgatcttttcctgctttttgccttgctttggcactcacatattccttgctacctttgatggaagatatgcttcatcaaccatcatgctgttctgatttctcttgcagcaaattgagctccctatcaataattagccattttaatatccatttgccaggttaaaacattgtactgtaccaagaatcggctagagatcaacagatatcatgtcatcagcatggctgatcagagaccaggtagaagcatctcaattgtttagactgtcactggtctctctggaaagtgttggtactggctgtcatagcacagg

SEQ ID NO: 47478 - DNA, 1671 bp, Oryza sativa
agccattttggcttattagaaaaaaagtcaaacgatggagcccgaacaaaactcaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaatttttagtcccatctaaacagggcctcagatactagtaccatcaacagtccaaaatccgtacaaatttgaatccgaagtcgctttcaaaaagccagagagagagagagagaaagatagatagagagagagaagggaaagggaagagagagagagaagcagatcagcagagctcccccatctctcgctgtctcccctcctccacgtgtagacgtcgacgacgagttatatacgttcgcacgcgcgcacgctcgctcgctcgctgccaccgcctccttcgctgccaccatctccttcgccgccgggcaccatcgccggcggtggccgggttcatgtaatgctattgttgctcttcttcttcttcttcttcagcttcttgttttgtacagtagtaagaagggaggaagaaagtggttgttttcctttcttttttgttcgtttgtttggatgttaacgagtggcgagaagttggagtcgtcttgtgtgcgagaaaaagcctcgatttctccgggtgtttttggatctctgaatctctgacgctgatgcgtttcttgatgtgtcagactaagacagagaggctttgcttgttcttctggcgcgtgtgcttggctcagctcaagctggggatcttcctgtggtgattcttttttcgttttttttctttttttttgtgtttttggggaggtgaggtcggcaggttcggttttcttgtggtgaggagtatctgtcaaaaggctggatttttatatattgccaaaaaaaaatgtgttcttcaattttatttgtggctgtcttgccaaatgatactagctggctgtttggctgaataaagtgagaatttgatgcaaatcctttgttagattgtgtgtgcatttgtgcttctgatttctgaggcggcttctttgatggagttagttgcaggaaaattgcccctgcttttgattagtttgttttggtttacctatttgatgatccaattaggatattttttaaatatttttggtgttcttcgtgtttcatttgaaaagttcttggctaggagaattggagcaaagactaaagatccaggccttatgttagtaatttcactccgactattttaatctctggttctttgtttttcaatgtggtttctgtgttctttgcctctgagaagcttaaactagtttttgttgtagtggccatcaagtcaacttggatgagccgagtagttcaaggagcaattaaacttttgcagaatcttcagaattattattggtttatctggagtgcttgtttttttgaccaagtccaaagtacggggtgcagg

SEQ ID NO: 47479 - DNA, 1296 bp, Oryza sativa
gctatttttttcgtaaaaaaagaatgcatctttttcctgtttcactggttaaaagttccattcaagttctgagcataatacactgaagatcttcagaagggagaaaaataaattagttcttcagaaatagatagccagattgttattataacgcaagaagcatcacatggatgtgcaaccaacatctatctaaagactgcaatctaggatacagaatgaatttatcttcatattccggaaagcaggtttgttaattaatctctttggaatttctgtggcttgtagcttcctgaaatctgaagaaaataaattcggttttactaccaccatgggtgcctgcgtgtcttcaagcaaaaaacggagatcacagaaattgtgctgtatataccggcgttaccgcggaaaagttttgagcaatgcacctatagtacgcgccagtgatgcagggagccgtgctgctcctggagaagttgttcatgtggaggctaaatctgatggctcgaatgtaacatttcatctcacacagttgcagtggcatcatagtgagctagactcagaaaatggaaatggtaattggaatttttcttgttacttgcattttttttttgtctcggttatctgagttaaatcctgaatttttgccctactggtctagttgtgtgtcaagaagaagcgggttcaactctctcagtattttaggatctgattctgatgaagatttcagcagtgttaatggaggtttgtattacctttcaaccaatgtgatctgcactgtacatgtgaattgatgcagtatattcaggcttggtcttttcttgcagacctccctgcaatgtcaaattcagcgggtacacaattaatgcactgtgaagatgcttcaagcattgctgatgcaatccagaagtttgagaggatttttgatggttcatgtgttgctcaagccattggacaatacctgaaaagagacgcgaacaaaatggatagaccaaaccaagcagatattcaagaatcggagaagcctaaaattccaagcccagaatcatgtgatgtatctgatgtgaaggttgatgaaacaaagactagaaatgagggtataaaaattctgacaaaactcagaagaggcgaggatgcatgtaatacgttgaaatcttcgaaagaaggagacaaggctcatgaaagtatcttcaaaagtttgacaccagtgtgcacgcctcgccatgctaataaggttcagcctttggccgtagcaagtcctcggggccaaaagaagaaatcaggagttgtcaggctctcttt

SEQ ID NO: 47480 - DNA, 722 bp, Oryza sativa
ctgcaccccccccttggccatttcctaacctctcaacactctgtcatttagccataattcaatccactgtccagctaaattcctacagaatcttgctgcagctgaagcaaatgaggttcttgatcatggcagccatcaggtgggtggttcttgcatacattgtcgtcatcggatgcgcactattgcgcgtggcgatgagcagccactgtcgaggattgcgatcgagagggcgacggttgctgctgttgattcagccagcgtgaaggctcaaccgacagttcttggcctgaaggtttgctgctcatttgcttcatagaaacactgatttcttaattgcataattacaatgaaatctcatgcacttttacccttttttgcggctatgtatgtttcagggtcaaagtagtgattgggtggtggttgaattctcccatccgaaaccctccaacgacgattggattggtgtcttttctccttctggattcaggtcagctgcaagcatgtgttgatttgcatatatcttgtctaaattgtgtactagaactataaatggaacgatggcatcattcaatgtctgaacatttttagctctgaaatatgccaacctgaatactatggagacctcccaccctatctgtgtacatcacctatcaaggttggtgccctcccgtcctttcatatttttcatatttatgctgctattcatgatgcatcatggattg

SEQ ID NO: 47481 - DNA, 1476 bp, Oryza sativa
  unsure (1)..(1476): unsure at all n locations
gattcaatattgatccttgtttgcatttcagtggtaatcatgaaagagattggcctgaaagcgggtcattttatggacacaacgattctggtggcgaatgtggggtccctactcagaccatgttctatgtcccagctgagaacagggcaaaattatggtaatttcagcatattaaagccatataattagttgaactcatgtgattacttattgatgaaaaaaattgttatcttatctccaggtactcgacagactatggcatgttcagattttgcatagctgatactgaacaggactggagaccaggaactgagcagtataagttcatcgagcaatgcctgtcgtcggtcgacaggtcgaagcaaccatggctcatcttccttgcacatcgggttcttggatactcatctgcgagttggtatgagatcatgatgggatcatatggtgaaccaatgggccgagatggtctcgaggaactctggcagaagtacaaggttgatctcgcagttttcggtcatatacacagctatgagcgcacttgccccatttatcaggtaaacctacaacctaaattctcatcaagaaattatgtaacagaaactcagaaatcaaattcatacaccatgtcagctttgttttcaactactttgcaggacttgctacagtagatatgtactattccagtagccttgatttacaatttatcaaatgtgtgacaaatttcattttacttggttgcagaaccgatgtgtccaggatggctcaaacctttacaccggtcaattcaatgcgactactcatgtaattgtgggaggaggcggcgcgatgctctctcccttcagagccactgtaccctattggagcttcttcagggactacgactttgggttctcgaagctcactgcactcaaccactctacgcttctgttcgagtacaagaagagccgggatggaaaggtctatgaccacttcaccatctcgcgtgattaccgagatatcatggcatgctcaattgataactgcccaagaaccaccttggcagtatgaacagcctccactagttcattgtcattatctttgtgaagtgttagtatgtgctgaagcatatatgctaagcattgtactgtttgacactggattatctagtgatatagtgacagtggagctggaataaaccatccaatcagccaaagtctgaattgcagttagccaaattttagagaggaaattagccaatcacactgccagtttagaacaaaaagagataagtaaaagaactggacaatgcataatatgtccaatcaatccatatatttacaaataactgtcacattctttttgacaaaaactgcactaagatgccctctgaatgcacctcatgctcaaaagactagttttcaattcccattgtaaatggagggagaatcttcatannnnnnnnnnnnnnnnnnnnnnnnnnnnnnnnnnnnnnnnnnn

SEQ ID NO: 47482 - DNA, 1310 bp, Oryza sativa
attcctgcagccccattaaccgatgtttgtgggctcaagtaggcaccttgcactaagagctctaatctaactacagcaggtgccaggaagtggacagaaacatagcagagcgttttagataaatcaaagatgggacacccaacccaaaaaaaaaagttcaaggatatgtgacttatgaaagtctactacacagcaacaaagattgaggaggcatatgtaatagaaaattcaaagagtacgcatagtttgaagctgataaaagattttaagtagctacttgcttcccaacctggataggattaagaaggatctgcaaacgttgtctcagtgaatcaccacactgtgctccacttctcttgttaataaacactagcaatggcctagaatcagaaggcacatccacgatttcatatttctgattattgtgtacgtgtgaatcctcatgttggccgttcggtatgctagttttgttttctgtcaacagctgtttatcattctctgattcagagctttcatgtacttcaggaagttcaccattggcatgatcctctctccttttagctgcattgtttgtttcttgtgaatctccttcaatatcagatggcgggtcaatagtaccagagctatctgaatcaacagaaatggtaccctttctgtactttttaccgcgactcctgatcctctctcggacattggaagccaattcattagccccatgtgttatagaactgataagtcctgctgcacctgtccaatggagctccttaacacaaagaggtgacaatattagccgcttcaaggggcaagtcacagatatcaccagtttctatagataggttgttgtgacaatcaacatgcactagccgttggcaccacatacagtaccaaattggagaacctgcgaggaaagctccattgcaagattcatcacaatagcagcagaaagaatcctcctcagagcgatccgatgtgtcaatccactgtacagcccactgatgaatgacatgttcaaaaccaaccatagaaacacatttgcaatctttgtgcgcatttcctgagcaactaggatgtgcagtggcaccacaaatatcacactgatggataactccccccatatactgcggagatgaaacagacttcaagcatacacagcatttcagacctttactacgagagccaagttcttttctccaaatgtgggaagaggcagggaccttatctttcaatttcttgtacttccttgccctaactctgatagctttcatcaaactcaagctgatgtttttgttcaattgattgacagtataata

SEQ ID NO: 47483 - DNA, 3663 bp, Oryza sativa
aaacccaaacgatacacagatttgaaccatgttttaacagaatgaacacggtctcaaggtttgtaccggattcaaacaagatggacaaaaaaatgaacatgactaatctgtgattctgtggttggagagagagccggtttctcacttcagcagtatgttccatttctgagggtagtgtgatctctgaatttttaagcgtttgttcaacagctcaaaatctcgctacaatcctaacgaaggtaagaaaactaaccccagaacactaacctttcgccgagaacccactcggcttaagcaagaaccctaatcagagcctcctcctccactaccactccccccatcccgagcatataatcacatcctaacgcccccctaaccatcgcttacacgcgcacgcatccatcccaaatcatccaagaaaaccctagcaagcagatcgcaccatccatcgaaaagaatccgattctttcttcctccaaaacgtaaataaaacaagaaaaacgcaaaccgtagaaccgagagatctcacctttgcaccggaagaatcgaatcgcgggggctcaagaaccgctctctcgcattgccgcgctcgattcgagagccttcgcaacgcgctcctctcctctcctctctctctctctctctctcgccttcctttcccctcctccgcttcgatgctgcgggaagaaggcgaaagttgcagatgctgtaattaaattaattgattaattaatcgattaattaaggtggagtaattaagaagctgtgctgattaaatgggattaggggggttaattacgcccgggtgtgggggcctcggatgtccgatgccacgtcaccagagacacatcgcgaccgttggtgtgggagtggacgggctggattggattggatggggacgcgcgttcgctttttgggtgggggtgggattagtttatttgttgcctgattcgggtggcccacctgcagtgggacaagggctgagactgtgagtgggaccttctttctgtagcggcgaagagaacaggatgggcatcttccatttcgacagtgactaagccattttttctttttttaaaaaaaaaaacaacacgcacaaaacagtgtgacatttcgtatgatagagcagaaagttaagccaaaattttcactcaagttacaaattttacgctagtttataaccctagcaatagttgttttgtactccctccgtcctaaaatataataagttttagagttggacacggttattaagaaaataggtacgggtgaatggtgaagggttgtgattggttggaaagagaatgctgatggagaagttgttatattttgggacaaatccttaaggataaaagttgttatattttgggatggttgagtataaaatttcagcgatttcgggtttggtttaaaacgcaccaccaggacgtgtcaaaataactgtcaaggtaagcatgtggctgtgtaccacacggtttaacggctagtggaccattgttaacagcgaaatctggcgagatatatatatactcggatttggagttagatattgaagaaggagattgaatcttgtccatgttttcggtcaacaaccatgtatttcgactaaatataatggtgagggggatattttttaaccgtgcccctaaaactcgctcctgtcaccgagtgctactaaggcattacaaactactaagctaaaccgccattcgcaaaattacataataacgtaatgtcgttttgatcaactcagattcttcagatgacaataaagtaacacatgatattcactaacaaggtttagttgtaacctacacttctagggttttgattacaagcactcctttctaatcaacattacaccagccgctagcgactacagttccatagccacaccgccatgctccccttgtatgcatgtgtcgtattaattgttatcaccatggttacatttatcccttagagtttgtcagttataagcctattgtttaactctcccatgccgctgttaccacatcaattactattaaaatatattcaacgcctattctaacaacgtatatacttgcgatttgtgactatcttgatcggggagttttatactcatattcaaattagaggatatgaaaactaaactttttcctaacacacaaaagtttttgtgtgtcggaatatgtattagacggtagcaagataaaaatatgacgtgcaaactatatatgtgcaggttaaactacaaaatggaaatccaagtgattttaacctctcacaatctttctaatctaatactaagaacttggttcttacctacttcgaaaataagttactgccacccaatagtagtttttaccccatttcaatggccatcccacctgctaatctttcatagataacaaaaaccaatgagaagatatatatagttttctttttcctaaatatgaatattaaattagactatataaaaagaataccatatcaaatcaaatgggtgaacattaaatctgattcttccaaagtataactcacaatctttagcagtaatcagttacaattgaaaagaagaaattcaagataagatctacagaaattaaaccccatgataataaaaaaaatccccacaattccactcccccttccaatcggacggacaccattgcccagcatcaccaccgccttatgatccaacggccgagaaaattcacagccgatggagagaaaataataataataaaaaaactagccgttgctgctccctcctccgctggcgccgccattttttacgttactcttcttctcctctataaattttggttcgattcgtctcggcgaatttcgaatcgaattttcactcgcgaaatcaaaactgaattccgcgttgctcgctcgttcgaaggattttcgattcgattcgatcgtgttcgaaggttttggttggtgagatgatgactacgccggtgatgatgaggagggccagggcgaggcggccgttcgccgtgttggcggcggcggcgccgccgccgccgtcggcggggaggaatcgggagaacgtcgagggcgaggcgatgtcgttctcgcagtgcgttcgtcggttcgggaagccggcggccaagaagggctcggcgaggacgccaagacgtgcgactccggtggcggcggcggcggcggcggcgtacgacgcgccgcgggcgccgctgtgggaccgatcggaggagcgggagaggatcagggccaggctgtcgtctcccgacgacggtggcgaggaggaggaggggtcgtcggggaagaagaggacgaggacgaggacgaggacgaggacgaggaggagcgtggcgctgcgggaggccatggcggggctcccggagcacggcgacggccgcgtgaggtacctggtcgacacgttcgagaggctcctctcgctctccagcgacccgggggagcagagcaggaggaggaggaagaagaagacgccggtggcgaggaagacgggctcctcgtggccgccgccgccgactccgactccgacgacgacgagagcggacgagatcgacgtgtcgtacccctccatcgcctcctcctccgaggtctccttccccatcaacggtgtcgtgctcaggttcttggcttctttgctgataattttcttccccagctgcacccatttct

SEQ ID NO: 47484 - DNA, 2559 bp, Oryza sativa
gcacaccagaacagttcggtctatgtgaacataattcctgacattgcaagtgttgatcatgttgttgattctatgtagaacccagtgaaacctctggggaaagagcccactgaaccgattgatgttgtgctacatagcgagattcgctctgtcggtcgcgccaggttcgatcaccaagtgagtagtaaattttgtaatgctagatcgccctcgacgagttcctaaacgtcttgacggtttatcttcaatcctgcaggtggccgaacgtaacagcttcctggagaaactgaacatggagagggagaggcagcaaaaggtacaccttgcaattcagagaatcacagatcaaaaactctgaattcagatgcaaatctgaaaatcatgtttcacaaaaatgattttaatgtaagaatttgagttatgaaatttgtgtgcagctggatgaagagcttgagattaagcagctgaggaaggagcaggtgccaagagcgcatccaatgccggatttttccaagccgtttgtgccgaaaaggtaactgaaacttttaaggtttctgttatttgtaaatataaaatcttgctgttacatttcaaatgaattcagatattttgttttcattgcaaatccaggtcagtgaaacctcaaacagttcccagagagccaaaatttcacccaaggctaactaggagcaattccaagacttgatttgatgccttcagagattcaccatttcctcctatctccacaagagaatggcagtaatcgtcatcgctgttacatatctatttactgttttgcttatgtgattcatcgtttactgttacatagtcatttgctgtcatcaaacatctctgaattcagggaaactgctgattgatgatgtaaaatgttgattcaaatgtgtagaaaaacaaaaaatcggacatgttttggtcactgtgtcgatactcgtatcgatttcttgtagtttacacaaacttgggaaatgttacgcaatttagcatgaagaacattgttactgtgatgagtagataaaagtaaaaaaaaacaggttgacaaacaaatgctcagcgctgcacatggagagttattgatgaagtttattgcagtgtccattctggagggaaagctctttcaatgtactacagataatttgaaatgtgacaagcgataatctcatatttgaaagatggaatcatggaaacctcctagtatggattatttctgcatcttggactgtaatttaaccaaatattttaagaccctgtttagttcccacacaaaaattttacaccatatcacatcgaaagtttgaacacctgcataaagcattaaatataggctaaaaaataactaattgcatagattgcgactaatttgcaagacgaatcttttaagcctaattgctccatgatttgacaatatggtgctacagtaaacatttgttaataacggattaattaggcttaataaatttgtctcgctgtttactgacggattctgtaattagttttttattagtgccgaaaacgctatacgacaccctgtataatacccgatgtgacacaccaaaactttacacccaggatctaaacaccccctaactgaagaaaccgggtggattttgaccatcagaagcgacagcaatctgtgacatattctgcaatcctcaacaaactaacgcctgtcaatctgaatcagaaacatctcattttttgttaatttttcacaagcactatgtgaatcaaacgttgaaatttggcacagattttttttttaacttttcagaagagaaaattacacacacaaaaaaaactggatatgtctgcgtgacgctgtttaccgaacggcccagctcagcgctttgctcgaactgggccggcccatctggccatctatgctctctgacatgtgggccccactatatagtcaaaagggataattcgttgatgaaaaaaaattttggaacggctcggcgcagactgcagtgctctctgtaaatggtgcgtgctcgagactcaatccgcgaaatcctccctgttttttcgattcaatccgccctggggacggcggattcggcgccggcgatccggccggtcgccgccgcgtccgatttggtgcggatttcgtcggagaaatcgcgtcttgaccttcctgtgcctctttttttttttgttgctcgtgggggatttcaggagaagaggggggcggcgtcgcatggcgactacgacgagcaaggttattggatgggtttcttctctttgatacctcgagcgagtcttgcgttgcgtggtgaatgaatcctgaggagttggggggtgtgtgtgtgcagatcgccgggtgaaaggcgccgaggtgttcgtcggcgggttgccgcggtcggtgacggagcgggcgctccgagaggttggtgttcttccgagagttgcgcgctgccggtagaatgtgcaactgtcactgtgttgtttgattggtgttgtgaattttagcctagtgtactgcatggttgaaaatacctgaattgtttgtgtgcttgattgtgtggacgtgatgctttt

SEQ ID NO: 47485 - DNA, 736 bp, Oryza sativa
agccattctgtctgacctatctaacatctgtgcttcatatttcctttgttcacacttcttttccttgtttttcaaagaatgtacgacatgtcgatctattagcactttgcagtcccatgatctcacatgcacatgttgctgctttcattacccctgtctatcccaattccatttcctagttttgttggatcaacattgaggctgagccagagtaccaggataatgtaatttgttccgagtaggagtttgtaaccacattccaatttatattgtgaacagctgttctttgcttaatattttgttagaatattagtttgtcaaaacttccagaccaaaatccacatgttagcattctaaattcttggacttgttctcttttttggtcagactggggcatcgaagaatttgaagaattgattcgcaaggtaagacctgtagcgccttgctttgagaaaaatataaggacctttagcgcctttataggtcattggggaatgctctaccagcgttgatgtgaatgtcaaaatcagtgagtgaattggggatttaactatttattcattgagttggcccttagggctaatatgagatgaatacaacgtgaaaagacagaaataccccttaacacatacacactaatacatatatattcttaacacccctactcaaatgcaatgtatatgcaacattgcatttgaaactaaatactagattaatgacacaggggtgcaggaat

SEQ ID NO: 47486 - DNA, 10215 bp, Oryza sativa
tatttgagatccttggaacatatttttaagccgcacatttcgttttcttttcttgatagcatcgaagtgacttttctttttaagaaaatggcgaatcttggaacagtctgaacttggttaactgattattggagctccaaacattccactcgataacctaaaatattcaggttaggtacatctccagagtcacagatgccaatgtttttttttcccctttagaaccaaatgataatgattgacccagctttcaaaagttgagaaatactattgtgttgaatacttagcatcacagcaacataaaatgtgattctttacaatatacaaaaatttgaatagatggtctacatgtatttatgtgaaataccacaaatatgttctcaatgcatgaagatatctgcattgaaatttgatagaacaatatatacttcttcattcatacgttcgtttagaaaaggatgatacatgtaaaatatgaagtcaagaactgtaaaacctccaaaatatactattcttatgcgctaacattgtactgttgcagtggaaagagaaaaatgctgctctgttgaatcttgagttcctgtcttctgctttttcagaaggccctaaccataaacctttgtttcggttttgtctaaccagatgaagtgaaggccctaaccatgaactatccgaccattgtcagtgttttgtcagtcacccccatcatcatctgtcgtcatggtaacagtcataacagagcaaacctgatggcagatgcgcagaagctgatgaatgcctcaagctttcaacacatccaaggctgttcactcaatcaaagaagcttctgtaccatgtcctaccaccttcttgattgcaggcagtacaaggaatggtgcttcctttcttcagatcacatgatctgcaaggttaatgaccaggcagaggttcccaaatttgcaatagcctataagcatgcattgccctaataaacgactcactgcacaagcagctcatggcctgctggaacacagccaacatgcttaacatgcgagctcaatctgtcaaccatctcagatatctggtctgaatcttggtgctttctatcccccacggtgaactcatggaacgtctcattgagttcgacccagcttgatcctgctgttttctgcgacccagttcctttcatctgcatccttgcctttgccatgtcactccactgcccagcctcagcatagatgttcgagaggacagcatagttccctgcattcgacggctgcagcttgctcaactcgttcactgctatttctgcatactccacattcttatgcagtcggcatgcactgagaagggatccccatataacctcattaggctcccaaggcatgcttttgatgaggtcgacagcttccttgatgagccctccacggccaagaaggtcgatcatacaaccgtaatgctctatctgaggcatgatgccataatccctctccatgttggagaaatgccggcggccctcatccacaaaccccatgtgtgtgcatgcactaagaacattgatcattgtcacagcatcagggttaaatccctgttgcttcatttgagcaaagagctccagtgccttgtctccatgcccatgcattgcaaaacctccaatgatgctgttccatgacaccgaatccttctgaacagtctcagtgtcaaagacataatccgctcggttcacacacccacatttgcaaaacatgtcaatcagtgcattgcacacatgggttgatctccctagattcctctttcgcacgtatcggtgaatcctctttccaagtgaaagagagcctgactctgcacacgcagccaggatactcacaaccgcggcaacatcaagttccacggaagcctccttcatctgagcaaacaacttacctgcctcatcaacaagccctttctgtgcacatgccgagaccattatagtccatgtcaccaagttcttgctaggcatcttgtcaaagatcacccgagccatctccaggtcacccttcttgcagtaaccagaaaccatcgtcgaccacgacacgacattcctctccggcatgcgctgaaacagctcgaaagccgcctccacctcccctgcctttgtgtagccatccaggatcgtgttccagctcaccgtgtccttctctggcatctcgtcaaacaacttcctcacgccagccagctccccctcccgcaccatcgccgccatagccgtgttccaggacacgacatcccgctccggcatttcgtcgaacaccttccgggcgtccgagaacccgccgttcttggagtaggcgtcgataagcgcgttcccgacgaaggtgtcctcgacggacccgagcttgacgacgtgcgagtgcaccgcgcggaccggggcgacgcccgcggcggagagcgccttgatgaggaaggagtaggtgaagctgtccctgcgcggcatggcggagaacgcggcgagcgcgtcgcgcggcgcgccccccagcgcgtaggcgcggagcatggtgttggcgaggaaggcgtcggcgtgcgggtcccggatcgcgtcgaagacgcggcgggaggacgggaggaggcggaggagcgcgtaggcggacaccagcctcgccgcggcgcgcgggttgaggtggaggccctgcttgagcacctgcgcgtggagctcccgcacgtgggcggcccgcgggaggccgcgcggcagcgacgccaggtgctgctccaccagccgcctctgcgacggcgccccccacgtcggcggcggccggaccgccgatgccgacgacgacgcggccgtggacatggacatggaccacttcacgaatcctcttcggcggcggcggcggcggtcgccggagaagaggcgtggcgagagaggcgtggccggtgaggaaggggaagctggagaaggggctaaggttgttgtctccgggtggctgacaggtgggcccgggcaaaacctcttccaggtggactaggattagacgtgtagtgaggcgtttggtttggttgggcctgactatatgtgggctggccctatgcaacgatgcatttagcctcggaaaaagtccacttagactcccttaattgttcaccgaatctaattcgtcacccttaactgtaaaaccggataggacgactccctaaattattgaaaccagtgtaatttgactcttccagcggttttggagggtggttttgctcacgtggcgctgacgtggtgagcgggaagaagcagccgccgcaggggctagaccaccgggtgatggtggcgctggtcaagatggtcgccgccaacttgttcctgcctccgggcaatgccgccgtccgcctacccgtcgtcgctcccgccgccgtccgacgtgctcgacgacgaggtccccgtgatggtgctgctcccgtcgatcgtggccgcacctccacctcgtctacgacgtgctcaccgccgcggtcgccgccgcggacaccaggacgctccgcaaccacgtcgaccggagcttcctcgttggcctcgtggcgctcttcgcctccgaggatccgcgcgagcgcgaccgcctcaagaccgtctaccaccagctctactccaagctcaccgtcgagcgcgcgtttatgcaacgcaccatggccgtcgcgctgctccggttcgtctacggcacgtccccggcggagcccgagcgccattgcggcgtcggcgagctgctcgagatctgcggcagcatcatcaatggcttcgtcgtgccgctcaaggaggagcaccgggcgttcatggcgcgcatgctgctgccgctgcaccggacgcggtgggtgcacacatgccaccgccagctctcctactgcggcagcatccgtcgtccgggacatcttcctccgccactggtcggcgaccaactgccagaaggaggtgctgctcatcgacgagctcgaggagatcgtcgagatcctcgaccagcaccacttcgacaagctcgtcgtccctgtctgctcccggattgcccgctgcgtcagcagctgcagctcacaggtttgtgtgcttcttcctccattttcacaatcgatttcatttcagtaaaaaaaaatcgatttcatctacatttccacattcaattaagtagcacatgcataattactgcttgcttccaacatccgggttcgcgctggatccgagcgccggccgggcctagagggggagcggcggtgggactgcttggagacggggcaggcggtggcgcggccgtcgccgctccagccctcgcccgcacgctgccgtcgccactccagcccccggccgccgccgccatcgatgcttccgaagggggaagagaaaagggggagagagaagagagagaagggagagagagagagggaggaggaagaagaagggaaggaaaaaggatgacacgtggtccatatgtaggtgggtcccatgatatattttgtgtttgaatggcagatgggccccacatatatttttttaattctaaatgccacataagtgccacgtgtaatgaaaaccgggttagcactgccacatcaacgtcatgttagcaaaaccgctctccaaaaccgctggaggagtcaaattgcactggcttcaataattcggggagtcatcctacccggttttacagttaagggtcacgaattagattcggtgaacaattaagagagtctaagtggactttttcctttaacctccgtccctcgcgccactccccagttcgctccccgaccgtatcccgccgctgctgtgggaggaggcgaatggaagcggcaccggcccaaggaggagcggcggcttggccgtccgcgtcgaggcgccgaagttaaggctgcggcagccagcgccgcttcccatctcactccccgaccgcatcccgccgtcgccgtaggaggaagcggaagcggtgccggcccaaggaggagcggcagctgcgccgttagcgtcggggcgcagaagctaaggctgtggcggccagttccgtcctacaccgacatcgcgctgctcccccctctcccgaccacattccgccgtcgctgtgggaggaagcggatggaagtggcatgaggcagaggaggccgacggcgatggctttgtcaattgggcaaacgggtccttccccgggctgccgaacgtcgtccccaccgccggatgccgacgccgccgactgccgcccctagttccgctgcgccccgatgccgccagccgccgctgccaacgagaagaaagagagaatataggagggagtcattgacaggtgggtcccactttatttttaaaatttatttgatgactggaatgccacgtaggtgccacgtcagcgaaaccgcccttcaaaaccgttgagtgagtcaaattgtactggttttaagagtttgagggtcgagatatctggttttgtggtttaggatcacgaattagatttcgatcacttttgagggtcacgaagtgaacttattccttcttgatgggtctgacggtttgggcccgtttggttatgggcctagttgagcgatcattttgagttgggcttagcatgggccgtcattgtacttgggctgctagagcaaaagctatcataaacatttttgtcatttagcaattttagtactccttttcttttttgaaacggcaagataaatgtcatgaatgcgagaagattaaaacggctaatgccagctgcatgccggatttcaaagccagaaaaaaatttgaacgaatacatgctttggattccatcaatgtgtttgtacacatgaccttttttttttcatcaaatgaaaagttcaaaacaaatatgaaaagtagacggaagaaaacaaaaaggaaaaaaagaaaggaagagatgctctgctgctctggtgggacccacctcaggggaggggatcagcttgactcaccctgacacgtcctgactcgccaaccgcctctgcctccaagtgcgtgctaatcctaatctctctctcgtcattagcagcgctaattaacccaaagtacataagattagcagtaatccgtaattagtggagtaattaatcaccaagcaatggcgctggcttggcttggcttggcttggcccgcgcgcgaagaagaagattcgttcaacgatcggacggccatccggaaagcaaggagaaaaatggagggacaggatcgctgcttaattagctggcaattgctttcttcgccgctacgtatcatgcatggacaatgcatgtgcttgtgcttccccttggtttaattctcgcttcgcttttttactcctccctttggtttactcacaaactttttttcaaaaaagaaaaatcttgatggttaggagtatttaagatacttggtgatttttttcatacatggtataatactataatttggatatggagaactcatacacactacgctttgtgccaaatacaataaaaatgagacgatctagatcatgttgtttatagtacgtaaatagaagagatagatatgtcaagttatgatgtttgtatatagaggaggaaagtatatgatatatttatcctacacattgtttccttctcgctttacacgttagtattttggttcgctcgcacctttttctatcttaattattacttatccacacattgtcgacgtggttatgtatgtataccgtttattagaaaagcataccgacaatgtagcgttctcgatatattttccagcattgtttctttccgcctttttacgtaaggtattttcgaaaacaaattatacacaatcaacaacatatgtgtcgtttatcgcgatggtaatggatacgtttaatccttttttaattgcttccaagtaccaatataatcacactcttcacgaccctcccacatttcttactcatccttacaccatctcagccacccaacgcacgatccgacggtccacaatccatcaacagcacaaggtgcggttctaccacagccgcagaggcatacaaagctcatcacggccgtccagatccgatcggacggtgggggatcgctccaaccccaaccatttctctctataaaagccggccatggcggccacaagccaagctcaccgccaccactccattgccatcttcttccacctccagcctcctcctccgcctccaatggagcttcccctggacaaggccgcggcccgctccaccccactcgcgctccccgccgctggggcggcggcggcggcgaaccagtccccggcgtctctgccactgggaccacccgcggccgcctccgccaagcccctcgtcgcggccgccaacccgccgctgctgccggtggtggctccggcggcggcggcgcccaagtcgtcgtcagggtgagctgtgtgtggtgtggggttttgctgtgttcttgtgtgttctttggtggttctgaatttgcttggtttcttggaggaaaaacttgtgagaaaattgcactgcgagatgggggcaggtttggatgttttggtatccaaagctgcactcctctgtagttcgcagttaaagttgcagcagaatactttgcgtttgcatttctttttcgctgatcgaaacgatctcatgtgttcttggttgtgcttgctcttgatcatgccgatgatcctagtgacatccaggggtagagatctattttggcttcctcgaaagcccggttgatgatctctcggtgtcttggagaggcaaccatgctgcagagtacgtgtgttcttgggtttctttggatgttcttggaggaggagaacttgagaagttgttgcactgtgagatggacagctttgggtgttttaatatccaaagctggactcctcttttcgcagttaaagttgcagcggcagatgctctctcttcgtttgcgtttcttctgcgttgagatctcgtgttcttggttgggtaacgaagctgcatatatatgcttttcatgccgatccatgcatcgaacggtagagatctcttgggttcatcggaagcccggttgatgtgatgatctctctcggtttcttggacgcaaacgcgtgcatgcagcgttgcagtagtacgtgtgatgttccagggtttcttttggttggtttgagttgagacttgagaacgatcgatcgacgactaaaggcttgaacaggttggatttctgccgtcttttggttgcatggagggtgtggatgttcttgaacttttggtgttggatctttgtttttcttgggaggttttggtttggcttctaggtttctaggtaaaggtaaccatagatccagagttgagctcaaaatgttcgtctcaaagctgcatgcaagagatcaatagtttttgcacagcttgacgacgagttcgacgtacgtgctagcttttgcttttcttgttcggacgatcaaaagcctgcatgctttcttgggtctcgaattgctttactttcttttctgatcgttttatgcatggctgcttttaatttgatcttgtcttcactccaggggttcatgccttctcatgcatgatctacccactcacgttctttctctttttctttttttttgtcgtgccatttttttttccttgatgacaagcaatattattcggttcttggtttcttgagtagtatttctaggtttcttgataagtatgtttcaatgattttggttcaagagtttctgggttttctttggtgttttactgccaggaggggtcaaaagttaagccccttttgctttttttttagcttctttgttctagctttgtgtttttggtgtttttttttttgtcttcttcttgtggatgaatgcctcggttcttgtactgatctgccggtatttttgttcaagctttggtccccccttactccatttagagatttcggttgttttatttatgattattcatcgtgtgcaagttgataactatggtactttggatcactttgtgcttcaccttgatcttgttttgtcacaacatgaactagtgcaaggtgttagtccccccttttttagctttcttgaacatcttgaagcttatttctggtcatgcgggtcaggctaaagtttcatcttgaagtttgtctgaaatcttcaagtatatttgtataataatatactgtgtaacattagttcactgttcccgtattaattgcactgttcaagtatattttaagtgtaacattagtttttagctgtgttaagagttcactgttcatttattgcattattcatcatttagtactacattaaaccttgacatatacacagttgtaccaattaaacctactgcatcgtttgaaattccgtttgggttaattctaacatcacaccgtctattagatatgatcaggtttactgcttatttagctttgttcaacaccctgactctatttatctctaatcatgttgttgtagggccgtggaagagagcaaagagggtgtggaagagagcaacaagagcaatgtgttgaccattggcagcatcaggagcacgctgatgaagcatgaggacaccatcatcttcggccttctggagaggtcacagttctgctacaacccggacacctacgaccccaacgcttccaggatcgtccggttcaatggctccctggtcgagttcatggttaaaaagaccgagaagatgcatgctagagtgagttcattcatttctgcattctgaatttgtgacagggacagaataatgttgtgacatcctttcagatggggaggtacaagagcccggatgagcatcctttcttccctgagaatttgctggaggtggtggagccatctgttgagtatgagaatgtaatatatatatctcactcccccaattttagagtcactttgtgataatgtgatttatgtgttgactgttaaatctgtctgtgttttactctttttgtgccatgctgatgtgctgtactttttgacaatgtgatttatatgtttaaatctgtctgtcttgccatgctgtttactagctctgcaattccagttctttcgtgcacatgctgataatgatattggtattaggttcttatgataatgtgatcatgtcactgtttcctaatataaatttctgaacttactacttatgattggtgacatttaaaattagaagtttcaggtcaacatcttagtaaccatctatattcagtcatctgctactctttattcagaacaaattgtctgttactgtctgtctccaaaatcatgtcatcagcaaaaactgtactatttgatactgaacctta

SEQ ID NO: 47487 - DNA, 1888 bp, Oryza sativa
ggttcttaaatagctagaggttgaagaaactgcgtaattgagccccctaattttttttgttcctggatccgcccctgctaataattggactgatggctgccactcgcggtatatgtcatgtgggccctcatgtgtctatgacatgtgggttcggtggtaaattcttaattactatttgtaagagtgacaaatagttaaatatcttgtttaattaagcaggtcgctatcagaggcagaaatgcataagcgggtgcagataaacaaacactaggcttgcatgcaagagctgttggtcttgttgtgagaatcacatgatggtgacatgccaaattgtcaatgggagagagagagagagagagagagagagagagagagagaggagttgggttggatggaggtcggtggtttagttgagcagatgccatctaattttgcttgtcaaccatatcagagatgggggcccttcaattttgcgtggacccgtttcatgcaccatgggaggtgtagagtactaaatcccaacaaaatgacatggtgttgcctttggtgaaaacgaaagtggcttcaatattttgtaggttcgaaatgaaatctcaagtgattatctatttctacttttggtccaatagttattgatggatcaatcttgtaaattgatatatcaattatgacaaaaaaaaatgtctctatgccgattggacccattatctaaaaatgtgtgacacgtcatagttgacaacaaccaaacaataattttggtccctaaaacataattaacaacaaattattaaataagaataatattaaacatacaaaattcattaacatgaaaactagtagctagactagaaaacataacccatcctaaagttgcattgtaactatggtgtagtcttattatcgctcttttctttttattattttttcataagtacgatttctggttgagtaacaatgtgttggtagtgtggcatgacttggtttcatttgcacggtaaaggaaacgaacttctagagaaaccaatactcctatcagtactaccactatatagatgacaaacgctagctagatcagcacacaaaacatggatcgagaaagtcaggtgccaacggagaaagcaaagtcatgcgcggatctcaacgtaaatccaacgaacataacaccgactactttttttttagctaaaaatttattaagaaagccgaaactctaacaaagttggcaacaattttagaaggcaaaaacatagaagggaagccatggaaaaaccatcctcggtggtccatggaccgggtgcaccccaaaccacctctgcatctccattctccaccttcctcggttccaaattccacctgcatcgctactccaactcatcatcagcagcagcaaaagccagccagcgacctctccattctctccaaatctctctcgctttccatctccattttcctcgcaatcattccgttcagttatatctgctcgttgctcgttgattcgctcgctttctgtccctgcgatctgtcgccgccgtcgttttgccggcgagaacggcggctagggaggcggcggcggtgagtctttgggtttcttgcccgctgtgtgtgtgttgttcttgtgttcatcaagtactcaaagtttcgggggttatttttttctttttactgatgagatggtgttgatatgatagcactgtttgatcacgatttgattgaatcaattagtaattgattattagttatcactatgttttatgtatcctggaatcttggaatggatcgcttcgttttattgattactgagcgagatttattatgttttgaggactggatttatcatgccattcactcattaattatctgattaacttgcatgtcctgctgatgaatt

SEQ ID NO: 47488 - DNA, 2081 bp, Oryza sativa
  unsure (1)..(2081): unsure at all n locations
catccactggttcttgccatgacagctgcaaatttggggcacatcattcccctgaacccaagaagtactggcctgttcgtcgcaggcgacatcaggaccgtgccaatgccgggtgcggaaagcaaggccaggatgaaatccagacacaaaaaggcagatccagaaacaaggacctggagctgaagatttgtcttgtgaaagatggtaatgttcatgacaagcctgaattcatcgaggtgaagaagccgcctattgaaatggcatctgacaactctgaaacctcaccatgcgtgcaagatcagttgtcatcagctgaagaatccaaacgtgttgaggatggagctgatctgccatgtggtgatgataaattcttgatccctgatggcaatgctgcatgttttgtggatggagaatcatcagagggagctgtaagcattgagctggagatgccgttggccatccaggacagtgacgcgtctgacgatcatatcgcagatgccatttcgcctcctgaatgtgtgtacaaagctggtgaacagttacttgtggatgacatgtgtgatgatggatcaggaaatgagtgtgcaggttcagagaagaagagcactcagattgtgatggcctccgagaagcgtgaaaaatctgggcatggaactaaatcgaagagtttgtataatgtttcagtaaaaccgaaggtgaaagagacatcgactgcaacgcgaagcaatgcgtcaagccagaaaattgtaagaacattggatcggaaagcttcaggtacaacaattgaaagctccaatggatcaaaggtagtgagagccaccaagttcaatagggacaagaaattcagatctaccgtcgcatcgaatgtaccaaaagtgaaggagatcaaagttacatcaccagctactgtgatggatcaatcttccaaacctactaggcaatcaaagctgaagtccttggttgcaaatgatgctccatctccatcagttaattcagagaaacaaactgacagaaagatgacagtgatgaatgttgccaagaatgctcgtgtttggcaaaagaaggaagaagagaaaataagtccagtgaaactgtctcgttctataaacttgtcatccaagtcccttttgagcataaagatgagagcagtcaagaaagaaaaacctgcttccctagtgaagagcaacaagaaggtgtatggagcagaaaatgctgttgctgacgttaaggagaaaaacctgaagtcagcttcaccaaaagtgagaaaagtagaagttagcaagaaagaaagccgttctcagaaaggtactacattttgtttgcccccctgtcaacaccatgttcaaagatttgcttaatttacattcaacattactacagatttcacatgataatctgtctgtttatgtcatgattgacaataaggtttaccttcttttctccccatcctaattcagtaatcttgcatccaacattactacagacaatttatgcagaaaacacttgtttctcaagcaaacattgacatgtgctcattcaaatttagcagaaaattctgccactccaagaactgaaaacacaaggcagccaaagtcctcaaccatcccagcgcagtcgcctcgcaagctaactttccgacgaggaaaggtactgaacctacagagcaattcagagtcgagcagcacgccgagacggctccggttcaggcctgcaaagactgtagaagacagcaacaggagcaaagaatccaccagagggagaaggaagagtgacagtgcagcctcttccgggtcaaaagattcaggctcttcgaaacctgaagttgtcatcctgaggcatcaggatgtcagggacaagaagaagaacgagcagggattgttgaacaatgtgatcgaggagacagcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47489 - DNA, 1615 bp, Oryza sativa
tttctgtccttaggattcaaacctctgttcatattttctttgttccaaaggagcaccaagcctttgatgcataatagaaatggattgtagtttaatttgttacgtaaaatttgcattattagttaagatttgaatttgaaaaccattgataatatattcacaattcatgtgtatctcctcaatggccatcgatccatggccagggcattgaatatatctctctcatatctagaggcacggggatgggaaggggttaggcctccttcaacttctgaaattttgcactactgtattataattgcatattttgtaaaattttagaggatttacatttttcgctctaacaaataaattctagtgtttctaaagatcagcctaagttgattcctaccactcaaaactcgtcctaaataagttgatcaacgcacatgcgaggtagctaaacagaactccattaatttctttagccgatcggtcggcatgcatgattgcatacatgctcactttctatctcccaaacctgacctggcccacctgtcgataactttggcagacaatatatatggcttttttagcctaagatcttcctactctctgatttaacatcattcacagcacaattatatactccctccgtcctaaaatataagcatttcactggtggagaaaccatctttcgtcggtcggccaaattccacaatagtcccggttgcaataaaaaccggggctaaagatcatctttagtctcggttcaaatgctgtcagggcttgtcaggccccaaccaggactaaagatcgtaactttagccccggttcataacaccaaccgggactaaagtcccacccctatatatatatatatatatatatatatatatatatatatatatatatatatatatatatatatatatatatatatatgttttcttcctcctcagctgcccgagcaagcttcaaaatttcttcaaaaaagaggggaggtcatgccaaaatttctagtgaatttattttggtgattatatacaaatcggaggtgcataaaaggttagcaacttcatcctccaatatttttttttgtcatattacatttggagctatgttttgtacacttttttatctccaaaatttagttgtaagttgatgagagagaaaatttgtgtggggaagaaagaatatatagaaatttagtttatttgctaaagaaggttttataaaatagttgaaaaggaaaatagtgaaagttaatcttaaataatagaaaacaaactaaaataaaaattaaaagaagtacaacacattaatattagtttaaaactttagaaatagtaaatacgaattatttggtgtaatattttataatttttgtatgaataatgatatgtcattattgtatgactgttgaaagagtttgtaattattttataattattgtatgactgtcattattgtatgaataattatttgtgtacaatttttttttcatctcatgtagatggatcggcaatggatgtacgctgaccagcggttcaaagagtttattgacggcgtgcattattttttgagagtggccgaagctaacaggcataagggttttatttgttgtccatgcaat

SEQ ID NO: 47490 - DNA, 5640 bp, Oryza sativa
gtggcggccgttgtagaactagtcgatcccccgtacgagaacctagaagcatgccctgtttgcaaagcactacgattcaagattagacgagacgatccaggagaagttgacgggcagctaacaaagaagagaattccggctaaggtaatgtggtatttccctataataccatggctaaggcgtttgtttagaaacaaggggaatgctagaatgatgcgatggcacgctgaagagcatcaacaggacgggatgctgagacaccccgccgatggttcgcagtggcgaaacatcgacagaaaatttaaagactttggaaaggatgcacgaaacatatggtttggtttaagtacggatggcatgaatccttttggagagatgagcagcggccatagcacttggcccgttacgatgtgtatctacaacctccccccttggctatgcatgaagaggaagtacataatgatgccgattattattcaaggccccaagcaacctggtaacgacatcgatgtgtacctaagaccactggtcgaagatcttaaactgttgcggtaacgacatcaatgtgtcctcaggctcctgcaccgactcctcctcaggctcctacaccgactcctccgcaagctcctcgtccggcaccttccaagtcaagggccccccaagctccaccgcctgcccccacaagggcaacgaagaaggcgaaagttgacgccgcaaaaaacaaggacccggggtacgattgcacgcaagaggagcttgacgcttatgtggcatcagaagtcaggagacaattgaagcctcgaagtccagaaaagaatattcctatagacccgagtgtcaggaacttcttcaggggtatgtctgcacctgccaaggaggccataaagctatcggactatgagcgaacacttaagaaagcatcttctggaaagtccaaaccagtccctcagcttggagagcaaccaaaccaggagatcgagccgttggtgaccggtgaagattttggaatacaagaatttattaatgacaccgggctaactacaaatcaattgctacgaggcgcaccaatcgaaaaggcggaagtgaaatacatgtacgaacttggtaaaccgcttgtcaagcctgagcagctgcagtccctacccacacaaatgtacaaattccatcaactgtacatggagatgagcgccaccggtagagagatgatcggagcgaggatcagggacacggacttcttgcaaggagatgatattctctggatcaatttcaagggtatctacgaactataccagctggacgccctcgatgtctctattatgagttgctggattttgtaagtatcgttcagttagatttcttattacgtttctttcaattaattaggtccttgtatataagtagctatatataatatataattccttttattgttgtagaatggatattcaaagggcccgacggcggggggttttcgatactggattcatcgaccctcggaaagtaaatgtcgcaatgctcaaccagtatccgcaagccacagaggacaatctcatccatctcctgaaggcgcatcattacaagacgttcgtactattgccgtacaacacagagttagtttttactgtcttcctataccaaatttcattcccgtacgaacatgctaagtgtttcatacgtaatgcatccgatgcacattgcagattccactgggtccttttactcttcgacttggaggcctgcaccgtcaacgtatatgactcaatggataaaaaagagtctacgtttgacaatattttcgaacttatagacaggtactgtcataagttcctatgttaattaagaatcttgttataattaattgctactacgaatcatagctttaaactccatctagggcttggtatcggttccgtcatttggtccgcggtaaatggagagaaagacttaggtggaagtttaattttcctgtgagtacacatgctctacatttatattgaatctccaattcaaatacatacaagtgtatattaattagatctctcgccgtttgtcatttatttatagtgcgcaaagcaaaagcagggaactaacttgtgcggctactacgtgtgcgagtattgccactgccttgcagaccaaatcatcaccacaagagagctcgatgtacgtacaaataaattgaaaatttcattgtgtacgtatcgatttgttgtttaattactaattaatttcatacattcatatagtttattcgcatgagggataacctcacacacaaggaatttatcgctgcagttcaagaacaactcatgggattcatcaacgaacaaatccttgatcccaagggtgaattctactacgacggaaatacaattcataggtccttagcttctgagataacgactactactacgtcgaaatcgtagctagctaggacatcataatggattgtaattaatacatgtctatttttctatatgcatgtacacattttctttaatgtaaatatatattttggtcatatatatatgtgcacataaaatgttaagtgctttcatatacacacacacatatgcatttgcataacatatatatgtataaatacatatatattatgcatgtatatgtattgaaacatatataaatataatattatatatatatatatacatacatacatacatacatatatataatatatatatatatatatatatatatatatatacacacacacacacacatacacacacacatatatatatacggtgatgctacgtagcgcccgtacgcgccatcgagtttcgtaacgcgagtaacagtcgcccccctccctctcctcctccgcttttcccgtttttaactcccttcgcagtaccgctattcttttcttttttttcctcccacctccttccgacttatccgttccacatgcagcactccagatgctagcctgtgttaagtaaaatatttactgcagttggtccattctcactaataaaattattttgttaatctttttcccacttacatccggtagtattaattccagtaaaaaattccatagcaaaatcagacctgtatatctacctagttaaaattttactccccacaagttagttaaattttactcacctctatttaaacttagttaaaattttactccccacaagttagttaaattttactcccctctatttaaacttagttaacttaggggctcgatattactccccgtatatttttcacaccagtttccgtgtgttaacaatagtaatatttttgttacatcctttttgcattattatagttaataactcattgattgttgaataaatattttattactcacttaatgatggcactgtatccatggaaccactacagcaggcaacgaggccacgcagcccgcgggggcaccgtcgatgtcatagaggatggccggcatggcaccaaggctgacgctcttcatcgatcctcctgctcatggaagttccatggcacgctcctagggagcgacatccagtgatggtaggggctgcgcagatcgattgtcgactgcaccattcgctagttgcttcgcaaaaaacaagccatatccggccgtagagcccggcctactcacagacaatgccagcgctcgccgccatgcccctcagcaccgggatcatgtatggcaccctcagcatccccgaccatgcatgtacgcgcaactgctgcgtaaatccaagatgaaggatgaggcacatctatttctccgagtcctgaaccgcctccatccctgtggcccggcgcgtacgcccgccatcaaggcaagcacttgggaaaacattgttgcgggcgccgcaccaattcaatttgacaccggcaatgccgacgggtagagccggataccgatccgccaccaagtctcgcaacttatcaccgctcacggcttggatctcgtcgcacgttgcctactgcggatcccgccgcgaacacgacgatcacgacggcgtggcggtgaggtgccggtagggcattctacggctgggtgctgggatggatccaaaaatttcgggaattggaggtttgaatggttacgggcttattgctggatacaaatacatatataggcagtgcaaaatgcaagtaaaaaaattactactacggctaggggtggattggagattggtcgtcggtgagttaaattttaactgcttattatggacctggtggggagcgtgggtgtgtggggctggaggctgtatcaggtgctgtttaatacgtagcaccttagggtgttgtatagtagttctctctctctctctctctctctatatatatatatatatatatatatatatatatatatatatatatatatatatatatatatatatcggtggcgctacccacaggcgctgcgcgccacgaaacaaaatggcgccagacacaaacgacgagaggtcagcccaccaccgacaaaatcccaccaacgaggcatccaacccacctgcggagttaaaatttaacttagatacagttggtggtggtggtgcggtgatatcgttgaggagttaatattatgcgatgattcagttggtctgagttaaagtttaacttagatacagttgggtggtggggtaaaaccaacggagttaaattttaacttagatacagataggtggtgggtgcgatgacgtcgttgaggagttaatattatacatggtttcagttgatatgagttaaagtttaacttacgtacaattgggtggtgggatgcgatgacatagtttttgtagttaaaaaattacttgttgttgttcaattctggattatatgtgattgagtctggtcgatgctgagttaaaaattaactcgcgatacaaaactgcaagacatcgttgtagagttaattcagtttgtatgagttaaattttaacttgtgtacaacaagattttaactcaacatatacatcctcacaatctataagcgtaagttaaatttttatcggcacttgctccggacatcaacggcggagcgtcatggaggtgttcgccgctgctcctccatgtccttcggtgttcgaactcgccgccgcggaggtcgccaccgtgtgcgtggggcgcggagcggcggccggatccgccgccgcctcggctgtcgcccgcagtcgctctgtcacgggatccgccgtcgagccgcccgcatccacgcctgacatgcaccaccgcagccggatccgtgtacgtgggacgcggagcggcggccggatgcgccgccccctcgcctcgccatgccatgttggatccgccgacaccacgccttcccgtgcaggattatccccggatccgtcatcgcgccggatacgccctaccatggccggttccgcgcgcgtggggcgcagatcggcggccgggtgcgccgcctcgtcgcctcctacacgtcgtcaaccgtcgcctccacgcctgcagccgtgccgtaccggatccgccgacgtcgcgctcgccgccgctccgcagtggaggtggcgctcgacgtcgcgccaccagccgtgccgtgccagatccgcccaatgccgccaccaccaccgcccgccgccacgcccgctcgctgctctcatctccgaaaaaataggatctggatatgtggttggt

SEQ ID NO: 47491 - DNA, 2824 bp, Oryza sativa
acattcaatttaaacagaccacgtagttaatttttaactcagcgatctaccaccccgccacccccacgtgaactcgatttggtgcaagctacacagttaactgttaactcaaccacccacccccacgcgcaagttaaattttaactcagcgacccacaacccaacccttcccccacacgcactcgatctagtgcataccacacagttaaattttaactcagctgcccacaacccacgcgtactcgatctagtgcataccacacagttaaattttaactcaacatactgactctatcttgtatatatattacggattcccatcttagaaatcgtctacccactctttcctcttcctctccatattttacggatcaacgatgacttgtggttccttgtgcagagaggaggaacggcgatggcgattaggggatgaggagtggcggcgaggcagttccggtgatggcttggcgacgaggaggaccggtggcagtttggggatgaggaggaccagcatcaaggaggagcggcggatctgatggcgttgaggtgcgtggacgggcgcgatagtggtgcggtatcgacgggtgactgtgggcgagaggcgatgcggcggtggatccggctgccgctctgcgccccatgcacatggatccagctacagcggcgcggatccagcgcggttgcgggcggcgcgtccgcggatccggcgcccccttcctcccgcatggatcctgcacgggtgaagactatgggcaggaggcaagatggcggcaaccttcgcggcggtgagcttgtcctccggcatccatggagcagcggcgggcatccatggagacggcggcaccgagcatgcctctctccgagttttccattttcatcttcttcaccggcagaaggagtggccaccgcccgttgtttccgttctcaatctggaaaccaccgagagccacctttatttccattcaacggatccagaaggagaagaaagctgctaggatcaacaacacaatcaatcaattatttttcctgattttggttggacgttgtcctgttatttgatctcaccgatgtgttattgcattatttgtgtgtaattagtttctaatacatgtgattcctatatgattagatgcatccggacatcttgcaaaaaaattgcaatctacatatcagtatattgacaattaaaaaagtactatatgtaatgtttggagtaaaatatttactatttgtaatttgtcagtaaaagtaaccaaatgatgtactatagttgaatctgaccatacctaaaagaaacagaaattccgttccctgtggagagaaaactaaatttaggtgtacaagcattattttcggatcaaggactctgttcattatccaccaggaccacaacaacaggatgtatcgcatgaaatgatttcgcagcttatggaattaacgccaaatcaatgcacgctatgatttcgcagtttctggaccaacggatccggcgacatggagttgagttctatccggtgaattaatcattagttaatttctatcgacgtaatttccggggagatgtgcatcaaaacaataaaattctaataataaagtgtgaattacgtcacacatcgccatcaccgcctaatttctcaaagtttttcatctactcgtaccagtttacaataagttaaaatttaactcatattccttgtcatcagaaacaacacacatccatgtctagatttagtgtattcgtttatcacagagctagacatttagtgtcttcatttatcataaaactacatatttagtgtctccattatcacaaaactatatttttttaataatgctaaaacctgtagatttgtgataatgaagatactaaacttgtagttttgtgataaatgaagatattaaatctgtagttttgtaaaacaagttcctaaatctgtagttttgtgatatattgtgcaaagtacctgcagttttgtgataaacgaagacattgaatgttttgtgaaacaagttcttaaatctgtacttttgtgatagatcgtgcaaagtatatgtagttttatgaaatttaatcatgataaatctagtaacataaatattatatgattgatctttttaacttttttatattaacagtcaaagttaaaaatgtttgacctaacactatgctaaaaatgcttatattttgggacggatatagtagttaactattattagggtatttattatttactccatgtgtctcaaaataaattaatccctcgcattaagaaaataaaataaaataatattctttatttggataagtaatggatattgaaggataaaacttctccattcgaggaccaggtaagaagttatcaattactaaagccctgtttagatcccgccacaaaatttttcaccctgtcaaatcgaacgtttgaacatttgcatgaagtattaaatataggctaaaaaactaattgcatagtttgcgactaatttacgagatgaatcttttaaacctaatcgctccatgatctcaatgtgatcctacagtaaacatttgctaatgatggattaattaggcttaataaattcgtctcagagtttacaagtggaatctataatttgttttttttttgcccgaacaccccatgcaacaccatatataatacccgacatgacacgccaaaactttacacccctgaatctaaacacccctaatttattttgcaaaatagtttaaaatatatgagttgatttattttgggtagaggagtagtaattaacctgttaatttagtttaatttattgactaataggatctgcaaccggctgt

SEQ ID NO: 47492 - DNA, 1146 bp, Oryza sativa
ttcctgcagccctttactcagccggatctgaacatgagacaaaggagatggttggaattaattaaggattatgacatgggaattcattatcacccgggaaaggctaatgttgtagcagacgcccttagcaggaaaggctattgcaatgctacagaaggacgacagttgccattggaattatgcaaggaatttgaaagattaaatttgggaattgtcagtagaggtttcgttgcagctttagaagcgaagcccactctaattgatcaagttagagaagcccaaattaatgatcctgatattcaagagatcaagaagaatatgagaagaggaaaagctattggtttcttggaggatgagcaaggaactgtatggttaggtgagagaagctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacctgccggtttgttgcagcctttgaagattcctgaatggaaatgggaagaaattggtatggattttattactggtttacccagaacgtcatcaggccatgactctatttgggtgatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagacttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcgga

SEQ ID NO: 47493 - DNA, 3812 bp, Oryza sativa
ttgagttttgaagaaagagattatgtgtatattcgtgagcacggcttttcgaggagttcatcgttttcacaccaaaggaaaattggcaccgcgttttgtgggaccttataagattgtcagtagaagaggagaggttgcttatcagttggagttacctcaatctttggcaggagtccataatgtgttccatgtgtcgcaattgaagaagtgtttaagggtacctaccgaagaagctaatcttgaccagatagaagtccaagaggatctgacctatgttgagaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaatcataaatatataaattgttgtttacatggaatttttagaaataattttaaaagtcttgaaaagaaaatctatttttaattaataaattccaatataaaatgggcccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggccgaaagtcggcccaaaacctctcttctctctcctcggcccagccggcccagtcagccgcgcgagcgcgccctcgcccgctgacaggtggggtccacctgtcagggtcgtcgtctacctccggccgccgccgccgaaaccctagtttcgcgccgccgccgtttccttccaaatccggccgctcctttccttctccggccgaattgatagaggggaaacaatctccgggatctcctctaccttttctcctttggaatcttcggctaattcgttttggaagtccgtggaatcgagttcgattcggatcggcctttttccttcaagccgcgaatttccttcgccgttgccgtcgccgtgggccttcgccgccgcctccgagcccctttaaaaggacccccggtgtctcctttacccgtcgccaccctcgccttcgcctctcgtcgccggaatcgctctagcgccgtgtgccctagtttcgccgtcgccgccgccgctccagccgtgcgccgccgtcgtttcagccgtcgccgttgctcgggaaggacgtcatcgtggtcgccaagtcgtcgccgtcctcgtccgtcccttcgccgtcgccggagatcgccggagcatcgtcgccgtcgtcaacccgaaggtttccgccgtttcctcctcgtcgccgtcgtcgtccgttgttcttccgccgccgttttggtcaccggtgtgttcgccgcgtcgtcctctacgtgctggtgtcctccgtttgcgtccttgtgccgccgttcgccggcgagcgtgcgccgcccgagccgttcgctctgccgagccgccgccgctgtcggtgacgtcaccgctgaagtcatcggggtcgtccgccgtgagccggtcgtggaccgttcgatctcggccgtccgttttggattggatcgatctcggccgtccgttcgtgtgaaccgccgcccgtgcgcccggtccaccgaaaccctagcccgctgacgcaataaatcccttttccttttcaaaaataattcattattgcgtcataattcaatttaaaccgatataagtgttttaatccgatttaatcttcaaaaattcataactaattcatcttagctccgatttagttggttcaagtctctaaatttttctaaaattgagatctacacattaaaaatatccacatgtactgttcatgcttgtttacgtgctgttttggtgatttggttcttttctgcttagattccgtcgtttccggagagtccgttttcgccggagaaaagtttgaagagttccaaggccagcaaggcaagtcacacagatcccaaacaaccctttgagcatgttgatcctaattaaagctattgtttcttttcaactattgcatttattttcgaatgtcattgggtggaattaacctattctttgttatagcccttttgttcttgattaccttattccttgataccttgggttattataatttgactagttgagctttatttatattggttcaactagatattagatataattgcttagccctgcttagaaacattagctcacttatgagataactaatgattcactattatttcatgatggcttaatgatagttcacgatggtcgatcgtgattagttaattaattaatgtgccaactaaaacctgataatggtgggttgtgagcacatggttttgatggtcgtgctcacgacaattaaggaccggttcacgagtttcggttgtgaaacatttatcgtgccaaccacaagccagcatgggcaacggctttatcttttatatagcatggttcattgcggggcaccagactgagaagtggcggagataagcccacgggggtcgctggggagtccatgccttgtttataagggggcgattacgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccatagtaaaagatgcttaaattggtaataatttgattagctcctggtttggaatggtacattcctggtttggagatagaactgtgcagccgagatggttgttcagaatggatgggcctatacaacagggtatgttgtatagtgttggattaatactgcctaattaatacttaactgttttattaaattctcaaatgtttgttaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctttattgattgagaggaactatctacctctgtaatgacattttattcgcttattaattagagtaataattgtactctattatcaatttgttattgtgtgtctcggctgattcctggacgagggttcacacacatgtaagcgtttggaattttggatagaaattccgggcgtgacaattactttattccttgataccttgggttattataatttgactagttgagctttatgtatattggttcaactagatattagatataattgcttagccctgcttagaacattagctcactattgggataacttatgactcactgttatttaatgatggcttaatgatagttcacgatggtcaatcgtgattagttatttaattaatgtgccaactaaaacctggtaatggtgggttgtgagcacatggttttgagagtcgtgctcatgacaattaaggaccggttcacgagtttcggttgtgaaacattaaccgtgcccaccacaagccagcgtgggca

SEQ ID NO: 47494 - DNA, 3785 bp, Oryza sativa
ctatctacctttgtaatgacattttatacgcttattaattagagtaataattgtactctattatcaatttgttattgtgtgcctcggctgattcctggacgagggttcacacacatataagcgtttggaattttggatagaaattccgggcgtgacactcggcgtctcctgcggctaccttctttctcacgcgcgtgctgcagcaggtagagcacggggcggcgcggggatggccgggctagagcacggggcggtgcgccaccactaggagtcctccctgaggctccgcttcggatggggctgcggtgaagtgggcggcgcggccatcggccaaaattctctctccttgcatgaccggccgccacctacgaccaaccgatctcctcctccgttgctccccttcctattccctttcaccatcggctctgcctcaccgaggagagttcatttttcccctttcccctctccctccacctcttagtcaggccaccaccgccgccaccatagccggccggagctgagctctttgtgttgtcgttccagccatctccctctccccctttgcttgacaccaccctccccggatgcgcgtcgcccgggaacatcatccgccaccagcgtcgccgatccccggccaccggagcatcgacgccctactctctccctctcctctgttactcggctggaaggaggagaagagaaatagtgtccagtggcattttggtacttacactactctttctctctccattttagccgaaaataataaaataatgtgagtagtgtccagtagctaattaccacttttttacagtgttctcgaaaagattcacgatttttgggtgtctcacagcaaaggccacaatatttcagtgtcctgttgcaaattttgcctttttttaattttagaaattgaatctatcacctttaatttcagttgaaagtttttaattaagttaaaagttttgaatttggagatgaaagttttcaaatgtaagttgaaaattttcaaatcttaagataaaaataaaaaattgaaaactatcgtgtcaaaatatgaaactttcaactcaaaattcaaaagtttttaactcaaattttgaaactttcaagtcaaaatttaattcaactcaaaattttgaaacttttcaacttgaatttcaaaactttcaattcaaaatttcaaaacttccatcacaaatttaaaagctttcaactcaaaattttaaaattttcaactaaaatttaaaactttcaaatgtatttttaaaactattaactaaataaattatttatatacttttttaaattagtggctaggacgacacggacgtcggggtgccgcgtgcgtgctacgggggaagctagctggcacgtgtgcgcccgcaacacgcacttccgcgcgtaactaactcccttagttaacactaatgatagtaattagaaaaaaagtgaagattttttttactagtagattgaaaaaattttcagttagatttgaaaactttcaacttaagatttaaatttttaaagtcaaaatttgaaaactttcaactcgagatttgaaaactttcaagtccagatttgaaaattttgaaaactttcatcttgaaatttgaaaattttcaactcgagtgtcaaaaactttcaagtccagatttgaaaatttcgaaaactttcaacttgagatttgaaaatttttaactcaagatttgaaaactttcaactcaatattcgaaaactttcaaatctagatttaaaaactttcaactcgagatttgaaaacattcaactcgagatttgaaaactttcaagtccaaatttaaaaatttttaagttcaaatttaaaaattactagtaaaaataggaaactaatcaatggtaaaactaattacgattgttctcctacccatacggcatcaaactgcgaaaaaagcaaaaaagaaaaaaaacggcggtaggaaagcgaaaaaagaaaaatcgtgcgcgcgcaccgcgtgggccgtgtgggccgggagtgcgggctgtcggaccgcacgtgtattaggattctcggcgggggacgctagctggcgcgtgcgcgccagcgacgccacttctgcgcgtaactaactcattagttaacgctatgacagtaattagaaaaaaatgtgaagacttttttgaagattttatttactaatagattggaaattttttcatttagatttgaaaacttgctacttattgagctggcgcgtgagcgtgcagtaggatccctgtaggcccggccacctcaatgaaatattttactaattaatcaaataattatattaaccacttgattaatttggccccttcaaggcttcaactccgatcgcatgcaagtcgtctagctttcttggcccttcgactggacgggaccagcacatggctgagattcgttgctgacattaggcaattaagatgcagctatcacacatacaacaatttgggcaatatgccaactaaattatcgagagtccgtggtttaatcaggtggctgtgttttaattggtgacatggcttaatttagagaaacttttgcactctcattaatatcacggacagagaatattagtggaataccttttgaaatgttaaaagaaaagaagagcggaccgaaatcatagaattttcaaaccaagttttcagacggtttaaacttttgatccatttccacatatccagcacgaaattctacctaatttcgtaattttcagctagctagtgcagtagtgtacttcctagcaggatccactgataaatccaaaattttgtgtgcttttagcagctcgttggcttataaagttacgaccaattttcaacttagaatattaatattaatatgtgttattctgattattttctatttttcagccttaacatctatctatctatctatctatctatctattatatactaaaagaccattaaactttctacaaacgcctctaaacgtggcatggtacgctactacaaacgctcctaaatagccacatggcactttaataaatcgggggacccactattctaaattatttgattatcttttaaaatagagaccccacaacccagcccaccatctcctctcaccggcccacaacccaacattgcacgcacgtacttacgtacctggtacgaacgtatgcctccctcctttaatccgatctcacaccttgctaatatttatttcgagggtagcaaataatttaaatatagaaaaaaatattataaagaaaaataaaaaacatcttaccatctgttttctcttaaattagtggaccttaaccattagaaataaacgtatagataattcaaacagcaaacctattaaatcaagaaaacataccctcctaattttagacttaactttagactgttgtcgtttgcacgacaacttaaataggaacaaaacattaaaaaaataatatctattatgtcacctttgaatcattttatataataaaagtcgattaaattctccaaagcgcttttaagtcaccatgtgtgacgttttaaatttagaaagaacttagaaattcaaagaaaagaaataaaatataattattggtttccacctaaatgaatataccattatttttaaccatcatatcttttttaagaaatcttaagccgcaacatgtcatgttttagaatcacagaaatatgagaaaataaacaaaccatcagttgcacttagcagttagaaagaatagaaataggggctgtttgattcatatgataaggttgtatgggtgcagga

SEQ ID NO: 47495 - DNA, 5598 bp, Oryza sativa
catgtcaccccttcctatctctcatacgagctctatgctattaatatctctccagtctcctcttcgtattatcagctatcaaactaaacagagaaacaaccaataattttatatatatactaaaagtacaaaaactttaagcgacacacatgatttctattctaactgttgctctatttataattaaactaacaatttaagatccatatgtctatattttgctatttaaaaaatacgggcacactcaacccgtgtgctttgcatatcgtatagcaacataatatcataaagaatcgtcaatatatttgttttcatcaacatcatctgcaaacatgcatgattaaatttaatcaataatattgaataagtataaaaattcatatttcaatcaaatttattatcgataggacactcctaccattttacatgtcaccctaattgcgattaaaaactatgaaacaattcaacaacgcatgtcgcacaatcacatattgttttgcaaacctatataaaaataacttgggggcacaaacacaccactgcctttttacctgttatccaaatttctataaaaaaatatcaactaattcaacaaacacatgttgcatcatcatacatcgttgcaaatagacagctaaattagatacatactgtacaagaaaaaaaacaatcgaacgtgaagagtttaggctattgtataaagaaaactggtgcgtttagttagagaaaaaaaatctgattatttcataaatgttttttttctaaattatatgctcaataatccaaacaagccaaacaatattttacgtaagtgctttgaatatatgttatgtaccatctaatcgacttcagacgatggtaccttttatataaagccaccacatgttactcttgcaaatgctcctaggccaccacatgacactctaataaattatagaaaaccctaaattttttgcaaaagtaaaacatctcgctatgcttatcatttaagctaatggactaattatttttaaccattagatctaaacaatgacagcctctatcggtaattcaattaaaaaaataaaaacgacttacttttattctagaacattatttggtagatgtgctctaaacaaaataagtctaccttgataaagaagattataaatagttatttattacgattagttaagtagcaatgctgatggaaaaaatgtggagaaatcatacatttgaagtgtggcaaatgttatccggtttatattccgttttgaagcacaacacgatgcatgcccgcgcgaatgcgcgggctaccttcctagttcatttaaaccgctaagagtggaagtacatatgttatactttttttttcatcggttatgcgtcacggattaattataagtgtcagccgaaagaaagaagatctcagccaagcagatttttcaagccaccttgcttgacactttggtcagctttgtcaaaaatgtatcggtcttcacattgttgcacggcatatgaaagaaacttggcggacttttaagcgcccgttacccaagttctacaatataagtccacatatatacagttaatcactcgaccgatcatgaccagcgccatgactgtgccgacgatgttgtggtccaccctagtaccattggtgctgcttgctcctctcttctccatcccccgccattgccgcgctcaggtgctcatgaactactcctgcaacaacggtagctcctacgccgagaactccacctacgactccaacgtccgcgccgtgctcgccacgctgtccgccagcacgcccaacgccaccacaggcttcgccaccgcgtcggcagggcgcggcgcggacacggtctggggccttgcgctctgccggggtgacaccgaccatgccgtgtgcgcgtcctgcgtcgccgccgtgccggctatcgccttccaccagtgccgcggcgtcagggacgtgaccgtcttctacgaccgctgcatcgcgcggttctcgtacggggacttcacggcgaggcccgacaatacggaggtgctcatggtaagccccagcaagtaccaagccaccgtcaacgcaggccacttcgacgcgctcgtgacacgcctcgctggtgcgctggcggactgggcggcgtacaactcgacgttgaggtacgccgcaggggtgatggcctcgagcgacgggttcccgtcaacaacggggtacatggtgcacaacatctatgggctggtgcagtgtgcaccagacctggcgccgccggcgtgccgcgcgtgtctccaggcgctcatcgtcgacatgccccaggcttttggtggaaggattggggggcagttcaatgctgtgtggtgcaaccttaggtatgagacatcggtcttctacgacggtgacccagcggtgaggctcgtcgcgtcgccatcactcgagggtcccaacattaatggttcaacaactctgattataggtgagttgttcaacactacaaggccggataaccaaatttctagcatacctgtcgtcctgtcctctgattattctgaaataacggcacatttgcattttactgcaggaaacaggagaaggcgcccaaatgccgcaactgttgttgtatctgtccttgctgctgtaataattgcacttctgtctgtgctctccatttacctctggagaaaattgcaagcaaaacaatgtgagtgtgtcttcttaattatccgctccattttctgttccaaattaacgactaatgaaattgcaaatggtcgtccacttactctatgccttacaatgaactattttgtgacacgctagctgagagctaaacagaaccgactgaaccgagagccacccatagatttcggagcaaattaaaacaactaggctatgaggcatgagacaataatgctgttatatttgttccagcaagtacttaaggggagtgctattgggcggctgatcgttgtgggcgatcgggcatcccccgtccctccgccttacgcgcacactcctccccttttttcccttcctaccgcaccataatttttttaagaaaaacaagttagaaaaaaataaaagaaaatagaaaaaaaatctattacccttaaaaatatattcatgtgcatatgttttatacttataaatatatacagtaaactttataagtataaactttatgtactatacaaaaaatatttaaatccgaatttaaatttgaattgggtatataaatttttgacatatgaattttaggtgcgtaaactttaggtatataaatttatccggaaagaaaaactatatggtgccaaaagaaaagaaagtgatgaaaaaaaaatcgccccaggcgattgaccgctaattactaattagcaatctagagtacttaacggtcggtccgaaccaactcatcattatcagttcctatacagttctctatagaactgacaacgattatactattactactggttcatctatttttcttgcccaaacattaattagcctagagaaaaccgcaaaaaaatactcattattattaagggtgtagtatgtctaggggaattttaaatatttcccatctctctcttgtacaaatatattttttctctttgagcctaattcttcaagagcaaaatcctcaatttctcccataaagtgacatggtatcagaacctatatcctagccaccagccaccgaacctccgtcgttgcgagtggcaggctcgccgctggcggccaccgctcaacagctcatcgtcaagcaagcagcaagcaaacagatcaagcagcaaagcacatacaaatcaaaacaagcaagtaagatctagcagcaagaagaacgtccaaatccaacaagcaagtgcacgagcagcagtagcaagtcgtcaccttcgtcttctggctgcagcagccacaagtttatccatcgtgcttccagatctcgtctcggccgtgcctccgcgccgccagtttcatctgcccctcctgtcaagcagctagcagcaccagccgcccaaggtcgatctgtgaagcaacatctagcaggggaaagtgaattcatctctggaggatatcccctcgtttcgtacatatcatctaaatagtcacaaaaaatatataaaaaattagcaatataaattaatatgaaatatatcacttcacaaacatgcaattttaaattcaacttagttgtaacaaaaataacaaatatagttgtgaatgtgcgataactattttcagtttaatttgttatttttgttgcaacttatagaagttgaatttgatcttgcatatttgtggagtgatatgtttcgtactaatctatgttgtcattttttttaaatttttgataactatttaaataacatgcaagcaatgagagaatgttccctcgagggatgaaaatccacatcccatctagcggaaacaaacctcatgtcatcctggagctcattcgtcttcgagcatcagcagcagcagcccagccctcgttgtcaatgccgccggctcccatctctgccggatgcaccatcatcccggctgaatttctcatcaactagtagtagcagcaaacaaacaacaaacaagcatatctgctcctttcatcctcttcttcgttccaactagatctcgtaaatttgttgtcctcgagctagatcagataagcctctggtcgctgtcctcgagctccattattcctcgtcttcaagtagcagcagcatgccagcatccgctcatcgtcatcttcgatttgcaaatccaccattatcttcaagaatcttgttttcctatgcagtttctgttccatcacatatgcaatccgttgtcgttcttatcggtcgccatcatctattactatttttcatcactactactatgttatgctattgcttgttgtggctatatcctcggtagagatggcaatggggggccgtcctcgtttgcccacggagaattctcctattagagggaagggatggttagaataattggttctccttgagatattaaatgggaggaatcatatccctctcaagttttgcgggagcagggatgatccttcattcctcacccccccccgaccctcttaggagtgaaagttcattgtttttttacttatcttacgtaattatcttacttatgtttctttataaatgataatcttgtgttttatcatgtgaattagtggatatatattgatgtattaatataaaacatgatatatgtgttgtattgcatgtatgatttggtacatatatattgttttacgtgggacggagaccccacggggactaattccccatgtggggacaggaatgagaagaaagtatcctcattgtatttcgtgggtacggggacagggaaagttttggctcacccattgtcatctctattctatggtgtcttttactagttcatcctactgctagtttaagtcatttggcaatccattcagtccaccaatgtcattatatatccttcaattaatcgaagtcgtgctattcaagtctatctctatcttcaccagagttaaccatcatcgtagcttcctgtcgaagccgaatcatcagtttgcgaaggtctgtcatcttcttcatcatcatctctgaatc

SEQ ID NO: 47496 - DNA, 1032 bp, Oryza sativa
acaaccatcggctaccgagccgattgcaagacgaccagcagtgattcctcagcctcacactcagcagccttcagggcagccgattggttctcatacaatcaggccacaatactgcatccaggagccaagaacattttcattttagcaagctccagggttcaaccaatttcaaactccaccaccacatcggcagtttgcttcaccattcattcaaaatccacttcagccgataggcaatcagtttgagcaagtccaaggggtcatccaacaacagcccttggctggcatgattgcaaatatggtgagagaacaatttggcatcaagccaaaagacagcggtatcatgtatcagaacccatatccagaatattttgataagatgccattgcccaactgatataagatcccagatttcttaaagttcttagggcaggatattgtttctacatacgagcacatcagccggttcctagcacagtgcggtgaagcatcggctgtagaagccctaagagttagtctttttcctttgtctttgtctggatcgacatttacttagttttcttcattaccatataattctatcaagtgctaggccgatctaaaaaagcagtttcacaagtacttcttcagcaacaaacaagagagaagcggacccgagaaaactctttgtattctcatttatgttaaaccttgaccaccagaacatggcttcttatgttcacacctcagctaggagggatgttcctagtataaatacctctctactctatccattagataactttatttcaattgtaaacctcatgtatgagagattgctgaagactgcataagtgtcttacccctttgttcttgtgagttcttttggacttgtgagaaggctcctctggtgctccctagtcttgctctacatcttccagttcggctgcaccgtattgtgtggattagtcccggattgtggttctgtgattgctcggtttgacgggttgaagtccaggaggcttcggatcgttcttaccctcaccacttcgt

SEQ ID NO: 47497 - DNA, 4275 bp, Oryza sativa
  unsure (1)..(4275): unsure at all n locations
tcctgcagcccaggagaatgcctcatgctgccaaaattgtagaatagagttgagagtgggtgaggaagaagttcataggagacagggaagtgagctcctcgtctgacttgttcctcaaagatgcggctccacgggagtaaacttttagtctttttgatcggatagcatgttattagtaacttgcttgcttgttggttcctagtctattttacctaaagtatccattctttgtttgtgttggttgcattgcttatgattgcaaataagttgaatagtaattccatgtatggttgtggtgatcggcatagttttgtctaggaaggcaggttagagcaacaaaggacgtagccagccaggtggtgacaaccatggctatccattgaggtctaccacattagccctagtaacattcatataaattgggtgataagtgttcaccccattctttgatgaatactcttatgccttaagcaagcacaacaaagtatttgtactgaatagttagctcatttaggcgtagtgacatgaagcccaagtaagtcatttaggctagaggatcctctcaaattaaaactacactcttggcttagtcctggaaacataagtatacattttatttctcgttgattcgataccgtggaatactctaggttgaaaacttgagcggttctcattcacttgtggactatttttcctgagcataaagagtgccaacacacattcatgtgatgtccagagctggcagcctgtccccgcctcaactgccaccgcttgagcctccaagcgcccaccaatccactccaggagacaccattcttactgtcggcttcccctatgatattgggcattggaaaaagtacaccgaaggtccctcaacttgtcatcaagttacaaaatcgtcccccacctattaaaccaaatatatgtcatccctcaacttacgaaactgggtcactttgcgtcctcaggcagttttgacctcggttttgtctgacgtggtggctgagacggcgtcggacccacgtgggccccacatgtcagggtgtccacgtcagcaccctctttctctttctcttctctccgttcctcctctctcacttttatcctcatgtggagcaggccggtcggtgggtggggaggaggccagctagctgaggcgggagagaaggaggtccaacgttcggcgaccgacgacgagcgacgcggcggtggcagcgtcggcgatgacaacgcgggagcaggtggacctcctcccatggcgacgggtgacacggcgacagcggtgtcctcgctctcctgtcgcactccccctccccgctgctcatcgccgtggcatccctaggccaccttgctgtcggcataccaatcccaaggcctggttcctccggcggcagcggggatgagctgggggaagggaggagagggcctccccacatggcgacgggcgacacgatgatggcggtgtcctcactctatcatccccactgctcgtcgtcgcggcgccctcaagccacctcgtcgtcgccatccccatatgaggcttggctcctccagtgatggcggggatgaggtgggggaagggaggagagggcctccccctatggcgatgggcgacacaacgacaacggtatcctctctctccccatccctgctgcttgtcgtcacggcgccctcgagccacctcgccgtcgccatcaccatctgaggcttggctcctccggggaggcggcagcgaggcggaaacgacgcgggcatgcagcgggcgtcgtgggtgagtgctgggaggtggagcttgaggatggcgaagacgagtgcgcgctcacgtgggtcatcgacagcaggcgcaatgccgtcgaggtcgcttacctcgctgccacagggatattcagcctctagctcgcccgcgcggtgacaccatccccttctcccgcgtcgcagccgccaccaccgccgacacctcccgggcctctcctatggttcgacaccgaggtcgcacacgcgatgacgctctcccttctcccgtgtcgtcgccaccaccgccgccgattcgccggccgctgccgcgagtcgcctcccttccccaacgtcacagccgccgccgccgccgcatcgccagtcaacagatctcctctcctgcctcgcctcggcgacctccccacccaccggccggcctgccccaaattaggataaaagtgagagagagagagagagagagtggagaggaggaagggagagaagaggggaaagagagagggtgttgacatggacaccctgacatgtggggctcacgtgggtcccacactgacttagccgccacgtcaaataaaaccagggtcaaaaccactaaaggacttaaagtgaacaattttataagttgagggatcttctctatatgtgattttgtggtttagggataattttgtaactcgatgacaggttgaggcaccttcggtgtactttttccttgggtattctactgctgctatgtgcttgctcgatgcccatcggccgttgcaatggatcagggtagattgcgactatttttttttagtgatgtttgtcatgcctgacaagtaggaatgtaaactaacgagcaggctagcttgtgatctaattactctttccgtaaactagttaattcaggtcttttttttttgtcattttcagaacatttggattgaccacgctttaccatcaatcagtaaggtgtaagtgtacgtaaatgtgaagttaagactccctgcttatgaagactacaggaacatacgtagcaacaagtttgatttgcttctttgcttttgtgtagtataggacgttttgtagctgccgtactgttgacacttgttacttaattatcttccgattttcaatttgcaataataacccttgtacggtaattatctttaccgtacaatgaagctgcgatatcattcagatcaacaacatttcaatcaaagcctagcttgcggcatgcagaacgacaatcctcaaggcatagatgctagaaacttccatactcaaaatataggtttttttgctgaggtcacaaaaaaaaaagttgagagcctaattaagctagagccaacttggtgagacgactcatactacatttcaattaaaatggatagatgactacagagaactctaaaattatcttccttcttagagcatcaccaacagtcctcgtataatctccttcaaaaaaaaaatgtttttggtttcctaaactgaaaataggaagttgaaaaactgatcttttcaacacaacacctaaatctaattcctaaaacttaaaaagtggacccttctgttgaaccaccaacatattttttttcgtttttcgtttatacggcactcgtgatcgcgattccccttggcggtacccaagcagcgccgcttcctctcgcccctctccccaccgccaatcgccctccccgtgacagcacacagcagcagctgctgcccttgcaaaatttcagcagcaccagcaatttcagcagcatctcacagctgcagcagcaatttcagcagctgttggggtgacagaccgattcaggctgaaccgaggcggcggccggaattgagacggcgctcacgcttgggaaacccgtgacagcgttgttgtcctctgcctagcaccgccatagcaatcagatagcatgtgtcgcccccggaaagaaagctgacgccaaagaagcttgggggagcgatgacggcattccagtcgccttcaaggaagaggacgctggcagtggaacagaggaacgacctcacggcgaacgagggcgcaaagatgatgccgcgaacgagggcgcgaagatgatgagctggatgggaacatttcgcctcctctgcgcgaatgtgctggattaggcgattggaagccaaatcaattctctagatgtggagagcgaaaaatctggagtagggaattcgtagatcggcacatgcgagtagggaatctgttggattgtggttttagcaaaaatccgccaaaacctgagattaggggccatgtacgtatgctgttggtgattcttattatattactcttttgaactttttgaactgggtatataggaattttttttataggaatctattttaatagtgaaatagcagaaataactaccttacaaaattataaacccccaaaaaantattctttaaattccgacgaanacaaagtaaagacaataattttttcactccaaaaatactatatagatgcaacttgtcccaatatcacacaatctaagattacttgatcacact

SEQ ID NO: 47498 - DNA, 739 bp, Oryza sativa
cctgcagccaaaactacaaaacttcaactcaagtatatacctttaattacatagggataacacaaccgatcaaactgcactaacaccaagagggaaagctactttctcattaaaattacagggtagactactctcactttattctattagcgaagaaaacatctgattgtgaaattttcaaatatcttctattggtcagcttagtaggctagttgcatttttctaatccagtcatagaatgtttgctacgaagttatactgaaagccatcaaatcagaaacttacattcaaccgtcaaaaaaaaaaaagaaacttacattcagcaatgcaggggatccattaaggccaaccagcagatgtggatgactcctttcaattttttgccgatactccaactccctcttaagagcttcttcacatgtgatagtaggacatgatgatgtattagatttgtgcatgcctgaaggtaacaaatagcacctatttggaagtgccagttgtatgtcagctaacaaagtatccccttccatgccatagaatcgtcaaaaaatgtgctgactttcaacatttataaccaaaggtatttcaccactttctgaaggtgtgcttatatggtccaaagctgcattttgtggaatcatcgatctgccataatataataacacgatgaaatcaataccgtatttggactcagaccaaaaaaaaaggaaaacgtatattatcaagcatccatgagata

SEQ ID NO: 47499 - DNA, 1191 bp, Oryza sativa
aataattcaggaaacaagcacccttcagcaatcggcagctgactttttcaaaacactacatcttcatccagtcctataccagtatttggatcttcttacacttaagatgtcatatacagataggtaacgaaagaacttgttcatgtatggtccatgtcagaatagatgaaagcccatgaaattttagttaggagatcagaaacaaaaaaacatcaagcaagttatagataattatttttgactttattcttcaataatactagtatggcatggcatatctattgacacacaaaggccagaagtgaatttaagcgccatcctgacctacttgaaggcaggggcggatccaacttgggacatgggggctcagttgaacccccaaacttttgggggaatgaacaaactgtcacttgtattaaggttcaagtctctgaaattaagagaagggcttcttccagatctagaagagaagctagggttaacgaaacgcaagcaaattccaggcaaaagtagtcccggtgggagagagagatgaaccagaaagaggatgtggatgctcaccggatcccctcccctcccctcgcctgctctactcgccagatggagatcagcgaccctcccctcccctgctcgccggatggagatcggcgcgccctcccctcgcctgttcagccgcgagatggcgcaaggagcggaggagccgagacgccgagacgggagatttttgggctgtttggatgatttccatagtttaccaccaaatatagttagtaaattgtcgcatgccccatattgcagagatatttaactatttgctatttttataaatacttcctccgttttatattatataagaattttcagcattgcccatattcatatactatatgctaatgaaactagatatatatgtgtgcctagattcattaacatctatataagcctagattcattaacatctatataaatatggacaatgttagaaagtcttataactcgaaacggagggagtagtaattaagaatttaccactaaactaatatataccataaaggggcaattttgtttctgcccctattttaatgtctaatattgattttatacctacattttagtgttttcgtttttaccctcacctttttttttgaactgaatgcctgttttgctcctactttggatggtgaaattaac

SEQ ID NO: 47500 - DNA, 2883 bp, Oryza sativa
ttcctgcagccctcaaaattttgtttaagttctatcaaaatactgaaattttgtcaaaattccatcaaattcagaatctgtccaaattgttatattagtcaatgtgcgtcatctaattttaaatatacttccaaaaataaagttccaaagctacgtgtataaaatggggacaaaaacataattaatgtatatacatgagagggtataaatatcattttatcaattacttaacactattaacttcaccatccaaagtaggggaaaaacaagcattcagttaaaaaaagtgagggtaaaaatgaaaactctaaaaaataggggtaaaatcaatattagacatcaaagtaggataaaaacgaaattgcccctaccataaatgcataagggcccatatgtcatagattgagtggcaaagccttacttgcaacatcttaaatgtggcaataagtcaaactacctagaaaaactgtcgcaagtttttttggtaaaactttcaaatctaactatagtataattgtaatataattccactataactattatataacttgtatataagtattaaaataatatatgcaactttatatctaacttatatagagtttgtagttacactacgactatactatagttacatttgaaagttttttccccaaaaaaacatgcgacggttttaagcaattccgaaagttgaatgtccctacattataagccaatgactagcctcatcccattgagaagaagttgaatcttccgcagtgtaatgaccaggagaagattgccttcgctacccaccagctctagggcctcgcttttgcttggtgggacaactacatgtttacccgcccagcaggaagagaagtcacttgagcagagttccggtgcagtttcaggaaggcgcaagttctcgatggaatagtggtgcaaaagaagaggaagtcccgtgcacaaaagaagaggaagtttcgtgcactgcatcaaggagacatgacagatacatagtatctgcatgagttcaaccgccttgcgcactacgtccctaacgacctgcacaccaatgctgagaggtaggagaagttcatgtctagttttgatgatgaactgaccgatcagctgatctctgcagactatactgattttgagaaactagttcacaaggcgattcgtcaggatccaacttctcgtcccacaaccaccatccgcgtgctatcctatgtccttgcctcgccaccagtttgcctaggtcatgcccacaacatcatgcactctagccgctagctcctgataggcggggcccatcgacttgctctctatgtgaccaacatgtgggtctgcttgtacaaaataccttatgagcagggtcattttgtcttttcaaaatatttttcttacaaaattggcaagagataataaaataatggtgcggtgtgttgtacttctctgtttcatattataacattgttggcggatggcatgaggcccttcgaccaaatctgccgaaacccatggcgaaggctatggagcaagaacggcgtgaggcgaagagtcgtgcgaagtgccttgccaggccagaggcgtctcaggcaaagggtgcaaggcgaagactatctgccgaaggaagacgacttcgccttggcaagttcgcccccacgagggccaaagaagcctttccggcccatcaagcctaggggcaatagggccggcgatcgccagacggcccatcaggggcccatgagcccctatatcatcatgtacccctgtaaatgtccctttcataagggtaatcatgtaaattcccctgtataacctaaaccctagtagtaagaacctgtaatggggatataaatagccccctaggaccatgtaacgggggaagatcccaagggaaattcaaaatttaatacacttcgtttttctaaccactgttgagtaaccacgtctttcgacgtatgcggttgtcgtttcgacaacagctggcgccgaccgtggggacctccgagcgaaaccactgagagtgaatgccaccgaagaaggtcgtgaaggagaaggttgcaaggcggaaggaaagcaacgccgcaccggacatggccgccgaggagggagcagagcattcggcgccagtggccgaagatggaggaggaccatctgcttccacatctgcgccatctcaaacgccttcggcccctgccgcctctgtgcaagtgccgaacgcggccgacgtggcgaaggcggctgctgtggcaagggcactccagaccagggcggagatcctttcgacaagccaactagtggtgccccaagccactccatcgcagccggcggcagccccgactgcgctcgccgctatgcaggcccatgtcagccctgaccctgagacacaagccgaagccgacatggaagccatgcgacagaacatgacacggctccaagacatgcttcgccaaatgcaagaacaacaacaagcatacgaggcggcaaggcggaccaaggtcacgtcggctccaatccttcagtattcggcaggttatgtcccgcctcaagtccatccgcaagtgacgacctagccctatccgcctcaagtcgcacaagcgccaatgtacttcgccgggcagcaatcggccgcagtcgctgcccaagtacaccatcaaccacccggccaagcgccaaaaatagtggcggaaggggcttcggctctgcaggcgcaactccaagcttttcttcagcaactcaaccaaccccactgtatttcaagtacaaccccatcggcccacccggaggggaatacaagtcaaggtgcgcctaattggttgccaccgattcagccgggcctgggagtttcgctgtggaatcaaggaccgcagttcgacttcgggggtgcaggaa

SEQ ID NO: 47501 - DNA, 1531 bp, Oryza sativa
cagttcaagttcccacccgtcccgtgctattcaggcgaaaatgacccgaagaagttcctctccatctacgagtcagcgatcgaagtggctcatggtgatgaaaataccaaagcgaaggtaatacatctcgctgtagccggcatcgcccgttcttggtatttcaatttaccagccaatagcatttactcatgggagcaattgcgcgatgtttttgtccttaactttcgaggcacctatgaggagccgaagacgcaacaacacctactcggcattagccaaaggcagggggagtcgataagggagtacatgcgtcgcttctcacaagcccggtgccaagttcaagacataaccgaggcgtcggttataaacgccgcttcggccggtctgctcgagggcgaactcacatgaaaaatcgccaacaaggagcctcagacgctcgagcacctacttcgcatcattgacgggttcgcaaggggcgaggaggattccaagcgacggcaagctatacaagctgagtacgacaaagcctccgtcgccgctgctcaagctcaagcacaagttcaagttgccgaacaacctcccctcttcgttcgccagtctcagccggcgatccaaggacagccgccgagacaaggccaagcccccataacttggagaaagttcagaacagaccgtgcgggcaaagctgtgatggcggtcgaagaagtgcaagccctccgcaaggagttcgatgcccagcaagtgagcaaccatcagcagccagcccgcaagaaggtccgaaaagacctctactgcgcctttcacggacgctcttcgcacaccacggaacaatgccgaaacattaggcaatgtggcaacgcgcaagactcaaggcctcagcagggaacaactgtcgaagcaccccgcgaagcagttcaagagcaaacacccccagccgaacaacgccaagatgtacagcgaagggtaatctaagtgattacaagggctgacccgccaagccagttgtcgaaatggcagaagaagatgcagatccgtatggtccatagcatcacttcggcgggtgaaggggcgccgcaatatctgaaccagctaatttcttttgggccggaagacgcagaatgagttatgttcccgcatcaagatcccttggtaatctcagctgagatagctggtttcaaagtccgacgaatcctggtcgacggagggagttcggccgatgttatctttgccgaagcatatgccaaaatggggttgcctacccaagcccttaccccagcaccagcatcgctccgcggtttcggcggagaagcagttcaagttctcggcggaaaagcgtacatgaagtacaaaagcttgcaagccgaattgcggcactcagacgattcctctcaaaggcaggcgaaagaggttgccctttttcaaaaccctccggggcgcatgaaagtttaattggacaccaaagtgccaagcagcattcgacgagctaaagcaatacttgcaaagcccgccagctctgataagcccaccccca

SEQ ID NO: 47502 - DNA, 2452 bp, Oryza sativa
tcctgcagcccataagcaatagcaaactagagcaaaatgtatgagcctccgaccatagtgcaatatggtatatgctggacttgtgtgataccaactaactctttgttccttctatgaaatgcacagtgctgatactggatcatctgaacacaagtgatgaataaagatacttgaagcttatggttgaaccggtaagtcctgttttatgtaattcagattcaccagtcattttcttttaatcgattgtaaactggtcacgagtcctgcatgcttggagcgtaaaatgttatagtttagtttttcagatgagtgtagtattatatgtccatatgccttataggcttaaatcatcataattttgctggtgtattgctttgcctttacagtcagggttctgttgaatgattctatttctatatctgtttgttaggctgtgcgtggctttaccatttagcatccttagaggaagggtcgtgttaactctaagcttattcgttttgcaaggttatagcatacttcaggaacatcttcccagttgtccccatgtgtgtgtcatgccacaagtgcagccaaggatttgagcaccacactttgggcaaagaaacgggaggtactgcagctgaactgtggcgtgctgtcattcagtaaagaaacaaacttggctggaaccaaacaggtctttaacctgctgatgtacatagttttctctttacactagttgtcttattttttgttgcaaatcatgtagaaataaaaaaaaatccttgcttggatgatggtatcttgcatgctttagcttgaattgctctggaaattttatctggtcagtaagacagtttctggttatcactcttctgtcttctccagttttctttggtcataattttgcttttagtttgtatagttcaaatatcataatttattgcaatgtacctttgatatttgtttgtctgttcaaccaacaattcttcattttgagacatgaatcctctaaggattgcagacataagggaattctgctgcttatatgatgtccgcagttctgattttctctccaaagttttcgtggctggagttatgtagaattgtagatacaatatctcaaatcttcatggctagtactagaatctatcttgacatgttctctcttaactacgccttggacgcctttttccctgtcggaatgataggtccgtcataacctaatctgatgtttggttgtatagttatttgactagttagtggctgtcttaagacaccaattgttatgaagatttggaggtcttgtttcagtaatccagttatccctctagtcacatgcattgccatgggcttccaagcttaaatattttgattactcgtcgggaatacacatctaagagaatgatattttagataatggatttgaaaaaaacccggcctctacaccctgcaggatatttgcagccacaaagttatgtagtctgagcatttaaactcgcaatacaggtttcaagcaacaaaacataaaccccaggcactaggcttccgaacggtatctagcagcaacaaaacagagaaaacaaagttcgaaacttccaaccttcctctccaatgatgtttgctttattttttaaggactgttttaccaatctgaaatgttacggtgaactgaatatggctaaatattccagacgtgtagaacttgtagcccagaatgaacgaacggtcccaatcaatcatagcgtggaaataaggtgcacgttttgccatcacaatcaacttcttatctcgaccgttgatcattcaattcgatgtctgctcttagctttttctctcacttggaaaccgaccgttccttgcctgattagatcattcgaacggttgattgcttatttggtgttagctgatcgccgtccatgtgaccactgatcacaaaagcttcttgccaatatgacagtaacatagctctgaagaattctcttgatccagaactgccagctgaaaattagcacactccaattctccaaatgctcagcaaccacaagttcacaactgcaatggttagtcgacgcagctaagctccaaacaccattggtccctgtagccaccatgctccaagttgctgtccattgtgtccgtattctcctaatccattctagccaagaattctctctcttctcatcaagccaagaattctctcttctcaccaagccatgtactttgagcagagcagccgctgctcagccacaagctccgctgcggtccacgtgtcgctattgtgttacgacacatcgcgcgccgccattggtccggaacagagccccaaaaagcgagctatatccaatcttggatcgatggctagagagatttgtggcgcagctgcttccggttcctcctatttacttagcttgtcaaaacacattactcactagtagcgtacactaccacagctagcaatggagacctcgtg

SEQ ID NO: 47503 - DNA, 3104 bp, Oryza sativa
tacgcgaagagcgtgaacccggcggtggcggcggtgagggcgacggcgacgacgccggagccggtgaagatcggcgacaagtgggcgcacccgctagtggagccggagaaggggtgcctgctgatcgcgacggagaagctggacgggtcgcacatcttcgagcgcacggtggtcctcctcctgtccgccggcgtgctgggccccgtgggcgtgatcctgaaccggccgtcgctgatgtcgatcaaggaggcgcaggcggtgttcgcggagacggacatcgcgggggcgttctcggggcggccgctcttcttcggtggcccgctggaggagtgcttcttcctgctggggccgcgggcggcggcggcgggggacgtggtggggaggacggggctgttcgacgaagtgatgcccggggtgcactacgggacgcgggagagcgtggggtgcgcggcggagctggtgaagcgcggcgtggtcggggtgagggacttccgcttcttcgacggcttctgcgggtgggagagggagcagctgcgcgacgaggtgcgcgcgggcttgtggcgcgtggcggcgtgcagccccgccgtgctgggcctcgccaccgtcgtcaagggcggactctgggaggaggtgcagggcctcgtcggagagaggagggtgtggtgactgattacttctcaagggtgaccattatgtaattaattaattaattaatctcttaattaactcgcaagtaaagtatttactcctttcagattaatgattttaggcttttagtcatcacggtaggtttaaagagggttgtatttgtatactctgtatcttgtactcttatcgttttgcccaccactacgcgaacacacctcgatgcccttctcgtctccaacgcatacactacttcatactttataattaaagccttaactttcaaatcaaaattctttcaattttagaaatttcagcttagaatgtcaaattttcaatacattctaccactcattttaaaatttctacataaatattggcaagtttgtaccgataaactcaaatgtttaattcacgtaacaaaacaccattgagcaacttggagcctcaaacaccattcaaaagcctcaaacttccaactgaatggtgctcgctttgccaaacaccattgagcaacttggagctcacctgcatctagatccaagagtaagaagaatttgtgtgaagtgacttgctatccttggagataagaggctcgtccatgacccgggggggggggggggggggttgtatagaaacaaacacgtcttatgagaggttcatctgctccgccactatgctaggaacttaattgggctgcacatgggctatatattttacccataatccaaggccgggactacgagcctcagaaagaggatacaaaaacaaacaacattggatgtactatctatctactctctccgtcccataatataagagattttgaatttttgcttgtagtgtttgaccactcgttttattcaaaaaatttatgtaaatataaaaaacgaaaagttgtgcttaaagtacttacgataataaagtaagtcaaagaaataaataataattccaaatttttttaataagacgagtggtcgaacactacaagtaaaaactcaaaatcccttatattatgagacggagggagtatctatctatctattatatactaaaagtccattaaacttcctatgaacgctcctaagccaccacgtggcacctctacaaactctcctacgtcgccacatggcactctaataaattagaagaattaagcaaatgtgaactagttggttttcatttaatctggtggatccattatttttaaccgttagatatatagcatagaaaatgtcaaatagatttattatctttaaaaatccacacatgcgccgtacgtgtacgtgcatgtacgtacatattttgtacgtgggccccacgcccccttttcttttttttctttttcactaacacatgagaaaaaacaaaattcatattccagcccatatagttcggagtatgtacttgcatgtagggccccacgtccccacatttcttttcattttccttttttcactcacataagataaaaaccacattaataattccaacccatagttgtacaaatatatttatttttgagttgtattgtactatacgcacatcattgaaatattcataaaatatctaaataaatgaataatatacattatataattatataattgtatgtcacttaatgacatgtattgttaaattagaattgcattttgaaaaataaaaacaactccagttgtgagtaacattgcaaaaatgattcgctccctactataagaaaatactgttatatcggaataatattattaaattatcataattacactctaccaatcatatacctaataattaaaaaattactaaaaaagataaaaataacttgacaaatattagtgcactaccacattattcataaaaaataaggaaagctattttttattaactatactattaataattttaatgttatgatttaataagtaatattattatttatttgttaactttttttataccgtttagctgttcgagaaacgtgctcgctacaaataagggagtatctaatcctataagctctttagaacacactcttaaatttattacttagatacaaacacaatatatactatacaatatatttggtcaatcctggcctaaaatatcaatcgtaaatcctcactgatcctcatgtatgtaagttttatatataagccattatccactaatcatcaagccatattgcttacgaggcatgtgtgcacagtgcatataacgattagttggcccttgatttacttggggttggcaatgagcaaagataaggtgactaagagggagttgttaccaatcatgcaaaaagttgagaaaaggatggatagctggcaaagtggacactgttggtattttttaacgataatactagaaatctaattcccagcaatggcgcagaaatactcgtagtatattatggttacagatttcatccgcaaacgcacggatattctattgtagcattttat

SEQ ID NO: 47504 - DNA, 1154 bp, Oryza sativa
atcattatagcaggtgttattggaacatcaatataaattcatggttgctgatggtgaagaaatgcgtgtgtactatatatgcagatactgctgaccaagatgtcgaagcaggttcacttctatttgacctggcaacattaaggaaggcaacagctaattttgcagaagttaacaagctcgggcatggtggttttggagctgtatacaaggtatatgcaccttgatactatctgaaaataccaatgagaaccctgctgatatgatctgaaacttatttcagggattcttgcgagatggagaggagatagctgtcaaaaggctcgacaaggcctcgggacaaggcattgagcagctgagaaatgaactcctattggttgccaaactccggcacaacaatcttgcaaaacttctaggtgtttgcatcaagggggaggagaagctgctcgtgtatgagtaccttcctaatcgaagcctcgacacctttctttttggtaacagcatttatagttctacgcttcatttttgttatgaaacacccagtagtctggaatcattctcagctgtagtaatcatcaatatgctgacaactagtagtataattgcgtagtaaatagcatccgagcatggtttgcaagcacatgatcagtttggtacttggcagatccggagaagagaggccagttaatctgggaaacgagataccatatcatacatgggacagcacgaggcttagtctaccttcatgaagattcacacataaaaataatacatcgtgacctcaaggccagcaatgtactgctagactctagcatgaacccaaaaatctctgactttggcttggcaaggcttttcgatggcaacaagactgctagtgtcacaagccatgtcgtcgggacactgtaagacactgataattaaattccttcattaattctttacacgttgccttcatctagttatatataaatctgttttacttaattacaattggcatacaaaactataaatgttagttacatttggcatacaaaactataaaggttatatatgtatctaaatataactagctagatttcttaatttatttctagtctggattacttacgtgcagaggatatatggcgcctgagtatgcagttcttgggctcctatca

SEQ ID NO: 47505 - DNA, 1666 bp, Oryza sativa
ttttaggggaaaagaaaaagagaagggaaccaagcacttcttttcttcttttcaggagacattaacttgtcatgtaactttttcatgtctcttattagtaattcctcagattttactgccagataaactactgaactttagaagcaaagacgtagggaatacaaggcaagttaaggatgctaaaacatactttcccatattgtttttttcgttttaggctcagttaataaaaaaactataattctaaataattttattgatggtaattggcttatttaataagttctttctaggagtattctttctaggttttcaacaatatctgcactatggagagtcgatatctgattctgttgaacctgcctcaaaggtggatttagactgggtgacatagcttaggcatgtcacataatatgaatccctcaaaggtgtttaggaacaagaaataaaatgggaatatgcagtgagtgtatccgggtactcacggcaaggtcttgggccttaaagcgtggggtgggccgagtgatctaggcccatacagactgcttgtaagttaagaaagggattaaagataaagctataaatcttatcccatataaataggtggcaggtactcgaattataagggctaccttaccatcactagctggccgacaccgtgattatataaggggcgcgggggaaacgctaaggattgatcattctcccgtatacacgctatcggctattcctacgctgatctgcgcacaccaatacagatctaatctacactgactggactaaggtattaccccgcgctgagggcctgaaccagtataaacaactatgccaccatctctacttaatcttgtgcaccctataaattatattgctaatcataagaatcgatagctggcatgctaaagtaggggtgcgcttgattatcatttcatgaggagatggcgtctttagtagttgtcttcgtctaagcggtagggcgaacctctccctccaacctctaaatatctttgtcggagcaatcggcagcatcccccttcccgatgacttccaaatccactcgggaatagtgggacttcaccaccgccaaggcatgatcaacgtccgaggtggccaccaccttcgacaaacatcgcacaacagtcggcccctctggaagaagtcgtcccacctacgcccacatgcccccctcctcgcgaaaacctaggaataacagttggagcgtcagcttcagggcatcaacaagttcaccccgcattgtcctggtggtctccacctcgtgttggaagtgctcccattgtgcctgattgccttgttgcactcctcccgctcggcaaccttgtaacaccctaaaaattttgaatttaaaatacgaaaacaaaaaaaatggaataatcaaaaatatttttcgaatttccctcatgctggattttttgtttcgaattcccttttcgccggtgccaaatcctaatttataaacataattgtctttttttcgcctcctttactcctttggagaaaattaccaagtctttaaaagaggttttccttgtttgtgaaaaggcctttgtcctaaaaagtctagcctaggtccctctcaccctaaccatctagctaggtcttttctgaaaaagtttattttacgtcccttgctacccaaccccttttt

SEQ ID NO: 47506 - DNA, 1846 bp, Oryza sativa
ggcgcgaggacgaaccgcgagcccgagcgccttcgaccggtacctctacgcccgtggctttgtcgtgacttcactcggtgtgccggtccccggctactgcacggtgagcatccatcctttcccttcccctcccttctccctcttggccgcattcctgccgtgccgccgccgccgtggcgctgtgccgcccgaagggcgaaccgccacaccggctccgtgctttgatcgccgccaaggttgaaaattttggaaattttggtcatttcggccacctccgatacgatataacttcggccgaaatttttcaattttttcatgaatttgggtaatatttgttcaaattcaactaaattttgctcaagattttggaaatttcgggccgaaatttcgggatttcggtgacccccaatcaaaaggactcaaccgatagagtgaaccctggtcgccgctcctaggcccctggaaccatctaccgcgctcgctcgccttgccaagtcccctggccgccggaccggccgcgctgcagaaacgcatgcgcgcgccgtgcattggggcgtggtcttcaccggccgaccgtacagatcgtcatgtttcacctttatatatatttcttgtaagctgccgtgtggtgctttgtaaccacatccgatatagtgaagttttctggctggcgctaaccatcatgctcctgagggacccggaagcccgccgccggccttagcctcccctctccttcaccgcttcgctggtgcgcctaggatccgcaggctgctgccgcctcggtccccaccagccctcgcgccgccgcctaacgacggcggatcccccaagatcttccccccaccggccgccaccacttccaagccgctcaccaccggtacaagcaagccctagcgccggcagcccatgctcgcgcgcttgagagggagagcagcgagaagagagaagaaagaaataaagaagagagagaggctgacagtgggcccaccatgaaaaagttttattttttaaaactagtgaaggagattaagttagctaagtgactaatatattaggctgacatgtgggtcccgtcttctaatgaaaaagtgtttaaaaacatgtttaaaacttgacaaattaccatgtctttttttttcttcaaaatagtttcatttttaatagtaaattccaagttatagtaaccacacactttaacagcacttagctatatacattttggtatatatagaagtttcctaaaactacactaacaacccgcgagatggcgtgtaagagagacacataagctctgtcctttgggactaattagagagagagagagagagaataagttcgattgatgcttctgcttcacttcgagggtcttccaccggccagcctgtttatcttcttgcaccattcaccgagctccccaagtgcagggcacaagtcgcggcgcgtgcacttccatcatctgcccaaatggattatgactgccatttttcttaactccctccaattcatattatatcatatttcgacttaacttctttaattttataacatttataaaactaaattaattttattaaatctaacatagaatatattttggccataagtttgttttgtgttgaacaacaaagctctcgtgcgcattcaacatagcaagcctatgaatacttgatgttgctgtaatcaagttcctggtgtttgtgacatgccaaggcaagactgaggacctggatgattgtgattccagatatcctagtggacctactcctaagtgatttccaagcaattggacttgtcctcacacaaagcagagtagtgaagattaaaaccggcctttttgttttgaaag

SEQ ID NO: 47507 - DNA, 1379 bp, Oryza sativa
tcctgcagccctttccttttaatgtcccggaacctctgtaggctgatcaaccatactggcccttaaattctagagcccctcagttataccacctctgtttctttattatataccgtcgtttttagatagtcacgtaaagaaaaaataggtgcaccctagctatcgttggatttttagagggtccgtatgtcatccatgcaaccccgttctgcatggatgatacgtggaccctctaaaaatctaatgaagagctccacttggcttgatgtgtgtgacgctccttttgactccctctaggaggctcactccgaattccagagagtgcaggcactacttgaaaaagggctaaaggtgccggttcctaaagtgccatatgtgccggattttcatccgacaccaattggtcgacaccaataaaagcaaccaacacctataataaaaatagaaccggcacctttaccattattcaagccaaaaaaaaaggaagagagctggctcgaatccgagccgaactcaccaaaccccaaaatcatcacccaaataaaattgatatcccaaccccaaaatcatcaacaaatcatcacagaatgaacattaacatcacaaaatgaacatattcaacaacaaatttacacaaacatcacaggggagggcgccgtcgcaacccgtcgcccgccgccgcaactcgccgcccaccgcctgcggcctcccctcttgccagatctggcggaggggagggcgccgccgcaacccgccgcccgccgcctgctgcctcccctcccaccaaatccggcggagggaagggtgccaccgctgcccgccacctgccgtcacccctcccgccggatccggcggagtggatggtgccgccgcaacccttcgaccgccgccgcctcctttcttgcgccgccgccggccgcccgccgctcgccacctcccgtcttgtgccgccgcctgccgcctcccctccagccggattcggcggaggggagggcgcggccgccgcggttgccgcctccgtcgagccgccgcccgggcaccgccgtgcgcgcgagagagatagagacgagagagctgagagagagagaggcgagagagatagagatgggagaggcgagaggataacgttgacttggctgcgtcggctcatataggatgtgtcggcttggcagctcggctcagattggataggtgccggttattataaaaaaccgaggtgctggtttttaattaaccgacacctataacatatcaaaggtgctggttttttttaaaaaaaccgacatatactataggtgtcggtttttctttagaaccggcagctatagttatttaaaggtgtcggttttacgtgtttctagcctgcggggctgcaggaa

SEQ ID NO: 47508 - DNA, 1586 bp, Oryza sativa
tttttttatagtgaggggatcgtgctgggagaagggaaagaaggcgaggcatcaacctctctccccgcctcgatgtagatggcgatggcggcatccgcggttctcgccgcatcgtcctttctgctcgctctagtgttgtggatttggagggcattgcctctcgaaagtcaaaggtacatctcactgagaaaatcactgtcttgttattcgccggaatgttgccagccactcttcctcccatagatctaccaatgattaccagcaaatcatgcgtggtctaaacgatgtttgcctaatcatgcctccaatgatttccactcaaacaatacactgcctatcacaaaatttagcattgtgtttgttttgtctgcttcctccaagaaccagaactatccacaaccaagacgagccactactacaaaacatcaaataggtgtcaccactataggtgtcgtagtgctaaaaccggcatctataggtctttttccacctctgcgggctgaaatcgtaaaaaaccagcaccttttagtaattatatgtgtcggttctaagtaaaaacatggcacctattatattttttgtcagtttttaaaaaaaccggcacctataacttgttataggtgctctggcacctaccaattgagccgagccagcaggccccaccactagcattgagagataaggtcgaggagatagcgtagaggagccggtgggccctaccactctcgtctcctctcccgttctctccattctttccgctctctctcccctttctatctcgctcgtggcagctggaggggcagcgtgcggcggcatcagcggcatcagcggtgtgcggcaggaggagcggcggcgggctcgccaacgggaggtggcgcgactgctcgaagaggtgtgaatcccttctctcttttttttattgcataaatttgagtccaaattttgtgttgtggatgaatgttggatgaatggatagtgatatagatgcggatgtgcttgctgtgatgaatgttcttattcatcttgttcttgatgaatgtgatgcagatgtgcttgttcattcttgttcttgatgagttgttcttgatgagtagagtagtcgagggactgctcggctcgatgcatcggcttgagccggcttttttttatttattgaacctaaaaggtgacggttgacctatgacattttcaaatcagcgccgcctcctttgtgccggttgggaaaaccggcacctaatggggtttcccaaccgacacaaatctgtgtttctgtagtagtgagccacgtatgggcaatgctagaaagtcttataataagataaaatatgttctttttataaaatgaggcaaaatagaatgcttgaattatttttgcaggagattatgcaattaaatgagcaggaactcatagccacaaccgtgtaaactctgtactcctatgaattattcaagtaaaaacatgccggtatcaatagataccacctccgtttcagtttataagactttctagcattgcccatattcatgttaatgaatatatatgtctagattcattaatatatatatgaacatgggtaatgctaaaa

SEQ ID NO: 47509 - DNA, 1192 bp, Oryza sativa
caatggataaagatatactccctccttcccaaaataaacgtagccataagttttcgtgtccaactttaatcgtttgtcttatttaattttttttaaaaagattaaaaaacataagtcacgcgtaaagtactactccctccattccataatataaggtgcgtacatatttcaagattcaacctttaaatcatttgacaaacacttagtataatatgaaatgaattttattgttaaaaattatatcaatagattgagatttaaatttactttgatatggttataattttgttgctacaaaccgtatatgaaaaattgtaagctaaagattagttttagagaccgtgccaactttaatcgcgtcttatattatgggatagagggagttttcatgttttataatctagcaacaataaaaatataatcataaaataatttcaaataagacgaatgatcaaagttgaaaacaaaaactcatggctacgcttattttgggatggagggaatagataggttaggaccactcagaagtgtaatattcatgtgttttttctttggaatggggctttgttgacgaaaaatctatactcggccgatggtgccggaactgtgttggcgcgaactaagttgacgaacacaacggcatagaagatcttcttagctccagtgcaggtccaaaggttgatgagatacaggcatgctagtcagtagattatgacacttgatataaataacaatataaaagcaatcggctgatgatgataaataacaatataataattcagtagaaaacaattggctaacaatatgatagaataaacactaattcgatgcttaaagcatacatcggctgaagatccaatttcataaaatccaaatgattagataaacagtaaaacatttgttgtcatcggcgaaatctaacttgtatgctatccttataagccgatgcaacatccagatacctcatcggctgaaaccccgatgaaacccttattggcaattaagagcagggtagagaatatgattctaagcacgacttagtaaatcaaacctaactgatacagcactaagtatgaaaaaaacataatatctaaacaatcaaacctttgactgattttcagggtggtggatatcttagctaatataatctggtaaagcgatttagccgataccggcataaactctaaagcaa

SEQ ID NO: 47510 - DNA, 8576 bp, Oryza sativa
ttcctgcagccctaagcaccagcgcgtgaaaaaatatatataaaatctaataagtttatgatattattatcatactagtattattaagacaaatctagatgataacatcttcttgtttaaattaggtgcggagtatgtttgaagttattgatggccaagtaaataaatagttatccgagatatctactcatagagttataattaacaaatggtttatagaaaaaaaattatccatgcagcgtacatggcatataatctagagtaagttaatttggcattagctcaaaatttggagataagcgcgcagtgatcaaatttttggaaggagtgaaattggtttggcgggctttagctgcggcaaagagctgtatagatacgcaaaatcctttgaccgccccttcgtctcccttcaccgactcccaatccccaatgtctgcctaccagcccccttccctcatcgtccttgccgccggttctctcacagacgcgcgcggcaacgcctctacctccccgacgaacacctcggccagatcctcgtgacgctctcccagtcccttgcccatggcgtggacgaaccgacgacgcctctgtcgctctcaccgcgcgtctcagcgtcaccatgcccacgagcatcctaccccatcccggtgccaaccatgacaagcacccctacatcctcgcggctgaccaagttggcctcctcatcagtggtggtgctcccatcgatccacagtatctcccctttatcccgaggtcttctcccctctctctaatccccaacccaatctctttaattatagaactaatgcgagcagttttttttttcgtgtgtgcgttataggtttggcctatggttgcaagcagagggaatgtaagttcgaagctatcagaagaggtgtgaagttattctctttatctcactgtcctgtatgtagtatcttttacgcaaaatttgccataggacactcaaaaaacatgtaattggctgggagacaccgtaaaaacatgacacggctgatggacactataaaaattatgtaattagctgtaggacaccggaggcaatagtttataattttcaggtcagaaggggtgagaaatttttcgaaatgacgagattgcccctggcgctgctcctctccagctcgctcatctccgccgcgtgagatctcgttgctgctcatgccgtccacaaccacgacctccttcttctgcgtcgccagtggggacacacaccaccgtcccggcctcttcgccgacgcccgcatcgcgagattctacggctccttcccgggcggctggctcgccgccgagctccccgagtcgcgcggccacgcgctgctcaacctctgcaccggctcgcgtatcgccctctcgacatgactccgctacagcgtcaacgcccgcaggagcaacaagtactccatcatcatccacatccacgccgtcactctctccgccgccctgtccgacgatcacccgtactacgccgccgccgtaatgtccagccagtcgaacatcgatattgtgttctggcgccccagcatggactactgaacggtgaacgccaccgacggagaattggggcgcgaagttagaagattggcagaagctgacatgcaatggtccaatcgaggacgtcacatactacatcggtccgcttggcgagggcttctatgtcctcaccaacaaggaggacctcctgctgtacacgccgaacaccaacaacaaccccggcgagctcaccatgtcgtccatggagatgtacagcgtctgtgatgtttgcgtcggccatgtttgcgcatgtactgcaagatgcggcggggtgacttctgctgtccgacgtgggtgacgacggacgcccggaagctcatcaagatgctgctcgaccccaacccgggcacccgcatcaccgtcgtcggcctcctcgagacatgtggttccagaagaatgcgcccgtcccgtgccccatcactgacctcgggctggcgccggtggacacgcttggcaaggccgacgacgacaaaagacgaacctcccgaggtgctgaacgcgggcggcatcgctgggacgcatggcagcgccatgcccatgcacgggacgcagggggcggctcgccgtggcgccaggggcaatcccgctatttcaaaaaatttctcaactcttttgacctggaaattataaaatattgtctctgatgtcctacagccaattacataattttgttagtgtctatcagccatgtcacgtttttacggtatctctcagcaaattaaatgtttttttagtgtccggaagcaaattttgcctatcttttatgatcaatcataatatcgttcatttacactgtcacactgccaactatcgagcaatagaagcattgaactctagttctgtctttgactgcttcggacatttcacaagccaagccagtttcatgcattaggtggattggcccaaactcatattgaacttagctgtttgctgatctattaaagataacttttgaaggttgtcaaactaatgtttggcagttgatgcgaatatggcatctagtcacagttatgatcaggacttctattgatgaatagtgattacctcaactggctctgctgtttctaatcttcattgtcatagaaggaagctgtgatttggtaaagcagcaatatctatactctgtatgacaaatatatgcttacaagagaatatctagagaatatctagagtacttgccctctggagttgtttatattgctggaaaaactgagacttctagatgttgagtgtgatattaacttctgaatttggctattacttttttggctaaattggaatatgctgaaatgtatcagattttttaactgaggaaatgaaccaatcttttatggaacttgcttttatgaaatgatagtgattgaccacaatgatggtacaaacagaattggcaagtgcttgtgttttcttaagtgatatctggttttgtagtactttcttcggttccatttattttcttgactaatggttgtattttttttttcagagcgctgttatttcttcaggttctaattcagaggttcagataaagtaaacatttatgtttgtaatgcaaattatatacagatatatggaaaacatgcatcaaggtatagttacggcctgtatactctaatcatgaaatagttttaattcaattttgtgtacatcatataactagtaactagttcaatgctttgcattacaaattagaaatactctgctatgatcttaaatctctacttcatgaagtcaatgttgataaaaataaacccctaattctcattccaaggaaatcaatggtcttgttgctgagaccactagaatttatttttaagcttttcttttctttgttcaatcaggcttcttgattgttttctagactatactcttgagattttgtgagaaacagagcatccgtgatattttaaccaaaacaatgtttaaaactgtagctatacatgccttagatattatcatttgattcaacaggatgtgcactgaatgcttttgttcatttatctgcttaatatttataatgcacattaatttctaatggctaatagctaaatatcgtgtttctcaactacaggtacttgcatagcatgcgaggtgtgtgtgcacacttaaaagtagatgacaagttgaactcaataagaaatggttgttcagctgattgcctcatcaagtcaccatgggacaagcggcatgcaaagatgcatgaagaatatagaaatagttatatattttgatttgagcactagaatttggtttttgtattgtgcatgttccctgtagatgtatataacagtatacttcaatgtaagcaataagtcaacaaacgtatggtgcataataaagatttctaataattattttaatatatagcagcaacaagcaatgatttcttaaactatattgctaatcatgctattaatgtgctgctacaattaaaaatggttttactactttcttgagaacttgtatttgtacttgtgttactagtgccaaaattttgttttactcgactatgtagcaacacagggcgttgtgttacaggagataaacaaaggtgttcctagctaaaaacttgtaacacctattcttatcaattggaacacttatatgtgctacaaggatccatgtgtagtaacacggccaacaagaacacatatcagttgtgttactagaatcctcagtaacacgtttctggagatatagtagcacaaagacgtgttactataaccctgtcctgcagtagtgtgatacagtggcgacgcttcttttctcggctggcaccatggcttccaagacctcattccctcttgaaaactaatcaaccaaccaatccacccatccaactagacctcaaattgatgacacgaaacaacgaaacaaccaaaccaataatccattatcggtggagaaggtcacacgaaaagaacgagtccagggtgctactaggggcggtggcagcggcagatgaggggaggcggtggcggcagcggcagatgaagtagacggaggagccaatcgagccgcgttggcacttggcagaggcggattcaacctggatgcaggggggactatacccaccgtacacatggatacccccctgagttcccccttcaattttttcaccatggatgataaggtagggtgctgaaggtctccggatggctagaggttggagaaaccgcgtattgggccaacgatccgcataattgtgccaggcagccaagggcataaaaattgcctattgcctattgggctttgaactcactcacatagacccacatctagctctctatgctccgcccaacccccaatccccattcccaatggcaaaccctagcttccaaatccaactaatcgaggtagcttaggcaggcaggcagcgagcggcgccgacaagttaacggcgccgtgcacggaatgtgtgacggcgctaccgcacgagcgcgggctggctagcagcaccgcggcgcacagtgccagcgagcgatggcgcattggcgcaaggctgcgagcggcactgcggcagccggcagccaagccgcggagcgtcggagcacgcgacgacacgactgcgcgagcagcaggctgacggcggcgcgatgccgcgagagcacgctagcgggactgcaagaggagcagtgtagcaggctggcggtgccacgggagcgagcagcagcagccagcaggctggtggaggggccggagcgagtagggagcagaatgtcataaaaaacattgttctgttaaacaacatgcatgtattaatgtatatcttgcctaactgatctagctgagatttagattgttagtttagataagatgtatatcctttagatcaaatctgggctagattagaggctatataatcctgtaatctcagcgccgattggtacgccaatataacacgcagccgtcgcaccgaaacaaagggcgacgttcaacccatctcactttcgctgttttacatggtatcagagcgagagaaaaccaattcaatctagatggccagctcctcctctaccgcagtttccaatccgctattcggggttcaagtctccgagaaattgagcaagcagaatcatgcgctctggagagcgcaggttctcacggtgattcgtggcgcacgcctggagggtcacatcaccggcgaaacggcagtacctgccgcacaactcagcaagacggtggaaggaaaggaggtcaaattctccaatccagcgcatgacgaatggattgccgcggatcagcagttcctcgggttcctgttttcctccatgacgagggaaacgctagcgcaagtcgctactgccgcaacggcggccgaagcctggaagacgatccaacggatgttcacagcaaaaacgcatgctcaaaccatgaacgtgcggctggccctcatcactatgaagaagggtaatctttcagtttctgattatgttggtaaaatgaaattgtttgcagatgagatagcaacagtaggcaagtccatggatagcgatgaactgatcgcatatatcctcaatggactggacgaatgcagccagcagaaaccgtgggggcttctcctcgtgtggtggcgcaggaagaggccggaacaccaacagcaaccgcggccgtggctccggccgtgggcgtggtcaagtcaacagcgcggcaacgacggccgccccttatgccatgtgtgctacaaacgtggccacgttgctgcaaattgctggcatcgctatgacgaagactacgtcccagatgacaaactcgtcgccgcagctacatacagccatggcgctgactcgaactggtatgttgatacgggtgctaccgatcacatcactagtcaactggagaaactcaacacgcgggaggtgtacaagggacatgatcagattcacaccgctagcggtgcaggtatgaaaatcaagcacattggtcatgctatagttcataccccaactcgtcctttacatcttaataatgttcttcatgtgccacaggccgctaaaaatcttatatcagcaactaaacttgcctctgataactctgtttttgtggaaattcactctaagtattttttgattaaggatcgaaccacgaggagcacggttcttaaggggccacgccgccatggtctctatccgcttccgtccacatcatccaccaagcaggcctttgcagttgctccatcgcttgagcggtggcacagtcggctcgggcatccttccattcccattgttatgaaggtcattagttcaaataagttaccgtgtcttagagaatctaataaagagtcagtgtgtgatgcttgtcaaaaggccaagagccatcaattaccgtattccaattctatgagtgtgtccaataaacctctagaacttatttattcagatgtatgggggccggcctccacctcttttggaggaaagaaattttatgttagcttcatcgatagctatcgcaagttttcttggatatatttcctcaagcataaatctgatgtctttgaaaagtttcatgactttcagcagcttgttgagcggctttttgatcgcaaaattatagctatgcaaaccgattggggaggagaatatcaaaaattaaactccttctttgaaaaaatcggaatctctcatcatgtgtcatgtcctcacactcaccaacaaaatggttcagctgaaaggaagcatcgactcatagttgaagttggtctagctcttcttgcatatgcatctatgccacttaaatattgggatgaagcctttcttgctgccactcatattattaatcgcattccctccagaattcttcaatatgacacacctctagaatgcctatttaaccataaacttgactattcttctttccgtatttttggttgtgcttgttggccaaatcttcgcccttataatgctcataaattgcaattccgctccatgcaatgtgtttttcttggcccaagccacacccacaatggatataagtgccttgacatagccacgggaagaatctatatttgtagagatgtcgtctttgatgaaaatgtttttcctttatctaaatttcactccaatgcgggttcaagactacgcagtgaaattgcccttctaccctcacatcttttatctcacacttctcatcaagggggagaacataacaaccatatgcttgatttttataatgtttcatctgatcagactgatgagaatgcagatatagatggaggaaatacgacagatacaactaatgatgatctgggtacgtcagggaatgtggatgtagcagcagactcgggttcggcttcgaaaattgggtagcagactgacccaacagaccaacctgcgcatgacacgtccgccaccggcgccagcactcgccgctcatcatcgccgtgccaaccaggaggcgaaacgcggctgcacaacagtgggtctccggtgcatagcactggtagtcaatccacacatggagacagatatctacattggcaggtaatcaattgcatgaattgagatcctctgtgatgcaggacatgcactttggaggagaagcagccactcatgccacagaagatcaatcaatggtcgcagcaaagcccagaacaaggttacaaagtggtatccgcaaggaaaaggtatatactgatggaacagttaaatactcatgttttacttcatctggtgaaccacaaaaccttcatgaggctttaaatgataagaactggaaacatgctatggactctgaatacacagccttaatgaagaataaaacttggcaccttgttccagcaaaatcagatagaaatgttatagattgtaaatgggtatacaagattaaaagataagctgatggaagtctagacaggtataaagctagactagttgctaagggctttaaacaaagatatggcatagactatgaagatacattcagtcctgttgttaaagctgctacaataagagttattctgtctattgctgtatctagaggatggagccttcgtcagcttgatgtaagcaatgcttttctgcatg

SEQ ID NO: 47511 - DNA, 1656 bp, Oryza sativa
tggcgcccccaaaaagaccatttcagtggtctatttgcgaaataagtttttcaaaaggacctattaagagtgaaatttggtaagccccgaagacatcatcgacctagagccagtattgtcttcagaatcccggaatcggccgatgagaattatcacgtcgccaatagtcggattccttctatattcggttaaggaaattcatctattaaaggaagcttatccagaagtcaccgagttcaaggaggatgcggcatagcaagctatctattaattaggaatagttttttagtttcctttatctttcagaaagtgtgtttagtgtcttataaatactctaagttttccttttatcttttaggaaagcttctttattttcctacaagtactagtatctccccatggatataaatatgtacacctggggtcattgtaaactatctcgacgatcagtacaatttaagcgcatcgccaccctttttacttttctactttttatcatccgacagaacttggcacctaacgcggggctacatcggctttcgatctccggcgaaggggtaagtcctacgttccgcaggctcaggcaattatatcatctacattggtgtcattcaaggctgcatcagtacatttgacctcttggattgttccggtttggaagacatatttgcttgcctatttatcatataagttaatctagtttggcaactcgatttacttgtatcggctgagattcgctttagggtttatgccggtatcggctaaatcgctttaccaggttagattagctaaggtattcaccactctgaaaattaatcaaaggcttaattttctagactttatgtttcttttcatacttagtgctgcatcagttaagtttgatctaatcagtcatgcttagaatcataaagtctagcctatctttgattataataagggtttcattgggatttcagctgatgagttatctggacattgcatcggtttacaaggattacatataagttggattcaaccgatgataacaaaggtttcattgtttatctaatcttgtggattcaatgtatgctttaaccttcgaatcagtgcttattctatcatattgttagctgattggtttctactggattatactattgttatatcatattattatcagtcgattgtctttgtttacctcaagtgtcagattctatatcaaatatatagctgatagcttaaaaccctatcgttatcggctggtatcgtcatcggctggactactccatcgccttatcagccgatcggctcattaatctgctatttatatatcttgtcaattgcaggaccaaactgactggtacgtccgcatctcaccaaccttgggaactgcactggagctaagtagatctcttaggccgttgtgttcatcaacttagttcgcgccaacacagacttgacaccattcgtcaagcacggatttttcgtcaacaggaccaaattgtaaaaaaattcagcaatgtgattgtgtgaatctgaccatagttcctcctgccgcaacaccgcacgagcacaacacaagtacacaactagtaaaggcagcgcccaagcgtccttattttgatcggaaaagctaaatggcgcaaacgtggccaccctgcaccagctcgcttgcta

SEQ ID NO: 47512 - DNA, 4901 bp, Oryza sativa
agaggggagggaaccagaccatacggacgaaaaaaaagtgacgaaaggaaaaatacgaatcttttaataagttaagattaagataagatatattattattaggtaggtatatatgtactatggggtgttcttgtggtgtacgtattagggcgtgatctgagcgtagtggacctgaacgtgacatgggctttttttttttgggaaacatgacatggggctattaaggaggaatcggacagaaaaaatcgtaaactacacgcggagggaatcggattaaaaaatcgcaacaatcacgctatatacgggagggaatcggactaaaaaatcactcgggacgatgtacgaaaattcatgggcaaaaacatcttaaacttttataataggaaaagatttaatgataaaacaaatcacagtaaaataattaatacttatgtacttatactacatttattgataaaataaatcacaaaataattgaatcctaacgttcacaggcctctcatttaagcatcaaagatttccaaataattaagaatttttggggaaaaaaagtggcatgaatcgaacaatccccgccttgcatctcttatttacctccaagcagctagccaagtctagtttttctccctcttatcttgccccaacacctccccttcctccctctcccgtgggcctcttggcccgagaggcccagcccgcccgtctgtttttgtccctccctcgttgccaagtggccctcgctacagtgtcgtcttcaagctcgcgacaagaccggactctgccatggccgccatctcctcctctaaaaccgacgcagccattgccccctaattaaatccgagcccaaaaaggaatcccctcaaacacctcttccttttggactcggaatagacgcaagagagcgaactgggagttttttttttctccaagtcgttgatgaatcagacttttttttctttttatatgtttgaatcggactaaaaaattgggacgacgtacgaaaatctaagggcaaaaatatcttaaacttttataataggtaaagatttccagccaaaacggaaagagaaatattggttaaagacaagtttgcccatgggcccacttgtcaatccctctttctctctctctttctctgctcatcttcctcccgcgtccccggggtgtggcgctgcgacgaggcgtggaagctgtacgaggctgaggacgagaacgacccgttcgacgtcatacactcggagagcgtgccgtgttccaccgctgggtgcgtggcgtgcccgacctggtcgtgtcgtggcacggcatctccctcgtggcgctgcactcagggatataccaggacctcacccggcccgcggcgacgacgagcgcatgtcgccggcgtccaaccacaacctggcccagtcggtgaactggtgctgtctgaggtgcgcttcttccggagctatgcgcaccacgtggccatcagcgacgtcgcgagggagatgttgcgcgacatgtaccagatccccaaccgcgtgcacgtcatcctcaacagcgtcgacgaggcgcagttcgagcccgacggcgctgggccgcgcgttccgggaggacctcacgctgctcaagggcgccaacctggtgctcggtgtcacaccctgaaaaattcaaaatatataaatggttgtttaattggaatttttagaaatgattttaaaagccttgaaaagaagatctaatttttaattaataaattccaatataaaatggggccagataaaatttcattaaatactttgcttaactctataattcctagatttttctgggatttatttgagctaaggaagtatttttaataaatggaattgcatttcatgaataattttaattgaaaaaggttttagaagtcttcttttggctttgggccgaaagtcggcccaaaaccgctctctctctctctcctcggcccagtccggcccaatccgcagccgcctgcgcccgcgcgttcgctcgctgacaggtgggtcccgcttgtcggagtcgtcgtcttctttcgcccgccgccaccttcgccttcgcctctcgtcgtccgtagcgccctagcgtcgtgtgcccttgcgccgccgtcgccgccgtcgctccagccgtgcgccgccgccgttccagacgtcgccgtcgctcgggaagaccgtcgtcgtggtcgccaagtcgtcgccgtcctcgtccgccccttcgccgtcgctgtagaccgccggagcaccgtcgccgtcgtcaagccgaagagcgccgccgcttcttcttcgtcgccgtcgccgttcgttcctcttccgccgtcgctttggtcgccggtgagttcgccgtgccgtccgctacccgttggtgccctccgttcgtgccgaagcgccgccgttcgccggcgagcgtgcgccgtccgagccgccgagccgccgccgctggtggtgacgtcatcgtcgacgtcatcgtcgccctctcccgtgagccggtcgtggaccgttcgatctcggtcgtccgttttggatcaagtcgatctcggccgtccgttcgcgtgaaccgccgccgtgcgcccggtccaccgaaaccctagtccgctgacgcaataaatccctttttccttttcaaaaataattcattattgcgtcataattcaattaaaatcaatataagtgttttaatccgaattaatcttcaaaaattcataactaattcatcttagctcggatttagttggttcaagtctctaaatttttctaaaattgagatctacatgttaaaaatatccacatgtactgttcatgcttgtttatgtgctgttttggtgttttttctcttttctgtttagattccgtcgtttccggagagtccgttttcgtcggagaagaatttgaagagttccaaggccagcaaggcaagtcacacagatcccaaacaaccctttgagcatgttgatcccgtttaaagctattgtttcttttcaactactgcatttattttcgaatgtcattgggtggaattaacctattgtttgttatagcccttttgttcttgattactttattccttgataccttgggttattataatttgactagttgagctttatgtatattggttcaactagatattagatataattgcttagccctgcttagaaacattagctcactattgggataacttatgactcactgttatttaatgatggcttaatgatagttcacgatggtcaatcgtgattagttaattaattaatgtgccaactaaaacctggtaatggtgggttgtgagcacatggttttgagagtcgtgctcatgacaattaaggaccggttcacgagtttcggttgtgaaacattaaccgtgctagccacaagccagcgtgggcaacggctttatcttttgtatagcatggttcattgcggggcaccagactgagaagtggcggagataagcccacgggggtcgctggggagtccatgccttgtttataagggggtgattatgatccaggaatggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcaccctctcatcataataaatgctttaattggtaataattttattagctcctggtttggaatggaatattcctggtttggagatagaactgtacagccgggatggttgttcagaatggttgggcctatgcaacagggtatgttgtatagcgttggatcaatattgtttaattacttaactgttttattacatactcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaatagttctacagtgaagctgatggtgtggaggattaggtgtagccttggtcaagctgcctgtggagtggagccgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagccaggttgaccctaggttatgccaaatggttatccatagaagccctctaaaaatattggaaaagtagaactgttctcctccctttctcttttaattaaactaaactaatggcacatgcacttcataatctcttttaatggttctcattcaaaatttattccagtgttattagtactgtacatctattaccgtactaatggctcattttaccagcaaaagttttacaatattgctttatttaatcttgctgcaacaaaataaatttagcatgttgattttataactttctttcatttcttttgaaatctgttattcaaaagtacaaaacttgtgaccttgtttccaactgtttcaacttatcttgcaagcttggtttactttatttacttacctttttactttgatttctaaactttattcaaattaatccaaaaacttgtgctattaattggataaatgtcttaactccctcctttcacttgtctttagatgcggcgttacaagcctgagtacttgtttggtgttgagggatttatccaggagttgcgtacgatg

SEQ ID NO: 47513 - DNA, 1223 bp, Oryza sativa
aaaagaaaaaaaaagaaaaagcggcgtcaggacgacggatcggcgcctcggcggcggctgcggttgatacggaggagatcgcggcagcggttgagacttgagaggaaggcggacggatcaagacaccgctcggccgttttcttttcgctgattccggatcgcatcgatcgagtcgcgcgacggtggtgtgcggactgcggaggaggagcgcgtagttccgattttctgatccacacatgtgcttacatgcaaaaatttcgcgattcccagcgacacgaaatattaacagaattcatttggtttagataagccatacgcgtgcgacggcgccgaatctatccaccaagataattaaactaatctccagattatttctcatccaagcctgcttccctcctctataaattgactccaccccggccgaggtttcctcacccatctcatcaacgccttcttgctctctatctctctctttttcggcatccttcttagtattggcaaaagctcgttgtcgtgctccggccatgaagacgacgatggcggcggcggcgacctgcctcgtggcgctgctggtggtggtgctcgcggaggcggccggcgtgggctgcaccaccgtcgcctacaatgaccgcagcctggtgatcgacggcgagcggcgcatcatcatttcaggatctatccattacccgaggagcaccccggaggtataatgaaaattagctatggatatattgatcgctatgcgcatgcatgcatgcatgcaaaaatacgtgtgattgtggtaggtcttagccgtcttttgatattgcatgtacatgagatgagattagtacgtgcgattttggttttgttcttcatatatatgctatacaccaatctcaaaggatcgcataaaatctaacagtagccgtcatttatatctactgtaattatttcttatagatcacatttatatctactctagatgtctacaaatttatattctctcagtttttctagtcatacacccgcgcacatcattattctttttttcaccagttgcttggctcataacatcgttatacatatggtcgaatatgactaacagtacgtatttacttaagtagattaatcttcgcatcatactttcacagtacgtataatatcctactagcgatcgatcgactatgatagaatatatgactaacagtacgtatttacttaattagatgaatcttcgcatc

SEQ ID NO: 47514 - DNA, 1109 bp, Oryza sativa
ggcaatcctaattaagcaattggtctctctgggctgccattaattaatctcatcctgaagcctatgttctattcttatattcttagtagtatcttgaacacaaaattcagatagaacttcactaatttctttttgttctatagctactagagttgactggttgagataggagctttaagtgaataggttccttctcagttcttacgatatgtacgtagttaattagtatctctacatcacaatcttcttggttgagtcattcctcttgcagtcttaacactaacagatgacgtgctctttaatttataggggacatataagatattataaacttaaatagtttcaatatttgatgtattccttgtatagcgtttatactattcaattatcaccaaacgttactttgtgcttaatgatgtcttaaagttcaacattttttcctatttaaaataaaaaaaatattttacatatatatttactagctactagtattgtagggccctttatttttgtctcgtactaggcctcaaaatttcatgactagccaatgatacacgtatatttatcatgtttccctctggtgcagatgtggcctgatctgattaagaaagcaaaggaaggtggccttgacgcgatcgagacctacgtcttctggaacggccatgagccccatcgccgccaggttagttctgtctccgataaaatatgtatactgctttagctgttactgctatttatttagtaagtaatcgaatatgtaaatccacagtaaatattttacgatttaaaactaagcttatgtaattcaaagcaaggctgttccccatgtatataccccatgtatatacggaggagtactatttatttagtaagtaatcgaatatgtaaatctacagtaaatattgattaaaactaagcttatgtaattcaaaacaaggctgttccccatgtatattatttagatgaattaagcttagtttatacatccttatattccaggctgttccccatgtatattatttagatgaattaagcttagtttatacatccttatattccttgcgtatagatcgcagtatcgctacttgtagcttattttgcaaacccga

SEQ ID NO: 47515 - DNA, 4734 bp, Oryza sativa
cctatacagccaggtcaagctataactaggcgtcgagactaagccgatggtcaaatcaatggccttagccgattcgacatagcccttggtgccaggttatagcagggcttgcctgtataggtagcagatacacatgcaacgatttaagaaacaagcatatcagataagatcggtgaaaccccgatactacccctagaactgaccaaaaacaggctatacccctatggttctaatcacgacttagcagatcaaacctaactgatgtagcactaagtatgaaaagaaacacaagatatagacaatcaagctgtcggtcagtagtcagggttgtagataccctggctaatctaatatggtaggacgatttagccgataccagcatcaaccctaaagcgaatatcagccgatacgggtaaattgggctaccaagctagattagacaggatataagataaaaccaagcaagcatgtaaaccaaaccagtgtgatccaagagatctagtgtaatgatgcagccttgaacaacgccgatgtagtcgacatgattgcttgggccggcggaacgtaggacttacctcttcgccggagatcgaagccaatgcagccccgcgtcaggtgccaagttctgccggaacgtaaaacgaaagtaaaagtaaaagggtgacgatgcaccgaagttgtattggactgtctcccctattacagtgctagggggttaacatttataccctgggtacaagaaaagtccattatggacacgacccaaaaccttccaaattctagatacaaacaagaccggccatttacgacggtttcttaccaaaactaatcaaaccgacgtaactaacctatttaacctatttaatagatacaattgccttcaaatgagctctatctctatttggtaatgacggttattccaaattgggcctacccgagcccgagtcgcactgtgctggctggcccaatcatcggccgactcagtcagtcctggtcgttggcctttgttctcagccgatatggttcctggccaatgcatagttcaattcggatcccagcatacttcgacatcaaatctatcctgatttccttctttcttcctgagttctgctgccagattacaccgttaacagatactccctccgggctgataatacttgtcgttttagacaagggtgaggtcaaactttagaatctttgattatgaatcattttttaaatatttgtctttcaaatatggtgactacatgtatagattactcttaaaaaatactttaataaaatcatatatttgttaacacttttatacatattataatataaaataatggtcaaagttgtttttaaaagaccgtgtacttttccaaaacgacaagtattattaacccggagggagtatatatacatgtattctataacattgatatatatatatatatatatatatatatatatatatatatatatatatatatgtattggagattatcttgtttacaaatgaaaaaggtttgacacagatagctatcataaattaattaaagaagagagttacccgtgccattagagtattagactctgccgacagtccatgaaggggtcaccaggtaaccatcacttggtacccacaggtcacaggaaagttggacaaatgtgtgcccaccctgctgccaacatgcttcttgtttaaattcacttgcaattatggcccagaaatcatcaactgattcccatatcttctcctttatgacctagctagcttgaaaaaaaaaatctccaaagtaaactccacccaagtttccatcaatcaatcaatgagatttaatttatgcaccattatttctttttgtacaacccaaattgcaccactgaattaaacaagaaccacataaatttccctcatctcattagtgctaacataagatactagtttaatcttagatattttgttccttcatatccaaatccatccacacaaggggcagctttgcctcatgtccaaatcacgtctccatcttcttctatctcatccatctataaggatggctcgtatcatcctcactctctctgcacactgcttctcgctcccgctctgaacttaacgctgcaaaaaaaatcttggagtgtataactgtgtaagctttgctcaatggcggaggagaacaagtccggctccggcgacctgatggcgagcggcaaggtggtcgcggaggcgaccatgtcggtgttccagcagaagagcgtggagggcgtcgacaagaaggaggtcgccggcgccgccgcggacctgctgcactcggcgtccacctacggcaagctcgacgacaagccggtcgggcagtacatcgacaaggcggaggggtacctcaaggacttcagctccggcagtggcggcgccgcaccgccaccgccggcagccggagacgccgcagcgccgaagccagcggcggaggagccgcccaaggagcctgcgccggctgagaaggaggaaggcaagccaccgtcgtcgtcggaagggttcggtctcgacgacgtcatgaagggggccgagtcgctgatggagaagaagggcggcggggaggagagcgccggcagcggcggcgccgccggtgggctgttcaagatggcgcagggtttcatgaagtaggagagctctttggctggatatatagctgcatgcatgcttgtctctggattgtggctctgctttaatttgcttgttaattaactgatgatctgtatgatgttttgtaaatgtctctcagctctgttgttaattttgtgtggtgaataataagaagacagctactttgtgtgtataaagcctgtttttctccgtgaataaactaattctaatctactaattaattcattcactacttaatattcttatgatagttcaagacttatggggagacgagatggataaattatgtggctatgtttttgtttgggctgttgccaatgtcaaacttgtcaaacatatcggtatactagagatttagtagtacctcaaaatagagaaaaaaaattgttatggtacatccaaaatttacaatctttaataatggactagaattgaaacctccaataaaatactaatttttttctcccaaaaagtcgatagcttcgagcttcaatccctctactatttatacccacaacgtggctgcccctagccacgaatccaactagaactaggactcctaatcacataggaaacctaccaaaccagggaaacaacatccccatacaattccacgttccaatcttttcaaacttggactccaatccaaatttgactactctttccatacgcacacaacacaacatgtatgtcatatggaaaccttcacctccacgtgcattgttctctaatccgagcatcatgtgtgacatcctagcctagggtttaatatgattaatagaatacccataacaataagttacgacttctttttcagaagccaatcaccaaagaactttgaggttaagcgtgcttggcgcaattttgggatgtgtgaccgcttaataggattaatagaatacccatactaacaagttgaaaatttttcccgggtgcgcacgagtaaagacaaagtgggtgaccgcttaataggattaatagaacactcataccaacaggctgaaaattcttcccgggtgcgcatgagtgaggacaaagtatgtgagggcagtctatatcctagaaaaactatcagatgtaagtgggcctggcctgggagaggttctacgaaaacaacgcgaaactttttccctggtgcgcacgagtgaggacaaagtgtgtgagggcagtctatatcctggaaaagctatcagatgtaagtgggcccggcctgggagacattctacgaaaacaacgcgaaactgatgtgagaaattctacgaaaacaacacgaaactgactcacatcaggagtttgccggtctgaccattgggctacccggtcaagcactaacaccaccggtttgactggccactagagccgacaaccgaaaacacatcacactgcattttcaccaaacaattgttcatcaccaggattaatcatcacatgattttatattggcctctccatcactcatatagattcattagcatctatatgaatttggagatatatacaaaggacataatggatccatgcaagaaattattccaaatccaaaacatgtttgttgtcgaaacgacgaccgcatacgtcgaaagacgtggttactcaacagtggttggaaaaacgaagtgtattaaattttgaatttcccttgggatcttcccccgttacatggccctagggggctatttatatccccattacaggttcttactactagggtttaggttatacaggggaatttacatgattacccttatgaaagggacatttacaggggtacatgatgatataggggctcatgggcccttgatgggccgtctggcgatcgccggccctattgcccctaggcttgatgggccggaaaggcttctttggccctcgcgggggcaaacttgccaaggcgaagtcatcttccttcggcagatagtcttcgccttgcacccttggcctgagacacctctggcctggcaaggcacttcgcacgactcttcgcctcacgccgttcttgctccatagccttcgccatgggtttcggcagatttggtcgaagggcctcatgccatccgccaacaagcccctcacgggcaagggtgaga

SEQ ID NO: 47516 - DNA, 5566 bp, Oryza sativa
atatatatatatatatatatatatatatatatatatatatatatatatatatatatatatatatatatatatatatatatataggacactcatatggggcaccatggtgcccgggcaccatggtgcccgggcaccatggtttcaaatgcacaaaatcactcaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaatgtagttaatattaatacctaaataattgaaaaagtttcatgctcatttgaattgggtatatactcaatttcaacaatggtgcccgggcaccatggagcaccaaacaaatttactatatatatatatgtatatatatatatatatatatattatatatatttttttatatatatattttcttttcctgggccgaaaggaacagtattgggctttcccttcgtgggcttttactgcgccgcttggacggtgggaagttaccgtttcgcctacccttgcgacacgtggcgctttattactggtgggtaggcgaacggtcgcccgagtgagctatatattcccaccgacctttccttttcaccgccacacttgccattttaccgcgtgcgctctcttcctccgtttctttcttccacagcatctctcgacccctcaagtgtttcgcccattctctttcttcgccaccgcaaacgcaccgttcaccatggcccctcgcaagccaaaccgtgcttcggctaaagggccggatcccggccgagtcgatgacgacagcaccgcctttctgggggtctctcttgtggacgacgtcgagctggcgaagctggtccgctctggggcgttggttgaggggcaggctttcgccccagggaaagccgtggtgccgaaacctatcgacaatcggacggtggtattcgccgtcttttttgaggctgggctacggttcccctgcaacgtgttgttgccggagatccttcgcctcttccaggtggaacttccacagctgagcccatcggcgcttgtttgggtcgctatcttcgactgggcgcgccggacttccgggtttgagcctaacgccgagctcttcggcgccatatttttcgccaccgtgaactcgaaaacggtgattaccccggctcgaacgaagaagacagtgttcgggagtgtgaattcaacgttcgtcccgagcggttcgatctttggccagtgaacgctgtcatgtcgaagtgggaccgccattggatagccaggtgcttctatcattccatccccttcgaggctagttctgacgcggcgaaagccctccggtgccggcgtagggcgatcgcaccgaactggaaacccaagatcgccgtggacggcactatggaggctcggttcgttctgctgcgcaaggtttgctcccgccttagctgccgtgacttggtggaggaattctgtatgcttcgcatctttcccctctcccagtcatggcaagtcacggttgatcaaggcgaagaggtcgacggtttgccgaacctgatacttcctgagggggcgaacagtaagactgttcttttgctatatactactgtgctttgttatttcgccttatctgacttttgacatagcctcacactctaattttgcagtgttgatccttgaccaggttgaaaccgaagcccgcaggatgatcggcgatgtgtcaatcgttgagtatagccagctgctaacacgacaagcggctgggcgggcgaaccgggtttacaacggcgaattgcctcctcgagcaaacccccacaaagccgacgatgatgcagggccttcacggaagcgaatgcgcggacaagtgaagcttgcccccaggaaacgaagggctcctgcttcgtcggactccgatgccgacgacgaggacgatgccgaagaacgcgacggcgagggggaagcagaggaggaggaggaggccgtggccgataaggccgcgaacgaggcggtcggagaccgcgtcgacaccctcggctacactcctaccccaagtccaggtcccaacgagaccggggtggagtcgaacagctccccccttcgacggaaggatttggaaggggcgaaggccctagttgcgttctcctcaggcaaggcagcgaagggaggtccggtgcagaagatctctaaaaaggaaagactcgtcgacatcgcccgcgttttcagcgacgacgaatcttctgacgggactccaacttcgcccgctggccgcagtttagacctttcgactgctcccctcgctccgctcagcgttgctggggcaggcggtaatgccgccgccggggcttcagcctccgccgaacggatcgtgtcggctgcggcgagggtcttcgggagccctctgcgtgagccagctatttcgccgctagtcaaggcgaaggggaagtgtgcggccgccgaagcatctgtctctgagtattcccttgcggcgccccacttcgcccctggtgatttcgagactcgggcgaaccttgttccctttgtggagggagtgagcaaccttgtcttgcccgtcggcaccccgagcttgttcaccgaacttaatgagttcgacgaggggtgttccgccattaaaagcctagcggttcgggtacgccttttcttccttcttcgttttcctcttcgtccccccttttttttacgtctgacaattaaccttttgttcttttggcccgctcctatctttcatctagattcttgcggctcactgtttgacggagcgaaccgtacgggcccgttttgacggttttaagagccgtctttgggccaaggacgacgaaataagccgcaagaacctggaggtggaggccctgaccaacaccctcaaggaaacgaagaccgaggtcaaacgccttcagtctgagctggataaggggaaagaggccagggctgaggttgatcgcctcaaggccgaactggagaaggagaaggcccattcgacagtgttgattgactactacaaccttatgagccgaagatggaggctcttcgcctgaaggctagtacggccgaagcgagcgccgcggaggagtcgcagcggttttcacaggagatggcgaagaccaccgaatccgcgagaactgcttgtcaaacgctccgcctcgcccttaccgacatgggcgcgaaagtgcgaggggttcctgccgaggatgcatcagccttcgacttctccgagtggacccagcaggctggcggatcggtttcggactgcgccatcgcgtacggcgattgctgtgcgcgtgtatcagcggccttcaccttaggccttttgcaacattttggctacgagcacgtcgccgagttccctacctatgcgaagggggactgggagattagtgcgcagaacatttcgcccgctcttcacgcgtggcgaaaacagttttggcagaaggacggccggtccgctgccaaggcgcgccttctggagcaactagcgaaggcggaggcggcagaccggcgcgaaggagaggacgcagcgggcgaagagggtggaggcaatgcccaggatcacccagaggtgtgaggccctccgccctttccttagatttttgtagttttcctccatcttttgcatttgcctggagaggcgaatgatgtacattcggcaggctgccgccaaaccttaaaagaggcttttctgtatatttggaatatatgacaccatcctaattactttttgatgatcgaagtctttggcgtattattatcttgcccatttcgctttatgccacaccttccctttccttcgcctattcttactatgtaaactgtgttttgccttttctgcactgtctaacagggggttcgccgaaagtcgtgcattcagcccccttccgggagctggcaaagtcgaaacgagaaatttgtggcattgaagggtctgccgaaggtgcgatgtccatttcggcctgtttatcgcgaaatggagataaacggtcgcagctacaaggttttcaaggttgccaactggctgcgggcgcaccccgggcgaaccttagaagattacgatcttgttcattcaagacgtttggaggatatggctcgcttttggcgaaaccatcagaagactaaacgtcaggaaatgatctttcagcgtcgttatagtttagtctgtgtttcgccgcctactactcttaaggttgtgtatgatattagtagtgaagacgaacctagttcgcctgtccattccttagggagggatagtgattatgggggcgaagatgtaatttacttgtaaggtgaattgtatcgtgttgtaaaccttctattcttcgattattttttcgaagttaataaagatgtgttttatttccttttcgctattctttcgcatcgtcacattccgtgcttttgttaggtcggaacatgtcggcccctttgcgtatattagcgaaataggtgtactgatttttcagcttttcgtcgttcattttcgatctatagcattctgtgttgaaagaaacgcttttgcttttatgtcgatcgaacgtaacgccgttcggctagttaggacacagaggttttatactggtttgggcctccatggtggataatagccctacatccagttttttttttctttttgcactctttcttcttttttttcttgccgaaaggctttcatagtgccaaagggcttacatagtgccgaagggcttacatgacagtatgtacatttttacaagttggcgatttgggtgccacccattctagacatagaagcgcttgagacaggtggcgttccaggaatggtcgaactcctcgcctttgagtgtcgttaggcaaaaagatcccgtcctagacttgtgtttgataaggtatggtccttcccgctttgattcaagcatgccaaccgctactgggttcgccttcttccttaggacgagatgaccaggcatcagctccatgggtcgaacttttttgttgtaagttgccgaagtgcttgtggcatacttgtgcatgtgctccagcgcttcgactcttactccttccaagagtttgagcgatacttcgcgtccctcttcgcccccagagaacatcacccttggtgagttagcccctagctctgctggggtcattgcctcatcgccataaagaagcataaacgggctaaacttggttggtcttgtgggggtcgttcgaagggcccagagaaccgatagcaattcctctggccatttgcctttcgctgccccctcgagtcttttctttagtgcttctaggatcttgccatttgtacgttcggccgccccatttgactgcgggtgtgcgaccgacgcgaacctgatttccaggttaagcccttcgcacatttctctggacttatcagagtcaaactgcttgccgttgtcagtaatgaattcttttggcactctgaaacgacaaacaatg

SEQ ID NO: 47517 - DNA, 12373 bp, Oryza sativa
ggaaagaaggcttttctggatgctcttgaatgcagagaaatgcggcccgattggccaaaggcctgctaccggcttggtgctgctctgatgaccctgaaggtgcaatagaagatccttttggctagttttttgaccaatgcaaagtgttttaaataattcacaaggccttcatcatcaggacttcgagagcgcgtgcgatgcactttttgatggattcaagttggacccggacaatgcagagattgagcgtgcattacggtatacataatactcttttgcattgttgcatgcatgtttcagcacatctcactgttagttatatattggaaacgtgttattttgatttctcttatgtgcttactttaggatgggaattttacagttgctcttgcttcctaaaatcttcatctatgctatctatttgctagatttgtgccatatcctgtttttgtatccttcaattggtaggggttgattcataacatgccatccattacattggtccacacaacaccatttacatgcatagagtattaaatatagataaattaaaaaactaattgcacagttaggggggaaatcatcgtgagatgaatcttttgagcctaattagtccatgattagccataagtgctatagtaaccccacatttggtaatgacggattaattaggctcaaaagattcgtctcgtggtttccagatgagttatgaaattagttttttcattcgtgtccgaaaaccccttccgacatgcggtcaaacgtccgatgtgacacccaaaaattttcttttcacgaactaaacaggcccaagctttctaggctgaaaaggaaagggaaaaaaaagtcaaaatagaactatggaacacaaaatggtgatctgtggcccaaatgatgtagatggatgctattccctgtattgcttcttaccgatgttcttctgtacttatgtggaatgccaatgttgttcatggcatgaactgaattatcccttcaatcagaagtttcatgttttattatacaaaaaggggtaccattacatgtgaccatattgtgatcagtcacgcatctgtgcctaaagacgtacagtacaccattatccaacactgattgtggctgtgatgtgcagggaagctatggaatctctgaagatatcatctaaaggcaccaaggcaacatgaactctgcccttatgttgagacacatctcgtgaatcagatgtgtggatcgcgtcctctttttctagtcaagtagtgaccgcagaaatgcttactgcgaagcatttcccatgtttccgagggcgaaaatatagcgaagttgcttttgtgcattacccaatgtgtcgccactgcttctcgtttgttatcttttgtgcatccgaggtggtaatgtttagtactagcaaatttttgtttctggcttgatttttgctgtgaagcgtctgcccgtatacgtcggtcataaacactgtcggtggtgggtgtgttaatgagggaaggccgcctcatgtagtcatgtgccgccgcctaagctgctcctcgcggctcttttacatggaccgctgaccgggttcggcagtgcgatcgattaggaataaaagttttatgtatactagaagtataagcgcggcgtcatatagagttaatacgaagcatataatataagtatatggtgtacggtacagaaaaatgttgtacaataaattagtagaaatacagaacacattgcagctcgttttgcccgcaaatggaaataacataattttgaatttactcatgttcccgagttccggcggtataactccagtaagtttgttctcatgtaaatatctgaagagaaaaatgacagtaagtgctatagaagagaacttactttcagaaaactgaaaatgcatagtaagatgcacttactttcttctcttcttcttctccttgtaccgtgtaagagcattatctctgctgcctccagcagatgaactttcaggaccaggaggatgccagggtggctcacccataaggatcattgacaataccccacaatcttaaaatctccagcactactttcaccagtcaaaccagagaaggaaagggatatgctggacatagccttcctaccaggaatacaatggctggaatcagcccttgcagctgggtttgacatcccagtatcaacagatgcgacattgttacattctggctggtgcacaggtttgggctgctgaaagtacaagaatttgacaaaacttgaacattcagagtcagatttgctgataagatgaacgaaaccttaaaaaaaatgacagtaagtcatggcctttgaacaaacaatatcatcagaaagggatactccaacaacagaacctggagcccctaaattcaacaattatacaaggctaaaaaaatcattccaatttcaaccaaacttccaattttaacgtgaactaaacacacccttcgtcaacctctgaaaggggacatgaaaacaagcagtcatgtacgaacataaaaatcaccagaagagttgatctgagcttctctgcccaacaagaaaaattcaagaaattggtactgcacgaaataaatgctaacataagttctaaattccaactgacattaatgaatctggagcccagaaaattcagaacacaaaacgtagtacatacatgaaccttgtctagtagtaaagtgtaaagttcagaatgtccatcgatccagttgaacaaaaaaaaatcaaactcataaacggcgctgaggtagtagtatgtgtataaaaaagaaaataaaacctgtggaagagatatcagatatagcacctgtaaacttggtccatgaaataaaaacacaactttcctgcagaaaaattggacatacagacatacagtaagccaacgaaaaaaccaggacaacacgtagaaccaatcggggcagcaaaaattaagagatttgctgccgttcgaagaaggaaaatttagtcgaacaaaattcagaatcaaccaccgctgacgcattgacaggtaaaaaaaaaaagaacagtggattctctgaagaacacaaaagaaagattcctgcagagtataggcggatgtgcttgctccagatatgcaccatatgcaacacaactcccagttgcttgatgccctccttcctgcacataacagcaaacttgccaactgcgttcatcacatgctccgcgcacctatagaggaaaaaccattcagatgaggaagaaagggtcaggacacggaaagtgcaaaaaaatcagatcttgtcaatcaaacaaaacaacagaaaaacaaacactttcctctgctccatccaacggcacattctgggcaagggcgttgacgtccttcagcggcagactccgtcactatgatgttgagggaggcgcactccagtcgaaggctcggtgctgagccagcccctcgttatctcgcaggttggggaggacacttttgggggtcgttcgagtggtcgaggcaggtgaagtcgtcgtccctttcccactgcggtgctgctccagccggtggggatggggatgagctgacccggagagagaagcggcagaaagcaataggtaggaggagtggtggagaggtagagagcgcggcgcacggagagacgggttgggagggagcccgcggagaggttggagggccgatgtgccttgtcgggttgagggggaaagaagggtgctcgccgtcgcatgcacctcccctcccttgccaatctagggggtcgagatccactcaatccagggggaggcggacgacgaaggcagcgacagagggaggacgcaccacggcgacgacggcggccggcggagcggggcgcagtggggacctccgccaggccaaggtccacctcccccgatctgcacggtgtgggaatggcggcaggaggcatcacttgagaggaggagatgcgggagggcgagcgccggcgctgatgggccgacgacggaggcggattcgaggggaggacaatggtggtggtgcttagggaggtggcgaggacggaggaaggcggtcgacgatggcggcgacggagagagggcgcacaccacgtcggggcgagggaggggggaggggaggcggacgacgaaagcggcgacaggagaggccttaccacggcgaggacggcggccgggcggcagccccaggctggcggcggcgcggggcgtagtggggaggaggtgggaatggggaacgatagggtggggatggagggaagcagatcctacgttagagggacgtacttcgcttcatcagcgtcattccgaatcctacggcgacggcgcgatttcctttttcatcgtccttcggcccagtagctgtccagagttcggcccagttgtcagttgcggaggccgaaggggaaaaacagagcagcgaaaatgaattagaaagtgaaacagagcaacgaaggtgagaaagattagtcatatggcccgcccaaccggcctacaattataatagccaaagtgcccaaccaaacatccccttggtcgctccctctcctcctgtctcctcccgacctccgccgatggcgctgctgcccgacgtccggaggcgagcagccatctgcggatgctccaggaggatcttgatcgtgccggtgtgtagttctccgcggcatcggtgacggctgcggccggacggcatgaggcttcagctccagccagatcgacggtgccctcgccgccgagcctccatggagaccaggtacggggtacgcgcccgcctctagtgctaaggtcgggtctgcgcgacgcgctttggctcggactgaatccatcccgcaatcagtttttgtcccacgtcgcttagagcaaggctaatagtatagcccgctgctggctaatagcccatggctaaagacaattactagtacaatagattgtctattagctagctgcatcttataatcaaataattaattataacatgcacatatcaatatatgtgatcaggagtgaattgtatccttgtagctatttgtgttgtgagatgaactttgttcaccaaacaccaagatcatttcacagatcatgccaaccaagttatctgttgtataaaaattacttcatacaaagcactagtgtttcgtgggcaagaagagctcacgaggaaggagtatatttcctagccggatttttgttgaacggtgtggcgtgagagtttttcaccggccgagtctttcgctgatgcatggacgacgattacgcacggacgatggagatggattcgcgcacggtgggggggaaggggatcgtgcgcctcacgggatcgggctgaggatgtgcgggccccacaaaccgcgttgtttagcgctagggtcgactgctcgcgagcgatacggcgtggagagaagcgctagcgcccggcgacaatttagtcgctcgcttcattctctctcatcctttctctctcatccacataggaaaatgatgatgtggcactgttttggagcccgctgagtcagcctattgtacctgctcttattctcagaacgcgcgacctctttagagcacgtataatagtgagctataagcttactataagcttaggtggaggagagaggtagtgaaaaattaaggatgttggctctcatgcaagagctagcttatcacaagctccaacacaaatgcattaaatgtgtaagtgagagatagagagaggagaagaaaattgtagccaaccttatagctaatctattatatatattggctttaaaataggctaatagtaggaagtgggctctattattatccttgctcttataaacgctagttgattatgtggtgtcgcctccccggagacacccacaccgactagatacaacagtaagatccccaccgtggccacggcttggcggataccttctgctgtaaaaattaaaaatggagcagtcataaggtcccctcccattacggggcacggcaggcgcctgccggttaggctgcatccataatacgttaagatgtcaaatacggcatacatatagtcgggtctcccggtggaggcagcgctagacattagcgctttgctttttgaaattttgtatgatcaaattattatttttccgttgattaattatacaatagcagcaatggaggcctgcattagaaccccctctgcgtttgaattccaatttcctttgcgtttgaattatacttaccagcttaacttatctgaagatgttgtccttttttctttttataattttctcggagtgaatcaaccatgatgccataatgcatgctaacgatggagtgtttaaaatcttgtcttgattgcccctgcaggaccttattgttcagcttctatactcattttgtttctgccactttctagagttaaaccctggctagataggtcttctccatgtctttgtattttaaagcattctaaaactatgctctacctttgttagcacattagtgtgtgcatctgggaatttgggtctaggggtgggcaaaataaaccaaaatcaaaaggcaagcatgccagaaccgagttgctacttgtggagattatggatatcccatatctacacggcgatggtatttggattgaatacaggataccaaatatagatagaatatcttatttgtgtctcgggtttgtctctcaacttgtacatcaaggaaataccttgagacttagtcggttacgactgtattttatctgtatctgcatattccgttagggatatagattatcttttgtaacacggactccttcccatatataaggggggtccgggtgcctctaggggcatatgttgattttctccaaatcatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacagttggcgcgccaggtaggggttgcgtcaagcttttcgccgatcagtgcaatgggttccgtctccggcatcgacgacctcgtcttcccacccgggcagacgtttcggttcggcagcctcgacttcgtcaccaacaacttcggcaagatctctatccttgactcggagtcagaccagtcgggagagaaccggatttcagtcccgtttggactcccaaacgcggctgaaagttacttcaagaccatctcaatcgagttggcttcaaaccactcaggcgagatcgcatcttctccaacaacaccggatcaagatgatggggcttacccaccaatcctgatgaagctccccgacgatttagcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgtcccaccgacatcgtggagtacgacgagtttagctctcgctacaacgacccggatctcgacgacttcgacggaagcctagatgacaactacacccctctctacttcggcgtcttcatggccgataacgagacggaggagcaacgccaagcccgggaaaccgaagcacgtcgcgagactgagcgtcgccgactggaggaggagcgtcaagcacaagaacaagaacggctacggcgtgagcagcaggagcgtgagcggaccgcgaaggaggctgaggatcgacggcagcgagccttggaagcagggcgccgagcgcgtgatttcatcggccaacaagatgttgaagggacaccggttttccgcacccctcaacagaatgcggttgccgcgatcaccctcctcgacaccctccttaaggaaaacgagctcaatcgatctgatcacgtcgtcaacatcttgaaccagacgaagaccatgattgcggcttcggtcccagttaactccgaaagcgtctgcacgccgactggcagccgagtccctcacttccgatctcatgactaccgtcatccaagcctcagcatcaccggcgcaggatccaatcgcaggagcaggggacacgacgagcggtccgttcactcacctcccgaccatcatggggagcgccgagtggaacggcctcgctcaccacctcgtcgccgccccgtcgatcttcgcgacacaatcatacagcgccgagcagctcgaggccatcatcattcgccggaccgccacgacgatgaccttgacggagtagcagccttcaccgacgacctgcgtcgagtggattgaccagccagcttcaagccgactggaatagagaagtatgacggtaccactaacccagaatcgtggcttaccgtctacggtctcgcaatctgcgcagcaggaggagacagcaaggccatggcgaactatttaccagtggctttagcagattccgcccgatcttggctccatggattgccccgtggtacaattggatcttgggccgaattacgcgatcacttcatcgccaacttccaaggcaccttcgagcgtcccggcacacaattcgacctctacaacgttattcagaagtccggagaatcccttcgagattacatccggcgattttctaaacaacgtaacaaaatctccgacatcaccgacgacgttatcatcgccgcattcaccaaagggattcgccacgaacaattggtcggcaagttcgggcgtaagcctcccaggacagtcaagcttatgtttgaaaaagccaacgagtacgccaaagctgaagacgccgtcaccgcatcaaagcagtcgggtcccagttggaagccaaacaagggtacgccggctacgggaggaggtggaagtaacaatcataaggaccgcaagcgtaagcctgaggaacttgttgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaagaactccgacgaagaacaaagcacgtcgaggaagaaggacgacggcgacaccccggcaggatttcaagaccaccgcaaggagctcaaccatatcttcggcggccccctggcttatgagtctaaaaggaaacaaaagttgaccgagcgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcacttaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagtttatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcctgctaccaagatttcaaaaagtggagaaagcgaagccaagactaaaaagattcccctagatccttctgattctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaatgactccgccgattcgcacaagacaggaaggatgcgatcaaggaggaattaaccaagctgttagcggcaggcttcatcaaagaagtccttcatcccgactggctagcaaacccggttctagttcggaagaaaacggggcaatggcgcatgtgtgttgattatactgacctcaacaaatcttgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggagcttactgctatgtcaccatgccgttcggactaaaaaacgcaggagcaacttatcaacgtatgatccagagatgcttctcaacgcagatcggccgcaacgttgaagcctatgtggatgatgtagtcgtcaagaccaagcaaaaggatgatttgatctcagatctagaagaaaccttcgcgagcatccgcgctttcaggatgaaattaaaccctgaaaagtgcaccttcggagtaccgtcagggaagctgcttggttttatggtgtctcatagaggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccagtggggacccgaagcacagaaggccttcgaagatttcaagaaactcctcaccgagccaccagtcttagcctcaccacacccgcaggagccgttgttgctatatgtatcagccacctcccaggttgtgagcacagtcttggtcgttgagcgcgaggaagaaggccatgtccagaaagtccagcgaccgatttactttgtcagcgaggtcctagccgactccaaaacgaggtaccctcaggttcagaagctattatatggtattctaattactaccaggaagctatctcactactttcaaggtcactcggtaacggtggtcacatcatttccactcggtgatatactgcacaaccgcgaagcaaacggacggattgccaagtgggctttggagttgatgtctttggacatatcattcaagccccgaatttcaatcaagtcccaagcgttagctgattttgtcgccgaatggaccgagtgccaggaggatacccccgcggagaaaatggagcactggaccatgcatttcgacggatcaaaacgactttcgggcactggagcaggagtggttttaatttccccaactggagaaagattaagctatgtgctttggatacatttttcggcgtcccacaacgtcgccgagtatgaggcgctccttcatggactgcggattgcaatctccctagggataaagcgtctaatagttcgaggcgattcacaactggtcgtcaaccaagttatgaaagagtggtcctgccttgacgacaacatgatggcatatcgacaagaggtacgcaaattggaagacaagttcgatggactcgagctcagtcacgttcttcgacacaacaatgaagccgccgacagacttgccaactttggatccaagcgcgaggtggcgccctccgatgttttcgtcgaacacctttatacgccgacaggacctcacaaagatactactcaagttgcgggcactcatgacgtagctatggttgaagccgactggcgagagcccctcatacgatttttaacttctcaagaactcccccaagacaaagatgaagccgagcggatttcaaggcggagcaaactttatgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccaatttttcgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattga

SEQ ID NO: 47518 - DNA, 1735 bp, Oryza sativa
ggctaaaaccctatgccggcaaatgggtgaaacagctgccatcagtactttggtctttgcgaactacacccagtcgggccacaggccaatcaccttttttccttgtctatggggcagaagcaatgttgccgagtgaagtcgaattcgagtctttgcgctttcgaaatttccgcgaagaacgatacgaagaggaccgagtggatgacttgcaccgattggaagaagtccgcgaagcggctttgattcagtcggctcgatacttacaagggctgcgacgttatcataatcgcaatgttcgatcccgtgcctttctagtcggcgacctggttttaaggaaaattcaaactacacgagatcggcacaagttatctcctttatgggaagggccatttatcatctctgaagtcacccggccaggttcctatcgactcaagcgcgaagacggtacacttgtcgacaattcttggaacatcgaacatcttcgtcgtttctacgcttaggcttatcattgtacttccctatcttgactgtcaacatcaagttttcttcttgaagttgtcagtcgggggctatcatcataataatggagtgtgattttttatcaatttaatttgcttacttggtctatcattgccttgtttggtttttctacttagtgtgcgaggactgaaagtttttaatagcttctttgggttttaggcttaataaagcttgataaaagcttttaagaaatcaaagacttggctagaattatcaagcacagcataaatacaccagtattgtacaagtatgcctccatttgctacatttatactcagtcagaatcagtcttttcatcatcagatttattactactcggctgaaggtcggcgttgcggaattgatccacaacgtcacttgcaatcttgtcagccgcattttgagcattgctgataagatcaagagcagcctctacgcttgtcccgtctgcaaagccatcaatggcgtcaatttcaattctcgggtacaaggacttggtcatcgccaatgccgtgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcttcttgatcttaccaaccaggacgtcaaattgagcttgagatttgattttgcagtctacaaaacacatttatgataaaaatcagctgcattgaaaagagagaagttcagattgttagctggcagtaccttcaacctccttcaaggccgagtccctttgcgcagccagttctaccttgtctctttccagggcttcaatttgtttctccatttgagccatcctggtggtttgcgctatttgaaatccaaatggttgaggatacagttacaacagcgtaaattaatgggacagatctagagattaccttttgatgaacctctcagctcgaagtttgaatcctggagctgagcaatttggtccctcaattccttctctgtctttttggcgagctccttggcctcgtgtagctggtccctaactgcttcaagagttcccaaatgaggaaccagcttttctaaagttgcggtcttggcctcattacgaagatggattctctgcatgatggttcatggtttagttttgctgaag

SEQ ID NO: 47519 - DNA, 2992 bp, Oryza sativa
tggtatcaagaggtttatacctggaagatgttctaatcttttgcattggacggctagccagttttttcctgggagtggtatgctttgggagtttgtcgggcaagcctttgttcccagatttgctgccatcgtcgccttcgtcgtcgctaagcaccagctttctcttgcgagaacctgtctgcccagttggattggaggtttgaggttgcgggtctgatctgattgttggccctccacctccctgaacggtgtgctggcgaggagaccggcgctgagtgattggggggtcagacttcatcaatacatattcctgaatgagatgcctccacggttagttaactcaacatgaagacaagattatgttttggtcatgggttgaaggtttcagatacatacctgcggaggcggattgaacgcgttatatggcaccactggcagctgatgtgagtagttgacgacaatagcatttgagaagattttatacattctctccttcatgattttaaaatccagagaatctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcaattccaaggcttgggctgcttcatccccaatcggaagagagttccaggtatcttggtacaccggaggaagacaagagtactcgggaagggcaggctcaggattctgaatataaaaccagcttgcatgccaccctttgtttgaggtcttgaagggcatagagaagtacttctggctcagagtccccctcagctgaaatccggcccctccgactacacatggcttactcttgttcggttggggcttgagaaagaagattcggcgaaacagagcgaagtggggcttaattcccaagaaggcttcacaaacatggacgaaattggcgatgtggactatggaatttgggtttaggtgatgcaagctgattccatagaagcttaatatcccgcggaaaaattttgaggtcggaggagcgaagccgccatagaagaaatgggagaagaccacaacctcgtgtgtatcgggggtcggaaaagcctcaccgcacgctggccgccacccgatgatctccttggcagggagaacgccgtgcgccaccatctccttcaggttctcctccgtcacgtcggatggcgcccattggccttcaaagctttccttctcttccgccattgattttacccgaatgcgctgatttgattcgagggatggctaaggagaagtgaggggttgaggcggtggatcacgggaaggattttgatgaacttttcgaaggtggattcgagtggaatggtgaaccctagtttgccggcgcagctctgtactgtagcagggagtggggaaaatggcgagagttccggcggggaagatgaagtgtcgcttggatcttgggatttcttgttaagggtatcggaggtgcaaatgggcttaggcctgaacagtacctcagcccagtacttttgacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttggaatgacttgtttttaccatagccatttccttggtatgttatatgcctgttttcattatggtaaatagtcatagcctaggctattagacttattcattaccataatttttataatttttggtgggtaatctttagagttttatattcggatgcccgtcaagtgtgttcattcgtgaaccttttagagtgctaatcactcggattccttttattatggctaaaaagcagttggctagaatgcccctttaggcgccacgtatgcttttgtcatacgatgcacgattgtgctattattttgttctcaactatatgtttagtctgttaactaatcacatagttgggggctacacctaattaggtgcatctattcgatgcaccatattctttatcttttcgccctttacagtctttgtcttcgctactcggcagatcttggcatgaaaggtttgaagcactcggattattatctttgagaaggctatgatggttgactgcaaaggtctcgggggctactgtggagattatggatatcccatatctacacggcgatggtatttggattgaatacaggataccaaatatagatagaatatcttatttgtgtctcgggtttgtctctcaacttgtacatcaaggaaataccttgagacttagtcggttacgactgtattttatctgtatctgcatattccgttagggatatagattatcttttgtaacacggactccttcccatatataaggggggtccgggtgcctctaggggcatatgttgattttctccaaatcatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacactactgacattgactgggtgaaaattaatatcttcaggctggaaattacttagttggttatgaagtgaaaatttgtggcatttgcttgaatctgaggttcttttgtcgagggtgagcttctttgcttctcaaggatctgatgttgcacaggtgacaaggcaaatgttcttgggttatgcaagcggactgctgatgacgtccttgtaaaatcaaaggtgtttttgattattattctgtgatgaacaattggg

SEQ ID NO: 47520 - DNA, 11168 bp, Oryza sativa
cttgtactagtatgagtttaggactcttagtatgagtttggttcgtggctttaggctgcctacctcatgtataaatagagggggagcgtgaggcttcccggtatcgctttagagagcaattgagttgagtttggagttagggtttcgagtttagtcgaaatttttgtaaggagtgctattggtgcactttgtaagcacagagagaatcaataaagttgtcatctactttaagagttcttcgatttgtgtttcaccgggtttcggcggtctaaccggcaactcaccggcggtcagaccggcggcattgcggcggtcagaccggcgggagcacagcggtcagaccggcggcgacgacagcgagcggcaggcgatctcggcggttagaccggtagatcaacaccggtcagaccagctaatctacttcggtcagaccgatttcatcgaaattaagggtaacttttatttccgctaaaagtttttggtttttgggtataccaatcattcaccccccctctggttggcttagttcttgtgattcgttcctacaagtggtatcagagccttgttttcttctttggatttttatcgatctagagtttttgccatggctactcccgcaaggttttcaactaagcctcatgttttcgatggaacggatttttctcattggtgtagtaggatgcaatcttatattatggctgaagattatgatatttggagaaaagtttctcatccttattgtcgaaacatgataatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgttaagtagcagcaatagagtttgctggttccgaagataataaagatgaagtcgctccaccatgatgacaaagttgtgttgccgtgatgaagtgaaccggtagtgaagacgcgcagttgtgaagataaaagcactagtcggcggcggcataacacgagtcggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggcaaatgtaggcagcttgtgttgaagatactgatgcctattagtagtgacagcgatgtagccagtcgtgaagaagatagcatcagttggcgttataacaggccagccgtgcaggcgatgacaccactcggcggcggatgcggcggccggtcggtgaagacgcagacgcccaacaacggcagcataataggccagccgtgcaggcgggaacaccagtcggcggcggtcgaggtggccggtcggtgacgacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcatatgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggaccccacctaagacatcttctccaaagcttctcttactgaagaggggaaagattgagcaagaatgagtacaaccacagtactcagcaggccacaccggagatgcacaattaatgcaaaggagtacaaggggataataacatagaggttaagttttgcagtagacggcatttaaaagtcacttagttgcccaaagctattttgtaaagacgatcctagctatacaatattattaaccaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgatatagtttccaacccatcctagccatagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttataactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttataaaaaccacctaatgttgcctaattaatcagcgaagcatctacctacattcatactagtggaaccatgaatagagtacccactagttggggttttgtttaatctagggtgaacaaggtaataatatcaataacaatagtattaaggtcataacaaaggtaaatgggcatggctaaataaaacagtgatcacgcgggaatttaaataaagcgataatgcaataatttaaatcaaaataattttataaactgggattcaacatgttcaaggatgatgtgacttgccttgctcagagagaacagccttccgaaccttcggcgacaaccgcgaaccacgcttcgggaacctccggaacgacgaaagctacgcgaagcacacaagcaaagctacaagcctataaagaagcaataacaacacataaaaagaaagcacagggttctttaggttataacaaacattaagagacttgaacgggtcgattcggagctcgtatgaccaggatatgatcatccgaagtttaatgctgttatatggagatttgcgaattattataattaggttttgcaactatgaaacatgtgtaagcgctagcctggaaaggacaggaaggctgcgccgttgacatgtggaccccacatgtcaacctaaaggaccgcggtagaccgggtacacagagacggtccacgggtcgacggaggcggaccccgtgtgtcaaccgaggcgagtggccaacaaacggactccactagacaccacacgggatgcacacgtagaaaccacgcggctaccgagcgggcacacaaacacggacaccacacgcacaagcgaacgactaccgacaccggtacacgggtaccggtgtcgacaaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttgaacgaaggcgagacgcggccggcacgaggcttgacgacgcggagccgaggacgaagacgaggacgggggctgcagcgacttgcttgactgatgcggacgacggatgagaacggcttgacggagggacgaacgccacgacgagcgaaaccgggaacgacgagaggacgatgacgacgacgaccggaaccggcgaggaggcgacgaggacagccggcagcggctgcacggagacgaggacgacgtgggacacgccgctgcgatgacgatgacggaggcggtgccgcgagacgacgagccgggcgaccgacgggacgtcgacgacgagaacgatcggagacgacgatgatggaccgcggaggggtttggatggaggggaagcgaggccaagagcgaccttgccgctgcgatgccggaggtggtggaggtgcagcgagccgacgagccggggaggaggaaggggcggccgaaaggacaccggcgacgaagaggatggagagaccggcgcggcgacggcgttccggcgaaaaccgaggagcagccggggtggagggcgatgcggcgacgccgagggaggagacggtgacgtcggccgacgctcaggcgaggcggccgggacagctggagatggtggagtggtggcgacaccactagtcgtcggtgaggacgcgtctccggtgatttccccgcgaaacggaggcgaagccgggaaagaggaggcagctgcgaggccgagggagaagacggcgcggccgggcggcgctcgggcgaggagaggaaggcggctggaggtggccggcgcgaaggaaagaggagggcgacggcgggaacgtagttccgggggtctcctcgcgaaacggagggcaggccggcgtggaggaggtggcggcgacgctggaggaggcgatggcgcggccggccggcgcacgggcgaggcggcacaggcggctggaggtcgccggcggcgtgggagagagagggcgacggcggggatggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccggacttggcgcggccgttcccggcgattgggggcggcattcaaaggggaaattagggggaaatgaagaggagtcaatggggattaatttcccctatttaattttggaattaaccaagcgaatcaagcggatttggaggagggagcgagctagggttcacgggagagggagagaggacggccgggcgggaggaaggggacgacgcccggcctggcgcgtgggacccaccggtcaggcggcggcgtcagcgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaagagggaggagaggaggactttggactgggcttggcccaaaggaggaagaggagggatttttaggttttctttttattgacctttgataattgtttttgttgtttaataattatttccggtgctctgaaaattcaagtgaaatttgagggctccttttagaccaaggagaatttaacaaaaattctccgggtcacatttgaatttttcttgcacgtattttagtgtttgccaatttctttccgacttttaattaattctattattccttttagaaaatgaattttaatttggaatggatttatcaggacgtgacagcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgaaggcacgccggtcagtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcgatccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcggcagcggcgaaggcaagccagtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgttgacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggataagccggcggagtggactcgcggccgatcgaccggaaagctgagaagcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcagagacaaaagatttagacaggttcaggccctctcaatgagaggtaataccctactcctgtttggggatttgaatccgccgggtgtagtatagatctgacgatcaggttgtgtcatgccccctagagggcctcctgcccaccttatataggatggggggcaggattacaagatagaaaccttaaccaatacggtatcggtttcctaaatctattttacaatattatcgaatcaggactttaggccactccataatataaaaggaaacgtaacacccaagtcatgatctgttacatattacataaatataagttatcccctataactagtcggataaccatgccgtgtgggtatggggtacccataatctccacacttatgtgattcctgaagctattaatactactgctgaaaaaactgcttttgaacaaaattgcaaagctcgcaatattcttttgagtggtatttctcgttcggattatgatcgtgttgctcatctttaaactgctcatgagatttggactgctttgagtaattttcatcaaggaacaaataatattaaagaactttgtcgtgatcttttcaaaaaggagtatattaaatttgagatgaaatccggagaagctttggatgactatctttctcgatttaataaaattttgagtgatcttagatctgttgattcttcttatgatgttaattatccacaatctgagatttctcgccactttttgaatggtcttgacatgtctatttgggagatgaaagttacatctattcaggagtctgttaacatgtctactttgactttggattcactttatacaaaattgaaaacacatgagatgaatgttctttctcgaaaagttgattctaagtcgaatgctttggtttcttcttcttcctctttggatgttgatgcttcttcatctaagtcgtcttttcttgctgtttttaatgccacattcgatgatcaactcgaacaaatcgaggaggaggatttggctttggttgctaacagaattgctcgagctatgaataatgccaggaacaggaaaagaggtggtccaaatcgttgctttgaatgtggttcaattcatcatcttcgttcgcattgtcctaatcttgggagaggcaaaagagaagacaaagatggtgagaagaccaacaacaacaagcccaacaacaacaagtcgaagggttcataccgagggaggaagatggagaatcttaggaaggcttttcaacaagtttgcgccgccttcgagccactaagtgatgtagatggtgaaagtggagatgatgataagggaaagaacatctccgatgtttgctttatggcgcgtggtgaatctgacacagagtatgaagataatgaggtgaatgcttttgaggaagctattaatattttgagtgcaaaaaataagaagtgtgagaagatgtatagaaaacaggaatttatcattgaatctcttaaatctgaaattgatagattaaaatctcttattcctaatgatgatgattgtgaaaattgtgaggttttaatgaatgagatttcaaaaattagagatgttaatgctgcacatgatttaaaaaatagatcttctcttgcttgtagttttgccttgcatacacgcactttggatgagttgtttttaactaaaaagttgttgcaaaaatatcaaattgcttttcatgctagtttgatgtttaacatgatttctgctaaaaagttaaaacaacctcattatgttttggattgctcaacatgtaatttgaataagatgaaactaaaagatgctttaggtcatgttgagtacatggaagatgctgtgaaaaacaatgaagtgctttcttgccctaaatgtcgtaaaagcaaaggtatcatggtagattgtgaaaattgtgctaatttggaaaaagaggtttcttatttgaaaaattctttgctaagattttctgatggtaaaaagaacctcaacatgattttggatcaatcaaaggttagcacacataaccgtggtttaggttttaatccttatgctcataattctagacatcctcctgttgtgttaggtgttag

SEQ ID NO: 47521 - DNA, 886 bp, Oryza sativa
ataaaggccacccgtgcagggggaaacaccagtcggcagcggggaaggcaagccagtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacgacggcataaaggccagccgtgcaggcggaaacaccagtcggcagcggcgaaggcaagccagtcggtgaagacgtagacgcccaacaacggcggtataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgc

SEQ ID NO: 47522 - DNA, 4601 bp, Oryza sativa
aaaaatcaaagagctaatgcaatggaggttaattgacgacaattgtaaaatgtaaaaaagatacttgtatggtgacgcattgttgaacttgtgctgaccaaaagtcgtagaatcaattttttttataataagcaagaatcatctcttctaaaaaaatatctgcatgtaattattcttcatgccatcgttacatcttatctaacattgtatcatatagctttccaaaggccatgttgacctgggcttagataacagggacatactcacatacacatatgaatcagctatcatgcctgatagtgtagttgacattgaagatagcgttgcattatccagttttcgacaagattgtaatagtcgaattagactcggttttctaagctagagaattggtccggaactcaaggaaagaagctgcaatcaaaattcattcctattttccttgactagaatttaacaatgggcacaaacacaagaatgcctatggacaataaagatataagctggaaggagataacttctgttgtctaaaccagaagctaaaaatgcaaagttccacgtatgaagttttgtatcatattttacacgagaaaactggtttcataacagaaatcctttccttgcaaagattctcaggtgatgaacttaaaaaaatggactaattccacatggtaattttttgtatatatatactactcttcaaattatattcgtacactcatttttagaaagtttaaaggaagaatgccaactgttttttcttcttttggagcatccttcactcattgtttccgttcactcattattgctcccttagaagcaaagaatgatgttctagcatttcaaaatcccacacatttcaaagtcctagatgatattaacaagtttaacaccaagatatactccctccgtttcataatgtaagactttttagcattgctcatattcatatagatgttaatgaatctagacacacatatatatatatctagattcattaacatctatatgaatatggataatgctagaaagatttacattatgaaacggaggaagtagttaacaatttttcagttttgtattagcaatgcctcaaaaaggaatgagataatgtcctacaattactaaccagtgaagtgtatttacacccatcaacttgtgcttagatggagtttttcactttagtcttttcataaatcaagggaattgaattgcgtaactcagaatcactgacctccaattttaacaaagtttattaaaaagaaaaattaaaaataatcctccttcctcctttgggccaagtctggcccaaagtcttcctctctcttcctcggctcgcagccgaagtccttcctttctccctccctttctcttctctctcgggcctccccctcctcccggcccacctggtccatgccactcggccgcctagcccaagctgagccgcccagcacctggcgcccctccccctcacctagggatggcagtcgggcacgacaggcactacccatgcccgtgcccgcgaggtaattcatgcccgcgggcatacccattactacatgacaggtaaggaacactacccatgggcatgcccgtttacccgttacagactcacagttcagcacttcaaccataaatctccacaagcagagacattatcacagtttaagaaagggtatagttccaccaagtttaaccatacaagtattacaagttcatcaatactagatggtggcattatactaatttgactgagggaccacatatcagttggtttttgcgggtaaacgggcgaagcgggcatgggtagtgactacccatgcccgtgcgcccgttgattataggttttgaccccacaaaaaacccatggatactaaatggagaacatacccaactctattagggtatttacccacgggtaaacggacaaacgattaaattaccatccctaccctcacccgtcgcatgcgcaacacacgtgcgcccgcacgcgctgaccacgcctcccgtgggtccattggttagaccccgtccccttcctcccgccgacctcctcttctctctccagtgaaaccctatgtgccgccggcccctaattctgctcccccatgcgagttctagccaaattaattgcaaaaatggaatccccatccccttctcattatttaccctaattttccccctctaatcccgtccccaatcgccaggatttgaagttcattcaaattaatgtcgccattgatgccgccggccacatcctccggcatcgttctcggtccctcccatggtcggcactccctccttggcctataaaacagggtcccctccctccccttgctccgttttgccctctcccgagtccctacccacctccccgcagtgctggcggttggatcgggaaccagagtccgccacgcggagtcctccctgtgccgacagcggttcgacggaggcggagcgccgcgcggagcaggcaccttccggcgacagcaacggcggatgacctcccagcaccagcagatgagacgagcggcaacggcaaggattgcaggattgttgatgaactcgtacttttatactactccctccgtttcacaatgtaagattttttagcattacccacatatatatatatatatatatatatatatgttaatgaatctaaacacatatatatatccagattcattaacatttaaatgaactaggcactctggcgcgctttgcggcgccccttcggaagttagtgtggtaatatttaggaaaaaagaaatcaatgtgatatagcgagtacatgagtattgtgggattaaaagcaacacatgacagcattgtattagatcaagtaaacaactaagcaacacaacttgattcgacgactatagataatggtttctaggtattgcaaggtaaaaaggtaggagataagattatttcaacatcacgattagcattgcaattagcggaatctattgttctttctaagctcttgaggtagacggcgtcgtggtgcagatgtggatgctgcttcggaaggcccttatttgagtccgctactcttggtgtccactgaaaattcatgatgataggaacccggcctggagtttgtttcctcatagtgtctcagcatctctccatctgtatcactgccactaccatcatcagagtagtcaaatagcttttcaatatgcactaagacagtagcagttgcagcctcacggtcccaatcaaccttgcttgtatgttgaggaccttttgtttcaatgttccagtccataatctttggtatcagattaacatctgttgtccaagctgcaagcctaaaaattgagacatcttgtatatgatactgctcatagatttcttctaccatacaactattgtccaatagttcaggtgttgcctcatcattccatgtttctgggggtataccttccagagcaatgataactctttgtctcaatgggttctttacactgtgcatgttaggcttgaaaggatcaaacgctaatcgagttgtctgaaacgtgtaagttttttgttcgattaatctttcggctgcttgttcctgctcatctttatccatgaacaaagctagatacatcctatgtttgaatggaagaagtgctatgtcgcctggttctaacttggatattgtagacaccatagctaccactttagtctttgtgggtgtgccagctcctaggacagtgacaacaactgcattgtgataaatgatatctgcaagtagctgagatagtggttttaatttgctaaacttggtgcctctaagtggtctgttggttccatatgacatcgctaaatctacatgaaagtatcttacataagtagcaggtttatgcatgaaggagacaaacactgaagtagacaggagaaagaaatgtagattgaatggttgagcttgttaccttttgttgaagacactgagcaaggagaaatcgctgaagcagcaacgcgggatagaggaaagctagtgtgacattgctcaaagggactcagcgttctatatagaggatgctttctacattgaatttgggttggtgtggtgtcttgtcaagtcctggtcaagaagctgcaacggttaaagtttatgctggatatgtttgaatgtagctatgttatctggttatgtctgtatagcgttggttgaaacgggtgaattccagaggaatcgttaattgtcggcctctgctttgttcattaagctgatggaaatgtgtgagcggtaaacgcagtgctcgctatgagtatgtgatatctttaagcagtaactatgattgacgaacgttggctattagattgtgaaacaaaaacatccagctgtatgttcgatgcactgagcagactaataaacagagattaaggaaggtgtttgaatccattagctaacttaaaccattccacatagcattcactattatcaaggtatagccatgataaccatgaatactgctagcaatggcagatgttgtttgcagcgttacaaattaagtttcagatcacatgaatagaaatggcattttcgtgcgatatatgaaatgatcgcatcaaatgcaggtttgcaaaaggggggtgcagga

SEQ ID NO: 47523 - DNA, 1637 bp, Oryza sativa
ctgcttcttaagaaccttgctgatgtgtttgcaaagagtggtggttccatagctgactacgatcttccacaaacaaacaacgtcccagaccatgtagttggcaatagaatccttgatgaagaactgaatgttgactgtgatgctttagcctcccatgcaaatgcattgatcccaaaactgaacagtgagcaaagaaaagtatttgatactatagtggattgtgtcaacgatggccgtcctaggtttttctttcgtttatggccatggtggtacgggcaagacatttctatgaaacactataatatctaaaatacaatccgaaaaaaaatcgttttggcggtggcatcatcaggagtggcttctttgttgctcccacgaggacgaacagcacactcgaggtttaagataccaattgaaatcagtgaaaccagcatatgtagcattcgaagaggcaccatgcttgctgacgtaattcaaaagacatcattgattatatgggacgaagcgccaatgacacatagacgttgcttcgaagcgttagataggacattgcgttacctactttctgaggaggaacctgcaaatgctattagaccatttggtggaaaagtggtagttcttggtggagatttccgccagatcttaccagttatacaaaaaggttcaaaaacaacaataattgatgcttcgataacaaactcaatactttggccccatattactcttctcagtctaaaaacaaacatgcggttgcttcgaaacgaccttatgcaaatagataaggacgaacttgataggtttgccaaatgggtgctagatataagcaatggaacagttccaacgacagtgaaaaacaacgaatctgagccatcatgggttcagattcctgatgacttgctgataaagacagatggtgagaaaatacctgcattaattaatgaagtctttcctgatctattgaataaccaaggaatcctgaatacctttcatgtcgtgccattgtgtgtcctaacaatgctactgtcgacgacattaatagctatgttgttaacatgataccaggaaaagaaaaggagtactttagctgtgacacaatctgtaattcatgtgagcacatacaggattacgatttgctttatcctactgaatttctcaactctataaatgtgaacaactttccaaaccataggcttgtgcttaaaaagggtgtcaccgttatgctactgagaaatcttaatcaatcaatgggactttgcaacggcactaggttattagttgatgtgttaggacagtgggttcttcagtgcactgtattgactggatctaagattggtgaaacggttttcataccaaggatagcacttaacactactagctcaaagtggccatttatcttgcaaagaagacagttccccatacgtgtttgctatgcaatgacaataaacaagagccagggccaaactttgtcgcacgttggggtttacctgaagaaacctgtattcacacatggccagttatatgttgctgtgtcaagagccacttcacgcaaagggctcaaaattctaattgaggatgatgatggtaattgttcctcggaaactaggaatgtggtgtatcatgagatacttcaggcaata

SEQ ID NO: 47524 - DNA, 7952 bp, Oryza sativa
aaatcaaccattatggcaagtgcataaaagggcaatgcacccagaagaaatcgtcccatgcatgcaattggctctttgaaaaccatacatacatgaaagcatgcataatagattttcacataaaacaatagtggtgatcccagttaacattaaacattactcttgcgtaagaatggagattataaagctatagactggactatagctttgagaatacatcgttatggatttaaacagaagcaatgaagtatttctgattattgtaacagctgctaccaaggagatcttgaagaataacatgtaactagaaaactagacagctaggaacaaacatttgaaaatttaattgtgctgcaaattaaagagccatgatcacatttcacatcttaacttacattgcaccaaaaaagcaaaacaacgtcaagggatgaaagtaccaaagagtaactacaatggagaatgagaacaacacagctaacaaacaaatgaagaaaaagcaaatgttcaaacttagtttatgtttacagttgaacatgcaacttaaggcagaagtagcatgatcttaagcttacatctgcattatgatccaataaaaccttcatagcaccgacttgtcattccttagtagcaagatgtagtggcgtcccacattcatcagctaccggatcaatatcagccccctttgccagcaacgtttctatcatttcacaatctcctgcatacaagaagcaatgatggtaagttttttttttcctgaatctttttttcttaatttgtatctggctcttggcagacctcagttttccctgcatataggctacaaagatcattctaaaggggttaacgtttcatagaaacaacaacaatccctactcgccaagtcaaagaaattgggtggactgataactgttgaaatcaagcaaagggggacattttggatgtggacatatttttcacacaccattgaataacaaaagaacacttatttgattaaaaaaaacattcagagaatacactgcctgccatagacattgaaatgtttaaggctgagttcggcacttcatgttcccaactcatctctttcattttccgcacacaacggtgtgttttttgcaaaaaaaattctatgcgaaagttgctttaaaaagtcatattgatccatttttcaaaaaaaaaattagctaatacttaattaatcacatgctaatagaccactccgttttgcgtgcaggagggattaattcccatcctgcactaccgaacacagcctaaggaataaggatgttgtgaatgatagctcaacagaatttagctatcagctttgaagataatctacttccacactaacataagggaaagaaatataaattgtcctggaacgaggtcaaataaaccttagttagaacataataccgccgcctaatatattacaaacaaaaggaaaaaaaaactgtgaacctgtggtgcacgcgtgtaaaacagagatgcatatgaatagagaggacctattccagcagcggaatgtagaggggttagcccgtcatcatcagctttgtctggatcagcaccatgatcaagaaggtacttgacaatagcagcattttcaccgatcaccgcaaaaactagaggtgttctacctgtcatgcacacagatcgatgcaaacaaattcaggatcagaaaagaaatgtacatctgaaaacttttcactgggcatcatatttagaaatatgatcagcaagattacaaagcatggaaccacacatacatgaaattcaggaatcacatgaaatggaatgtggaagggcctgagactgtgtttggaaaaaaggactaactatttcactttaaaagttctaacagacccgtaagtatgcagaatcaactgtaggaaattaatttccatccccgtgagatgaaattgaagtattaataacaccaacgaattcttttggggcattttcgcaagtgcgagtaaccaaacaatcacagagaattccctctcaatcggttacatgtttgtatctgatagtgataggaaatatttcattgttgaacatggcatattttaatgaagcatacgatgatgaatgaggataacataacaagacaatgaagagtaaacccatgcttatcattttgtgctttttctctgctaggaatagacacaatcacacaaaatttccagcgtcccgtgaactcatcaatcatatctaaaacctagtacgtatcaagcaaccgatcaacttaattaattacacaagtatatcatcttataagttgcacgacagccaatacactggttaattccccattgtgcaatcaattaactattttcccccaccaaaaaacacaaaacagagcaggtttttagattcacaaatcctaaaatgccagcacaactaactacggatcaacaaaacagaaacataccctcatcatcggcggcgttcacatccacgcgcagcccttcgacgaggtagcggcacacctccagctgctcgttgcccgcggcgagctgcagcgcccagatgccgccgtccgtcctcgccgcctccaccacctcctggaggcggcccctgaccttatccagcgcccgcaccagccctgcgcacattcaaaagcaattccgaagattaacgccacccaaatccccaaaatcgcggaggctgggggtgagtgagtgagagagtgagcgccgcgtactcttgaggtggcggaggtcgccgctggccgccgcctcgaggagctcgtgctgcatcgaagcggccgcggctgtatagagagagagtgagcggatttagttagggtttttggcgtacgggtcaaggcgcggggaggagggggggtgggggcttaccggaggaggacgtcggagcggcgaggcgagatcgccgcgccgccatggcggatgggtcggggaagcgcgagggagtagggttttgcgaatgggggtgagactgagaagaggagggtgagagagagagagaaaggaggcgaggtggggaagagagaggcgaaaaatggttgggcatttgatttttgaaaactgaggcgagagaagacgagagagagggcgtggaggaggcgtacgcggcaagccagcgcgtgggacccgcccaacccctgtaactgcggacacctggaggcggtaggccaaaatgcccaaccgattccatcgtttcgtctaccagtaacctgtgcacgttactgtgcacgtgtagtacacgtcgtaacctgtattaaaattatattatttttaaaatcaaatttatagtagtatataattaaaagctacgacatacatttaaaaaatcaatatactttcacttataagtttgaataacataacataactatttttttttgctatttagtaccaaggaaatcctcccaatcttgcatcataatacttttatatgaattgagaaaatatgaattgcgcttgaggtatctttaatgataatgaaacaagtcacatatatacataactttttaacaaaattatcagtcaagcgtcatgtcctacaagtcaataatattatatattttaaaatggaggaagtaatattcatgcatcaaagtgtgactgcaatcttggatttttcatcagcctccttgaatgagcaatatagctgttagaaaaacttaagagaaataaaatttgctcatgttcagtataaaatttcttagaattttaactgttccctatcaccctatgtgccaagggggcaagaagactaaagggaatgccttggttaggtataaaactgctcggatttttgtttaacactaatttatttgaaaattgtaaacataatccctttctcactccatgccaaattttgcaaagaacaaaatataaagtcctgctaggttgctatagagtacaaccaattcaacattggtaacacttgatgaattacaacagctagacagctagacgattgtaagggtacaaaacaccagatgagaaaaaaaatagtttaacctaagataatatattgttcaaaacatcttcctcatgtattgcctttctccaactgaatcatgtattctgcactttatgaattacagtattgatatccaagatcctagcatggtcaattggatcaccatggaaaagttgtttccatttcagtttcttaacaatgagtttccctttcatttatgcctatgaagacatggtcacagactaactgtgcccaaaaatagttttatcactgccctatgtttttgccttttgctcttgagcagcaacctgatttttttttcaatctcaaacaataaaagccacaaatggataaattttgatttaacaaagttcatataagtaatgaaagctccttatgacagaccatcctagattcaaactgtagctattagagcggcaatcttgtgagttgtgataagaaagtgatctagctagctgcatacaacttccaacctgcagataggactgaataaatatgtaaccctcttttcaatttggcaatttagaaaagtatgaactggcatatgatgaacatcaagagtttctccacaattccagatttgcaacaaagtggacatgcaggaacggaggaatggcaacgtaggtgaaaaaaaaacagtagtttttttttaaataaattcagctgcaaccaatcaatagaatatcagtagcatagtgcctcgtaaaaataaagaattgtaaatatgtaccaatatgttcatgtgcatagcagaaaaatgttgggctacttctttatgcgcaatcaacacaatctgttaaatatatcatatatgtcaactctcaggtgttctggagtaaagaaaaactctcagattgttcaagtattacatagcatggagttgagctgatcagtttcatgctgctaattctaacagccattattgtaagaggaaatacctagctagtacgtatgcagcaggaattctagtgacaagaagtatatagtaaaatatgaatgtcagatcatcaaatagcagagctgagatttagaaattacctcccaacccagatgacaagtactttgaagaggtgagtccaaaataactactatgaaacttgataatgttgtatcatacaatttaagagtaaattggagagatagtagaagtgggaagctaccaaggtattttggacatgtagctcttgtactaattttgcccaaatcttaatatcaccattaaaggaccagaagaaaccatgataattacgtttagaatcaaacaatcaactttggtattgaatctgcctcagctaatggcattcctccttttgttggttctaatggcaaagcagcgggataaagcaatatcaaactgcaaattattagtggtcgaagaaattagaacagacaattaagagtgcatgagtgcatcgaaggaaaaaaagaatatggcattccatatttcaatggtgaatggcagagaaacaaaaacataccagtgggctttagctcgtaatggaataaatcaattaacttgtaatactgtagacaagtggtgttattaacttccttggatttgcaactcatgggaatgcctggacaagaaacatattatcaagatctcaaagaataataattctttcaatgcacatcgtctgttttctttccaaaaaaatgcaaattaattcttgttagcaaaatagagaatgcatctattgaattgcaaagggataaatttctgaccacacgtacatataccttcctaatcaagatttctccgataaaatcctttccaatcattattgatccaataaaagtacaattcccagcgttgctccaataaaaccctttccaaactgccccgcaaaatactttcccaataatgttttaaaacattttccaaacagctcccgacatatatagccttctcgacatcgacgcaagtaaacaatttttgctcattccataataaaacagatttcagtcattccacaatgattcactatgacgtatcaggataagagcacattcacctacaagaaaacaacgatagcaactataacaacaaaaactactgaaccaccattatgtcgtgtatgctagtttattcaacaaagaagtatttaaactacttgatttctgggggtgtagcaactatttcctttgcgcgcacctgaaccggctccatcaccgaagaggagaaaactcaggtaataagctcgatccacaaaaatctgactgattagtgattagcccccacgcctccagtacatcctctgtacctggttcacctacaaagaacatgaaagaaatgagggggaagaaagaaaatgtttcatcgtaattggacatggtggctagggtggctgcagtgcaagggtgggaactcacctggtgggcgctggagatgggtgctggcctgctcgatcgggcggcgagccagcgagcggcggtggcagttgatgacgcccgacgatgggcgacagccttgatccaatagcgagggcagtcaacgccggacaacgacctgcatccaacagcgacggcgatagacgccgggtggcagccgatgatgggaggggatccggcgacgggagggtgagcagcgaccgacggatcggcgacgctccctgaggaagagagaggagcttagggattccgtggggagggattctcggaggagagacttttgtggggccggcgcgggcttcgcatgaagctcaggagctatttgcggaggagcaatgggggcgtgcgtccatagtcgtcgggggcagtcccaggcgtggcaccggcggaaggggatgcgattgtgcggtggtggctcagcgctggtcgagtgaggagcaagcgagagaggatgcgcacggcggagtcatcgcggctgggttttgtgtggcggagtcaccgctttggggcgaaattggtggaatcgatggaattagtggagatccaacagcggcggaatcggtggaatcgccgtcgctattggaatcagcgaggaggagcagcgtgagaggagcgaggcgtggtcaacgcgcggtcatcacgggagtcacgtgaggagcagcgggaagcaggggtgggcagaaaaagaccgaacagaaaagatcgagaccgagaccgaaaagaccgagaccgagaaattcggtcatcaattcggtcctaggtagtgaaagaccgaattttgtttggtcaattcggttagtctcctcgggtaaccgaatagaccgaaaagaccgaattaccaaaaaatgtctaaatgcaacatacaatccactatgtttaataagattaaactctaattttcacatcctacttcttctagcatgcaacctattaagagtctttactcataagtgcttacgaattttttttgtgatttttgtgttgaaaatttctattgtttctttgcatatatgaaaatattattgaatttcggtcaggaccgagaccgagaccgaaaagaccgaggccgaatttgtcggtcctgacattttttactgaaattcggtcttcacttttcaaagaccgaaaagaccgaaagaccgaagaccgagaccgaaattttcagttagaccgaatgcccacccctagcaggaagagccgtgcaaggatcagcgctcattaggaggacgacagaacggattaggatagaagatggacggtccggattagtagatagatgtggacggatggtagggattgatccaagtgaattggctggtaggattggaggggggcaactcctcctttttatattagtatagatgaattgaataagcgaaacggaatatttataaacgaaaaataatttgtaaataaaacttttaaatatgtattatttgtgatttagaagtaaagtatgaaaaataaattatgataaaaaaccttaaaattaacttcaaatttaaggtttgacatttaaatttcgtcttataagcataaattttggctgcaatgcagaatgagtttgtatcgtcttaacattgcatagt

SEQ ID NO: 47525 - DNA, 824 bp, Oryza sativa
atcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcggcagcggcgaaggcaagccagtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcgtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgt

SEQ ID NO: 47526 - DNA, 2845 bp, Oryza sativa
ctgcacccccaatggataagagagctatagatacccatggtttactattaatctagtctattgctgagatgtacatgttttgtagatagcaccttactttaccattgcgggtgctcttagccagtttatattgcctagaaaaatgaaatggggcattatcaaaagctctgatcatttaatctcctgaactatctatgcccatgtaatagacactctatatgatagacttgactaatagaagtcttaagatatatttgcaaattcctctagaaaaaagaacatttcaacaaatagggatgccatgtgatccacaatgtcttccgttcagttcccgtagactataagagcagcttaattattcgagtatctatgcatatataaatttgctgacaacatgttgttgtgtttctaagtgttgaatgagatagcatcactgctagcatcccagctaagatgttaaggtatacgcatacattcaatacgctcaatttgagctggcccatctactgttgcgcgactttgccgcgggtactttctagtcaaaccttaaaagcgttccaactggaaaaaaaagaaaattaaaaaacaaagcaagagaaaaggtaaaacgaaaaaaaagtcacatggatggtctatggtatagatgggatgtgatcaagccaacagattcatatgctcaaacggatcacatgaccacatgtgtcagtgtgagttagaaatccttgtgcaggaaaggtgaaacgctagccccaccacgtagtcagaaatcatgggtgtatctgatcggtgatcgaaaaaacgtttgccttatattaacttttaagttatcctgttcccacgtaatgctgttatgtagattttctgtttaagaattggtctcgtcaggttgtcttttttataatttttagaattcctattatacgtcactactacacttcattacggtccgcttactctcctcttaattctggctgcagcttggccgagcttcaacttttaacttttctatcacattaaaacttttctacatacaaattttcaatttttctgtcacatcgttctaatttcgatcaaacttttaaatttagcgtgagctaaacacacccctttataacagcgaaagcaaagaacccaccaatttgagcaaaaacaacagtcctatgcacagttattaagaccggaccggaccgaaccggcgatcggaccggaaaaaaccggaaccagagcccccaccggtccggtccaggtggtcctatactcctatggggaaaagggaaaaaaagaaaaaaaaaagaaacgacccaggcggttcggcgtgaactgggccttgggcgggttgggctcgagcgaagacgttccctcatggcaccgcttcccctccccttctcgctcgctctcctccgacggcgccgcttcggcgcttcccgacttccagcggcgagcagccggctgcggatgcgcccgcgctgctccaggaggatctggatcccgctggcgtagtctccgtggcatcggcggcggcggccgggcggtgggaagcttcagctccggccaggtcgacggcgcgctcgccgccggcttcagcgaagaccaccaggtatgccccgcctctactccctaggtagggtctgcgcggcgtctgtaggctctcggactgaatcgcgtccagctatcgagttttgtcccacatcgccaattttgagagcgagcgacctgtttatcaacgcggttcgattctactccatcgcctccccagaggcacccaccccgaccgaatacagcgaaaagatcccaaatgtgggcatcggctgggtgtgtatccccttccggttaatggctgtaaaaaaaaaaagataaaggagcagtgaaaagatcccctcccgttatggggcacggcaggcgaccccctgccggttagctgcatccacgttaagatgtcaatacggcaacggtaagttgtcaaatacggcatatgcatgcagtcgggcctttggtggaaggcagcgctagacactagcgcttagcttttttaaaatttggatgaaatttttatttctgttgaatcgttttttaattccttgtcttaagccaagagaagcttaaataaggtgaatttggatgaacttttttttttctgttgaatcgtttttcaattccttgtcttaagccaagagaagcttaaataaagtcttaaaacattaagatagggtaggagatgagaggagatacttgctgtgttgatatgcccttactgctagcaatttcgccttaagacgcaaaacttctaaccgactgcatttccaagtttcgactggatgccggtcagagatgacttggcagatgaataattttgatcttactctgcagatactatggttagcatagtattagtaatgctttgtcatttgttcactgaattttggcttgtatgtagttttgtttttaatagtaaatttctctgtaaaatttgcacttatatctgaattaatttacgctgcaagactatgacggtaaagatttggctggaacatccaatattttcagccaattgtctgaagatgtgattaccaaagttgcaaataactagcaacaagatcaggtatgtgcagagttgcagacaaccgttgagactgaaccaaattcgtcctggcatggacagggaaaaatagaccatagcagcatagttttgatcaggtagatgaagaatcctacattttgaaaagtattttatgatgctcagggattcatgtaagcaataattctgatccttgagtcaaatgattttctcaatttttatttgtaaaaatgactgtccttttctttgtaaatatgctgaaggaaatag

SEQ ID NO: 47527 - DNA, 1670 bp, Oryza sativa
atgcaaatttgattgatgggaaatgtctcccatgtctttttaaaaccttctggtatggctagctggttctttttgtaggaaagaaacaaatctgaaacaagaacatgtagatgacagattgtacatactggaatacaaacatttggtattgactggaggaccgcaacaattcgttctttcccaactttcaattccatatatatattgaagcatgtcctggtaatacttccttcacaattcgttcttttctcatttgtcagattacgagctccaaaaaatttggtgcaaagtttgttatgggaacctggtatggagtgtgcacgtgaaaaagttataacaacagaatgcttaatttgttatttgctttgagatatcgagaagtaactgaacccactacttggatttgatattaggcaagcattttctgactagtaccagcattttaatttcttttttctgattgcccatgcaggaacttagtattcacttttgacgtttcatttgtttgtttcaaccatattgtacagttcatccctgcctatatatatcctctccatgtttatctaaaaaaggaaaaagtattctccagtcgggcctctggtggaggcagcgctagacattagcactttgcttttttgaagttatcttttttccgttgaactcattggttataatcatgcttgccaaatttattgaacataagctacagctaaaaactcattggttatgatcatgcttgccaatttcattgttttttgttactgtcatgcatttgtaacataacttgaattattctcttagctagataaatagcacagagaatggatcagtgcttctgagacaccatgtaataaagatgtggtcaatgtggttcccgaactttggggtgtaaaatataaaatcaagcagctttccaaaacttattagacacaagatttttgaacttggtaaatgtttttgaacattgaagatcgatccctgctacttctttaactgtaggttgcacaactggtaaaccattgatgaatgttgtgtcagttgcatccacagctacctcaacaacaccacccggaagaacggcaagggcttcgccaacccgggcaacaccaggtacttcagtttggacgacaagcgcacaggattttggaaatattgctaagtcccaggtaacactctagacaagcaaagatcgtgatggattttggaaccgttcaagcatcagataaatggacaagttcataactgttcaaactaattcagagagcacagaaatgttcagaacctagatgcgatcaccaacaagtcttgtttcactgatcactctttatgttgcaacacaactttaaaaagacttcaaagttttacacaaggcgtgctatggttcttttatttcagtaaaacactcgttgctatgtgtatttatttgcccttttgatgcagaattatattggtaaatcgatcagttttcttaaaaagttaaagtccgtactctagatgcaatgctatttggcttcgaatggaataggtgcaattattttcgttagtaattaatgttctaaaatagcactcatgtttcttgtatttgagaaaattgattgcttagaagttgcataatgcacttatgctatttaggtggatgaatattttgatcaagttttttgttttttggg

SEQ ID NO: 47528 - DNA, 2634 bp, Oryza sativa
atagggagtggcttctgatgcactggaacattaggtcaacctgggattgactttccaaccacatatcgagttcatcatagaatagtcatgactcatgtattgagaccacctactaggaagaataactgtgcaggctgaagtcctaatcctccaatctgcaccttcatacaactgcatggtggttcagaaccacatactgtccaaggatatcctactgtttgagaacctgctgaagcaaatagcaatgttgcaaagaggtgcaacatgggtgctgaaagcctgaaacaactgccagaaattttagccgtagctgattcttcttgtaggtgaacatgtcaaataatttgactggagggaatatctttttagaaccgttgggtttggcttactgattatttttctacaaaagaagagaatttcaaacaagaacatgttggttgattggttgtaaatacaggaaagcaaacattgttcacttgaaggcatttcttgaggatttatgtacctgactcgaatgattggtgccatgttcctcttaatgaactggcccgattgcaactgttcgttctatcccagcttgcagtgttgtatatgtattgaagcatgacctggtaatacaaatctagcgcaaagtttgattatgcttagtttttcttcgctttgggacagcaaggagtgaagtcattacttgggttagatctttgagcaaattctgcctgactaatgccagcattttaatttagcgtctaaaattttgtcttgattgcccctgcaggagcttattgttcactcgatcattttcttgagttaatcccttgctagataggctccatgtctctgtattttaaggctttctaaagcaatgctctaccttaaccttaagtaccgtattttgtaaaaatggattgtgtacacggggggagacaagggtggatcaattatagtcctaagcctaactatctaaattttcacattaaaactctattgatatatcatgaactatataaagatagtactaaaagcatagcctaactgcgaaccaaagaagcaacccttgctaccaacttgaacccaaccaagtgaaatggaaaaaaatgttcactttcgtctctcaactatacgtcgaattacattcttgttagagtatcctcggaaaatgcttgcggtttgacgtccgacgcagcaaagaaaatcggacgtgatctactcatggcctacatgcatgtctagctgttgtcttatctttactctctggggctactgcatggctgcacatctctcttcttgctttttttccttagtacttcactctaatatataagtatgcatgtctgtatataaaagctatgcatgtattagtaacttcaaactattttttatcctaaaatatttattaaatctacaatccgattacaatattatatccgttgaatttaatttttacaacaagatcttagttgattatattttgatcaaaaaataaataagaagaataaaacactgttaaatcctaattgaaacatttttattccatatatgaaacaacgagttacaagtgttgcaacaccgcacctatttattgaaacactcaaagaacaccgttgcaacatttacgttaaactagtgaaacattagaaaatacttattgaatcatctaaataatatcacgtgcaatatttataaagatctaccacatcataaaatttaaaatgtgcaattaatatatagtcaaactccaattgaaacatttatttctcgcacgtgaaacacccaagttttactgttgaaacatttgtattttttcattagaatataatgatgttatgtattgttatagagatttaattacaacaaatacaacagtgaactcggattgtaaatcagataaatggtttttgagaaaaaaaaacatttgaagcttgtcactatccctgtacctctttcatttggtactatgcatgcacggtaaacttttgtcgttgttgctcttctctgcatgcataggtaatagttttttaatcgaatggatgtggatccaacagtagaataggcgtccgacgaaacaatcacatcggatgtccgatccgtagtcgtctttgtatccctcaacatttaaaatcagcacaaattgagtcccttaacaatattgaggatggtttcggctaaagtggtgccttagtctttgtcccatgtggtgcctacgtggcactagaagaaaaaaaaagaagaaataataacaccaatgagacctgcatgatagcaaggacctagatagaaaaaataaaacaaatatgttaggtccacatactttggatggcgtgagggcaggtgtcggtgccttggtgggctagcagcggatactgtctttggtgtcctgatctggaaggcggcttggcagaggatctcatgcaggcaaccgtcagcatcctggtggcggatggcgtgccagcaatgatcggtgtcgtggagttggccatcgagcggcatcgacgtcgagcatgagtggcggtgtgccgactaccatagtgccacatgtgtggaggtggagtggtggataacaagatgggtggttgattaggtcttggggttaggacagggattagttggaaaatgctttgtgtcctgcgttcgaca

SEQ ID NO: 47529 - DNA, 1813 bp, Oryza sativa
ttgctacccctactttacttcaatataagatactctcaattaaaacaacaccataaatcactgctccactcttctaaaattctctgtatttgatctaatttaatctaaaaccaataggccatcaatgtcgttaattctaacaaaattgttaccatttcattaatatctccagtttcaattgcacaaacatatccttgataaagaattaagaatgtatccctatataagatagcccatatgtttcgtttacccacaattcccatacgtactgctcaatgcttaatgtaccattaatatgaaatcaggtgccagtcaataacaggttagtctgttcatatttcatcattttattttattttttatcttcttacacccccttcccataattatagtgtaatttccccttctgttttggacaatatgtttgcatgaaatattttctttagggtgtcagtgacactatgatgtgcccaattctcttccatataatatccaaaggatatacattttagagtgataaatggacacagagctattgtagcacaaactggtaacacttgactaaatgtgttacagggaatactgcagtagcacatagtatgtgttacatgaaaaggttgtaacacagtgtgaaacagtgttacagaaagagctgcagtgacatataataaaagttactaaggtttgattaccagtatttgcagtaccgtcggactcttgagcatattatattactttacttaaacaccgtgggaatggtggaagattaggtggccaactcatcaataactttacttaaacaccatgggaatggtggaagattaggttgccaactcatcaatattttcagaaacaaccctcatctctggttaattgtgttttggctcaggctatcaaggtccgttcgatctcgggctagcattgatctggccgtccacgtggcccagcgtggttgttctttcggagtcataggaacggtgagattagaatggacggttcagatcttcgagcagatccagggacaaaaacccaagccgcacatgtactcccggcccagccggcctcgctctcctcgcctttgtctcgcgagaggtggtgacggcggtggaagcgcgatgtatcggcaacagcggaagtgcgacgccacgcctgctgctggcgtgcagtgccgccgtcgttttcccagctcgcggctctcctctcctgacgatgtccttcccttcttccctctcttccattgatggctccatccatccccaatctcacccctaaccctaggttggcctaaacactaaagattgttgacgatggtgctgcttgcgcagcaggtggtcaggttttgccgacggtgcgccgtggatttgggcctcccatcctcaaaccttcaaggtcatttctatctcccagccaaggacactgttcaaatgtgctcctccattcccctccttccccaggtcagcagcagctatgcctcctttctccttctcacatttattctcctttttatgaacaacaatttagctttgctgtttatatatcacagaaacataataccatcccctcaattggacgatgggttagtcatattttttttccatttttacaaatccacttatccctggaattaacctgttaatattaattgcaggtagacatgtatcatgtgtttttgtatggtctggagaaggcatgctttagccatggtatgtcatatttgccaactctctcgcaacaagatgtaacacacacgttttagtattattattattggttttatatttcttggttgattgctggtaatgctactctaatg

SEQ ID NO: 47530 - DNA, 17508 bp, Oryza sativa
cacatgaatataatctcttagtgttctttctgtgtgatatacatgaatagcaaatatggcacaataaattatcgagagctacaattttgcggtgtgcgtcaaaaatagtagttccaatttaaaagatatgaaaaatccccgtgcagtgcacaatattttttttttcataagaaagagtttaccagaattgttctttatttggggcgttcgtccataaccaatagtatgtcttcccaatcctcttgatagatcaaacatcgtagggcgattttcaagacacaagtttctttgagcaaattcctgttcctgttcaatttgttagctctgatgtgactcttctctttaaaagatcaagccagataagttctccaaatagtatgtgctgtttagagaacatagctctttagttagttgtaaaaggtgacagcactggcatggtctgccgccgcatgttcaaggagttttgaccaaacgtgcaacactgattgctcttgcatagttgacccacatcactaataattttctgcaaactggaagtccctgatgcagtgattattgctttctatcacttgcataatcgacatactttactttcgcgaggggtaaaagattgaatatcatgctcagcgggtaatccgtttgaaatgcctgagaaatttactacacataactcaatgtgcaagctatgatgagccatttttctgataaataacagtttattgagtgtacctttataattaacttggaattttccagtgtttatgtattcagcaggatgaccagctgctgtgagcctatgattctttccttagtttagaacaaaattgtttaccaggttacaataaaacccgatgacatcagtttatggaccttgtgagaggcactaaataaaacaaaacaattaaacaacctctgataaaacatacaaattattgtctatttctcacaatgttccacatatgttttgatcgcttaatagggcacttataatttacagttgctccatggtggattatttatttagtaccatgacatggagatttcgtgatccaaaattttggtagctttagggctcctacataagggttgctttgcatgtacatttttcacaccttttcttacaatggagagacattttgccacgcaataatatcatattattgtaacaatcactgtacatccttttccccttgcttcattttctaccaagtcctgtttaattatctacttgttcccgtcagccaatattgttatcaaacttattggtttttctatgagaagttccttggatggtatgattagcttagtactccctccgtttcaggttataagactttctagcactgtccatattcatatagatgatgtataccttgattcattaacatctatatgaatgtggacagtgctagaaagtcttatagcctgaaacggaggaagtaataattttattttcaacaatggaccatactactgttagctactcacaagctatgtaatgtcattgtgttttgctcttaattaattattcacaaggataatagctacaaattgattctattatggtcaatcttcgcggttctgagttctgtgctgaccagtcaaaatgccactgctcctctctcaccagctataaatatttagccttttgaattaatcatgcatttacgtgttcttctgatggattttgtaggcatatgctgataagcatattatttgtcattttgcaagtgaactaaatcccagatatttcttctttatgttgtagatgatgttcaaggtgagcaggggcgccagtagatgtctagctagcactgtggttcttcagtattttgtaacccatgttgtcattccttttatataataagatttcattgtaattttagattaaattcgatcaatgttgcctatataaaattatgtatatgtattctctaagttgttcgtttacagtatagtttgtttccaaatttggccaacattatagagtaataatgcttatgtagaaaattctgattatcataaaggcacactgtgatgatggtcaaaggttatttgattccatggatgcacaactctatatatgaagggacaagcagactcttctgtgcattttgatcaattcagatcgcacacggcgtagcacgtgtttctttctagtatatataagaatgaacaagtgctcatatgttgattttaaaagtcattatataaagttatagacctaataactagagttatctaagaattgatcattaaagaatttatgctacttaaaagttcttttaagagtttgatcacaatatatagataacaaaaattagtactaaaagctgagataatcacacgttactcctttaatggcaaacttcatggaacatgctatgacaaaatagaaaaatgaggttctactgatttatgagctataccaaaaaagaaaaggaaacctcaaaataaaaaccagaactgttgttataatcaaaattatacatgctttactggattgtgagcaaaattagttcataatgttggaataaatgggctaggctcaatttaattcaattaaaatctcaagagcccacaagtaatgttagagagaataatactgccttgaaaatttaggtggaagaacctcaacttaaatagggtgatattagaaattccctgttaaccggttgaggtgatggttggactgccacacgcatgcgcgcatgccgagtcgccctcggccgtgggcgtagcgaggcgaggcggccgaccgagccgagcctgcttgctgctcttctgttttgtaacagacgagaataaagtcaccattaacaaatgaaattcattgtgttgtaatctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgagatttatttgtgtggtaatggagatctctctctctacatataacgcaaggcagaggctctcaaagtgtgtgtcttcctcctactattgttccttggtgatactctccttctgttcctgcgctgtctctctgtttccccggttctgttcatcccgcgcgcacgggtgatcggaacgagcaggtgcctccgaaactccgtccgcttgagaacctgcacgggtaggcgggcgatcaagtttttgggtagcgcttcaagcgcgactgctctgcatcatcttcaccaacatgtcgacaaccagtgacaacaacaacactggagacaaggagaaggagcctctcgtcaataccaacagaagcaatactgcctcaaactccagcagagggccattctcggggtataacgtttcactattaccgttcgttcttcatttcctacaactgtctgtcgcaatattattgcgttctcttatctatgttgatgcttattctatattaagcatgctcatgttgtacacatctagtactgccactagatctactcaaattacaaatgtcatgtttgttgtcttaatattttggattaaaatatgccgaattaattatgaccaaatttccaacacataatgcataggaaacttcgatgttatcaccaaccaattgaagcaagtggtgattttgaaaaattttcatgtaacaaaagctgtacatattcatcaataggggaaaaatggcagaaagtgaaagagttaccgtagtatacatgttatttcactctccaatttatttaaaattaatcacctataatactaggtagaaaaaaaatcttgtaaaggctgatcagaagggatgtttttttttcatattcacaagtgacgtatgcataagataaaaaaaagaaatgtaaaactaaatggataaatgtatatttaaaggaaaccagtattctttttttttttgggaattgaaggaaaccagtattctataaatggagaaactcaaactgttgttctaatcgagttcagcttcaacaggccatctgggaattatttttttgactgacatgggctcatatattttgttttaatttttaaattattaaattttgcttcatatgccatgtcagtgccacgttagatgaaaatcgagtcaaattagctatgtagcgtgcctcatcggctaaaaccaccgtccaaaccaccttgatacatatattagaccggttttgacagtccaggtaccgattatattggtagtgcggtttaaggatgaaaatcgaactagctgcaagttaagggacctaaaataaacttattcctttcaaaaacgaaagaaaacaaatcagcccagtagcaaactgggcctggcaaagcttcgtctcgagccccatgtgtcagaaggatggactcatcgtcctgctttaggtcatggcccagcatcctgcatagtagtatacctgagtcatcgatgggagctaggctcgatgtctcctccttcccgactctctccactctccccgacgccgccgcttcccgaagaccggcggcgagctgccagctggggatgcgccctctctgctgccggagaatctggatccggccggcatcggcgacggcgacggcgagggccgggcggccagatcgacggcgccgtcgacgtggggtggagagcaggtacgccacgcagctctactcctagccctaggtcgctctgcgcgctgttctttggctccgactgaatccatccggtaataagttttgtaccatatcgcccattctgagacaacacgacctgtttattagctcgatttgattctattccatcgccaccccagggacactcaccccgactgcaatgggcagcggtagggcgtgtatccgccctaccgtttcagctgcaaaaaaaaaaaggcagtgaaaagatcccctactggggcacggcaggcgaccccctgccggccagctgcaaaaaaaaaaagatccccacggcaggcgaccccctgccgaaaagatgccctatagaggcacacagtcgggtctctcggtggaggcagcgctagacactagcgcttggctttttgaaatttgtaacattagatttttttttctatgttgaactcattgctactcatgggttaatcgaaccaattgcaatttgaccattccatcctttggatgcatagttcgattactccatatataatactccaaaaacagtgtatttagccgagagaagtttaattttttgaaagaatcttacaataaacacacaactagacattaagataggtagcagaggagatacattgatcttttgatatgcccttactgctagcagttttgccgtaagacgcacaatttcgatcatactctggatgatttgtcatcctttgccttctgacttaagacaataggagtataggacatgaaatactctggacgatttcagcgtagtgactgtgaaaatgatgccggtggtggaggacgctgaactttcatattaccttcccttggaatccttgattaggtggaatccattgaagtgaaccaccagcggttaacagaattgaaccaccagaaaccgggggatcatttctgaaggctgtccacaagatgaacctggatggatcagtgacaagccacacaccaatggagaatccctccccttcgggatagaagccaaacgcaaagcgccctgagggggagacccaactttgggggccagctgtgttgatttcagaaccttgaggaatggttgtctcattgatctgagctcccatggaatgactagcttggatgatgaagagaatcaggcacagagggataatacaagggaacattgtttggccagaggaggttcttcctttgggctctgcaaaatgaactgcttggttctcatgtaaggaaataaattcaggacacaaaaacctcctattatgtgcacatgaattaaaacacaacatcagggataatcacaactcacaagaacgttgacctggacctggacttgggaaagggaaagtactaagttagtcaactactgatgtaaagtgaaagtaatcttgattttttttttctgggcgtagccgtaccataatggtatggaagcaacatgtcagtacaaggaagtccccaattttccagggtgacaaataacacattggacaagtcatgcaattaattgcgcaggaaggtctgggggcaaaaaattgaaccgaatgatggcaatgtatcagaaaatgacatcctaaccaatcaaagcacagaggaaatagaacaatcaaatatgcagtttctcaatttattacaatattttttcaaaactgttgctctttgagtgtgctatatatggcgacactatattactagttagggcgaattgcagcgatgaagattaaatgtcacatgtttgcacccatttaaaacagaaacacatgatcattccacactagacaaatacaacatgataatttgattggctcacataataattattttttcaaaaattgttttaatattaaaaagcactttactgatctctctgtagtcaaagaccatggcagttggagtaaatattggcgcaactgcgatgtgctacactacaccccaagcaggaatgtttctattgctaaagtcaagtgaaattgtagtgcattattgaaggccaggctccagctatagtgaaaccagagatatatagctaacggtagcagattgtcttgaacacagaactgcttaaaactttatgaatctatctagtcttttcaaatctactagcagctcatattttgttccctaaccattgctcaaattttgttgcgctgttgctgacaatcctcagcatcatctggattgtgacacaggtttgctatccttatgttttttcatggaaatataggtgaactaggtcatttacatatgcaggggtaccatttgaagtgcaagttacaagttgagagggccatggttacagatgcatgtcacctcaccattgcatgtggaggcttgatctgctaggaactttggctggctgaagaaacaaaaaataatcttatttgcttttacatgctcgtttgttaccgcatggagcaaactatctcaaaatgttcttttgtccaaaaactttgcttcggcacaagatttgtacatgctatgtaaagtatttttgcaggtatttgccctgtcaagctgatgatgtctcagttgtcaatgtgaacaatcaatacttttcaatacaacaccgttagtcacggcaaacagtatttgtacatgcaatgcatatttctcagaaatccaatttatatatctctgttttcatgtgagttcagattagaaccgagacggcagcagagtttgtataaccccttttttttactttgaaattcaatgggaaaatatgttctgaaagttgtttttcctttgcttgatgttccgtagtaaaatgaaaaatttgcttgatgcaactcaacatgtgattttcacctgtcctatgaccaagtatggtgtgcctgtagagacgcccttggctggagttctgttcctttttcttttgatcattgtttgctgcagctgtaaacgaaacaagagctgattatcatgtagtagtgaacatttcattccacaaatgcaaaaagggggaaataatttgaagtgaaaattaccattcttgagtgtacgggtgaaaagtagattttaagaagagtccaagagaaggaaaatgaaaagatgtagtattactgaaatgcccaactcaggggtagcttgtccaacagtccaaacctcactcgaaatttgaaatgcccaactctgtttctcgaaagagcatggttgagcccaaaacacattgaagtgagcagacgatcgatttgaacaaatatttaaagtgcacgctactatgacttttccttagatactcctagttcatactactatgaaaattttccggtcttctcgagtacctaacatttcagatcgtatctatttggcaaaacaaaagaggaaaatatcatatgtacgtctaagtatgcagtcttgttttcgattaattaacactacttaaaaaaggtttttatatgcggctaaatttatttttcacagaaaattcacgctataatgtctaaacaaggcttgtgaaaataaataatttaaggtggttataggcggccaactctaagagacctacccgtgaaaattggatttcacaaactgcccaaattagttttcctaggcggtcctctaaagtgaaccatttcttcaaatgtttttgacggaaagaaaaaaagaatattaagatccaatcataatatgcaatttcccaaacttcttataagtaattgtaggcacaatcacaaattcccaaaactaaaaaaaaaaattgcaagttctccaaaatccaagaactcacaaattcctcaagcatatgagcaagcggatggtaataggtcttgcccgagactttggtggcctatggagctaccgttgacaccctaaccgacctttattgacgccatcaagtcatttttgtcgacggcacgcaagccacgaccctcaccaaggtcttaattgtcaccaatccatagtcctgatcgtatatttattttgcgacggaatgactagtactaaccaaacaaccccaataccaatttgagcacatacaagaaacaataatccttcgggaaaacattaaaaaaaagaagaaaaaaaagggggcaaaactgcccagccgtgaactgggcctggaggacgtgaactggactcatggtaatcttatctcatggcccaccttatatggaaggctcgatctcgcttcccgtcgtgccgcccctctcctcccgacttctctccccgatggcggcgcttccccacgtccggcgacaagcagccagctgcagatgcgccatctctgctccatcggccatactctccacggcatcggcaacggcggcggtcgggcggcgccaagcttcagctcgggccagatcaacggcgccctcgccgccgggcctccatggagagcaggtaggcctcgtctctactcctaacttggtctgcgcgacgcgctgaatccatcccgcaattagttttgtcccacctcgctcattttgcgacagagcgacctctttttaaactctgattgattctattgtgttgcctccccggagacacccacaccgactagatacagcggtaagatccccactgtggccacggtttggcggacaccttctgctgtaaaaaaataaaaatggagcagtcataaggtcccctcccgttacggggcacggcaggcgcctaccggttaggctgcatccatcatacacgttaagatgtcaaatacggcatacatacagtcgggtctctcggtggagacagcgctagacattagcgctttgccttttttgaaattttgtatcatcaaattattatttttctgttgattaatcacgatagcagcaatggaggcctgcatttgaaccccctctgcgtttcaattccaatttcctttgcatttgtatttgaataccatatttaccagcttaaattatctatggtatagactacggaatgtgtatagcaaactggaaaaattagagatgtggcgatagaggagagcctatcatcagcaggtatgcaaagaatttcctgtgaaacgaagtactgaaatactcttagcagaggtgattttttttaagccagagatgtgaatgatttgttcacgctgcaagacaatggaaataatgattgaagtgaaacatcaatcaaatattttcagccaattgtctgaagatgtcaataccgggattccaaataaagcaataagatcggctatgcgctgctttggctgctccgacaacctctgagactgagctgagctcatccaagcatggacgaagtatccaacattttgaagtcctttttgtgctcaaggcattcatgtaagcaaaaagaaaaatgatctcccacacgagtaatttgcgtcaatttttgtttctgaaaaggataccctttcttctagttttctcagagtgcaatcaatcatgaggacataatgcatgctaatgattaccagaagctgcgcctagaagaagcagaagcttcacaggcgtcataaagggaagctgaagctttaaggttttatgcctatcatggatacttagaagttgcaacaatttttctgttgctacatggactggatcattggacgagctggtgcagtggtgctgttggagcaccattctgttttcaggtgggtgctctaaatggcaaagcatgttccctgctgaactgttttaagacctcctactaggaagatactagttcattttgaagtcctaatccgccaatctacaccttcatacgactgcatggtggttcagtcagctcaatgagcataactgaacatttcaagaagtttttttttaagaacaagaaccacattccgtccatggatatgctgctgtttgagaacctgttggcaacgttgcaaggatgtgcaaatgaggtgctgaaacctgactaccacaaattttagctgtagctggtcggagcaaagtaatgtctaggtgtaacgcactgtaaatttgatagatgagacgcgtccctaaataatatcctttttaagtctttgggtttggcttactgattctttttgtacaaaagaaacaaatttcaaacagagcatgttgggttactggttgcgaacacagcaaaacaaacatttttcactggaaggcatttcttatggatttatgtagctgactcgaatttatcactggaatgcttaatgaactggcagaaccacagcaattcgttctttttcctagcctgtagtgctgtatgtgaatgaaggcatgaagcatgacctaggaatacttgacgatttgttctgtacttatttgtgagattactagccccaacaaatttagcgcaaagtttgattatgcttggtttttttcctttgctttgagacggtgtcacgccctggcaatgagaacttggttttttctttgctttgagacggtgtcacgccctggcaatgagcgatttcaaggcacggcgactagattcatttctccttgtcgatcttaatcgaacgaattacaacttaaataagactcgatctaagattgttcatgagataaaacgtgtttgctgtccatcggagaacgaataacactgcaaagtcatccctatttttgtccgttaatgatgacaatggcaactaatcagaaggaatttgcaatttctcaggatttagctcgaagtagagcggtacttttttccccgcgagaaaccaacaagcatgagattctgactaacagcaatcaccatgacatggcccggcacaagctatcggccgctgatattgtagcaatggtagaggatacgaaccccacgaactcagcctaaatgaagattgttgatcaatgcagagagttgatcaacagaacaaataaggcaataaagcaagcacaactagcgaacatatcaagaaacaaaagcatccagacaggaacaaaccccagggccaacgggtacagatttcccaccggaagtctcactgtaaacacaggccaagtctacctcctgttggaacgccaaaattgcatatccagtatccagctcaagacagcctaaagataaaaataaccatgttgcatacatagataaggagacattctccccagtaacagaagaaaagcctagttcatcctccggatgagctcgttgatgtagtcctcacggttgccggcatcaccaccctcgacatagtggttcctcttcttcttgaggccaccgagtggtgccttcaacttgaagggccacaggaagttgttggcctccttgaagtgtggaccgacagtcatgatctcgtggacaagatcctcaatgcagatgatgtcatgcttccccaagccctaatggttgaccaacaataggccaaataagaatttgattagctgtaaatggcatatatacaacacaatgaaagcctacaagagcaaacatacctcctcaatgactttgttgttctgaagaggaatcctctgcttgttgagctttccgtaacccctcttgtagatcaattccctgacactcttcaggtttgggtacctgatcacaccagagaaggtacttgattcagccaggtagaacattaaaaataaccaagtatctaacaagctcaaaagctataaagtcactatgagaaccctactgctgatcaaagtattatcaaagcaacatttatgcctcaagcagcttagcaataatctaataacccaattgagatagtgtcatcattctaattctgcaacagttgacatatccaccatagtactttcaatagcttctgaacttagatcaaacaaacaagattgaacagaaataggcaaaggccattaagattaactctttcaagaatgtctaaatggtaataccacaagtccacaacagactataaacaagggggaaacttatatgttcatcacacaattttaggtcttaaaagcattgataatttgcgatggaggattacaagtctgtaacagcaagcaataattagcacagctaaatatataaacagaacagcagctaaaattgataacatacccatatgcaacatatggctcaaccctgcgcagcatgttaatggttgccttgttaaccttgaggaagacaccattgaagatctgtagaatcaaacaattaagcacaaagttaatacaccagcgtacgcaagagttcacgcatttctaagaaaactggttcataaaccaacctgcctcaaccgcagaagctgcaagatcttcctggtcttggggtgcatggcattgatactacataaagcatagcgaactgtcaatgcttatgcaaacaaagacaattttaagccgtagcggtatagtttctcacccacggatgcggaccacaaacagaagtttggcctcagggctgacgtagaacccacccttcatccgagcctcacgcttgagctgcacaagctccttctcctgcaaagaacacaatcgtcacaataaattcaaaaagataatgatcatttcagaaaggaactatcccttgaacaatgccaacgaacagattaactacacttcaaaagcaaaaaaaaaaacataatccaatcgcccaccagattaagtgtgttggcattaaaacaaattcatgggataattagaccatttaatcataccagctctcagcaaaacagattaattagaacatgactacaccgttggtttttaaatctaacgcaagttgctaattactggcatctagctaaaagaaactgaaatcttgaattaaacgggttcagcatccaccacggacacctgcagacgcgcattagacgcttctaaacaatcaatcgtcacaggagaaaacaattctcatattttttagcggacttcacgatgcgtcgatgcgcaacgcaaatctaaacgaaccattcctagacgccacagggttccgcgaatcaacgggcagcggggaggttgctctgctcacctgcgcgtcgtactcctgggcgtactgcttggcgcgggcgaagatgagcttgcggctctcgacggccttcttcttctcggcgagcgccttctccttcctgtccgccgcccactgctcctcccgcttccgcttcttcagcaccgactccggcaccaccgccgccttcgccacctccgccgccatctgcacacacacacacaccgctcagagatccgcacggccgagcagtcgctggatcgagctagggttcgggagcttaccgcgatcgagtcctgcgagagagagaagacgagatcgagaggggagagagagaggaagaggcggcggcgaggagggagaaggggatttatgggggaggcgggaggttttagggttagggtttcgggcgcggctcggggtgtggatcggacggctgtggttgccgcggccgcgtgatcggacgggtgaggagggctctgggagggatgggaaatggcgaatgggagatcttccgagggggtgtgcggaaatgtgacggcccaggttggtcaaaggtttgttgggccggctgacatccataaatgtgacggcccagattggtttgggccgaatgagatggtgttacgggccacatagttggctggctagagccgataataataggggcaattgcgtttttggccatatttcgaagactaactactaatttgactaactctaatttcaccctgttttttcaagtttgctcatttaaccctctttttttaaacgaagatggaacttggccctattccgtgaaggcaagatgacggtgttaactcaagacaaaagtttcatttatacccttatgaatttaaccatgtttctcaaagttttttattacacttatcagtatatattgcctcaaacacaaaaatacatggtgcaaaattatgtctaccaaaaacaaaaaaaaagaaaaaaagtcaagcaataggtcaccgcgtggccgaggagcggcaaccaggggcggcgggaggagcggcaatggaggggcagcgtcggctcggcgacgaggagggccgctgctggcggcagatgagcggcggtggcggctgcggcttggtgatgaggaagtccaccggcggtggcgtcggctcggcacgaggaagaccaccggcgacggcggttgcggaggggcggcgtcggcgtcggctcggcagtggcggcggaggtagttgccgaggggcggcggaggccaccactcctctctccgcccaccggctccgctgctccgtgcgccggcgctcccttccttcgtacgacgccaccgccggcgctccctccctccccgtagaacactccatccattgtggcataaaaaaaacatttttttctattttctaaatgaaaccctaacggtgtgatgaaaccagggccaaacggcaactccaattttgaaaagcagggtcaaataagcaaactttaaaaagtagggtcaaattagtagttatagttcagaatagggtcaaacgagcaattgtcccataataataagggtagtacacccgaagtccctcgtcttgtcaccaaattacaaaatcgtccttaaattgtaaaaccaatgagaaggtgggcccgaggagctcgcccactctgcccaataggggtggcagaccgagaccgataaatttggtcatcaattcggtcctacgtagtaaaagaccaaattttttcggtcaattcggttagtctcctcgggtaaccgaatagaacgaattatcaaaaatgtctaaatacaacctacaatccactacatttaataggattaaactctaattttcacatccctacttcttctaggcatgcaacctaataagagtctttactcataagtgcttatgaatttatttttgtgatttttgtgttgaaaatttccattatttctttgcatatatgaaaatgttgttgaatttcggtcaggacaaagaccgagagcgaatttgtcggtcctaacatttttgcgctgatattcggtctttatttttcaaagaccgaaataccgaagaccgagactggaattttcgattagaccgaatgcccacccctattgcccaacgccgtatgcgaggagaaaggagaaaatgagaagagaggaaggagagaggagaaagagaatgaggatggcatgcgggccccacatgagcccatcatttttagttattttctagcgtaactaacataagtactacgtggagcaaagacttagtcaaagcagccatctaggcgccacatcagctaaaaacggggacaataccgtcaagggatctcgttcgcactggttttttggttttttaagttagagaatgcgttatatctggttttacggttcaagaacgattttgtaattcggtgataaaatgagggacctccgctgtacttttccctttttagttgattggctagctagcttgcacataggccaaggagggaagcggcgcgcgcggcttcagctcggaaacgtgtcgcgcttcggttcgtcgaaaggagaatgacacagattgatccctctgttttggtgtggaaaattcggatcgattacacaatcatctggagtatttttttttgagaagaaggaagagtggatagcttagggtaagtactataaatatccaagtacaatctcttggagagataaagaaccacccctcaagaggtaacgactatataaaattcaagacaaaaggagagagaggaaaagtagattggacaaacaaatattggggctaatctattagaattagtatatatatactagaaatcagcgcgtctgttggcgcgccctcatagttaaactcatactaagatctctttttttaaaaaaaaatatatatagaagattatttgtccattgttaatccaatttcagtaaaatcctttaattggtttcaatcaaagttgaattaatgaagactgcattaagaaaacaatacagtatatttgaataggtccgttactttattctaaaaaaataatttgtacaaaagaatgattatgttttatttgtatataaaagaatacatgttatgaatcaattgtaagcaattttatggtagtaatttgtatttatattcagtttttatgtttccatagtttatcgtggcaaagttagtcattgagcatccattcgatggttatcaagctgaccagcgctaggttgcacgagtgcatgcacatgcgtgaccacggagggaagacaaaacatacggaagatttgggaattgtttactccctatattagtcgttttggacaaaagtaaaatcaaactttaaaatctttgactacgaatgatttctaaaatatttatcttagaaatatgaaaaccacatgtgtagattagtcttaaaaagtacttcaataaaataatatatttgttaaaatgtctatatattttataatagaaaatagttatcaaagttactttttaaagaccgtgtccttatccaaaacgacaagtattatcaatccggagggagtacaatttagatgatgtttggatcgagggactaggatgtttaaacactaatttggagtattaaacatagactacttacaaaactaattgtataaatgagagctaattcgcgagacaatttttttaagcctaattaatccataattagcacatgtttactgtagcatcacatacgctaatcatggattaattagactcaatagattcgtctcacgaattagtccagggttatgaaatggtttttgtcattagtttacgtttaataagtatcccaatacatgatgtgctgtatcatacacaggggcttactaactcggttgaactcaagccgcttgtcctcttcaagttcacaactccacagatttgccaccgatctcaccgtccagcacgagggtcagtgccggcgtcgctctccatcgccaagtccattgtgcattttgtgagcacccaggaccgtcttcgcttatgtcgctcagcgtcgtcagatacattggtgga

SEQ ID NO: 47531 - DNA, 888 bp, Oryza sativa
ttcgccgctgcgaactggtgtttccgcctcacgggttgcctttatccgccaattttgggcgtttaagttttaacagaccggtttgccttcgccgctgccgaaatggtgtttccgcctgcacggctggcctttatgccgccattgttgggcgtctacgtcttcaccgaccggcttgctttcgccgccgccgactggtgtttccgcctgcacggctggcctttatgccgccgttgttgggcgtctacgtcttcaccgaccggccgcctcgtccgccgccgactggtgcttccgcctgcacggctggcctttataccgccgttgttgggcgtctacgtcttcaccgaccggcttgccttcgccgctgccgactggtgtttccgcctgcacggctggcctttatgccgtcgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggccgcct

SEQ ID NO: 47532 - DNA, 6220 bp, Oryza sativa
atcctttttgacgcagttagataattctttggaattactacaatgcaaataaaaaggtgcccaacagaaaagtgttatactaattttgtaggcctttttaggctacaaagctgttcgggtcttattgagatgactgattttgaatagtcattctctcggcacgttatatgctactttggtaatagcgtgagatgtagcttaggctatttagactcgtcgtttatcatgttttataccacatttgatggatctttttgagagtttttactcggatttttatcatatgtattgatttatagacctttagagtgtttctcactcgggcctcttctatgtctcctttttggtgtgttaaagctaaggcagtcgactggatattttattaaacgccgcatatgcttagctatatgatcccttggatgattcggttgtaaaaccacacggatggatgttcatatgcactttgactatatgattggtttttagttaactaatcatatagttgggggctacacctaattaggtacatctagtcgatgcacctgattttttctattttcagcccttcacagtctttgattttagtactcgggagaccaaggcagaggaagttgaagcactcggattatcattttgaatgacgagagaagactatttcgtcgactgtaaaggtctcaggggctactgtggagattatggataccccatacctacacggcatgtatatccgactgggtatggggtaccatgtatagatagaatatctttaaagggacttgggttaaattccaaacttgtatgtcaaggaaatacccgggatcctagttggatacgattgtatcttatctgtaactacctattccgttaggaatataggctgtaccttgtaatacggaccccttcccctatataaggaggggtccgggtgcctcttggggcacgatttttctcccagatcatacgatcaataatacactcggcggagtaatccccggacaggagcagggtattacttcttgttaagaaggcctgaacctgtataaaattccttatctctcaacacatccacttttctagcttgatagccacccctcttagtattgccgaaatcttgtttcgacaaacggagagacgaattttacgtggaaaacccttgtgggaaaaaaccacgggcgccgaccgcaatgatcactatagaggagttggatatgatacattgggctatcgcaccctccccgtgcggcttacaagagatatgtataaaagaaatctaggagtcctagtgggaaaaaactgagtcatattaggaactgatcctaatagtcaagttctattaattaggaagctattccaaatatattgtgggctcaaaatttgaatcacatatttaacagagaagatgattagtgcctcagttatttgaatgtccattattctgaaatctgaaacatatattcatatggttaagtttaggattcctaatacgtacgtatgtatgcgtatctgctctgtttttcatctcctgtcatttgtctaaaatgcatgctagcctgagacccagaactatatatattctttcacgcgtatacgtgcagcttcatgttgaaacgcacggtggttgaactatcgaccaatttcttcctgtatatgtagatagttctgtggattacttttaaattacgaatggaaattaaaacacataggcatccatatttggagataaaactttacggtgcatgtattggtctcggtctacgagtaacaacttttacgttaaaattggaaatttggttgaagttggaacgatgtgatgaaaatattgaaagtttatgtgtgtagaaaagttttgatgtgatagaaaagttaaaagcttgaaaaaaaaagtttggaactaaacacggtgtaaatatatgaaaaaaaacaaaatagcataatcactcaccgcgtcacacagcgggaacagcgtctagtctccttcactccacggtctccacctctcctctcttatcctctcctccacggctccacgtctattctccgagcggcgttggcgccttggaacatcgtcaacactagttgaaaatggaagtggaaggatcctagtaattgctgattgctgtcgccttaatttcaaattgttgacgcgcatatgcatattatttattcattccatgaggagaggggcagcatgtgccgtgtggtcgccggccgtgagcagtctcatactctcagttagtactctatcagtgcagcagctaagcctcagcctcagcctcagctagctcgcccgacgcccggcccctcctctgacctctctctgcggccggcgccgctcatggagtacggcatcacgccggccggggggtttcggtggagaagctaccgcgacttgatccgggacgtgttcatcgccggcgacatgtactgcgggccggcgaagctgttgttcccgcagatcactggtagtgccggcgaggatcaagcgaggtgcggctggtcgagcgcgagctccgtggcttctagccccgtggtgtcgtcttcttacatgtcatcctctggatcccctgcttggtcctcggcgtcgtcttctcccgtccacaagctccgcgtcatcgctcaacagatggtcggcgacggctacatacaggaactcatccgggcgttcggccgccgccgccccgacgagctcatcttccagaggtggttctcgcagctggacgtggactttgtcctggtcctccacaccgacggcatggtgcgagctgacagcttctccgtggaagacctgatggccttgataaagcggtggatccgagctctcctgaccatggtgcaggtcctcaatatcacgctgctcgagctcccactcccggtcgccggaagtacggaacggatggcggcggcggcggaccacgcgcagttcactgggttcgcggaggagagcatcctcaggatgctggccttgtcgacgccgtcactctttctgctctcaacgtcaacgacgaccaccgccaccggacgccggagctactcccggggatgctgcagctgtacgcctgcgtctccgaggcatgcgatctcctcgtctcagctggcatgggcaaggacgagatcacgaagatgcaggccttggacgccatgaacaatggcatcctgatgcaaagcaggaggaagctgagcgatgctatctgggtcatgatggagaaggtccgggctctcttcttgatggacgcctgctggcaggtctcgcaggaggcagccgcatccgggacccatgagaccacggagctgacgatgaactacatcacgcttctctggcgcaaccataccatgctcgactacttcagcgtgttcgtctccgacgccgacagcttcagctcggtggcgagactcatcgccgagatgatcacctgcctcgagtgcaagctcgaggaaacctccctctccatcccggacctgggtttgcgcttcatattcttgctcaacaattggcaccgtgtcttgcagcgtgttgaatccttgcgagacttgccagcggccgtccggcaagaacgaatccttctcctccatgcctcggacagcaagattaagaggtacatagacgattatcttaatgcctcctggtcgcctctgttacgttgcctgctcatcgacaagccttttgttgctctcgggaggtctcatgaatctaaaattgagacacaactccaaacaacctacgcaacacaaaagttttggaaggttccgaaccctcagcttcggcagagactgcgtagagccatcatgagcaaagttattccagattatagtaaatacatagagcaaatggataggcagaataaaatcaatcgacacctcgtggtcactagtcccgagcagctcgagcagcaaatagaggaattatttgaaggatgatgattattaattcaactaggaaggtaacccccgcattcacgtgggtaagtatgttttttttcacgtgtttgaccatttatcttatttaacgtttttatgcaaacatgtggaaatgtaagtcatgcttaagttataaaccaagtcacaacaaaataaataataatatttatttttaatatgctacgtgagccgtggatctcgcatccgacggcggagatctgtagttagctgcagtacgaactccaagatgtaatgtgtgtatgacaggtgagactagatattaatagtatagtaagcaactattgtaagaattgactattacattggctatagatgatttagagttagtagtaggctatactattaaacttgctcttatgcattcaacggcatggtttttgacggaaggtacacgtgtttgaccatttgttttatttaacgtttttatgcaaacgcatttgaccatttgttttatttaacgtttttatgcaaacatgtgaaaatgtaagtcaagttataaaccaagtcacaacaaaataaataataattatttatttttaatataaataaattgccgaacatgtatcaaaaattcaacggcgttatctatcgaaaattgtacctttaataatcgtacattttttttgaaaaatattctttatcgatattgattatttttaagctatttgttatatatttaaatatcaatactcactctctaaagtataagtatatttggattttcgtacggtgtctgagatgctggattttttttacaatttggtctttctaaaaacttaatttacaaatagatccctaaaaaaatttattttagaaatgatccttttttttacgccagagtggctgatgttgtcatccaatagagctgtgcctgccatactggcgccaaccccccaccaccccaaggcgctagcgcctcttgcacgcttctccggggtgggggtagcacttaacccatgggccccaccccctcccctctcactccccacacatttgccccttctcccatgctcgagcccgagaatacctcttgctctctttcccctctcacttcctccttctcaattcgactcgttttggagccattttttgcgggaactttcaagacatcgaagagcaagatatactcttccattccccctctcaaatagacttcaataattgttttgtcttttgtgttggtttttagtcactctttatgtagttgcctgaatgcttattctctttatgagattattgtaataagtggctgcagcttctttgaagtaaaggccaggatttattccattatctaaaaaattcccccctctttttttcgttttaatcggtgaaattcgtagatcggacggtaatcttataacccattgttcccccaaatttatgaatttgaacgttaaaattggggatttgtttataatagtgttacatgtgtgtaatatactcattggtgctacgattttttagagtatgtatgtggtaatgttgattaagtttaacatgtttgacatgccactattttaaatatgcttatttttttagttttggaacagaagaattgtatgataggataatcctaacatattaaattgttctctaatatttgcacatcggtttttggcatgtatagtgttagaatatgcatccatgtaccatatatttcttttaatttttttatatgcaattattaagaaatactaattaaattatgcaattattaagaaatactaattaaattatttttatattaattgttagctagaaaataggaggttagctcaaaagaaagagaggatacgggaggggagggagtacgtacgtgcaactatttctaaacataatagatctaatcaatttaattagtgggttcaccaagggaaaatcaacacttgatattattttcagaatatttagaatctttctaatttattatattgccacatggcggtttaggagtgtttatagaaatcctccattgcggcttgagagcgtttgtaaaaagtttaatggattttagtatataatagatggaattgtttgtaacattttgagaatcgtggcaagaaaaacctataaaatttagaactttctaaaactttttgcacttctttgtttgtttgagatgtcaggtaatccattttaaaacaaaccaaaacatatatattgatctcggagtataattaatatacattactttttaagcattcatgacactactagagaagtaatctttgctgggattgcaaaaatcacattagtcccggttcgaataggaacagggactgaa

SEQ ID NO: 47533 - DNA, 8845 bp, Oryza sativa
aaaattttctaaatgaccaatctacccctgcgcgccgctacctctaagcctgactgggtctggtcgaaccagacccagccggcgctgtttccatcctccctccctccacagcccgattcccgattccccattcccaaacctaaccctaggcgacggcggcggcggaggcggcggcggcagcgacggcggcggcggtggcggggccggcggcggaggcggcagtgttgaggacggcggcgacggcggcctagtcggcttcggttggtgcggcgatggacagctcggcgtcatcttcagtggtacggcgccgtggtggtggcgagttgcccttgggcaaatgtccattgtgccactgatggggattgttggctcagaaatgaagggagttgaaggagtgggacgaattttagtgtaccttggagttgtgcaagctttattattactgttgattttggtagttgtcattagcaagtaatatggactgtaataggcaatttagtatttggaagcaatgtaatgttgaacttatgaatgccctgtggaattaatgaatgtagtatggttttcagatgaaatgcagccattcgaatttggtttgatatggcatctgagcaattggaatttttgcagtactctgtgatgttgctttgatatggcattgagtaatagtgcacagcatttgcagtagtatatggcatctgagcaatttggacaacatgttgacaaaatttggccagagaaaaatttggacagcatgttggcaaaatttggccagacaaaaaattggacagcatgttggcatctgagcagtaaatttttgctgtctgaaacattggcaaaaaatttgcccagacagcaaattgacagtttggcaaaatttcagacagcaaactggcatacatccatacaacaaacatttacaagcatgttggacagtaaacaaaattttagacagcaataatttagaagccattccagaaatactcaatgccattccacatcaactagtgccatacatccagtgccacacatggtactgccactgccattaagcttggtctatacaaaagccatacatgaaagtctttaggcacattttgcctagcaaatatgagtagtactgcccattggctccataacaaaagcagtgcacttagcacataaaggagtccatgccattaaaagctaacatcagtgaacatagcatcctacatttatacaaaagcaaatttcatgtcattgaacttcagtcttcagatggcaccagctgccttgttgcttggagcatcaacatccaaattgtgagctctagccctgctccttgttattgggcttgtttgagttaccccagatgcttgtgatcttgaaggtgtggacctgcaaaaaaatgaaaatcaacataaatatgtagagtaaatatagcaaatgtatggcataaaaaagaaattttgctgttgacaacatacacagtagctgttgggacttgtataacaggatcttgcacagaaagcacaactttcttcactctttttctcttgggctttggtggggctggtggaggggcagatggatcagcaactggttcattgcaagtcttcttgatatggccaaactgaccacacctcttgcatctatactttctttttcctgaacctccttcttccattcctttaatccttctgcttctaggtctgcctgctgacctcttcaacagaggtggatataacttgaatcctacattaatcttggcccattgagacttgtctgtcattggaactacatgtcctgcatatgccttcttgaatgttgcaacagagtagcagtcatccacaaactgttccaattctagccccctccgtgaaatgactagaaaaatggcatgtgtgcaaggtatacctgttacctgccattgcctacaactgcattctcgagtgttcaagtcaacagtgtgcctccatgtcttcaaatccctaccagtccctcctatttctcctaggtgactgtgggctgagtacagcttgtatccaaggtccctgctcctagcatacagggacttcattacactaggaagaatagtaccagtcaacttgacagcaagccttttcctaacagacattctctccatgatcatttgcctaatcttatccatcaaatcaactacaggcagtgatttctcatgcctgatccaactattgaaggtctctgctatattgtttgtgacatagtcacatttactgagagtagagaactgacatctagtccaaatgtgcttatggaagttatcaatccattctgtagcttttggacatgcctctttcatctcattatagtgactctcgaatatgtcctgcctataggcccttgatgcaggccacagattcctctcaaagacctcaccactgaacctcttctgaaagttcttcaccaaatgtctcatgcattccctatgctctactccattggtgaagactctggtgactgctgtgtcaatgcctttaccagcatctgtggacagaaccaacccctctggggacccaattgccgagtaaagcttatccatgaaccaagcccaattatctgtactttctgactcaaagactccatatgctacaggaaacatccagttatggccatcaatcccaattgctgatgccaattgccctctccatttgccagtcagtacagttgagtcaatacctaaatatggcctgcaaccgttaagaaacccatcaacacatggtttcagtgctacaaacatcttgctgaaatgattcttcccatccactgtcacatgatcaacctccacaattgatccgggacttgtcctctccaactctgctttgaagttgtaagctgcatcgaagctatcttcccatttgccaaggatttcatcaagtgccatctgcctaccgtcccaaacaacgtagtaagaaatattgatcttgtacttctcttccaagaacttctttaaagcagtagcaccaagggttggttcttgtctcaacttgttgatcacacgatctctcacccatgaattggtggccatgcaattgttctccaaaccagctgtgctagcacaattatgtgcgtaaggaagcttctttatctgaaatgaaatagcaaaaatgttataaatggcagaaaacacaatgaatagacaaatcagtgaacatcaattatgtaggcctacttacttgccaagttctcccatccggtagtctagaagcatgtatcctccacttgcaccgcttagccttacagtatgccctatacctccttgattcgctatatggcactgcaagttcaacctcttttagtactgcatattgtctaatgcaccttttaaagcaattgccatcttcaaaagttacaccaacggctatcttaggattgtctacatcagttacatgagccactgactcacaaccctcctcatcgtcaacggctaaatcgtcttgatcttcgtcagaaccagggtcatagtctgcgtcaactgcctcatcatctgaaaccaagtcgttgtatttctctttctcatcatctacaccaacatactcaacctcatcactctcaccccaatcatcaaccttttccttaggcttcgtaggtttgctaggtttgctacgtttagatgcaatgacttggctctcttgagtggctaatacaatgtcagtacaagcaacttgtccatctcctgcaacagtactagccggcccatcaatgctgccttgatccatacaaggctcggtcctatttcgtgggtcatcactcacattaacaagcaaagggagcctcctcatctcccagtacatatcaaatgcatcaagcaatgaactatccgaagctatctctgcatacctctcaacatttttgtcccaataggttacagttatctcctgaagataactatgttttacctccccatcaagatcattaataaggtcaatccaacaaattgtatccttgtctattacccacttaatatcacgagagacatgataatccggtctaccgttctcatcaaactcaacgtatggaccaactcgaacatcaactctgcaagctgcgctagcgtccatcctacgcgacaaaaacgcagcaataaaatcaccaaatttcaatcactttaaattgcaacaaaaactctacaactcgcaacacatatcactgcaaacaattccactcataatgcgaggcaaaaaggaatcaagcttacccttgaggaacccaagacatgtccaatgccttcaatggaacctcactgctcgtcagccgcagggacgatttcttcccagcacacttcttccttggcgacatcttcctagctgccgctcggccgcctaccaatatgacagctccatcggcctccgccggcgccgccaccgccggccccgccaccaccgccgccgccgtcgctgccgccgccgccgtcgcctacggttaggtttgggaatggggaatcgggctgtggagggaggggggatggaaacagcgccggctaggtctggttcgaccagacccagtcaggcttagaggtagcggcgcgcaggggtagattggtcatttagaaaattttctgaccacttttgcctcggaaattataaaatattgcctccggtgtctcacagccaatttcacaactttcgtagtgtccgtgggcaaagccaagattttgcggtgtcccacagccaattacacgattttggagtgtcctgtagcaaattttgcctaattatttataccaatcggaaccaaagattaaaaaaaagcagctgcacacgcctcctcggcaaccgcgcgcctactcgttcttatcccttcttattctttttcacaaacgccttatcccttcgtcctctcttcctccactcatcctcttcactcctttcccgatcccctctcctcctctcaatcccctccccttacctattggtggcaggaggtggcaggcggcggtcgggcgggtggaggggaggacggtggcaggcggcggcccggaggggttgtcgcggcactgacgagcgggctgatgcagcgctgaagacgacgatgtgaggacttgtttttgtgatgtcgttgtagatgtgtggtgctgctgtggatgattaattttgtgaagtatgtgaatttgtgatatcaatgatctgtgaatttgtgttgtcattttgatctgtgatgtttatttgatctgtgaatttgtgatgttggtgagttgggctgtgaatttgtgatattggtgagtttggcgtgaaaacaataaattagagggtaacctttaattccgcaaaaaatttgggtttttgggtataccaacaattcacccccctggttggcttagttcttgtgattcgatcctacaaacatttttgttctctctgaattagtctgaacagttttgaactcgtccatttatctgaagcttgaacggttctgaaatctattgctccaaagtgttacctggaactaggcaaatttgaacagattggccagaaagaagctctccactgcagctcaccaccatcttcctcagcatgttgtcactgtaaactgcaacgaggaaggcagaggccaccaagtgctgtagtgagttccactcaactacatacagcaaactccctaaaataaattgctgcaagccatgtgaattattactgcattgcttccttcaatcaatttctagctaccttagctataaaaaaaatattcgcagtgttgtgaacttaccttctgaaagcggtggtccctaagtccggcaggatcgaggagtatgtgcaggactgtaggaacgaatcacaagaactaagccaaccagagggggtgattgattagtatacccaaaaaccgaaaacttttagcgaaaataaaagttaccctcaatttcgatgaaatcggtctaaccgaagtagattagccggtctgaccaaagcgtaaccgccggtctgaccggtgttgacctgccggtctaaccgccgagatcgcctgccgctcgctgtcgctgccaccggtctgaccgccgtgctcccgccggtctgaccgccacaatgctgccggtctgaccgccggtgagttgccggttagaccgccgaaacctggtgaaacacaaatcgaagaattcttaaagtagatgacgactttattgattctctccgtgtttacaaagtgcaccaaatgcactccttacaaaaatttcgactaaactcgaaaccctaactcaaaactcaactcaattgctctctaaagcgataccgggaagcctcacgctcccccttttatacatgaggtaggcagcctaaagccacgaaccaaactcatactaagagtcctaaactcatactagtacaagaaagaaactttacataaccaatcgtaccaaatttggactccttccaaattcaactccgcatcccatatgcacacaataactccatcgtatgacatatagaatctccatcaaccatgtgcatcaactctagcctaagtgtcccgcatgatctctgaccaccacggatgtcgccttatccccaagccgactcccggtccatcaccgcaaatactctcccgagacatcgagtcacctacacatggaacaaacaaagaaaccatattccgagaccaagctatctccaacttgactcattagcagcaaacaatagtattacatacgtatagtatccatctagaagtcataatcaagaaataaactcggatatccaaacaaacaacccgaaaccgaaaccgacacagcgtcggccggtcagaccgcgggctggccggtccgaccgctcgatcaccgccggtcagaccggcatacacaacccggtctgaccggtcacataaaataatgaaccctgcgatccacctatgaatccaatcatctccaaaaccacttcgtgaataaattccaaataacaaaatcaataatctccaatgccctattgttcatcacagaataataatcaaaaacacctttgattctacaatctcccccttgatgaacacattggcaaactcataaaaatgttttggtgtttggaaaaataaaaacaaaagtggtaaaaagcacacttcgtacaaatgtacacatcgtgctcaaaaatccaaaagaaaacttctccccctttttaaaagaaagaaatttccaattgaatctcccctttttaaaagaaagaaattcccaattgaaccaaaaacatgctcttctcaacaactcctccaaaaattcaccttgcttctccttgcttctccaaaaatctaaaaattttcacaattacttctcccccttttgacaatgatttcatcaagtataggaattatgttctttaatggtcaagagcttagcatacatatagcatatcaagtcatgtgttacaataaaaagaagataaacccatctagaacacaataagcatgcattaaagtataaccatgaaccaaagattttacaattaagcttgaatcaacaatcaaaattcatgatatcatacgatttataatacaacatcttaacaagcacataggttgaagaataaacactaaacacatatacctattgcatttatcactctttctcaaataaactttagcacaaaataaccaagataattttttaactttttcttttcttgagcctttttactcatatttttctcttttattccgggtacgtccctgtcgtcaaaactgtttccagagattcggcacccattattttgctcacatcgaatacgtccttgtcgtcaagactgtttccaaggattcagtattcattttttttcatattttttattctctttttcacaatgagcaattaaagctatttgaggaataacaattcaataaagcatatatatagagcatttataaatcaaaccatatgctagcatcaacattgcatatttacttaattcaagtagaatttaaatgttatgcatcatctcccttaaaagcaaaatctaaatctcatgaagagactagaatacttacaagctatgctagagacaaataaaccttcaaagtattgctagcatgcacaagaaaataccatatgtataacataaagctctcttttctcaatttttctcattgcaatattattgcttgataaaaccatgaggtacaaactctccctcaaaccatgccaaaaggatgatttatgcccaattcaccacgaagaaaagcaaagagattagaatccaaaggtttagtgaaaatatcagcaatttgcaactttgtgtccaaaaactgcaattcaacatctcccttctcaacatgatccctcaaaaagtgaaaacgaatatcaatgtgctttgtgcgtgactgttgaacaggattcttagcaatattgatagcactagtattatcacaaaagagaggtactttctcaaaagtaagaccataatctttcaaagtagataaaagccaaagaatctgtgaacaacaactagcaacagcaacatattcagattcagtagttgattgagcaacactagattgtttcctagaagaccatgcaattaatgatgtaccaagaaaatgacatgttccactagtaattttcctatcaattctacaaccaccaaaatcagcatcggaatatccacttaagcatatagaagatgaagtagaataccaaattccaaactcaagtgtatgattcaaatacctcattattcgcttgaccgcttgacgatgtgaagcacgaggagaagcttgatagcgagcacacaaacacacagcaaattgtatgtctggcctagaacagttagatacaacaaagatccaatcatacttctatactctttttgatcaatagcttcaccatcttcatcaggatccaacactgttg

SEQ ID NO: 47534 - DNA, 1811 bp, Oryza sativa
tgcgcatagtctcagcaaaatctacaaccaaagcgtgagtcgaacagccaaagatgatatcatccacataaatctgaacgaaaagttgattatcaccatgcttaacaacaaaaagcgttttgtcaacctttcccattgtaaaacctttcgcaagcaaaaagtttttatgcctatcataccatgccctaggagcttgtttcaaaccatacaaagctttagacaatttaaaaacatggttgggaaaattaggattttcaaaacctggtggttgtttgacataaacttcctcctgtataaaaccatttagaaaagcactttttatatccatttgatacaatttaaaaccttttgaagcagcaaaaaccaacaaaagtctaattgcctcaattctagcaacaggagcaaaagtttcatcaaaatccaaaccctcaacttgagtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcgttaatccacgattcatcagttaatacatgtgacacatttttgggttcaaaacaagcaacaaatgcagaatttgcacaaacatcatgagttgttaccttagaccttgtagtccgctcacctatattaccaatgatttgttccggcggatgtcgtcgttgaatgtgcaaaggagcagcgacttctgaagttgatccacgttttgtatcagtactggtcgaagttgtaatctccagaggaccatctcgaacagcatcaacagaaccctcagccgacgatcctggccggtctgaccggaggtgtgtcggcggtctgaccggcctggcgcccggtctgaccggccgagccgacctcatcgtcgtcgttgtcgttgtcgctctcgtcttcaaaaatacgaccatcctccccctgaacctgtgacagtgtacctgcaatatcgggtctagtacctggactagcctcatcaaaagaaacttcgcaagtctccacgactttgttagtctccaaaataaatacacgatagccacgagtatgtgcggggtaaccaagaaacaatccatcggtagaacgagcctcaaacttatctaaatttccagatttcaagacaagcatttgcaaccaaaaacacgcaaatgtgaaactttgggttgatgtccaaatcgaaattcataagaagtttttcctagtttagatctcaagaaaacccgatttgaaatataacaagcagtgttaattgcgtcagcccaaaattttctaggagttttatattcatccaacatcgttctagccatctcaaccaaaacacgattttacctttcaacaacaccgttttgttgaggaacacgaggagaagaaaattcatgatcaagacctctttcgttgaaaaattgttcaaatgaagtatttttaaattcaacaccattatcacttcgaattcttttcgaagaaccaggaaattcaagctccaatcgaagaaacaaaccacgaaagtgttgaaaagcttcgtccttagttgccataaagaaaacccaagaatatcgagaaaaatcgtcaactataaccaacacataccactttctacactctagctggaccaacagtgtccatatgtaatagctgtcccggtgcatccgtcatcacaaaaacaataggagcatgtgaagaagcaaccatcttagcatgacgacacggtgtacaaaccaaatccag

SEQ ID NO: 47535 - DNA, 1037 bp, Oryza sativa
  unsure (1)..(1037): unsure at all n locations
cggcggcgaaggcaagccggtggtgaagtcgtagacgcccaacagcggcggcataataggccagccgtgtaggcggaggcacccgtcgccggcgacgtaggcagnccggcggtgaagtcgtagacgcccaacagcggcggcataataggccagccgtgtaggcggaggcaccactcgcgggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcacgccggtcagtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggaggaagcaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccattcggcagcggcgaaagcaagccggtcggtgaaaacgtaaacgcccaacaacggcggcataat

SEQ ID NO: 47536 - DNA, 3490 bp, Oryza sativa
  unsure (1)..(3490): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgccctgtgctcgtaggtgtgcccatcagcagcaacataagggtcatccattacctcctgcaccaaaattgtcattgtttctatttagtctagggagataatcagaactggcgcactcaactagttagcaaattttacctgcaatattgggcagatgaagtggctcggcacagctgcgtttggacttcttaatgtgggagaagcagtaattctgctcagaatgctctcgatctctggcagcacctccgattcaaggctaggcctgtctctacattttaaagctgtacaccgcaccgccaattttgccaagatctctgcctcagcgattggccaatcaatctgagaactgtcaagaacatcggaaattgagtctttttttatcgcttcttctgcactaagtatcagcccgtgtgggcgcttgccagtcagtagttgaagaatgatgatccccagagcataaacatcagatttcggacgaattgtcccagttaactggtattccggatccatgtaatacagtgtgccggcaactgcagtatctctgtactctgtgagcccttccggcacaatatctgatatgagcttggcaagacctacatcaccaattttgctgacgtagttcttgtcgagcaatatgtttccaggcttcaggtcacgatggacaatgggctctggtttcgttgcatgcaagaaagcaagcccacaagccacctcaaagatgatttggatgcgcaggaaccaatgtagtgattgctgacctttgttgttaataagttgatcttctagacttccattctccatgtattcatacacgaggcatccaatttcagggcagaaaccaagcagaagaactaagttgggatggtgaagttggctgaggatctcgacctacataatatcagataaccaaataagtaattctaagcgccagtaacaactttattgcctagccaagaaagtcatccatcagttatgatgaagattagaaaaagataggttaggatacctctctcaagaactcatcaatcttgtcactggaatcttgctgaataaccttgacagctacttcagtatgatcaagggtacacctgtacacattcccatagcccccctcaccaatcttctttgcatcggagaagttatcggtggcaagctgtatttcacgttttgagtaccgcctgcaacttttgccagttgacagaagagcatccataacctttgtcttctcagcaatcaccatatcagctactatttcagccttatgcttggaaaaagcctcctgagcgaacaaagtttttgccatctcaacttctgtaacagcttctagatgtctggtcttctcatctgcaaccttctgcttcaacaattcctccctatgtagtgcatcttgcaccttcttcgcttcctcagtacactcactagaaagaaccttaatctgaaacatcagagtaacatggaaaaaaactaattaaaacattcacttttaatatatgaatatagatatcttcatgtacctagtaatgtaaaaaactggtcacagtaactcaagccaaacagcagccaaaagaacttaaccttatcttggttagatcatcacaagctttatcacacatcactaacctttttcttggcatggacgagatcttcacaagctttatcatacatcactaacgtatcctgcaattcctttctcagttttgctacttcatctactggttgagactgcagatcctgctaagaattgaatcacaattaatacaacttatggaaagcttatgaaagccaacactagtcagaatattttcaaggctggaaacaggtctgacctcatcaattgagctcaaggcaacataagggatttccttcaatcggccaatagcatcgggatccgtgttcacatctctgcccggtgtttttcgccctaagcttccaaaaaggcttcttccatgacttcctgaacttttaccagcattagtagaagtgctacgagagctgcaggtatgagagcctgcataactcgtatctccagaagattttggtgttccatcctcagggtggtcatgcaaagattgtttgtctagcagccagttcttctgtattcgggaaaatgatttatgactgattgactgagtccttacacaagcgcttgactctgcaaaaaatagaaaggtttaaggcaaaatgagtgcctcaccattgcatttcccaaaagaaatagtagagaatatgggcaaaacatactgcttgttcgagcctgatttgcaaacttaatagtcaatctgtgcctggacacaacaaatacattgcacgaacatggcatagctttcaggacagtagagggcacatctcggagccgtaatatcctgaaaaaggtaacagcaataccatttaacaacaacagtggatttggcaaaagtggccagaaatcgatttacatttacagagatgctcattaattttgcttatgagtttaaagttgacaaataatgaagataaaaatcccccgcattaaccagctaaagtgactaatctatttatcagcatcatgaagacaaactgatgttagttgcgctggctcttaccaatatctgtggcttcctgggtcctaattactcaaaaggcataaatgcgagaaaaaaagaaacgaatgtcaacagaaaaaggaaagtttaatcaagatatatgtacgtgcacacacctatcacctttactcagaacaagtgacaccatcccaaaaaggggctcaatcttcccttttttttttctgaaaaactttttgtcccatatacacagcatatctagtatgcactttccagttatttttatactttggggggaataaagctatacaggtaagaacaaaaatcccccttatccctatcaatctatcattggtagttgaattctcaaaagcgaaattctaacctttactagtagttgggaaaggagatttgtcacccaaaataaagtgaagaggattatatttttcaaaaaaaaaacaattaatctagtataccttttgaaccagttgagggaggtggatccaaccacgaggttgcggacgccggagtccgccgcgtacctgaccagcgccgccgtgacgctcggctcctccagaatcaccgtctccacctgcaggggaggaggaggaggagggggagctcgaattttgaggcgcggatcgagcaaaatcggcggagattttcgaggaggaggaggaggagacttacggttgtgcgggcgaagaggcggcgcagggggaggaagacctcctcctgcgcacgcgcgcggcggtcctccgcgtacatctccaccgtctccgcgtccatcttctccaccggcaccctctcccccgctgcgcgcgccacgcagagaaaa

SEQ ID NO: 47537 - DNA, 3189 bp, Oryza sativa
gggggcggctcaacggctgtgtgggggtgggcccacacgtgtgggacccacactcttgttgttgtttgactgtggcggcgaagtcgctggctcgctgctcactggaactggaatgtttaaccacgtgtggatatatgatgcttttattatccatcaggcccgccagatttttctggctaggctgatataaacagataggaggagatgggagaagaacgactctgtgtgtttaaagtagtaaagaaataaaaatgatagtattaggaagaggctagtaaggcctttagaatgaagattttttttataaatttcatgagaattgaaatagtttatgtatgaaaacctggtgaaattttcacattcaaaaagaactttcataaggcatgtcaaaaggtcacacttgattttcgatgcatcctactctagttactctagttagattctcggcgtagctcgaagcgggaagatgatcacgaacagcatgagggtgtagggatggcagcgatcaaaaacgacaattgactacaattgagctatgttccccatgctgcttgtacacattgacagagatggactgattcggctattcacatacgtggacaagtttgagtgagcagtcatttacaacaaattaacctttgggggtttgaaaacaagagtgacaattgaggtggttatttcttaaatctttataacaaaatatcatatggtaatatttttttaaaaaaaaaagatgttttactctttgttctctttttttttcactctgttgcactttaacgtttccttggatattgcacgtattaggttcctgatgttgcaatcaggttttcactgttcaccaagtgattaaacattttttattgagcagtgaaacattttaaatcatttttctaaaatatttttttactgagtatgagacatcttaaatcattttttttgctaaaataatttttattgggtgataaaacatcttaaatatttttgtacatatggtaaaacaccattcggggttttaattatgatccgacatctgatcatagttgccttgtatttttctttctgctaggcccgtcaatatgagagtttcgtagaggtcgtatttttcttttctgccaggcccgcctttaagaaaaataggaagtgctgtgaaggggatagtaagacattctttacattagaaaaaacttcttaggaattgaaatacttcctctgtttcataatataagtctttctagcattacccatatttatatagatattaatgaatctagacatatatgtatatatagattcattaacatttatatgaatgtgagccatgctagaaagtcttacattataaaacagatagagtagtttatatgaaaatctcataattaaaattataacattcaaaaatgcctaaaatataagttgtaatacagagcaaaacttcatatttattgaaagcatagccttacacttgactaacagaaaagatatcttcatcctttaagagaaaaaagagagatccatgttgtaaacaggtgttagtgtgtggatatatacataaggaaaacagtccaaacaaccactacacttttgatggaagtacatcaagcacctttaacattaaaaccagacatctaacgcactaaacttaaaaataccgttcatactgtcagggttaccgataagacataccctctctcctagaaatcatgaaatatacggatacgatatatcctcaagtatacggaaaggactcgtatttaagataaggaaatcaatgagtccgtatggaaatattctttaagggtggaaagtattagagtactacttagagaggataaggagtgtgtcatattgtacgaggtccgacgtctccgagttctattgggagacaaaggtgatatgaggtacaaatgcatacccccaggaagatacaaggcatcgaatcttagtgcaagacacccgccatcatagacgcaatccggacgacttgaagcctattcaccaatgatctcgtcagtaatctcggagttcaattgttctcttttgtaccacaatgttttcttctataataccatataaactggattagggctattaccttacagaggagcctatcgtgtagattctcgtaccaacgtacctcaataccctcagattataatccgtggtatctcccgtcggcacatattatcctgagatagttttgattggtggtttgtgtatttgaaagcttaaatgggtggctttgaataactaatataatgtttttatatataatcaacggtactcccttcgccccaaaaatataagcacttataatgttcaaattttatcccaaaatataacaacttatagcgtaaaaatttatcctaaaatataacaatttttccaccaacattctcttcagcattcaaattttccagcatcataaccttccaccattcaattttcctcactgcctcttctcaaccaatcacaagaatcctaatcctacctacttctttctaagtgagagtgaacatgaggtaaaaagaaatatttaagtgaagattttaacacatatatccaatgcctatgtcatgtgatgtgatcaaactcatctactgtataatacaaattagaaaaaaaaaatactatgcaaagctatattagagggctatataaatggtattgtaaagtttaaggatctaaatgtccggttttaaaatgtccggttttaaagtttaggtgataaatgaacttccatcaaagtttaggggtgtatttggactttttctttttagtaaataaaacccatcctaaatttttatcaaactttggatgttggaggtccatctttactttcctcttcccttagcatgtggttaacattagtaatctttctaatggattgaatattatgcatcacataaatgatatatcctatcttttgcacaacgacatttctcatatcaatgatgggaatggctatatgaagtggggatctatatactccctccatcccaaaatataatgctcaaccacttttctctcatatctctaatataagacgtgcatgcatacatacattaactagcacctcttggtccaatagaattgatttgtcttaaatcctataccatcaaaccacccaatcacattactcgcatgcatcaaggtgatccaatcaagaaggtgattaaatgttttctt

SEQ ID NO: 47538 - DNA, 752 bp, Oryza sativa
cgtcacagatgagtcatctcaatcgggttgagttaatgcccgtcacagatgagtcatctcaatcgggcctaagttaatgccagtcacagatgagtataatcccaaaaaaaataaattttatttttaggcatgccgtctagcctctctcaggccgccaagcacgcttaacatcaaagttctttggagatcagcttccggaagagaagttgtaacttgtcggtatgagtattctattaatcctattaagccctaggctaggacgtcacaccccaacatccctcattcatatacattcattcacatacacaaccatcaaaaatcctaaacaacaaaattgtataactcaccgagatctacaactattgtatcggtcctttgtacaaataagttcatttgaataattcagattttgaattttcaaaatttgacaacttggaacaaaaattagggttaataaataatttcaaatggaaaagtcaccaaaaccaaagttgtagagctcatcgagatgcaaaatttttattttggtcatttctccatccgactctatttaaacaatttgaaatttgaaattcaaagtttgagaaattcaaacagaattttttgttagtgaacgacttcaactgaaaatgtcatcaataacaaagttgtataactcatcaagatctataacttttattttggtcatttttctatataatattttttgaaccgtttaaatttgaatttgaaaatatgacaacttcaaacaa

SEQ ID NO: 47539 - DNA, 800 bp, Oryza sativa
cctcttcttcctcctccgtaaaaatccagagagcaccactgccaactgcatgcgtaatgcatattcctaacacgtgtggccgtcatgaaaatcaccatttttcgttggtctcataatttaagagttgatataatatcatacttagcctgaaaaagctgtacttttttatgggctttcatgactgattcaattatagtatatcgagtgaggatgacaagtcagtgccactacatgatctaccgtagtatatttaagtcattaagtgcaccgagaaggaagagtagttcgatgtttgtgttacctatctctctacctcttattcaagttctgtccaaaatcacagtcaaaatttctgccagtgacggctcatcatctacttaattatcttcttcttcttcttcttcctcggttctcctcatcctgaagaaactgtagctaagctgcccattatcatcctctctctgtgattgtttggtgtgtcgcttcttcgatgtcaggggaggatgaagcgaagccggtgaccgtgaagatcatcgagacggtgtacgtggaggccgacaccgccgacgacttcaagtccgtcgtccagaggctcaccggcaaggacgccgtcgccggcgatgcaccggagctgaatagtgcccagaggtttggctcagggagagaggccagtcgccatggcgatcacaaggtaggctcctccagcgaaaagaagagcagctaataaagaagctattgctgcatgaataagcatagcataacttgcatgctacctcttcaattattattttttagtaaat

SEQ ID NO: 47540 - DNA, 2545 bp, Oryza sativa
ggatgctatctccaagcctcagagaacctaaagagccttaagctgtacgggtatgcagacgacaagctgccagagtggatcacgctgctgcggaagctcagtaaattgaatctacagatggccatgttgccgtcaggtgatgggctccagttccactcaggcttcgacagtctcgtgatactcaagatttcctgcagccccagtttacaggccgtaacgtttcactctggagtaatgcctagtcttgagtgtctgaagctccgttgctgtaatgtctcatcgttgaggctctctggattagaagcactaaccggtctcaaggaagtctggttcggtggatcctatagagaagcattcaagcgagagctgaagagacagattggccagcttcccagggaaatgaaacctgtcttgaaggaggagcaacgcttgccctgaatcctgattggggtgcactgcacgcagctatgcgtgatagtcgtcgcctctactgtcccaggagcacccacaggattacacgagtgctgttgttcacttccttttcactacgactctgtccagcctagcttctcgaccactggaatagggatagttgtgtatccagcgcacatctctagctgtaattgttgttagttgatctgttgatgtcactgaacactgaaatgctatgttccatgcatgccccttttcatttcattgtatggatgaaatggactgcatattgcctggattagcaggtggattgattatacaccgtagtatgtacagcacagcacattcattctacagtctgaacttactgcgcacctggaaatggcacattgctatggcaattctatgatcgaccttagtacttctctatcgagggcattgctgataaccaaatgattgtggacaaatcctgtctggggagctcatctcttgcttcatcagtgggacttcacaggatttgtgcaggagagacgtcgtggctaatgtcatcactacttgtgagaccccttgatttttgcaaacggagcataactagcggcgtctttgcatgcgtccccttaagtggcccgtacggaaaaatcgattttcccatacgggtcttttaagaggaccgcatgtaaaaatgacacttaagcgcccgtatggaaaaattatttttttttatactggccacttaagaagccgtatgcaaaaataaaatttcaaaaatttaaaactatgaactccaaattagatgattcttttttctaaatatttctaaaatcatgctctatcatgttattgtgttcttgctgctattattttggttattttttcttgtgactttgttttatcaattaaaattttaaatttcaaaactttaaataatattttgaaccagtaattgatttcaactgaaaaagtcatcaccaacaaagttgtataactcatcaagatctataacttctattttagtcatttcttcatccgacaaggttatttataagattgttaataaaatgtacatctctcttgtagttttataaactttataagagatatgtgcatttttgtgaacaattttataaatcactttatcggatgaagaaatgaccaaaataaaagttatagatcttgatgagttctacaactttgttattgatgactttttcagatgaaatcatttagtatttgaaaatgttgtttgaagttgtcataatttgaaattcaaattcaaactgttcaaacaaagtcatatagaaaaatgaccaaaacaaaagttgtagatcttggtaagttatacaactttgttgtttaaaacttttccatttgaaatcatttattgctttaaaatattatttgactttcttatattttaaaatttaaattttatatagctcaatcaacctcggatggaaaaatgaccaaaagaaaattggtagatctccacgagttgtacaactttgtttttgataactttttcatatgagttcatttaatatgataaattttgattcgaagttttgatattttaaaattaattgtttttccctcctcatcccttcaaattttttcatcaccccttctcactcccctgtctagatacttttaccaccacacactctctctctctctctttctatcctttcccctcactctctctttctttccaactctctttctctcctctccactcctcctcgagcacggcggtggctagggcggcttggcccggagctagcggcggtggcgacctcgggcggcggcgccaccgccatctcctcctcaccgccgccgccgccgacgaggaggaggtgacgggccagatccggcggcaggcgacctcgggcgacttgaggcagcgacctcgggcggcgacgccaccgccatctcctcctcaccgccgccgccaacgacgacgaggaggcgatgggccagatccggccgcgccggtcctcgtctcgcccggatccggaggcagcgggcctcgtcctgcccggatccgacggcgaccttgggcgaagagtgccgcggcgacctcgggaggcgggagcggctggcaatggaagcggca

SEQ ID NO: 47541 - DNA, 3113 bp, Oryza sativa
acgggggtgggcggcggcggcgggagtgggggcgagcggtggagccgggagtggggacgggcggcggtgggagcgggaacaggtggcggcaggagcagccagcgagctcgggtggcggctagggtttcgttttttcttatttttcgcatgcgggtgccctggccgcatgcaaagatggcgatctttgccgcatgcgaaaatcgttgccggccgtatgtaaaaacgtattctgtagtagtgcatgctcctcacactgaaacattttattttaataaaaaaactattctttcttgaaagtagtgaaaaaactaatcccagccgtgataattacactggtgtaacctcctttggctaatatacatctaaagtatgtagtgaaataactaatctttctcaatacggtaatatgcctgccatgtcatcaaagaaatacagaccatattcaatttatattttcagcaagaatcctagagctgaagccattacagacacggcctaaggatagacaaacgcggccttgaatgattaataatttttgttttgtttgtagaacacaaagatatataatggactaaaatgcatttttgttctcttcaatgaaagggatgtatggcctggcatgtaaaacaatgagaaagtgcggtaacttctaagtaaaagggagccaaaatttattatagccaagtccatgcaagcacaccaagtcatggccctcaatttgtaacctattattgacaatattgagtatttccatataacggaataatttgttcaggaggggttcaatttagaaggaggatcgaattacagaattcgaatcctgagggatttaacatttggcaagatttgggattcacccggatggatttagtcaagatctttggtaaaaaaaaaaacctaaatgtactcaaagaaacacatgttctattgtgcgggctgggctaggcccttcaaggacgaaaaccagacttttccgtgaattcttttaaaataaactctttttacgattttagtttgtaatagggtttagatggcaaattcccactagcctttatttgtagaacaaatacaaaagattatttcttaaaaaggattttcatatattaattaatattagattttgtttataaaataacttcctccaggaattatccctgaagggggttttctttaaagattcagtaattgtagacattcgtaaaacaaatacccaaaaggggttctaaattatagaaaaagagtttttaggaagataatttatatttacaaatattttattattttataatcatggttcctttagtaaataatattttaatccaaattagattttaatttccgtccttgtggtcaagcacaacagaaaaaagaaagtaagatacaataaagaaatttggaaaaagatttttgactattccgaatttttttcatatttcaaattcaaaattttcaggtgttacaggtccccacgcgccttgtgagttgcgaatggctgaggccaatcaccggtcggacacacgctgcccgtgccacaagaaaactcggtgctagacctcaaatctttagaaacagatctcctgaaataactgtacatgcagttatgtcacttataaattgatctcactttactataattcacatgtaaatatctcaactgcgtagtagttaagttaaagtatcctgttcctaaaatgttgtatttcgttcatagtacaaactcaacacttttgaaacccaggtcaagggtgaagacatcactattagaaaaatcgttttttcaggcggcccaaaacagttttcacagacagagagaaggaccgtcggttcactgtcgcctgtcctccatcgccttcagccgcgcctcctctggctccggttgaccatccagcaggtcggaccggccgctgggaacacagtgacggaggaggaggaagacgagggatgtaatggctagcagcacgaaggcggcgagcatgaggaagtacccgaggacgacgtaggacgccgcgagcaccgcgcaggcaagcaagcagagcgagagggcgctggttatcctgatcgcggcgactaggaagaaccaccggttggctgtggcggcgacgttcacggccctcttcgacaacgtcatcgccgacatgccgacgatggcggtggagaacatgaagaagatggagacgtagatggccgtgaacctggtggttgcgctcactagaacagataccatcatctcaatcgggcggcaacccccatctcaatcgggcatggcgtccgttacaggctagaagtcactgatgtgaaaagttatctcaatagggtaaacggccgtcacagatgaacctatctcaattgggccataattaaagcccgtcaccgatagttttgacccagacgatcagtcaaactatagcccgtcacggatgacctatctcaatcgggtctaaactatagcccatcacagatgacccttatctgtgacgggcattagctatagcccgtcacaaatgagtcatctcaatcgggcctaagttaatgcccgtcacaaatgagtcgtctcaatcgggcctaagttaatgcccgtcacagatgagtataatcctaaaaaaaataaattttatttttaggcatgccgtctagcctctctcaggccagtcttttttgtccttactcgtgtgcacctgggaagaacttccccctatctcaatcgggccataattaaagcccgtcaccgatagctttgacccagacgatcagtcaaactatagcctgtcacggatgacctatctcaatcaggcctaaactatagcccgtcacagatgacccttatctgtgacgggctatagcttaggcctgattgagataggtcatccgtgacaggctatagttagactgatcgtctgggtcaaagctatcggtgacgggctttaattatggcccgattgagatagggggaagttcttcccaggtgcacacgagtaaggacaaaaaagactggcctgagagaggctagacggcatgcctaaaaataaaatttattttttttaggatcatactcatctgtgacgggcattaacttaggcccgattgagacgactcatttgtgacgggcattaact

SEQ ID NO: 47542 - DNA, 7492 bp, Oryza sativa
gaccaaaataaaagttttagatcttgatgagttattcaactttgttgttgataactttttcagttgaaatcatttagtgtttaaaaatgttatttgaagctgtcatatttttaaattcaaattcaaacggttcaaaaattgttatatagaaaaataaccaaaataaaagttatagatgttgatgaattattcaactttgttattgataacttttttagttgaaatcatttagtatttgaaaatgttgtttgaagttgtcatattttcaaattcaaaattcaaactgttcaaaaattgttatatagaaaaatgaccaaaataaaagttatagatcttgatgagttgtacaactttgttgttgatgacttttccatttgatatcatttactatacgtaaaattattttgactcataaattgaattattatactgcaagttaattattttgctatagttcaacttacaaatataaacatttcatatgaaaaatgagaaaatactcatcgatgacgggctttagttaatgcccgatagagattaagtcatgtagaagttgaatttaaacttgcatatttgtgaagtgttatatcgcatattaatacaccttctcaattatttttaatttttttataaccattttagtgacatgcaaacaacaaaaagatatctcctcgagagattaaaataatttccccgtcacggctacgaggcacttggaggcaccgcgctggacgccggagacgagccgttggggaagcccaatcatggtcaagctgaggaaaacgaggcagctcccgctgacgcctgacggacgtggcgaatgccaacaggagtgagacaatgaagcgcgtgttgctcgcgtgcttcgcctcggtggggaggcagagcgaggcggtcagcacggtgaagccgaagacgacggcgatgccgctggccttgaggttcgccttcgccttggcattgcggagctcttcttcctccttcctcctctctgtcggagcaccgccggcctcctcgtcctacattggaaggtctgtggatgaccaacggttaatttgtaaatacagtggggaaacaattttttttaagaaaaaggaaaaaaggcaaaagaaatgaaagaaaggctaaagtaataagttcaccggccgtccctcaactttatgccgagtctgtttgaggtcccctaaccacaatatccgaaatgtgtacccctaaactatataaaaccatccaaaaaaggtcccgaggcagtatagatgcctgattttgctgacgtggcatcctagtcagcaaaaacaattaaaataaatatgtggggctcatatgtaagtgagagaaaatagtgtgggccctctcttctctccgcttctctcgagcgggcattgtggcagatgggggagaggtggccagcagtggagcaggggcagcggagagacggacggcgcaacagtgagctcagcggcgaaggagaggagcagcgcgtggcgtggcggcaggagagacgagaggactggcacgcagaggccgagctgctgcgccatagcgacggcctcagcctcggctttgccgtgatggacgatagcgccacgatgctcggtgcgctcctccatgccgcttaccgacacagcgcccgccctccccctcccccaacccggtcatctgcaacagcagcttcaacaacagcagtgggagcgagcatttcgcccccctacctgcaggaggaggcttcctcatcggagagcagcagcatgtgttgccggcgtcctacgccgcggcaggtgtccgattcatggccacgggagaagaaacgccgcagagctttggctttggcagcctcttcaatggcgatctcctgcaggaggcgaacgggagcatgtatcattatcagcagcagcagcggcagctgggcattgtgccctcgtcgcagccactgtcagggactcgagtgggctgcacatgggccgctggctgcaccacgggctggtcagcccatcgccaagaagcccaagcaaggccaagctgaaattatatgagcagcagcagcttacaggagatggatcgaacagattcatttggccaaggcggcgaacgacggcggcggcgacctagaggctggctggcctctttgtcgatctctcctctatctcccttcttctctactagtctagaagctactagaaccttctagcccttgtatccttccatcttccacctcagaaccactccactattgtaacagacttggttgttccctgtgttggatttggcactgctatttctgaaattacattgttgagtgggtctctaacaatttggtatcagagccaatccccaccaagctcatcaagcaagctgccatgggaagtgaggacaagtttaacatgcttttaaggatgctcgaagagtgcgagcgaaggcgggaggaggcagaccaaagaaggagagcagatttcctgtctctcaaggcaacaatagactcgtggatgccccaagaatagaagaaagctgaagaccttcagtttttggttgaggatgagcagtccaaggtgacgcccaccacctgttcaatggagtgccccaatggcagcagcccgagcacaacagcgagatccatctacgacgacgagggggctactccgacgatcatcctggagcttggggatggtgaggggaaggatcgcatgcccttcatcattagcaaggacctttccgagttgacgcctatcatgtgtttgacaatatgctcaagcctcgacgtcgagcctgatttcaccgtggctgcggtggttacatgctccaacactgccatggactccaaggagttggtagccaccgatggtgcaaccggcaccaccaacattgacccccgtgtttgttccaaggagacgcacaccaagtgtttgttgtttggccccgatgtcaacggtgtcactgatagaggtgtgattgtgttccaaagtaggatgggtgtgttcaaggtcgttccgatatcaagtcagtccatggagttgatggttgacgagaaagcaacctgcactgacaccactcaccttcccaaggtgatgcacccaagccatttgatgttgggccccaacgtcaacaccggtactatccaggctggggttgcgtactcactattgcttggcgcgccagaaggaatagcatcctcgggaaaggccacactagtcatggcacaaaagcttaactccaatttctgcctaaaatgggtggcgctcaacaggtgttcgaccaaatgctccaagggctacaagaagctgttgatgagtcatcccaagagaaacccatggccacctccttgctcaggtagagtggttagaagatggaaggagtggtatgtgccttgggctgcgggcaattatttggggataatattttatttcatgccaccatggccaccaccaactcaaattggaaccataatactttggctgctggtaaacacatggttgacggaagtagagctgaaaccgtggcctgacccacaaccaagtcaatatagcggaggcgtgatgtgaactgagcaagtcccatagcctgcaccagtttttgcacatttgatgggatatgatttttgcagtgcaaattgcataagagaccaaacaccttctgttgcactatattgtgcacctaaaggagatttaaatcatgaaaaatctgatcgagctcataaggatacattggtggcaatatttaacttggaacagttccattatgtgggtggtgaggaaaaagttatagagggaatgttatatggcctaattacagtaaactgcaactacttgatcattcctgctgctacaatgacaacaacatctactcaaaatatatatatggagcttgttggttggaggctagagaagggttaaatgatatagctaagggaagaacttacaaaatttgtaagtccatgcgcatgacacttaatcatgttgagagctggctacagaacccaacaaacatattatacaatggtcagttgtttaactgtccagtgggggtacattttggggtcagaaggatttctgagattattgctagaggtgctggtgagaatcagaataggaaggttaagacatgtagttatgattccatttttgatttctgtgagaataatcctagtgatggtagtgctgcagcaaggttttccattgatgggattgataccaggacagattcagagatgatatatgcatcaattgcaaacagggattattggtctgttaaattattcgaggtcataaaagaggggtgcccaatacgccacttgttactaggtgatgtcaagatagaacaattgctgcaatgtgagacattcagtacaagacagacaaatatagagcaagttatcaagctacagctgagcaattccaaggaaatacaagagctacaggtaccatgggatccaggaggttttcttcatcggcttggggacaagccaaatttcaagaagaggggattgtcaaggactcgggtgggctgcacatgggccgctggctgcaccacgggctggtcagcccatcgccaagaagcccaagcaaggccaagctgaaaattatatgagcagcagcagcttataggagatggatcgaacagattcatttggccaaggcggcaaatggcggcggcggtgacctggaggctggctggcctctttgtcgatctctcgtctatctcccttcttctctactagtctagaagctactagagccttctagcccttgtatccttccatcttccacctcagaaccactccactattgtaacagacttggttgttccctgtattagatttggcactgctatttctgaaattacattgttgagtgggtctctaacagccacatcatctgaatgtgagtagtgactcgacaggagcaaaaaacctaaattgaatctgacatttaccattgttcttccatcattcgtccagtggtaacattttacatgtcttgcatcaccgcctgctcgccggcctccccatctccttcctctctgcttctcgtgcctcctccttaaagcggcgttcgttgacgttggagctccctccttgccggtcgtcgacagtagccaccgtcgacaaccacgacagtcgtgcgcgggcaagaaagagggaggtaacatctgccgccggccgtatctggcgctcatccgtgcccgctgcgctgctcctctcccctgccggtgcgacacgcgctcctcctctcctgtcgtcgtcgtcgcgccggccgccacctctcctcctctcccgccactgccatcgcgtcggcctcttctctctccctctcccgccgttggccgcctctctccccctctcccgccgcctccgctccgccgctggccgcctctctcccctctgtcaccacgccaactcgatagaatcaggagagaagaggaaaaataagaaaggagagatgtggggcccacaccattttctctcacttatatgtgggcctacatatttattttagttatttttgctgactaggataccctgtcaacgaaaccagacatctatactatgtcgggacctttttttagacggttttacatagtttgggggtacacatttctggtattgtggttaggggacctaaaagagactcggggcctgatcggttcagttggctgcggcgttttggactgcagctgtccagcctagacgatcggctgcaacccaaaattctacagcaactgttatgttttgaatgtgcacactgctgcaaagagcagctgcttgttggttgttaggaaaaagtatatacgaagtccctcatctcgtcatcggattacaaaatcatttcccaaccacaaaaccaggtatataacatctctcaaaatacaaaaccggttcactctaagtcctttgacggttttaaccgatgtgacagctgaatcattgtgggacccacgtggaccccacatgtcagggtgtccatgtcatcatctctctttcccctcttctctcccttcctcccactcttctccttgtcgtccgccacgaaggggtcgacgatgcatgccgtcgtggcgccgctgccgctggttccgggtggcgcgggcaccacaagcatcggcgccccggcagcggcattgccacgttgctcgcgctgccagagaacgcctgctcgttcgcggccgtcgacgccaccatcgcgtggctgtacatcctgtcgagcaccatcatgcgtaggccctggcccgcacgtcggcggcgatcccgttccgggacttcacgcactctatctcgtcctatttcttctcgatcaaaacacatcccaaaaatccgagaaaaatcaaggaggagcgcgggatactggcgcatcctcgtgagaaattcaggctagatcgatggcggtagagggacaggacaaaataagaaaagaaatacagtagtcttctagcaaaattgttgtgattttcgtctgatcgagacggcctctccatctcgatttgtattctatgttctagccttcagggagctccagagcatgcatgcaggcgactaggcgaggcttccagggttcgttctgctttgaattccgcctcgataaggttactaatctctatccccttggtcctatgatgaggcagccgcaacgccacgctgcttgcgctgccgtagaacgcatgcgcgttcgcggccgtcgactccgccgtcgagtggctgtacatcccgtcgagcaccagcatgctgaggtcgcggactggacaagcgccgtctcccggtccgtcgacgaggggtcggacgcgtcgtgcattggcgccgacccggctgggttgcctgctgcccgtgctcttcgtcgtgaacagggcgagcgccagctgctgcctgctgcccgtgctcttcgtcggacatggcatctccgttcaagttcaggaagtcgggtcgccgtcgggagatgagcgggggcacctccggctcagcaggcaccgtctccccggccagtctacagtggtggacgcaggattaaaataaaaatgaggtgaagatgctcatctcaataagaacaactaaacacaaaaaaataccatatttatattgtaatcatataaacatatagtataatcaataaattaaggcaaacaaaaaacaaaaatgatattaaaatagagtaataatttttgcgccatacataattcatcatacataaaaatatactagtaaacatatcaatttgcaaatatgagttaattcataaagcatggttgatagatatcttttaaaaagtaaatatatgagaagatatcgcatacccagaataagatgattattattttgcttagattagaagggagagagagaaaaacattaggccctatagtaggggacgggggtgagcaatgttgaggaattgagtcgggaaagcatcacatacgcaggattaaaattggacacttgggctgcttatttatgggccaattgtgatatggagggttggggcggctcaaaaatgatatggagggttggggc

SEQ ID NO: 47543 - DNA, 15621 bp, Oryza sativa
ccccgcctaatgggtggtaccgcccctgtccccggcgttctgctcctcttgcaccggaaccggctcctcggcgccggaagggccttgatggtgttcatgtcgtcctctgcgacgggagatgcctgtcggctgggtggttctggcgacggccgcggtagcatctgccccgacgccgccatggcgcgccatcacctccgacgagcggcggggacggggagcgcgacaggagagcgtggacactgccgtcgctgcgtcacccaccgccatgggggtcggtcctcttgctccagcgtcgtcgtccgcgtcacccgtcgtcggtcgaaagctgtcggacctcctctcccgcctcagctcgctggcctcctccccacccaccggccggcctgccccagatgaggagaaaagtgagagaggaggaatagagagaagaggggaaagagatgacatggtcgccctgatatgtgggtcccatgctgactcagctgccacgtcagataaaaccagggttaaaaccgcctaaggatccaaagtgatccgattttgtaagttgagggatggcatatatctggttttgtgattggtagatgattcgtaatctgatgacaagatgagggacctctggtgtactttttccttggttgctgctgcagcgcaaccacaagcgatcagcctctcggtgtaaagttgagggatgtatggtgaacttccacaaaaataagcccgtcattacacccatgttagatcaaggcccaatcactcattggcccagctagcggtttcacccatagcccgccaagctgctctgcttccgcacgacggcccaccacgacgtacggggtcacacagcatgtggaataagttcattctaggccccttaattttacaccgaattcgatttttatccttgaacccaaaaaacagatacaatcggtccctattaaaaccggtgcaaataaagtccctggcggtttagaaggcggttttggctgacgtggcgccaacgtggctagtttgacttgatcttcgtcacacgtggcatatgatgtggcgcttatgtggcaattcgatacttgaaaaataataaaaatcgtggccccatacgccagccacacacaaaaattaaataaaaatggtggggcccacgtgggccccacatgtcagccttataccttctttcctctcccctcttcatcctcaccctcttcccgcaggcgagcgaggcgggcagccggcggcgccctcggcgacctcgcgcgccaccgccgcactccacctccgaaccgccgcctttctctcccttcctcccccggccctcgccggcccaccgcctccatcctcctccccctgtgccgcctctgcagcagcattgggaggtgaccggtgagtagggagccacggcgttccgcggcggcggagaagaggcggctgtggcagtcggaggttcgcgaggaggaggtagcgaacccgtccgcggcaagcggcagccgatgaggagaggacagaggcgagggagaggagaggggagccggcgagctcgagcttgccatctcggccgcccgtcctcgccgaccaccaatgcgtccaccgccaccccgacgccgagctatggggccgccgggacaggcacgggcctcgccgcgaggcgcgacgacgaagactgcgtgccgaagaaccccgacttagtgttatccacggcgtcggcgctgtcgtcgtcctccgccgccttgctcctcgcctgtgcggctgtgccgctctgctccggacgccgccgcccacctcgctctgccccgcccgtcgcctgctccgaccgccccgctccaccgccaagcaactgagagagagagaggatggagagaagggtggcgcccgacggagagaagcccgcgtggcccgacatgcggccctccgctcgagcccgaacgatggcagcggccgccggaaaaccgcccgctcgtcttacctgcacgagctgattccgttacacattctggcggcggtgtcgatttgcttctcgccggcgagcccccggctagatgcgtcgtatccgccggtgaattggggatttccggttgcgaacacagaagaatgaccccatcatgtgggtcccgcgtggtcccacattttttattattttgtatgtgcctgatttgtgggtcccacagtttttattattttttagattagattgccacttaagcgccacatcattgccacgtggtacgaagacttagtcaaataagccatgtcgacgacacgtcagccaaaaccaggttcaatatcgccgagggacttcatttgtactgattttataagttggaggtaagcctgccaatgggctagattgaaatgggcccaatggattggtttcagctttgggtgtagtttggatggatggaaatggattgaggagtttaatgggctggactggttagggtggaggtggaaacggtttggattggattggtttttggtttctgatttttggatccaaattggattcagtccatggatttctttggatgcactagacagtccagtactctccaaagtccaaacctagcgtcatcagtcgtccacggctccactccttccgccgctgccgctccctccccttgcttcgcctcctccacctctccgccaccgtccgcgaatccgccgccaagccgtcgccggtcagattccctcccccaccaccattgcttttctttttccctggtttttctcggtctttgatatatcctggttgttttgtttgtgtttttttttgggtctcttcctgatcttggtggttgcgggtacaggtgaagcagaagaagaggaaggtgcgtgcgccgccgggcgctggcgaggatgtcctcctctggcggtccggccgcgtcgccaatctccctaagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgcaaattatttaacatatcattacagattgagtcctgatatgattttgagatgcaaattaattctatggtcaatcgaattttagtgtgcaatttttagattgtagcacatgtacaatgtgtgaaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattgacagccaccaaaaagtcaggaacaagtcaccttattaatcacatagccgaatcatgtccagctattgatggtgatgctagaatcaacttccttgcaacaattaagaaacagactggggaaggtttcgtgtttgttcccaagagaagccgggagctaatggtcagattcttcattcatgcagaggtgccattcaagaaaattgaggatccttattttttggagtgggtggagtccatgcagccaactttcaaagttgtggggcgtcaaacacttcgtgatgatgcctttaacttgtatgagcgaatgagggaagacttgcatgctgaattacataatcttgattcgcacgtatgtctaacatccgatatgtggacttcaattcaaaatataggctacatggttgtcacagcacactatattgatagagagtttaacattaagaagaaaattataagctttaaggaattgaagtatccccacacgggattcgccattgaagaagctataatgagttgcttgacatattgaggcattagagcaaactgtttactataactttagataatgccagtaataacaattctgcatgtcaagagttgataaagaatcacaagaatgcattgatgtttgagggtcagcatttgcatgttagatgttgtgcccatatcctaaatattttggttcaggatggtatgaagataattaaacctataatacacaagctacgtgagttgttgaagcatttagattcttcagtatcaagaatgcaagatttcaattctatggcaaactcgaaaaatcttccttcgaagttgagtttttcttttgatacaccgactagatggaattccacctataaaatgattgtagaaggattaatgtacatatctgtcctggatagctatgcaaatcaacatggtgaagttgcacctactgaactagaatggcagaaagttgaatcaatttgtgcttttcttaaagcttttgaagaagctacattatcggtgtcagcagataggaaaccaacagcacataggttcttgcccttggtgctacaaattcgtcatgcattgaatgaccctgattggcagactagtgatattttaaaggtattggctgcagctatgctctcaaagtttgtcaaatattgggacagtgggtttaactctgcacttgtcattgccacaatgttagatccaagaagaaaaggagattatttgaatttcttttatgagaaaacatctaacagtgtgacagagattgtcaaaaaagtgggttctgctgaagattggttgaaggattattatgaaaaatacgaagggtttgtaagaagaaatgatgaacacatgctttcacattcttgtgaaggcagcaacagtgttggatcacctgttcttgggaaaagaaaactcgaggaagagtttgctttatacaagtctcgaaggagaactgcacggcaaacgaaatcagaatttgccatatatttagaagaagatgttgaggaggatagtgagagtttcgatgttttggactggtggaagagacatgctcaaaaattcccagtattgtcatctatggccagagatttcctagcaatacccctcagcactgtatcttccgaatcagcattcagttgtgggggcaggatacttggtgacacacgaagttcgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcatatatcatttacaggtggaaatttgtcctgatttattcaggtggtgaagtgaagaagatggaaaggtgactttccatatacatatatgcaactttaaattcaacttttcctttggcgtattggaaatttggaatggaatacttctcttgaacctgcatttttccaaaattgagtttaccactttgttgcctattctgtttgtatataaaatgttactattcattatttaccaattgaatcaatttggcacattgttttgataacactgcaaaggtcacattatttaaattgttattgtaattttgtatatttgctttcttaagcaacgaactcacaattttctagttattcctggatataaatttttgatgacatctacttctttcaggttactgtcatctgcaagaatgtgtggctgagaattggaagggtttttggttttggttatcttagaaggtaatctaaagattgagacatgaagaaattattggtgttcagttatacatggttctgaggcttgtaatgcttgatagctttttttgttagagattttctcttgagcctgttgctctagtagaatctctagtgataattgtaatatttagttgccaaaacttgttggatggcactacttaaagcatcaaaagttctaagtatgctagtagtgttgattgattatttttgcatcttgcttatgttatttgtaagtatgctagtagctgtatgcagcgtgagtgttcgccggctgctctgctctgctctgcttcctgccgtggattgggtatgggttggaaaatggattccacccgtggattgtgttgaatctggactgagcaactttgtgggttgggttgggtggggttagctcaaggaattcttggtatggattggagtgacaattttgctatagtcactttgggttgggttggattcggggtggatgccaacccattggcaggcttagttggaggatgtgatgtatctggtttttcggttcgaggacgaaaatcagattcagtgtcaagttaagggacctagaatgaacttattcccacagcatgtcgctccctgcgccgcctcgtggcctcgtcgccgtcggccgtcgccctcccgccgcgcgccggcgacgcgcatcggtgggcagctggaggcgcccgcggtgcggcgcagcgcaggatccatctccgaatctccactggcgctggtgtgaggaatacttgctccctctctctctgtccctgtgtcccgcacgaggtcatttaggtttgtttgggtgtagaaaggggatcgtcgacatggggagtgcgggcattcgtccggttaaacttccaactgaaaaattgatgccaaaatctgatgccgcgactcatccgatcctgaatgaagttgaatcacagcagcagctgtgctggcgctgtgaagagctcaaaacgagtcccaaatctgccaagggaacgagctatggataagcgtagcgtaccaggctagaactatattgtatgccaagatgctatgcaaatatcagcactataatttagcttttatcaataggaggacacgggagaccaatggaaactgcctgatctgatccactcttcagtcatagttggcattattgcaacaaaatattgcactttagttccagtactgttatttctaaaacaacacattgtgtatgtagtacataataattaataaaatgatacattcactggcttggacacatttatagtagtatagtagatgatatcttgcgagaaaatttaccacacagtcaaacgacagatctcttcacccagaaatagaagactccaacattgttcaaccggcttcatcaacagaaacaagcatctccaccacactttccatggtgggtcttctggctctgtcttcttccagacatgaaactgcaagctccatcatcactcttgcttgcaagttgttgaatcgagtgtttaatctggcgtcaatgaagtcagcaatccatgactgttcatccccatcagacgttagattctctgctagcattctaatgattcttccgagaaccatttccacctcctcatctttgtttgtttcaaggtccgaaacacgagctccttttagtagttctagaagcaccactccaaagctgtagacatcaacctttgctgttatcggaagactagaaacccattcaggcgctaaatagcctctagttccttggatccgtgacacgtttaaattggatcctcctctatgtagcaactttgcaaggccaaagtcagctatctttggctccaaattctcatcaagcagtatattttcaggttttatgtcacagtggatgacccactccaagcactcgtgatgaagatatgccaatcccttagccacacctagagcaatcttaaatctttgctcccattctagtaaggcttgtgattcctgactgtcaaacaatattttatccaatgaaccgttctccacgtattctgaaaccaatatcctgtgtgaatcatcagaacaaaatccccaaaccctcactagattcatgtggtagatcctgccaatcacactcagttcatgcttaaattcttcttccccctggtttatgtctagcaactttttcacagctactaccctcttgtccttcaagacccccttgtatacaacgcctgatgctccttgtccaattgcatcctgaaaccttctagtagctgtcaccaactctctgtaggtgtatctgcgaaaatggttggttatcatttcatagccaacctcagctagttctcttagttgtttgtcctccctttgcaaaataagtgatccaaatataatgaataatacctctacaacaaatattgctgacaagaaaccatagaagtaccaatacttcgattcattttgaccgctcttaagcttatccaagaaatccggtacaaaatatttgtcaactgtagtacagtatttgacatatttctgatcaaaaggctgtgaacgggggacttgatgatccgacacttttaattcctgaggaagcttaatatacatggtaccagtactaccaattaagcttacaccactaagaagagcagtcttcggatagcaataaccttttccttgccagtatgcaaaccccacacagttgctgtcattcaagcatatcttcttgcaatcgtgcaaagaaacatgaggataagcccttatatcattccctaagaaatcagtgtttgggagcctaaggagccttactttctgttctctagtgatattgaactttgggctgcagcctttgctccaatcgcttgggtcactgaactgataaccaggggcacacacacatgtaggcgcaggcctatacacacatattccatttataccacacacaccacgtacattgcagagctgaggaaatgccatccatgtgactgaccatgttccgcttgaatcgttcagactgtacaacctgagattgccatcataatctagtgttaatctcctcataatcctaggacccaaatcagcagctgtgaagtttgcatcatcacttccaagaaaatgtccctggctatcaacagcaccgtttgcagtgctattaaacggctttctgtgcttctcccagatattctgagttggatctggccagtagatcaacgagagatccttctcatcataaaacagcgaaagtagatattgatcatcaaagtggaaactaaagcgaccaggggcaagtaatctattagtagatatgagcttaattcgagcagtaatgttttgagtgggtagcaaggtatcagtaggaaaagcaaagctttcccatagaatggtgtcacctttgctcttcacgatgaggtttccagtattcaagagcttagcttgaacttgctccgcatttgaagagctcacgttgttggtccacacaacctggccattataatctttcaacagcatgccgccatcggatttcaactcaaattttgattcccatgtgtacacagggtggagaggatttgcgctccagacaacagttttctcggaggagtttgagaaccagatggagaaggtggaggcattgggggagatattgtagaagccacaggtgaaagtacgatctggtgagtagagcagatccaagctgcgttcaacagagagaggggagcctggcaagagggattcaagagctgaggaggagtacaaaagcagatggatcaatgtgaggagaagcagagaggtgaagattgcatccatggtggttgccgcattcaagctgatctttcaaatgacaagcaatgcaagctgttatcggaactagctgcccaaacttgcagaaaaaagtgagattctaacattctatatactactacgaaggtgataagactaaattcagtctgccagttattttgcgtcaatgggcagtttccttggaccaaactatgcaatgcaagtaccatgttggcaaatgattcgtgtatacatttccaacctgttgcacaagtggcactgtggcatgacgtgtccttgtcaggatccgtaaatctggacagtaaaataagatttgcaatatggtaatgagttcagtgtacttcaccagtccataggtccatcctaaacggctgcacatgcacatattcatcccccatttccaaagaagcctgacttctaacatgacggggaagctcaggctttgaacatttgaacacaaaaataatggcaattggccatgctaatttttatttacatgtggtacttcatgcattgtgagtttgtgattgggtccctttcagctttgagtatactcacgtggaatcttcaacgagagatttcagcaagcatacacagtaaggagagtttaataatatttttttattggctgaacaaatctgtgaagacatttcttccgatcaaatgcccattgcttgaacaaaacatttacatccttacctaaaataaacaaacttaatacgggacgtggacagattcatcgactttgttcgtttgttacctttttcagctcacatcccccaattttcacatgcacgctttttaaactattaaacagtgtattttttaaaaaaatttctatacgaaaatttctttagaaaaccatattaatacatttttttaaaaaaagctaatacttaattaattatatgctaatgagtactttctgactgcaacaaacgaactcagccttaaagatataggcaacatatccagacagagtcacgaaggggatatcaatttacaccaaacaatgctgtaaaaacagcttctcagacgacacagcacagcaccagggttcataattccaataaagaccggtcaaatacagtgaaatttcgagatttcgatgaggctcgaaagtagtaagctgtatgagatttcgatgagtttcatccaaattcaaatctgaattgataaaaaagaaaaaaatcaaataaaatcttataaatagtatgatattcatagaacctattgggatataaatttttgaaaaaacatcaactgtcatagtaccacaccattgtacacgtacgcgcgtggcgcaaataattttgggttgcctacggctcgggcgcccgagcgatttggagtaaaatcgggcgctgacgtcagcaccgatttacgtgcaaaactactttaaacttatttttctcttaaattacttatccaaatcatgatccgattgcaccattaaattcgttgcaattaaatcttaaaaacaagaccacacatggatatattccgacgaaaaaaatagcttattattgaataattttaaatattgcacgatgttctaccaggtatatcggaattgtttcactaagtagatcgaaaatgtttcactcgtttagatcgggtgttgtttcaccttatataaaaacaatgtttcaacaaatatcgaaagaatgtttcagttaactgcaacagttgatccatacatagtgaaacattataagtacactaggtgaaacatttttcggtggaacaaaaaataaaacgaattccctaaatagggggttttcaaaatatatgggtttttttttgcaatggaatatttttattcaatgcaacattagatctatacataatgaaacattatgagtacaataggtaaaacattttttgtaaaacaaaaaataaactaaattcacttaatagagagtttccaaaatatgtggatttttttattgcctccagggatatgctaataacatcaactgaaaattttgtatcgatcttaaattcgtaattacatcagttgttcagggttcagctagctagctataggaagtgtccggcatggtaggattctccgtccttgggatgcttaatctcgccgttacagctgaagcagaagtccgtccgcgacggcgaggtgatctccgggatttccaccggccgaccggcgggtcgtcgccagcggcgaggccgccaactcggtcggcctcgtcgtccagggaccggaggcacgtcggtatccaaccttcaccgtcgttacgcacctcggcgaagaagagccgctcctcctgccgcaaggtgccgccgccactggcggcggccctggctatgaagttgacgtggccgtagtcggctctgcaggtgatgatgacgccgctgatgatggccctgacgagctcgttgacgacgccgccgccgccgccctcgacgacgagggcggcgttgtagtgctccagcgccgcctccgcgtacatcacgctctgccgcatccagtccggatcgtcgggctccatggtcggaaacacctcgtagttcggcggcggcggcggcggcgtgtagtgctgcttgggcttcttcttgtttttcttcttcttcttcttcctcctcttttcgccggggcgatgaaacctgttgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacagtagcccccgagtcctttgcagtcgaccatcgtagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacacttgacaggcatccgaataaaaactctaaagattactcatcaagtattataaagattatggtaataaataagtcaaatagcctaggccatgactatttaccataaaaacaggcatataagacgccaaggaaatgactataataaaaacaagtcattcctagttaacccaaacagtttttgtagcctaaaaaagcttgcaaaaacagcataacgcctttctgtcgggcacctttttaatttgcattgcaataattccaaagaattatatgaccgcataaaaaggattttatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagctgcgcctgcgaactagggttcacaactccgaccaaatccacctccgaaaagtgcatcaaaatccttctcgtgatccaccgcctcaatccctcacctctcccaagccatccctcgaatcaaatcagcacatttgagtgaaaccgatggcggaagagggagaaagcttcgaaagccaatgggcgacatccgacgtaacggaggagaatcttaaggagatggtggcgcacggcgttctccctgccaaggaaatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaaaccccaaccaaacaagaacaaaccgtgtgtagtcgggggggcaggattccaactaaggggaactctaagccaaaaatatttctcgatgcccttcaagacttcgaacaaaggatggcatgcgaactggttctatgttcagaatcccgagcctgctcttcccgggtactcttgtcttcctccaatgtaccaagacacttggaactctcttccgatcggagatgaagcagtacaagccttggagttgttggatcgtatgttaaatcttaaagaacaaggcttacagggagagcaaatcactcggcacttcatcaaatgccgactggcgccaattaaggaaagatcccgcacagcattcgagttcgacggcaaacatgatcccaaccgtgaagaaccagactccttggatttcaaaatcatgaaggagaggatgtataaaatcttctcaaatgcaattgtagtcagctactctcaccaactgccggtcgtgccattcaacgcattcaatccgcctccacaggtatgcatcggaaactatcaaaccatgatcagaacatagttttatcttcatgctgaattgactaactatggaagcatcttgtgcaggaatatgcattgatgaagtcagatccaccagtctctcagcgccggtctcctcgccaacacaccgctcagggaggtggagggccaacgatcagaccagatccgcaacctcagacctccaaattggctggtcaaacaggtcctcgcaagagaaaactggtacttgatgatgatgaaggcgacgatgataaaactggggataagggctcgcctaacaaacccccaaagcgcaccatgcccaggaaaaaactggctggccgcgcaatgccaaagatcagaacatcttccaggtattagacctctcggtataattccgcttcagcatgctttccgatgaaaataatgctaaatactgaaaaaacactctgcaggaaaccatctgatatagatccatctggaaaagaccctgatccggctaagacagagcaaaatatatccaaggactccgagccgactactgaaaaccagccgactgctgaaagccagccgactggcgcccatgcttcgggagatagggccaatccgagtgacctgccgccgactggaaaccagtcggcaacaactgaaacggcaacaactcaagagcccccgactggaaaccagtcggacgcaggccctgatcaagaaattcccgaagtagaaacgcagacgacgacttcgcaaggaccagaggctggtaacgactcgacaatcgggtctccgggtaaagaacaaagatcacttcacgctcagccaggtacatcttcaggttagttgtcttctcaaacaatgtcgatttaaataacctcagtttatctgtctaatggcttggaaacacatcaggaccatcaggagatgacggagaagaaatccctcgcataaaggcgaccgacgactctcgtcctcctatcttgatcaaatggtgggacgagaactcacaagccgcaggcatagtcataaaccgtcaaaaagaagatgaagaagtgtgccagctgaagaaagcgctcggagaagccactcgtattgtaaatgtaagtcttccgggtgacggccttcggtaactttgttttctttttag

SEQ ID NO: 47544 - DNA, 1826 bp, Oryza sativa
attcttgcgaagtttttgatttcttaaaagtttttgctaagcttagttgagcctagaacccaaagaagctattaaaaactttcagtcctcgcaaactaagtagaaaaaccaaacaaggcaatgataaaccaagtaagcaaactaaattgataaaaaatcacactccattattatgatgatagcccccgactgacaacttcaaggagaaaacttgatgtttgacagtcaaaatagggaaatacagtgataaagttaagcgtagaaacgacgaagatgttcaatgttccaagaattgtcgacgagagtgccgtcttcgcgcttgagtcgatatgaacctggccgggtaacttcagagataataaatggtccttcccatagaggagataacttgtgccgatctcgtgtggtttgaattttccgtaaaaccaggtcgccgactagaaaggcgcgagatcgaacattgcgattatgataacgtcgcaacccttgtaagtaccgagctgactgaatcaaagctgcttcgcggacctcttccagtcggtgcaagtcgtccactcggtcttcttcatagcgttcttctcggaaattacggaagcgcaaagactcaaattcgacttcactcggcaacattgcctctgccccatagacaaggaaaaaaggtgactggcctgtggcccgactgggagtagtacgcaaagaccaaagtactgatggcagctgttgcacccatttgccggcatagggttttagccggtcaaaaatacgcgctttaatcccttgaagtatcatgccattggctcgctccacctgtccgttgctcatggggtgtgccactgaagcgtagcaaatcttaattccaaagtcttcacaaaagtctttaaaaactccgccagtgaattgtgtgccattatcggtaatgatccgattgggcactccaaatctgtgcacaatgttgatgaagaaatcgcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtttgtaactcttgagctggcaagtgaatttgtctggcgaaaaattggcaaccttcgcacgtgcgcacaatcttgtcggcatcagacactgcagtaggccagaaaaaaccttgccggtaagctttgccgacaatggtgcgtgcagcagcatggtttccgcatatcccagaatgtatgtctttcagcaattgtctcccttcctctaaagatacgcagcgttgcaaaattcctgaagggcttttcttgtataactcagattcgtgcataacataaagtttgctccgccttgaaatccgctcggcttcatctttatcttgagggagctcttgagaagttaaaaatcgtatgaagggctctcgccagtcggcttcaaccatagctacatcatgagtgtccgcaacttgagtggtatctttgtgaggtaccgtcggcgtataaaggtgttcgacgaaaacatcagagggcgccgcctcacgcttggatccaaagttggcaagtctgtcggcggcttcattgttgtgtcgaagaacgtgactgagctcgagtccatcgaacttgtcttccaacttgcgtacctcttgtcgatatgccatcatattgtcgtcaaggcaagaccactctttcataacttggttaacaaccagctgtgaatcgcctcgaactattaaacgctttatccctagggaaatcgcaatccgta

SEQ ID NO: 47545 - DNA, 13742 bp, Oryza sativa
tgtgcagtacatcgccgagtggaaacgatgtgaccaccgttaccgggtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttgatgaggagttgtttgaaatcttcgaaggccttctgtgcttcgggtccccattggaaattatctgttttcttcagtagcttgaaaaagggcatcccccgctcgccaagtcttgaaacgaatcggctgagcgccgccatgcatccagtcagcttctgaacatctttctgagtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccaatttgtgttgagaaacatctctgaatcatacgttgataagttgctcctgcattttttagtccaaacggcatggtgacgtagcagtatgcaccaaaaggcgtgatgaatgaagtcttcaagcagtcggattccttcagtcggatctgatgataccccgagtagcagtccaaaaaactgagaagctcacagccggcggttgagtcaactacctggtcaatgcgaggcaacccaaaaggatctttgggacaagacttgttgaggtcggtataatcaacacacatgcgccactgtcctgtctttttccgaaccaggaccgggttagccagccagtcgggatgaaggacttctttgatgaagcctgctgctaacagcttggtcaattcctccttgatcgcgtccttcctatcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtcgcggcttctgtttccccaccttttgaaatcttggcagcgggcacttcgccttcgctcaccgtggttgcagccagtcggatttcctctcgggcagacgccatctcgcgggtttgggccatgtcgcaactctccttgtcgcatgtgacggcttgcttgatgtcgctccgtagggataggactccacggggaccaggcatcttcatcatcatgtacgtgtagtgcgggacggccatgaacttggctaacgccgggcgtccgagtatggcatggtatgctgtctcgaaatcggcaacttcaaagctgatattctccgtgcggaagttttcccgagtgccgaaagtgaccggaagagtgatctggccgagtggagttgcggataatcctggaattactccgtgaaaaggcgcattgcttggctttagctcggagcgaggaatctgcatatcatccaaggtcttggcgaagaggatattgagtgcactgccgccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttttgcttccgtttagactcataagccatggggccgccgaaaatatggttgagctccttgcggtggtcttgaaatccagccggggtgtcgccgtcatccttcttcctggacgtgctttgctcttcgtcggagttcttccgagtagacttggtgtactgctccgcgaactgcttgtagatgaagcactctttggccacatggttggagtttgggtgatgcgggcattgggagttcatgatcttgtcgaaggtgttgacgcgcgaacgctgtcgagaagagtgagcggcggtcgcaacaagttcctcaggcttacgcttgcggtccttatgattgttacttccacctcctcccgtagccggcgtatttttcggtttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggagatgtcggagatcttgttacgttgttcagaaaatcgtcggatatactctcgaagggattctccggatttctggataacgttgtaaagatcatattgtgtgccaggacgctcgaaggtgccttggaagttggcaatgaagtggtcgcgtaattcggcccaagatccgatcgtaccacggggcagtccatggagccaagatcgggcggaatccgctaaagccactggtaaatagttcgccatggccttgttgtcacctcctgctgcgcggattgcgagactgtagacggtaagccacgattcagggttagtggtgccgtcatacttctctattccagtcggtttgaagccggctggccaatccactcgacgcaggtcgtcggtgaaggctgctactccatcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaagtcgggaggtgagtgaacagaccgctcgtcgtgacccctgctcctgcggttggatcctgcgccggtgatgctgaggcttggatgacggtagtcatgagatcggaagtgggggactcggctgccagtcggcgtgtggacgctttcggagttaactggaaccgaggccgcaatcatggtctttgtctggttcaagatgttgacgacgtggtcggaacgattgagctcgttttggttgaggagggtgtcgaggagggtgatcgcggcaaccgcattctgttgaggggtgcggaaaaccggtgtcccttcgacgtcttgttggccgatgagatcacgcgctcggcgccctgcttccaaagctcgctgacgtcgatcttcagcctccttggcgatccgctcacggtcctgctgctcacgccgtagccgctcttgttcttgtgcttgatgctcctcctccagtcggcgacgttcttcggtctcccgggcttggcgttgctcctccgtctcattattggccatgaaaacgccaaagtagagaggggtgtagttgtcatcaaggcttccgtcgaagtcgtcgaagtcgttgtagcgagaactaaattcgtcgtactccacgatgtcagtaggacgtgagtcgacggtgggagagctgttgtagtcatctagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccatcatcttgatctggtgtcgttggagaaggtacgatctcggccgagtggtttgaagccgactcgattgagatggtcttgaagtaggtttcagccgcgtttgggaatccaaacgggactgagatccggttctctcccgactggtccgattccgagtcaaggagagaaatcttgccgaagttgttggtgacgaagtcgaggctgccgaaccgaaacgtctgcccgggtgggaagacgaggtcgtcgatgccggagaaaggacccattgcactgatcggcgaaaagcttgacgctacccctacctggcgcgccaactgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacacctgtagcgtgggccgttgtttatgagggcgttcttgcgccgcggccggagctccacaagatatgcggtggacagtttctgctccggcagcggcagcggggaagagacccggctcggggacagcggtgagggtggctcctcgtccaactgctgctcgtagtcttccgtgacgccgcagtatcgcaccggcggcggcgcgacctgctccatggatcgatcgtctctggatcagcactactaggaagatcgatctgatgacgcgtggcgacgaatgaaatatatagacggatactctgatccagtcccaaaccgtctcggtgtcggtgtccgcgtcgcatcaggtcacgcgtgcggaacagcggaacgcgcgaacgacaatgcgtttcttcggaaaagactccgcgtaggacgtcaaatatcggacgccgtgcatcatcacaccacctacgtatgcagcatgaaaaagttgaaaaatttatgtataggaaagttcgatctgacgaaaaagttgaaaagttgaaagtttgaagaaaaaagttaaaatctaaacagggcctataatacatgcagttgtagttgaagtagctagctagctactccctttgtcccaaaatgtaaatatttttaactatgaatctatataactgtatgtccagatttatagataaaaattatatgtctagatttatagataaaaattgttatattttggaatggacgtagtagatggctacaggaagtgtccggcatggtaggatgttccgtccttgggatgcttcatctcgtcgtcacagctgaaccagtagttcctccgcgacggcgaggtgatctccggcaggtccacctgcgggtcggcgccggcgccgccgactcggtcggcctcgtcgtccagggaccagaggcacgtcgggatataccgtttcttgtccttgcgcacctcggcgaagaagagccgctggtcgcacgagctgccgccgccaatggccctggcgatgaagttgacgtacgtggccgtaggcggccttgcaggtgaagatggcgccgctgaagatggccctgacgagctcgtacttgacgccgccaccgccgacgtcgacggcggcgttgtagtgctccagcaccgcctccgcgtacatcgtgctctgccgcatccagactgggtcgtcgggttcgaaggtcggatattcctcgtaggggcagatcggcgaaggcgggctcggcctcggcgttggagaaggcggcggcggcgtgtggtggtgcttggacttgttgtgtttcttcttcttcttcctcctcctcttttcgccggggcggcgaaacctgtagcgtgggccgttgtttatgagggcgttttgtcgccggagctccgcgcggtatgcggcggacagcttctgctccgcagcggcagcggggaagagacccggctgggcgacttgggcgagggtggctcctcgtccacctgttgctcgtagtcttccagaacgccgcagtatcgcaccggcggcggcagcggggaaggcgcgtccttctgcatggatgtcgcgcctctcgatcgatccgttgcgtgcgctttaatttcctcgtggcaacgaatggaagcagcttctggcctcgcctcggcccacggtccaccccgccaatatatagaccgatcgattatggatccaattccaaaccggcttggcgtcggagtccgcattgcattaggtggcctagcgttgacggacgcgtttctttcccttctgtctccctcctcctttgccgcgccagggtttgcagttacaaaacgtttttttttctgggcgaaagaaccgaaatttcggaattttttcttccgaaatttttttaattcaaatatgaaaatttcgatcgaaaatttggagtataaaaacttggggcgctccgagcacaattttgcagtcagataattcatgattttcaaaaaaaaaaataagtcatcttgcaaatcaatcagtccattacaattgcatacaccaataaatccattacaagttcatcacatagctttgacagtccattacaaaggtttcaaacattccaaatgtgcttaacaatatatcaccagtccaaaaattgtctcaacaagtcaacatagcaaaataacatcatccaacaggtagtttgtacagtccgttacatagtaaaataacataatccaacagatagtttcaacatcttccaaaagtgctccctccgtcagaaaaaaaaaaaagccaaatcctgagttttcgtgtccaacgtttgactgtccgtcttatatgaaatttttttataattagtattttcattgttgttagatgataaaacatgattaatactttatgcgtgacttgtcttttttaattttttttcttaattttttcaaataagacggatagttaaacgttggacacggaaactcagggtttgtcttttttttggatggagagagtagttattcatggacatccatctcctcattctcagtaaattcgtgttggagttactctttctttgtctgatctgaaacaattaaataaagtatatatgtactagtcagtgcacattccatgtgatttgttacaagcaacatcatatggtgtttttttcttctaaagatgaagataaagattaagttttttacgcaaaataaagtggtattaacgtttgattgattgggttttaattattaaaaacttgaaaaatatattaatataatattttagagtaactttcatatagaaagttttcacacaaaacataccatttaacagtttgaaaagtgtgccacgaaaatctttatcttcatccaactcttgttggagaaatgaacgggacatgtaggtttctaatttgtccatcacagagctagtgtaaaatacaagttttatttcttattttctaaaaatacaggaccagtgtgtggatgttgtcatatgcttaattgctgtcacatcgaatgtttgaacacatgcatggagtattaaatataggaaaaaactaattatatagcttgcgtgtaaattgcgagatgaatcttttaagactaattactccatgatctgacaatgtggtgctacagtaaacatttgctaatgtcggattaattaggtttaataaatttgtctcgcagttcaaaggcggaatctgtaatttattttgttattagtctatggttaatacttcaaatatatgtccgtatatccgatgtgacacgtcaaaaacttttcaccctagcatctaaacacaacctaaatacactcagaacgcaaagtgagctggttttagtgattgagggagcctctctatggctgattttacagttaaaaggatacgaatagttgaggcagtcgaaatggattttcttcaaaagattgctccttattttgaataggacaaatgtttgcatcagaatttaactggacctgggatccctatatgagcttctcttgggcctcggttgggcccaccgtttcttccaaccaaaatgggcccatgtaaaccgatgttagctcaaggcccaactagcccagctgacggtgtcctcctcctcgcgttgccagcatttcacaccgtgcgccgccgatcatggccgccgcccgccctcccgccgcgcgccggcgacgcgcatcgctgggcagccggagacccgcgccggccgcggcgctcctgttgcagcaaactccatctccgtttctccactgcaacggtacgagcaatagctgctctctttctccgtctttctgtgtctgcacgaggtcgttagggtttggggttagaaaggggatcgttgagatgcgacatcccggcgttcatcctgttaaattccaatcaaattgatgccgaaagccgatgctgcggctcatctgatccaatcaagttgaatcacagctgcagcagcggctgtgctggtgctgtgaattgccccaactgcgtctcaaaatctgccatgggaacgagcaatctaggagcgtagcagggttcgtaatagtaaggtgcgatgcaaatatcagcacgattcattctaccataggacaccaatgcacactttgtccaggactccaggttctagctataagttcgaatcattgcaacaaaatatatgtagcatagtaattgcattactaccccattatttctaaattgatacattgcacatttcagaaagcatagtacatgaaaaatcatgcattcagtacacaatggggcttaagcagttcctcttaatgcatcagaccaaaagacattttcttaagtagatgatattttagccaattatgaaagactacaagatatattctgtggatgtcaaatggcaaagctctttaccagaattataactcctaaattgtagaactggcttcatcaactgaaacaagcacctccaccacactttccatggtgggtcttctacctctgtcttcctctaggcatgaaacagcaagcttcatcattgctcttgcttgcaagtcattgaatcggccatttaatctggtgtcaatgaactcaacaatccacgattgtccatccccacctgacttcaaactttccgcgagtgtcctaattatcctcccgaggaccatttccacctcttcatcctcatttgtttcaagatccgaaacacgagctcccttgagtaattctagaagcactactccgaagctgtacacatcaacctttgctgttatcgggagacttgaaacccactcaggtgctaaatagcctctagttccttggatccgtgacacatttaatttggatcctcctctatttagcagcttcgcaaggccaaaatcggcaatctttggctccatgttttcatccagcagtatattttcaggtttcacgtcacagtggatgacccactccaagcactcatgatgaagatatgccaatcccttagcgactcctagagcaatgttaaatctttgcttccatccaagtaaggcctgtgagcccttagcaccaaataatattttatccaatgatccattctcgacatactctgaaatcaacatcctgtgtggatcatcagaacagaatccccaaaccctcactagattcatgtggtagatcctgccaatcacactcagttcatgcttgaattcttcctcgccctggtttatgtctaacaactttttcacggctactgctctcatgtcctttaagatccccttgtatacaatgcctgatgctcctcgtccaatctcatcctgaaactttctggtggctatcatcagctctctgtaggtgtacctacggaaatggtttgttaccatttcatagccaacctcagatattcctcttgctagtttgccctcccttcgcaaaataaaccatccgaatacaataaatgttacctctgcaagaaatattgctgataagaaaccatagaagtacaaatacttcgattcattttgaccactcttatgctcgtccaaatttttgttagcattgcagtcaggaccgtattttggaccaaaaggctgtgactgtgggattgaagtcattgaatgctccgacagttgtaattcctccaacacttcttccatagggagcttgagatacatggtgccagtactaccaatgtgaggtaagcttacaccactaagaagaacggactttggatagcacttaccaattccttgccaatatacaaaccccatacaattgcagtccttcaagcatatgttctcgcaagctccaagagaaacataacgaagaggacttaaatcagaatctaggaattgagtgtttggaaggctaacaaacattaccttctgttgtacatcacaagtgatattgactcttgggctgcagcctttgctctgatcacttggatcaatgaagtcataaccgggaggacacgcacaggcaggcacaggtgtgtacacacatatgccatttataccacacacaccacgtacattgcagagctgaggaaatgccatccatgtgactgaccatgttccgcttgaattgttcagactgtataacctgagattgccgtcataatctagtgttaatctcctcataatcccaagaccccaatcagcagccatgaaagttaaattttcactttcaagaaaatgccccgagctattaagagtaccggtcggtatgatattatacaacatcctttccctccccgagatagtccgagtcggatttggccagtaaataaaagggatatcattctcttcataaaacagtgaaagctggaattgatcattaaagtggaaactatagcgaccgggaacaagtaatctgttagtagatgtgagcttaattcgaacagtaatgttttgagtgggtaacaaggtatcggtaggagaatcaaaactttgccataaaatggtgtcacctttgcccttcacaatgaggtttccagtattcaagagctgagcttgaacttgttcaccatttgaagagctcacgttgttggtccaaacaatctggccactattatctgtcaaaaccatgctgccatcggatttcaactccattttggatccctgagtgtagacagggtggagaggatttgcgctccagacaactgttttgtcagccgagttggtgaaccagatagagaaggtgcaggaattgggggagatcttgtagaggccgcaggcgaaatcgccattcggcgaatagagcacatcgtcttcagatagagatgcgcctggcgagaggaaatcatgtgctgatatgcacaaaagaggatgaatcaggagaaggagcagagaggcagagcttgcaaccatttttgctggagctggagagcaggtgttcgtctttcaagcgttgctgttaacttattataagaatccatactggtcagtggtttctggatccagtaaagaaaagtgtacttctttggataacaggtttttgaagcttgaacttcgtggcagatgcagcctctgaacaactgtgcacacatgcattccttaaaaattcaagggtgtagagatctctactgttaaaaaacaagtgggtacagtgtattgattagcatacatttaggctcccccaccagtaggcattaaccttatccgttgttcatatggcgttgttcaaataagaaccttcaattgccaaaaacaccagaaaacgcgagagattctgacatccttcaattgcaataggaggttgatagcactggagtcatcacccagtcagccattcagcgagcctgtgtgctcagtccaagtcagtgtgcaagcttctttcaaaccaggaataggattttaggagtatgcaagatttcaagttgcacagcaatgcaatgttgcgagtaattcatggttttatgcatacatttccaacctgcttgacatacactgtatatggcaaatgtggcatgacctgtccttgtcgatcaggaaccgttaatttaggcagtaaggtaacatctgcaacatggtgatgaattctgtgctactaccatgcttcatggctgcacatgcacatattgatctcgctttttcaaagaaactgacttgtaaataaacaagataattttgctttcttttttaaggtttgctcccaatgataggattcagagggagtgcaaatttgaagtgttctcagcaggtcaccacgcctggtcactgtcagcaatctaacacatactgtcaacgaaatagcggtgcagccgacaggtcacacatctccaggaaaccgaaatgtactactgctatcaaccaaaaaaatagtggattacagtgtattgagcaatgcattggttttcaacaagcagttgtgacttgtgacttgtgattcgattttttttggtcggtaccattttttaaatacaatattgaagtttttataggaagaacatatttagtaacttttttttgttcatagggatacggtattgtctcaggtataatgctagctcatccaaatgatccttataaagatcactcccatgatgtgtatatatgcacagcttaagatctctgtttccacattccacattgctgatgcactcgacgaagaaaccttcatttggtgaaacccaatttttggaggaaacgctccgccattgcttcgggagacgctgagacacgatatcaaccccggccaaccaccggagtaactcaccgtgctaaaaaaaaagtatcttctggttgcatctactccctccgtcccaaaataagtgcagttttgcactattcacgttcaacgttttactgctcgtcttatttgaaaattttttatgattagtatttttattgctattagatgataaaacatgaatagtactttatgtgtgactaaatatttttaattttttcacaaaattttcaaataagacggacggtcaaacgttgggcacggatattcacagctgcacttattttgggacggaggtagtacacaataattataattaattaacttcatattttcttacaaactttagtgaattaagatattgatatatatactccatctgtcaaaaagaaataatcatgggtttatatccatattcaaatttaggattgggtttttttttctggatagatgaagtatatgtcacaattctcgtgacatgtatgtgtgcatccccaacataattttttttgggtctggccatggtttgaaagcaccattttgtagttccgggcgtccgtcgtcagtttaagatcaatgcggttagagtgggattagagcgaccatcacacctttggtagagctgacactttcatgtaccagttgcatgtatctagcacagccatttcttaaacgatacgagtgactgtgaagtcgaagcttgcagcattggaagacgtgatgtgtgatgtgtggcaacaatggcatgagtttagttttttttaagaaaaaaagggtaaaagctttgcctcatatatattttgatagagcaaaaagagaaaaaattataaatttttatttacagggcatcaaccgaggctcaggtaagcttttttttttttttgttttttaacttcccaaagcggtaagctcatggcatgagtctagtggagttgctgggtgttggtgtgggccgagttgctgatcttg

SEQ ID NO: 47546 - DNA, 4131 bp, Oryza sativa
catttccaatcgattatatttgtgtgtatgcataattgatcagagtgatatatgctcctgtgcaggacatcgacctggagaatgtccaaggcttcgacagcaacgccttcaccatgaagctgttcgacgacaacgacgatttgatctacttccacgtcgtgtttaccggcgagacgccgggacggcgcggcggcggcggcaagcgttactccttcgccgagatcgtcggaaaagacaagccggaggaggtcagaatgtggaaagagatggacgaagaaagtgaaagtaagcaagcacacatatataccaccagcagctaattaactgatcaataattaattagattcatgcaactgaagcgttttcaatatgcatctgggcaactaattaactagctaaatattaatcctgtgtgttttcttttgcaattacagattgcaccgtggagaactgcatcttctgcaccgggatgtggcaccctctgtcgggtggcttctgtggatacaagaggaagaagaagaaccggagataggctcttctgcaattatcagccactgaagctgcatgtctcgtcgtctcatctttcttctaactttgttttctagaaataaattgggtaccaattaagtttagttgttatcgatgagttgtcgctttgatagatcgcgacgtagctggctgccgtgcttgcttgcattgcttagtatacatatgtgcccaaattaatttatatgtaatttctgttgcttgcttgaagaattaattacttcatcagtgcgtttaattaatttcatgcgtgtgctacattaatttctgttgagcttttctccatttcattatgcttgcgaatgtgaatatgtgatcggttaagtagttttggcagctgtcatagacttatagtactctcaattccattatatttggagtaatacatatggtatatattaattaacgtacccttgaaccttgatttctacttcccattgagcaagctacatgaaacatttacctcttaatttttcccttttttcacggaaatcttgacctcttaattaatcaagtgatcacaaaatatatttatagatccatgatactgttaaagtgaaccggtaactttcgatataattcaaaactgaaatcgttaagtttcgatgctttagaaccaaattttgtatgcgtttttttttctacaaacctcattcatctatcctccggattttggattttaatgtggacaaactatctccatgactcaatcccatcatgcattcaacctgcattttattactccctccagcatacatttcatgtttggttcacgtactgtaagtttaattgatgttctaactaccaccaactacctcagagagaagatgtttggttacttgtacatagtaactcacagtttgccagccattgcgtcaacaaagtgagactaccaaaaattgccagagaagtgttttgtgcaatttttgcatttctttagactacaaacaacaatatttaatttgcactaataaatcaagtcaacaaaaatcgatcagaaaacttaagattaacatcaaattgcaaacacccctgattcatgagcaacgtatgaagcatttgataattaaaatggcatgcaaagggcatgtccatatgcagacaccccaaaatcacaataatctgttttgtgagggatacgtatccacaaaccacctcacacatagataaggcacaaaaaatataggtctctttaatttactatactccactccatcatgcttgcacatgtatccaatcagcagtgtttcctattttagcggaaaacaaattaataaaacatgatttattacacttatttacatcatagagccaacaactgtgactagcaagaaatttcagaggcaaatacattcaatcgcagtcttttacagcatgattattccagttatttataacattctattacatacattactaattgtcccaactagcaaatacattcatacaaaaaatctcacgaccgaatctaattttcaccaaaagttgaatagctaatgagctacagccaagaacatccccaagaacagccgcaagaacacatgaaacaaaaaacttaagagtatagttattaggaccggaccaaacagactagcaaagaaaaaaaaggaaataaaaaacagaagttgagccttagttggtcccgtttagttaaaatgaagggaccagaccgataatccgaccagaactaaaatggaaccatgcaaactgatggttgggaaggcagttccttaccactacattgcgttgatgttagtgtgatagctatgaaatctttaatttcttaaaacatctttagaccagtgatccaaccggttgtaccactcaaaccgtgaactaagaacctaaaatttcagtacaaacaccctcaaaccgatggttagacaaaacaaattaaacatatattaattagaggatatgtcgagagcttatgccttagactttggtgggacttgggataagagttggccctatgcaggattttcttacaacaacagctatcaagatagccttatagatagccacattcgaggcattgtgtaggagaaaatgctgcaccccctctcctttaattgggatcaaacgagagaatgtcggctctttgggagttgggactggcatccaaaacgaagcagagaaaaaagtgaaaatcattcaagaaaggctgagggtagcccaatcctgccagaagagctaagctgatagtcgttaaagagatttgtgttttagtgaaggagattttgtgtaccttcgagtccccccgtttcgaggtgtaccctcttacaaaccaagggaaaattggcaccatgctatgtggggacatacaaggttttgagtcacaaaggagaagtggcatagaagtggcataccagttggagttaccccaagtggcataccagttggagttacccccaaccatggttgtcatatatgatgtattctatgtttctcaattgaagaaatgcttaagagtgctcattgagcaaattggcctggatcagatcgagatacagaggatctgacttgtggaaagaaatccatccgcatccaaaccagcaaaagaaacacacaaagacgagtggtcagtttctacaaggccaaatgaagcaatcattcaaagttgaggctacatgggaacgagaggataaattgaagtccacccatctgcacttcttagccagcacctccgaatcttagggatgagatttcatttaatacgggtagatttgtaataccctgagtttttcccctaagtaataattccattaatagtacatttctagaaattgccaaaaaaatcttataggaaaatctacaacaataaaacccttaaataataatctattctagttgggtgtaattttcttaaattccccatgctttaaattactcacagtatttttgcttgattttttttagagaattggagctacttttaataacccataaacaaatatcataataaataaattcataagagcttagaaaaaactctcatactcttgggtccactctcggtgcatccttcctccccttccgcccgcgcatgctagcaagtcgccatagccatatcctcttcacactcatgccagcctagcctcccatgtagtcgtcaccctaggacactgtgtcacgtcctaaaatgaccctaaaaatatatccttaaaattatgctcagaataattaaaatccaagtgaaagcctccaaaattaaaatgtgcaaagttaaaagtcaaataaggcttgggggattttttatatttcctaaaagctaaaatgtgtaaatagattttagtggaattttcagagcacaaataataattatcaagaaataaacaaagttaaaaaagttttataaaaagaaaaaccctaaaaatcccctccctctctctctctgggctgaattcggcccatctccctccccctctctctcttcccccgcggccccactcggcccctccccgtgcggacgtcgctgacgggcgggcccgcccgccaccctcgctgacgggtggggcccacccatcatccccctcatcccgccgctcccttcgcccgcgcctaacaccgccgccaccgccaaat

SEQ ID NO: 47547 - DNA, 17252 bp, Oryza sativa
ttccttccccttccggccgccgtctctcgccctcgaccctatttaaaccctccccgagctcctcaccaccgtttccaccactcgccgccctctttccccctcggaaacgcgctcgcaccgctctcctctctctccgccatcgctgccgagctccggtccgtcgccatcgtcgccccggacctcctcccacctcggcgccgccaacctcggcttcgccgcgtcaccgccgacaccgtccaccgcctcgccgagctcgccgaccgccagaacgctgccgtccccgtcgaccctagccgcaccgccatctctctccgctccgaccgcctcctacgtcgccgtcatcgccaggggtgagccgtggaccgctgcctcctttccccccttccctttccctctctcgaggcgtggaccaccgtccaccacctcaccagtgaccataggggcacaggcgccgcctcccgccgaccgcgccgacgtggccgcctccgagcgcgccgtgtggccgcgtggggctcggccgtcagccatccgtgccctcgggtgcggctgacgcgtggggcccacggggccgaccggtgtgagcccgagtgcacccagtccaccgtggaccgtgaggctgccgcatgggccccactcccgtggacccggtccacgcaccctctcccctctgctgacgcaataaaccctatttttaattaaaatttaaatgaagaaattcgcaaatattcacattaagagcatataaacttcaaatggctatatcttggtcatttgaactcggaattggaccgttcaagtctctaatttttccttaagaagtcaagaacccatttatgtactttgtttctgcttgttatatggagtttattaaagtaaaagcctttttttctttctgttggtcgtgtagacgctgcagcttcggaagatccgctctacgtggaggttgaagccgacgtttgggaaagcgagcaaggcaagtcacatctcctttgaacatattgttgtcccatgctttaaaattattttgttttaaattaatgcattatcgctttattcaaattcccacgttatcactgttttatttagccatgcctatttacctttgttatgaccttattattattgttattgttattaaccctagagtaactaaaacctcactggtgtgtactgtattatggtctcactagtaccaattttaggtagatgcttcgccatttaaattagacaaattttaggtggttttataattctagactttgggagttctcatatcagttgtaccttgtggaatggttggcttatgtggaattggacacacaccttctcctctattcaaaaccctcaaaatggttttaggctgggctcgaggtgcatggttttgatagaagcacctcggccactataaggaccggtcttcgggcctctgttgcaaagcactaccgtacttccacatgtctagtgggtaaggcgtagtttgtggctcagtctggtcatgggcaaaagtacatggatagggatatacgaagtcgaggcttgatggacatctcgaggacaaatgaaggctacacaagctgtggcccgatagtcgagatgtcacggcacagggccggtgtcttgttgctaggggctcaaccttggttacctgtctcgggattccggccatagccagggttgggtcggtactcttgtttatggctaggatgggttgggaactatgtcatgtcttccgtctgtatgccgtggtggtatgtggcacgtggttacacgtgaggaagacgtgtcttgtgggtaaagatgtatacctctgatcagagtataatctattcgaatagccgcgcccttggttatgggcaagcctagcaatgtacccaagttagtggtttattttttaaaacttgcttaacaactaaaatgtgaaatggttggcctgggttggcttgggacgaactgggacctgctgggtctggttgccagttcggtctgaatcatcataggccttgggttaaggcaggttcgtgggggttcatggccttgattaataacactgtgtagttctaggatcgtctttacaaaatggccctgagcaactaaatgtcttctaaatgctgtttactgcaaatcctaacccctatattataacccccttatactccttcacatttattctgcaattgtgggtgtgtcttgctgagtacggtggttgtactcaatcttgctcattttttccccaacctagaagaggagttcctggaggatgatggcgttggtgtctagctcgtgcctgccgtcaagtgcctgtggtcgtcgccctagtcttccactgtttttgtttatcttcgtgtgtgctgagccttcgtcgcccatgtaataaattaactatttacgcttccgcttgttaaactctgaattgtatcaacttttggtgtaccttgcctcctgggacaaggaataatacacgcacttatggaatgcctgttgggttaattccggtcgtgacacactgataggtggggtctacttgtcgggatcatccctaaccttggccatgtcgcgatcccttgtcacgccttcccacccacgattgctcattcaaactcacgaggacgtgatcatcgcccacttcccctaccttcttcacccactcgctcacaatagctagcctttccacccactctatccttcacatcacctccacgtcaccctagccaccgcttgcctctccttaaccctgcctcccaaggctaaaaaggggcccctagcctccactactttttttccaccctcacctcctaaaaccaagcttctggacctctccattgctatgaaaggtaagcattgctgtctcttccattcttcgacgatgtttcgacgccgttagggactgtagcaaccgccgctagcctctccatgtccttcataggttcaggtgtcctcggccatggcttccccacagctgaggactggtggagcattgtctttgccggtgtcccgtgagtcttctctccctgctgacttttgaccgtcatttctcgcgtctcatggcatcgtggacctccttaaccaccaccaccaccccctaccttcgcctggtcaaggagatgcttggccacctcttcatcttcaccaactgccagtgaattgctgtcaatatcacttacccgaagcctcttgccgcttcgcgccccgccgttggtttcctctctatgcgcaccgccgtcttcaccattgtgcactcggcgaggacaccatcctattatgcttcctttttttccactcccatcgccacgtcgtatggtcgctaccggcaaccatcaagtcacacatccggttgtctggcaagccgacccctcctcgccccgtccgtccaatctgtcatcctcgtggatcatctgtggctgcctatgtcagtgccgtggtgacaccacctcaatgcacctgactaccatgcccgccatgtgcactgtcgcatggcaaggacacatgaccgtgcaccagtgatcccgggcttcgatatgtgctggcaaatcccggtcattgacctctcgtggaccacctcggcggatttggtccacgagagctggcctcccttcctcgctgaccgtgaggcccgcctgttgacgccaggttccccactactgacatagtaatcttgttataatgcgtcatatatcagtttataacttctacaaatgattacaatggttaaaatttctaagatttataactaattcattttaactaggtattgaacattcaacatgcacatttgctctaaaattttaaagaaatcattacaaatgttagatgtattgttttatgttgtcttatgtactattttgcctatgggagtatctaaagtgaaaaaacttctagaaataactataatataattgaaatgtaattatactgtaattacactgtaactacggtatagcttatataaaacttgtattcaattatggttttgttggttagcagcggaatattatacatgacatgtgtggaaatttctttctagcaatttttttccttcatgcacaaatctcaaggcaatcaaatggctacaaatttgaatgttcattgagcaaaaagaaaaaatttacgaaagtttttagcaatttcgtttgcgtttttgctttgtttctcgcttccaacgctcccatttaggccatgtttagtttctactcaaaaacttttcaccctgccatatcgaatgtttcgacacatgcattgagtattaaatatagacaaaaagaactaattacacagattgtgtgtaaattgcgagacgaatcttttaaacctaattgctccatgatttgacaatatagtgctatagtaaacattcgctaatgaccgattaattaggcttaataaattcgtctcgaagtttacaggcggaatctataatttgttttgttattagtctatgtttaatacttcaaatatgtgtccgtatatccgactgacatgtcaaaattaaatttgaaaatatattgtttatttattttttcctcaaaatattcgggatacaaatttttcttttttacaaatataccgtcctcgctagtttagagtgagaaaacgatacggtatcgtataactactgcacgagaatgacgtagggtgatgacacgacacggtttcgcgaggggtgtcgcgagagcgtacggcctcgcacagtcaatgtacgagaccgcacggcattagctgccacacccaatgattaatgtcttaatcacattgattagcaactaattaatcatcaattatcattaaataataattaattatagtaattaatcattaattttgtacaagacattcggtagcactgtttctttgtgcgatactgttcggtatcgttacttcattgttccgtttcgctgtttcattatgcgagaccgtgctctcgtacaacggttgtgcgagatcgatatatatttctgttaataaacttgtaccccgaatttttttagaaaaaaaataaataaacagtatattttgaaaaaaaaattaaactttttacccatgaactagagagggcctttgtacgagaatatcgcagaagtcccaggaggccagcaaggcaagttatatgctctttttttttgaaacgttttatcctttacaaataaactttcatgttttataattacatatggatacatagggacacctatgtataatagcgacagcaaagaaatgatttattatagtaggtgttaattagctttaggtgtctttgttccgcggccggcggcggcccaccttcagcagatgcagcagctcgcacgcccttgtggtccggtcgcggccgcgcgcggcgcaagggcggcgtccggagaccacccgatccgcagcttcaccgcccaaaaccgatgctccgcccgcctccacgtccgccactcgacaggtaagtcccgtagtagaggatggggaaaagtggctacttcgcgctaccgcttctgttcttccaactgaacaatctatattgccaagtgttttgggtgataatcgtccgatctgggaaatgctactagtagtacatgatctattattgttcattttattgcacacagccaccgtgtggacgtactgtatattagttgctgcgtcagtcaaggttgctgtagacgtagacaagtagtattgggcattttctttccaagatatcgagggattgtagtacttattatcttgttaaaatgttggtttggttcatccatgtgtttgggatggacaatttctcctctctgtcctattacacgattgagcccagaactgctttggacattcaatttgtggtggtgttgcgtctattagttatgtagcacagaagctggtcttaaatctgcccgtagaaataagtgaaataggtgaaaatttaatacatgtaaaacaagtaattataaaattatctctcaatatcagcattacacttttcactgaaagaggcatgtctatgaacatgtcaccgacattcccttgttctggggcacactttccagccttccagttattgctggagtttttacaacagatatagcatgattattgtgtaaatattactagttacagtagtagttagctattgcacaaatattacttcttctatatctggaccctcttcttgcatagactttaataacttattagtgatgaagttctggttgaatgtggttcctcacttcctcctgttggtgtgctactgacttcatcaactgatacaagtttctgcaccacacattccatggtaggtcttctgactctatcttcttcaaggcatgaaacagccaattccatcatcattcttgcttgtgcgctgttgaattggccattcaatcgggtgtcaatgaagtcggcaatccaaaactgatcgtcgccatctgacttaagttgctctgagcatagcctgattacccttcccagggccattttcacgtcctcatcatcattcttttccaattctgaaacacgagctcccttcagcaattcgaggagcacgactccgaagctgtacacatctaccttcgctgttattggcagactgtaaacccattcaggtgccaaataacctcttgttcctcggatccgtgatatgtctatgttagatccatctctgttcaggagctttgcaaggccaaagtcggcgatcttcggctccatattctcgcccaacaatatattttcaggtttcatgtcgcagtggatgacccactcagaacattcatgatgaagatatgccaatccttttgccaccccaagagcaatattgaatctttgtgtccatccaagtaagttctgtgagcccccactgccaaacaagattttgtccaacgaaccattctccacaaattctgaaaccaatatcctgtgtggaccgtcagaacagaatccccaaaccctcactagatttgtatggtaaatcctgctaatcacactcaattcatgctggaattcttcttcaccttcgtttacgtctaccaactttttcacggccactaccctattgtctttcaagactcccttgtatacgacgcctgatgctccccttccaagctcatccttaaattttctagtggccaacaccaactctctgtaggtgtacctgcgaaaatggttagctatcatttcatatccggcctcagctggccatactcctctgagttgtttggcctccctcctcaaaataaaccatcctaataaaacaaataatacctccgccagaaatatcgctgataagaacccgtagaaatacaaaaactttgatatgctctgcccactattaagtgtatccaaaaaatctgctatggaaatgttgtttgttgtattacagttagggccatatttaggaccaagaggctgtgaatggggaaatgaggaccttgacacatttactccctcaggaagcttgagatacatggtaccagtgctgccaaagttacttagtgttacaccaccaagaagaacagactttggatagcaatcaccagttccttcccagtaggcgaaacccttacacctgcagtctttcaagcatatgttcttgcagaatccaagaggaacaaaacgataaacactcagatcataccccaagaaatcagtattgcggagtgcaacaaatttcaccttctgtccatcacaactgaggttgacctttgggctgcaacctttgctccggtcacttgggtcgatgatctcgtaaccaggggcacaagcacaggcaggaacaggtgtatacacacatattccattctgaccgcacaaaccgcgtactttgcagagctgaggaaatgccatccatgtcactgaccatgttctgtctaccttatcaagactgtacagcctgagattgccatcataatccagtgttagtctcctcactgtgccaggaccccaatcagcagctatgaatgttgcattatcacttccaaggaaatgtccccagctgtcaagaaccccatttgtggtgctgttgaatggacttcttagctttgcccaaatagtcatactagggtttggccagtagataaaagatatgttcttctcatcatcaaacagtgaaagtaagtactgatcatcgaaacggaaactgtaatggccaggaacaagtaacctatttgtagacacaagctttgtagcagcagtgatgctctgagtgggtaacaatgtatcagtaggagaatcaaagctttgccacagagtgttaccactttcgcccttcacaacgaggttcccggtgtccaagagctgagcttgagcatactgggtatctgaagagctaacgttgttagcccacacaatctggccagcataatctttcaaaaacatgccacagcgaatttcaactcaactttggatccccaggtgtacacagggtggagaggatttgcgctccagacgacggggttttcggtcaagttggagaaccagatagagaaggtggaggcattgggggagattttgtagaagccacaggtgaaagtgccatccggtgaatggagcacatcctgtacagacagggaggagcctggcttgaggaaatcttgagctgagatgcacaaaagtgggtggatcagagtgaagaggagcagagaggcagagcttgcaaccatttttggtggagctgcagctttggagttgatctttcaagagttattaagaagccactggctagtggccgctaatggagtgagcatcttggaactgcaggtttgaactttagtggaagacaggggcgaagctatagccatctatcggggtccactgaccccgacgatttcttgtgtacgtttcttactccacttaattttaccgtgtatgaccccggtcgataaaaacactagaccccggtaaccatgatttgttatagcctgattaattagcaacttgaaacgacacgtttgagattagcaagcaacaaataggaattagctagcgctaatgattatacgtcagcccaaaggcccaatatacattttggtaatcttagcagtgagtatttgtgcatttaatgtctactttgtttacatattaattatgtccggtttttaatacttcctccgtttcaggttataagactttctagaattgatcacatttatatagatattaatgaatctatacataatatgtagattcattaatatctatatgaatatgggcaatgctagaaagtcttataccctgaaacggaggtagtataatttatagacatgtccgtgcgttgcaacaatctcctatgggccaatggttgctcgtagcattatttaggatatggattttcatccctcgaggggatatcccctcattgtttgcatgtcatctaaatagttataaaaaaattgacaacataggttgataaggaatatatcactctacaaacatgcaaaatcaaatttgacttctacaagttacaataaaaaaataaactgaaaatagttatcgtacattcgcatttatatttgttatttttgtttcaatttgtagaagttaaattttaacttgcatatttgtggagtgatatatttcgtattaatctagctatttagatgagatgaacgaaacgagggatatcccctcgagggatgaaattactttccccgttatttagttttctgttgggtctggtttttccccgtattttttctttcagggtggatgataaattctgtttttatgtagtagagataaataggcaagcaaagtattatggagcgattcttgaaaaaaaaacccccccgctattttagaagatctaacaatgtatcatacactaaattagtattgaccccgtcgaccatttatcctggcttcgcccctggtggaagatgcagccattgaacaagtatgcatatgttttgcttaaagtcagggtgtgggtcgtgttactgtcggatgatcagttgattattggaaccacttgtgcttcatagagcactaaatcaatgggggaaaatatttagttattttttgtggtgatgcaatatgtgcaagagagactggtgttgttacttacacccttcgtcccaaaaaaaaaaagtccaattctaagtgtccagatttatctctagaattgggttttttttggacggagggagtaaaccccaatcataaatatttatttactccctccgtcgtaaaatataagttcttttttatggacacagttattaagaaagtatatagaattaaatgtgggaaatgtataattggatgagaagtgaatgtaggtaaaaaaaattgaatggttgagagttgtgattgattaggaagagaatattggcgaaaaagttgttatattttaagataaattctaaacactaaaaattattatattctggaacagaggaagtagattttatgaacttattttaaatttatggtcagtgtttaaatatttctaactggagtgtaatatactgtgtaattagatgttaggggaacgagcgtttgttattgtactagcgttttaaacaaattattcaccgaatcattatcgcggattatatattttattattacaaggataaattaaatattttaaaaataaatttcacagaacagaattttttaagaagtacccagaggtccagagctgctgctgagaggatcccctgtgactcgtcgattcagcgggagagggagtgcagtgttctcagcaggtcaacacgccaggtcatcggtcagccaccaaacatatttttggggggtggagttcaaagatgcgaatggtaagccagctggataattccttgtaataatgtacctaatcctcatccgtattcgcctaactcctgtcgggtgcccccactgaaatgccgcagcagtagatccacacaaacgacactgggatttattccttaatcatgaacttccaacagcagcttcccatatacagcgcatatacaccaccaggccatgcatcttttcgggagaccaaaaatttatgtcacgagacaactctattgcagcttcccatctctcctgtctcagaataatacaaaatgggaggtacataaaaaaggaaaaaggaaaaaacaacgccatgtacgttttaacatgttctatggaagttgaggagctgcaacaaaatttccaaacaaagaatggggggtacagcttggctcgaggagggaacccattttctaaggacgaagatctacataaaaccagacgcagcagagaggaacatcaacagcgggagttaaaaaaaaaaagatcaacgccacgattacaaaaagtagtcgggggtcttgcgcgttgtgtccggctctatttgtcgtggggctggatcgaactgtaggaagttctgatccatgttctccccgatttctagaattgctgccatgttaccacagcggtaacagtagtttggggcgctgaacaccgtgacaacgttcttgtcctgcataacaatcattgtcattaagtatcaagctttttgttagaattttccaatttggtgctcaagtgcaggtcactgatggtaaggtaaggttctatgtacatgctcctatgtgatgatacatgaaaaccaaacatatagtaataatactaggatcaacaacaaaccacataccatacatccaaaccaagaaaagttctgctcatcttatagaactgtatcaagcgttgcattctttatgtccgccatagattgtaaatatgttatgcctcctagataataatcagcaatcactatacagcataaactatgtgggggaagggccgaaggggttgtcattgtttaacagatcactgaagggttgaacaagctactaaaacttatataatgcgaagttcaggtaccataacatcataatgattactagattcagcaatcagcatcagcatgcaactatgagtctataacttagctaaagcaccagaaattattatgaataccaaaatggattagcctaacatagtaagaccaataataattatgtgaacagggctctcagagtgggacgaatgaaaacaagcaaatggaacattttataccaacctggcaccaattgaagccttccatcacaagttgatgggcccttgaaataagggtaaggccattagtatggttgaattgttgtgcaatatcttgcccaaacgtgtatcctgcccctcttggagaaattccccacccacatcgatcgtccgggtcagaccacaaaagatcacacatgggcccttcatgagggacctataaccattaaagagaacagggtgcataagtcaaaacatatgatttccataaactataaattatcaagacaaaaaagtgtgcaaatacagcacatatgttctacacaaagacggtcactattacgcacaattgctcaatgagggccacctttagttactagtttaagctatgtacgaacaatggcacgaaccaacaaatttgatatataggcatagcaggtactaacactaaaccagcaagcataatattatttgtgaatggtcatggcgagtgaggtcctgtttagtcttaccaaatgcttggccaacaataaagtaagaaatatctgtaactacttaagcaaattgtacaggaatattgatcttttagtttgtttaatttctgagctcttctcccatatcccattgcatcttgtaaaaaagaacacactatggtacatcagaaaatcgcgtaactggaacctattactccctccaggttgataatagttgtcgttctagacaaggctgatgtcaaactttaaaatctgactatgaataatttccaaaatatctgtctcagaaatatgcagaccatatgtatagattagtcttaaaaagtacttcaatagaatcatatatttgttgatatttctatatatattataatagaaaatagtggtcaaagttgttttttcgagaccatgtactcgtccaaaactacaagtattatcaacctggagggggtatatcaacctttgtatatcatttgatcctcacccagaacattttatgtatattaatataaagttattgtgtgagatcaacatatatgagaagaatgccattcgagccatgcacgtgaaacgatgcagataaattattagagcacaccgaatcatccaatggcaaagaatggtatatgctatcctctaatataggttcaattatttaacactcctggacctgttctcaagctatcatgaatgagcattacctccagttcaaaaggagggtgcctatggactatggagacatggcaagtaaagacgatggtgcaaaatgatgcataattagatcactagctcaaaggtatgggtgaagtgttgcatacctcctgtatgcgatcgagggcgaatgttatccaatgtatccaatgacggcgagagaccgccatggaggcaaaagacctacaaaatgaaatttttcctcttgtcaggtatgccatatacatggacaagctgagttcaatgtccatattaatagaacaaacatttggcaaaaagagctaacctggttttctacaagagctgtgagaggcaaataatcaaacaagtccgtgaagtacttccaaacatttgcatttccatacttccgtaagcattcgtcataaaagccatacctgtatccaaacactgggtgtcaagaacaccctagcacagtgggtgtgcttgcattttacaaagtagaatgcagcagaagaaattggcaaaagttcatgtcatgacaagaacattataaagtaggattcttgttacatcaatcttcagacccagagcaatcataacttttttactttaagaaagttcatggcagcaagtcagcataaagttgagatctattcatcatattctaggaatttggcttaaacctccagtagatcattggctgccaatacctaaacttctatgtggggttgttagatcagattagggagtcagaagctgggagcccttgtaaattatttctaaataactctgcaactcaaatctcatgcaacgcataacccaacttacaaagtcccaaaacatacttacgcagctaattatttcaaaatataaattgatgatctttattgctaatttgcattatttctttctttaggtttctaaccaaaaaaagtcatgtaatttaccaaactttatgatttataaagcgacatcaacattacatgatctaattcttatgatatcatgctagctaaaaactacagtaccagataccgtgctgagtccaagaaaaataaatgtgttttgttccatgacctcttaatcaagagtggttagcagggatgcctttggccattttggatcaccagttcagataacaaatcaccttttgttgttttctccatgaaatggaatattcagagttcagttggtgtcgtagcctggagcccgagtcaaccaaataagccagcaattggtgattactttccatgccttttaagaacaaggaatttgtttcttaaatgattgtttattgtcattgatatatctgttgaaatgcaaatcgttgtttaaatagactgcctgcataataagcaaccaggttgttttttacgggtgttacgttgcaagaaattattttaactttgtaagtctttctaaaagtttttgctgttgagggttgtcaggctcctacaaagtataacgttttcatagtcatctgcacacataaccactaaaataggcgatccgtgactctgccactgcataattttaacaattcatcaatgtttgaattcctctttataatcaactccagattactattttaactcaatccacaattccatatctaataagatgtagactgagaatagagtgttgaattacatggcatgaatttccataccaagacaagagacagattccttattcagcttataggatttctgacgtttggcatgacaccatacagccattatgttacccctattagagggtattcaaccatatggaagtggagtatcatctatgaaaactagaaacaggatgcaatcctcctgattctaaaatcgaacaagttgactaacaaaatacccaggggataggccatggggtaccaaggaaacaattgaataaccaaatataataatgcctgtgccagaatttgcatcttacagatattatgtggccacagaatctagttcaactaatatgctagttcacctttgcaaggatattgctatgctcaatatcaaaacaatgtatttatataagacaagcttttgaatacaactaatcaaggaagttaaagctactaaggtcacaatgtttttcttgcatgttaactagtattgcaaataaaaaagcgcacaaaccaaaagatatcgagacaatgtaatcgtgatcttccaacagaaaaaaaaaaactgttactctaattcatgcccaacaaaaatatattctttgtctaaggaggcagaaaagatcaatttcaagcataatcatttggtaagatttgcagcatggtcatatatgttttgcaaaaaattgcaatatagagatactgtgctgaaaattggcaattggcaactattgaagacagttcagagtttttttcatatcagaggaatagaaactcacacttgggtgatttgtctgctctcgtgatttcctctcaatattgtgattctgtctctataacggactttaagagccactagtaatgtaacagtctccactgaatagtaaccacggtctgcagcaagcgacaacaaaatcaattcaactacaaatagaagaaacaaataaacacaatacaggaaaaagtaattgtgatagaaaaaaggcatatcattcaactgcttatctgaaaaggcattccgtacaaattgtctaatccttaactgaatggtgccctgtttgtccgacatgttgtattgcatacagatttcagatcaatacacatcatgagcatgcaatgaatacacatagacaaccatagtcatgatgacctcaagtttaagaatgcttgacatgtacgattaccaaaaccaacacggcagcagtgtagcggaaccaagcgacaagatccttgtatgttagtgtaccggtggcaacaagctatacatgccatttatgttgaaagtacatgcaagctctccgtttccatgcaaccttgaaacatttaaaatgaagcaaaccaaaaccttggctaacagacatctcatcagttccctaagacagtaagactccatataatccaaggaataaacactccaaagcccaaggacgttcatcccatcaagaaaaaaaaaatccaacatgcctaatatgtccaatagcaataaatactcacataaatttctacttgattaatatacctaatccagacgaacaacataagaaaggctagcatcaaaattctagcgatccatgggacaacataacaagaacatgatcatcaattcagcacattaatcagaccaaagcactgcctcaaagctcccaaatccgaacacctcagcacctcaacactgcatcaggatctaacgaattcatcccctacctcacacgccccatttataccagatcgattggtcgaaccaccacaccaaacccgcagatcggcccaaaaggggaacacacgcgtccgaggccggaggagaagagagagagagaggggtagcgagctagaaacttaccgacgtagtcacccatgaagaggtagttggtgtcgggggagtccccgccgatgcggaagagctcgatgaggtcgtagaactggccgtggatgtcgccgcagacggtgacggggcaccgcaccggctgcacgttccactcctccatgaggatcgccttcgcctgctcgcacagcgccctcacctccgcctcccccaggaacttgcactcccgcagctgcgagatctgccggtccagatccgcgtgcgacggcatcgtcgcctcccccctccccacctccccctcctcctcctccctcctcaccagggcgccgccgcaggggaggtggcggtggggggcgcggtcgctagggtttgcgggggatcgggggaggtggcgatgcaggaggaggtgctcatgccgccatctctctctctctctttcttctgcgaccgcgtggttgctcgcgtcgcctgtataggatgggggaaggaaaattgtttttttttttagggtgtttgttttggttttggctttgatgggggtttggtgatttggattggggcgaaaagtataaataaatttttgcgagttgtttaattaattcggggggaaaggcggatgggggagtgctttccaggtgtgtagagatta

SEQ ID NO: 47548 - DNA, 11266 bp, Oryza sativa
atataatgatgtgatttgtgggagataaaaatatatgtcatatgccactatatttgttgtgttataaatctctggctataattagtgattggaaattagccatgagtcatggcatatggcttgtctagttttcactcatttgtccaattgtgcattgttcaccaggaatgattgtaggaaaatagtttgtggctttgaatatattgcctgatcattaggatatatttaatagcatacttgcattaagaactagattgaggcacatcaatttatcattttggttcaatgcattcaataaatcatcaagataaataaaatatcacaacattttctcatcatcatatagaaagtgccgtgatattagctagtagcagtgtgacaccgaattaccaaattagcaaaagtgttcgagccaatctgcttcttccttataataatagagtgcggccaaaagaactatatattttcttccattgctatagtccgtcttgtctctttcttcgaccagccgctaacattgagaagggtgtcaaagtcatatacaatgaatcagcaatcaatacttacaacagcattgacagtggttgaaataatctttctttatgggagctcaaacacatgtttaggtgtgatgccttttctcagattttggattattgccataattattgcgcaactaatcaattttactacaaagtacaaatagttgttgtttattggtggagtcaacatgtaaacaaggaaattgcggtatcaaataggcatttctagttttatcatgtacaacaacatgagcttcatcctcaacatagtcactatgtgaaaataaggcctgatataaaactgtcgttggggagggtttggggatccccgtgcttactgttgatgaaaaatccgcgcttggctgatggtgctagaactgtattggcgcgaactaagtcgacgaacacaacggcctgagagatctgcttagctccagtgcaagtccaaaggttcatgagatacgagcgtgctagccagtttgatcctgcaactgacaagatatacaaatagcagatcaatgagccgatcggctgataagccgatggagtaattccagccgatgccgataccagccgatagcaataggattttgagctatcggctatatgtttaatgtagaatatgacacttgatgtaaataatgatataaagacaatcggttgatgatgatgtaataaaataataatataacagtattccctctattacagattataaggcattttgtcccatcatgattttttttcctttgtcctattctgattaaatcacgtccgatatctttattccaaaactaccgtcctgattaagataggagccaaaacatctcttgcctaccgcaagacctatcttgcatcttcccaactcgtgtttgtgtatccaagactcccatcctagctccaatgtcttccaatcttctcccaaatcacaataccgactagggcacgaccgatttgcctcctctgctagggactctttgtcacactcaaggagtcccgacgtcaaggtcgtgtcttttctccatgaccgcatgaccggacaactccatcgcttcgccaaggaggcacaagcgttcttggcagtgtagatccatgggaccttcgtctgacggcacgaccctcatctcacacgtaggagtgctccacccatttatccgggaaggacgctatgttggcggagtatgtgggcgcaacccatcttcaacgacactcagggaggacatggtgctagcgaagtgtgtggggacaacctacgtgggctgtggtggcgcgcgagctgctttgcctccgcgacgtgcgtacttcaccgctcgcccccccccccccccacacacacacacataattaactcatcaactgtccttttgatcaaattttacaatgtatccgccaaaacttctgattgatcgaacaaggcacgatgaactgcttcatctactgtagcttgaaatgtttcaaccatcgacttaggagattgttccttcttggcattgacttcctcttagacatgttgggtgcaaaactcgtgtcccaccaggcgtgccaaagatgtgttgacgcgaaaaacacacactggcctaggagatccgcttagctccagtgcaggtccaaaggttgatgagatgcgggtgtgccagtcagtttgatcctcaattgacaagatatagaaatagcagatcaaatagtcgatcggctgacaagccgatggagtaattccagccgatgccgataccagccgatagtgataggattcggagctaccggatatatatccaatgtatattctgacacttgatataaataccaatataaaggcaatcagctgatgataatacaatataacaataatataatctagtagaaaccaatcggctcggctaacaatgatatgatagaatgagtattgatccgaaggttaaagcatacatcggctggaggtccaatgccataaaatccataagagtagataaaacactgaaaacctttattgtcatcggctaaatccaatatgtatgcaatccttgtaaaccgatgcaacgtccagatacctcatcggctgaaaccccgatgaaacccttattggcagtcaagaagcaggctagagattatagttctaagcacaacttagtagatcaaacttaactgatgcagcactaagtatgaaaagaaacgtaatatctaggcaatcaagcccttgactaatctttaaggtggtagatgccttagctaatctaatttagtaaaacaatttagctgataccggcagaaaccctaaagcgagagacaaccgatagagctaaattaagatactaagactagattaactaacacatatgataaataggtaggcaaatatatcatccaaaccagagcaatccaagaggtcgaatgtactgatgcagccttgaacaacgccgacgtagatgagacaattgcctgggccggcggaacattggacttaccccttcgccggagatcgaacaccgatggagccccgcgtcaggtgccaagtcccgttggacaataaaataaagtagaaaaggtaaaaggtggcgatgcgccgaattgtattgattgtggagattgtttacaatgaccccggtgttgatgcgaaaaacacacactggcctggaagatctgcttaactcctgtgcaggtccaaaatcttgcttttaggttcatgagcgtgccagttgatttgatcctgcaatcaacaagaataaaagacaagaaaatgaggttaaatccataaacgataaccgatcggctagttgccgatgatatatcatttatcttcgagccgatgtcatgttggaatcgatcggcagtaatgaatgaataagataagactaaatctacttggtcggctgtagatattaacgacatataatctttccttcgacgtatgtttaaactaagtgattgggatagattggtcgccatgccgagacagtataaatcacttaagtcgaaaaatacattaaagcaatgattatataggcgtttatagcatagctggtcagatagaactagcatgtatcagctaatactccgacaccactttatactaagatattaaaacaagcaaaatatatcaaacaagaagcataatatactctaatgcaataagatcttaatataaagggcatatttagcataacaattaagcatatgagataaaaataactaaatcagataagatcggctgaaactccgacactatctctactgatgatcatgaaacaggctagatatcacaattatagatataacttaatagatcgaactcaaccgatgcagcattaagtataaagataactgtaagatctaaacaagataatgaaaatctctaagagatggtagatacacaatataatctagattaataacgaaatctaactctatcggctactttctaacagtaaaaaccagctgattacaagttacatagagcaactaataaagattatgaagtatatatgataactcgacgaattacataaacaagattagggtgtcataaagatggaagcactaatcccgagaatgcaaaccgccatgacaagtttacctctagttgaagatcgaaaccgatgcagctcaacccgaaagtaagaactcatcgaaatagaacgaaagtaaaaggatggcgatgcgccgaaagtgttattgaactgttgttgttaattacatgggttcgggtcatatttatacccgagatacatgatatgtccttggtggacacgactcttatctctaaatctctaagatacacataagtctttacgacagacttttgcctaaacatatctctaacgaaactatttaaaatatcctaattaataggtacaattatctatctgagagcttatctcgcatcgtggcaatccttgtgtagtacgttgattgattctagaaacaattttacaactgtcttcaacaaaatcggctatatcggctgtcctctgtccgatccatctcagccgatgcagactccagccgattccttcgcagctgatgcatactctgttcttcgaatctatttctttgccgaatccactctgtttccaatgccgaacctagttcatatcttaccaaatttggtcgttaacacaagggtgtacatatttatacccatgggaagatactagtccttataggacaagaaagaaactttcctaaggaaaacataaatagataaaaggaaaacataaagttcttataggacactaaacacgctttcctaaatataaaagaaaactaacaaatgttgcctaattaatagataaactgtcatgccgcatccttcttaaactcggtcacttctagataagctttctttaacagattaattttcataaccgaatatagtaggaatccgactattggcgacgtgataattctctcaggggcttaccgaatttcattgttaacaattatataagactttctagcattgcccacaattaatgacatataaatatgggcaatgttagaaagtcttataatataaaatggaggaagtaatacttaactaatcacacgctaatatacggctgtttccgtgcatataagtgattagtcgacaaccttggctgccgagcgcagcccaagggcccctttaaattgcaggattgagaaaacagagaaataggaaaaacgtagaaacagaatgccacacttattggattcctatgagattttaaacacattaaaatctccaaactagcgtttgattatcacacaggaaaatcgtaggaatcttagacatacgaggaaaacatgaggtgagacctcacacttatttttctctaaaattgctctaggaaggtccattcgatgcaaatttcaaaggaattgttaggaaataatctgtttcaaaggggtttcctgtttgacggttcgacctcgccttcacgctttcagccaaaacacagcggtggcggcgcgacagccgacttggtgatcggcaaaagcaccaaaccatccccctcctgcctcctccccttaaaccctactcctctcctaatccttcccttcctcgtcgccacgcggcgacagcgagctcccctaaccaaaaccccaccaccgcgatggacgacgcggcggagcggaggcggcggcagcagcagcagcagcagccaggcgccgcccaccccgcgcgccgcaaggtcgtggaggagcccttcgacccctcccctcccccggccgccgccgtggcgccgccttcctcccgcctcgtcggcgccatcgtcgagaagggcttctcctccggcgcggccgccgccgcgccctcctccgccccgagtcccaccgtcctccccttccccgtcgcccgccaccgctcccacggccccgtaagccgcctacgcctcctccgccgccgccctctatctcggaaccctaggtttgatgtggtgctttggttttgtactccctgactgactatctgctcttccgcagcactggaaaccggcggcgagggatgctgccatggcggagggggagggcgaggaggaggaagggatggatgtggacgagacggactaccagcccgtggccgccgcagctgggcccgttaagaggaaggagaagaagggcatggatttcagcaggtggcgggagttcgtcgctgacgatgcgcccccgaagcgaaggcaggcaaagccgttgcagccgaagaaacagactgcgcagaaaattgacaccggggtcgtggctgcaacgacgggtggcaccgcacaggagaagcgctccgggggaattggtatgcagctggaagttggaaatggtaaggaagaattgggtggagctgctttgagtctgatgtggcgccaaggaagccgatgaaacaggttgatgctagagatgatgtgaggaatgtggaattgcgaggagagggtatggaatcggataatggggaaccatctcttaccgcagagattaatgcggagaacatggctaggctggcagggatgtcagctggggagattgcagaggcacaggcagagatcctgaataggatggacccggcatttgtggagatgctgaaacgacgggggaaggagaagtctgggagcaggaaagatgggggaaagggcaagggtggggggatttcaggcccagggaagatctcgaaggctatgcctggagaatggttgtcagctggtgagcatagtggacacacttggaaggcatggagtgagagagtagagcggatcaggtcttgtaggttcacattggaaggagatattttggggtttcaatcttgtcaggagcaacaacatggtaaatcatttttctttgctcttgtgttgcttttagcttctagtgttctggtacccgttacatgtcaacctggctttcccacttacaggcaagaaagcacatgtggaaactgtaggtgagcgtgattttcttcgaacagagggagatcccgcagctgttgggtacacaattaatgaagcagtggcacttagcaggagcatggtttgttactttcttttgttgttcagtgtgaaaatggacttttgagtaaagttcaagggctaaaaatggactttacccaatgcaatacaacatctagtttctctttagtatttttagagatattaacctttgcatgtgaatggattttgttgtttttttttttaaatgtcatatcatgcataactgagatacaccatcatcgcttaatgtttttcttacatcatttctaaagtgtgcctccaaaatattgcaagataaataaatgtaataattcagtttttacgttcaaaccataggttcctggacagcgcgtgcttgcgcttcagctccttgctttgattcttaatagggccttgcagaacctacataagacggatctaattgataactttaaagaatcaaatgatgatgacaagtttaatgactggcaagcggtttgggcatatgccatcggacctgaacctgagttggttctctctctaaggtaaactggttgttttcaaactataataataattttaatttggatttgcttattccatgcaagagtttattagttaccaaagtgaagagtacttaactgaaatataccggacaattctattaagactaaataatcaagaaaccttaacacatgctttagtgtctgcacctatgcttaaaattgtatgcctgaaaatttgggctgccacatcttgtattttagtcatgaattcatgacagcaggcaagcattaacagcataaggtcatcttgtccattagctatcagttagcacttgtaagaagatgtatccagttaacttaggccatgtctagtgtaggtgaagctaaggttgtcacatcacagccatgtgatacacagggtggataatttttcttctctagtgtgctagcatcgattttagtttttgagtggactccactagaaattttaaaaactggctttcctagtgtatgcaaataaaacattttgcttcgcatcaaaccatatatgcatcgattttgttcctagcatctcctcttctagtgcctagaatcattactaagccttcaaatccgcttgctagcatcggtcaaggtgtgcactagacatgcccttattgtctttctttttgcagtcacgttggctgtttcatgtataataagttaggaaaattccatctatagcacaaagttttcataggtactaataaataccacaattttcaacccttccagaaatgccacaatgtgacaccacacgtaaaaaataccacaaaattttacagaactgaacgtatgacaaattgaactattaccatggacaaaattgcccctggcctttcttcaatctgcattcagtagtctccccgtgattccactcgtctcctctctctctctctctctctctctctctctctctctctctctcggcgagatgaagtgaagctggtggccacgaattccggcaatgaagcacggtcctacctacaatccgtcctcgaggactagcgaccgccgccagccgcggaggccgccagcgccgaggccgctgaggcgttggctctcgaggtgaagtcttccgcactcctcccgtaaccgatgaaggtctggcaaccatggccatgcctctgacctgctctagcgtgatccaatcacttggtctcacaggtctccatgatgctcttattgccggcggccattgcaacatccacacatgcatccgaatcatatgtccccaaatccgaacgcctaaatccatttcctccttgtgttattctcttggccacagaaaacacctcgttttggcaggatttgctgcgaatcaagccaaataatccattgccttcgtggtaatctgggcattttctttgtaaaatggcactgtccatccccgccttgttctgttctgagttgtggtatttctgaaagggtggaaaaatccatggtattattaggtaccagtgaaaactttgtgctatagatggaattttccctaataagttataatctcagaaaactgcggtgtgacctaattaactgttgtctataggttttttttatttagttctctcatatgccatctaattagtttctttgcttatatgagttaattgcaccagtgttagaccttaaaatggcctatgcttttttcattgtttattctacttatgtgtcatcactaactggaatatctgcaggatgtcattggatgataaccatgattctgtagttttgacttgtgctaaagttatcaatgctatgctgagctatgaaatgaatgagatgtatttcgatgttttagaggtaactttactaatttatcttctaatttgtttttcgttgagaactttatccttaaatggctgatttcaacattacagaaagtagtagatcaagggaaggatatctgtacagctcctgttttccgtagcaaacctgatcagaatgggggttttcttgaaggaggtttctggaaatacaacacaaaaccatccaatatactcccacattatggtgagaatgatgaggaagaaggtgatgagaaacataccattcaagatgatgtggttgtatcaggtcaagatgttgctgctggtcttgttagaatgggaatacttccacggatctgcttccttttggaggtgagggtctggccatctgctctccctcatcccctatctgccattgtttctttcagaatcccactgccatgcatgcacccagaatcccaccgccatgcatgcacaatatgggtgcattaggtcatcttttgtttactatatccgtgaattgtctggttccttgatgttcaatcctgtctagtacttgccatccatccttgaaatggcagtgaaatgcctccttacctggttgacacatcacttgttttcaccaggaaatctggtttgcagcagaatttgtggctggctttgattgttcttttaccatcggaaaattacaattttgatattcaacaaccaaactatgataaattgtgtatagcctttcatttttagcaatattttttatttcctgaagctatgggccttatccatttgcagttttaagtattttgtagttctatgatgtcatgtcatctgatacccgtaatctttcaaacttcttatctggttattggactgtctcgtagattgttctgttcacccttggtgctcttgcttgttgactgtttgttttatagtgatagctttatattgcagttctattacttcactagtaaacatcatttgagctagttggtcttctttttatttatgttttcatttcctattctacgagaaagtgatggtcatgattacggatcttaatggtcaagtttttgttgattcagatggacccacatccaattctagaagataatcttgtttcaattcttttgggattagcgagacactctccacaatctgctgatgctatcttgaactgcccaaggctcgttcaaagtgttgttaagttgttagtcaagcaaggatcaatggaaattcactcctcgcaaattaaaggagtcaatctcttgaaggtatcttctggtgatataaataatcttttattataggagtatgctgattttgtgtagttttggaagttgcagattatttattatatagtttttcttctatatcattggttgataataacttgatctagttatccttcagaaggattccttctgaaggataactagatcaagtctgccagtaataccacttgcaattgctgattgtacatctgaaatggtttccttttgttggtaattagctaccaacagcatcattatgagttttttttttgtttgctgcttctgatatcttaacacatagcaattgtattagccatgcctgctgttatctgaatcaatcacactccttgcacaatgccttcactgtcaacacacaactgtttggtccccccccctcctgcgggcactttagttgccccattaattcattattatggtaagatgagaaacaccatagtcataagatttgaatgttcagattatgctaaaaaaaatcattacttctatttctaaatttgtcaaagatttttttttcactagcatctaatttcttgttccttttgcctaggttttgtccaagtacaacaggcaaacatgcttcaattttgtgaacactggagtttttcatcaggctatgtggcactggtacagaaaagcctatactcttgagattggataagatctggaaaggagcactgcaagcttacttca

SEQ ID NO: 47549 - DNA, 2805 bp, Oryza sativa
agtagcatggatttgcttctagaagacagaagtagggatatttttcatgctttgcaagaactgtatggcctgcatttggatagattatgccagaaatatgacagtgctcactctgtcaagaaagaaggatcagcctctgtggacgaagaaaaggtgaccaggactgaagttctcagatttcaggagaaaatccatgcaaactatactacttttgttgagagccttattgagcaatttgcagctgtctcatatggtgatgctctttttggtcgacaagtagccatttatttgcaccggagtgttgaacccacaattcggcttgcggcctggaacgctctgtctaatgcttatgtgcttgaactgttacctccactagacaaatgcgtcggtgatgttcaagggtacttggagcctcttgaggtattgtctctttagtttcttgtatgcttgtcttttggttggcattttgtagtaacaatgtaaatttgggtctagaagtttgctttatactactgcttttggggttgcacattacatagagtatgcaaagagtaaacaatgcatgctatttttcttaactatttgatttcggtacatacatgagcacatgccatgattctttgtaagcatgttcccacctgcttgtactttgttgcatctgtgtgataaaacagtttcagattttctgattattattttcacaataattttgtaggatgacgaaggaattttggagtcttatgctaaatcatggacttctggtgcccttgacaaagcttttcagcgggatgcaatgtctttcacagtagcaaggcatcacctttctggcttcgtcttccagtgcagcggttctggcaaagtgcggaataagctggttaaatcgcttatccggtgctatggccagaagcgccatcacgaggtaattccctcgtgctttccggaatattagtcatatatttcataaatcatgaaccatccttgatgtttggaaaattctataccgcaggatatgctcaagggttttgttctacaaggcattgcgcaagattcacaacgtaatgatgaagttagccgacgatttgaaatcatgaaggatgcttgtgagatgaattcttctcttttagctgaggttcggagactgaagacatcaattgatagataaatggccccaaaagcatttcacatgcactcagagaaggagcaatttttttggtgattgtaaatagtaacatgtgtcaatgacaaatggctagagaatagttgcattgttcgagtttactttgcattacaaaccaaccaaaggaaaacatcagtgtgtgtaggagtgctcccggttgtggcttgtgggttacattttaaaggacaatgaaacagactggtgttacagagatgctaactccaaccttatgctccagtatccaacattttctccctctcttgtgttcttgaaagaagacatttattcatggtgtttatctgttagcatgcccatctcatttcattctgtttgtatatacatgctaactcattatctaaaaagaattatacatgctaacttgcatacatcggtagcagaatgcatcatacgtttttctgtacaagtttattcatgagaggaacgagttatgtgatgcaagttacgtagaactatcaaagcatggatacgtgccagcactatacctgtttctttgcaaaagaaaagaaataaattgccgttatcacttgccgcatgtatctccggctgtcactgccagtctgccctggagctttacgagctgtttgccctggagctttacgagttgtttgcttgctaccctgagcaacatgcctgaaatttctgtgtgcctgagtggcatatgagaagacaatgcatctagcctggtcaggcagcctgagtatgtgcttgtttggttggttattgctgcctgagcaacaaatatgcatggccgtctgttcagattaataccattttaaacaatattttaaaccatattattgtttggtaaattgataaatatatggtggcgtttagtttgttattaaatattggtcatatctcatatttagccaattttatcaaaacttactaatgttgctaatttgctaaaattttggcaatgccaaattttaaaaagataaaattggctataaagtgaataattaagcccgcaattatgcctttgatcattatacaactaaatgaagtattaatgggacgttggcacaagatccaactaagatccatctattactctaacctcccatgcacaagcacaaatcttgcgtacattacgaggattgaaatcttgaaagaaaaagcatgaaaaaaaaaagagagaacgcaatggaagagtcaaataaatcctaaatccgtacatccagaagcacaactttttcgggtagcaaccaaacagacccttacaaaccaacgtcgtcccattaaatacttggggggcaacctagatcttcggttatcactgtcctctccgccacggtgggtgcggcctcctctccgccacgacgcgacgatgggaggccgtgggattaccgtgattgtaatctttttgtgattgtgtttggacattttttgcgattgtgtttggatgatattgattgtgtttagttgatgggatgatgttgatttgtgacgatgatgatgatgatggagagttggctcggtgcatcggcttaatttcgagccgatgcatcgagccctttttttctaatcacaaaagtgccgaccaatagatgtcgattgagaaaaccggcacatataaaggtttcccaatcggcatctatagttat

SEQ ID NO: 47550 - DNA, 11588 bp, Oryza sativa
atgtgagcacacatgacttgttctgttcttctcgtctgatactgcgtgaaaagaactatttcaagcgagaccgaccgctatcagggaccaccatttgttttgatcgcgagttggactcaaaccggataaatgcacgtcatcagggtcaaatggacaattaggaagattatagtatccttgagcatgaacaactatagcagagcagcgccattgccgcaccgcacttgtctttagtttaccagttagccatgcatttcagagggaaaaagaacatagtttggctgttctagaacaaacacttgcaataattaggtcgtcggtcgatcttttcggcacgttctctgtcagtcagacaatataatttgttcgttaagaaagaaaaaaaaaacagcagtcaatttgacacggagaataaccctttttttttctttcctttaaactaattgaagagcacaagaggctgagaggggacacgtagtacgatcgagcacgaagccacgaacaagttgggaacggagtcaacaaaaaaaagtcagaaaccacgagtgatctggacttgtgaaggtaggagatagaaggagagacgaagatgatgcctcggactcaaatacgggcggtttgaagatgatgccgccatcgccaggagaggagaggagacaggcgcgtcttagctaagccttgccggctgtcagctgccatgaaccaccgacacacagagcaaggaaacacacgcagaaaagcagcatgtagttgttttttttttaaaaaaagaagcagctagcatgcattggcactagtaatgtggtgtttgaaaccgatgaaaataaagagtaagttatcgtacgtaaaacgtgaaacctattattacctccgtcccatataaactgcaactatgctctcaggctttgtctcaaaaaactataattctaatcacgtaagacctagcaaattgattaatctaaatatgtttcatatagtctcctaacatttcattccacaatcttccttttaatctaaaaatgtttccttaattgtctcaaacttcctttaatcaattttatatatatagaatgtgtgcatcttttgtgttcattaaatatgattattatagtcatttttcaatcctactattttgtcctaaattagatagaagtgcaatttatataggacggatgtagtagtaaataattaattagttttaattattataaacttgaaaatgaatatatttgtattttaaagcaacttttatatataaattttttgcacaaaacgtactgttaaatagtctgaaaaaaaacgtgcggtagaaactgctaattctaaagcttcccataaggagaagacaactacgcagagagagagagagagagtattcattagtcaatgtgcgtaagcgtaactttcagaattcattagtacaagacctgggaatttttttttaccagaagacctgggaaattcgcccgcagatcaatggaaagggggcctcgtggatttttctcgtttatcccgaggaaatgaaatactcccttcatcccaaaatatagggcgctctctttttaagaaaaattaaacccgataacttttgactaacaatcacactaaccatatatatgctaagtattatgcatgttatatcactagattcatattttaaagtactttcatgtaatgctaatttcatattcgttagtaacataatatggaataaattaatggtcaaagtatatcattgaagaccgtgtaaaaaaatatatgccttataatttgggacatagggagtaatacttcactgtattgcttccaatcttgactatcgatgtttggtttcgtgggggtccttttttatttatttagagtgtgttttagattcaggggtgtaaaattttagcgtgtcacatcggatattatgtggggtgtcacatgaggtgttcgggcactaataaaaaaaactaattacagaatccgtaaactgcgagacgaatttattaagcctaattaatctgtcattagcaaatgtttaatatagcatcacattgtcaaatcattgagaaattaggcttaaaagattcatctcgcaaattagtcgcaatctattcaattagttatttttttaccctatatttaatacttcatgtatgtgtttaaatgttcgatatgatagggtgtaaaattttgaggtgggatctaaacaggcctacgagaactcatatatacatgttccatcaccgtacattttatcacatagctagcttttcatacccctgtcacgtataattatgggtgtgtttagttcacgcaaaaattaaaagtttgattgaaattggaacgatgtgatgaaaaagttggaagtttatgtgtgtaagaaagttttgatgtgatggaaaagttggaaactaaaccaggcccatgtaagaatatataagctctacctcctccgtttcatattataactagctttgacttttttttgtcaaacttttttagtttgactaaatttatagaaaaatttagcaacatctatatataataccaaattagtttcattaaaactataatttaatatattttgataatatgcttgctttatgttaaaaatattacgatatttttctcagatttcaagacaacattcatgaaagctatactactttttgtcgatagccttattgagcaatttgcagctagctgttcccatttggagacattaattacttgcatcggagtgttgaatccacaattcgccttgtggcttggaatgcactactgtctaatacttatgtgcttgaactgttattaattacctcctctggaaaaaatgcattggtgacgtccaaggatacttagcttcttgaggtatttgtttcttaagttttttcattgctttgtcttttcggtggcgtttttggtagtataattaactgcgtaaatttcgttttagaagtttgcttaatttatactacctccgtttcaggttataaaactttctagtattgcccacatttatatactccctccgtttcgttttgtttgtcgtttccgacagcttcggcgagattaaggttgacgtgaatttacccttttgcccttcctcttcactgattcattccccttcccttctacgcgtgacggcggcggtgccccatcccgatcccgagcgtcgtggcagggccgacggcggggacggcggtgctcttccccaccacccctgtcgcggcttccccttcccacgggcagcggcgccggcatcctgcttccccccgccggtgagcacacccttctctttcccctcttcccacaccttctctcacctccctcccgtctcttcgcgagcctgcgcccaccgccgccggcgaagtcgccggccaccgcatcccgccgccgctctccggctactaggggtatctggccgacgcatcctctcctccgaagctgtagagtagtgtagtggcgggtggcgttctttgcgatttgccaccactgggcagcgccgccggctcgccatcgccggagcccagcaagaagctggcgtactgagattttggtcagggtagtactcacactgcggcactgccaagtccggcggctcgttggaggtttagcatattgggtttagatgatgctgatcacgttcaagatgatgatgatgatgatgatgatgaattgatgttggtttaataaggttttagtgggtggtgattaaggtttgatcttgaattgttcatgtggcagtagcttttgatcttttgattattcgcaatattacttgtagatttgctctgaatttttgcaaggtgtgttgcagataattcttcattttgcaggaacgatttgcttctaataaaatgcttagtgtgacaatgaccatcatggcaccaatatttcacttgtaattagcagttttacctaggtaatctgtgactaatgcaatgctgacaccacagttgagctagatcagtggataaagtagatattatctgaacattatttgtgcctaatgtaatgctgacactatagttgagctacaccagcagaactaaattaaaatgataaattctatctgattcctggacaacagtgtatggtttacggagtagtttctttgaattgatcggttgttgtttaccatgtgtttcttgtcttctggtattttttaccatgtttatttggttgttcatttcttgtccgttcttgattttgtatggaagataccgggtgttcttcctggacgccgttggtcatgacgaaggaggagggcagggtaggtagacgtcgcaaatttgtcacaccatggaagaaagcggctcaggaggtcggcgacggcggtgcagaggatcgtgtcgagcgcctcgctgccgcggctttgtcctcaactgctctctctccaaggttcgtattcgattttttttcgatgatgtattttgtgttcctaaaatgtgttattttcaggaaaactctatagatgctcactattgcgaggttaaatgaattttcacatctaacctcacatagttcagttcatggctactgcttgtgcaaaattcgattaattagagcaaggaaatagcactgtatttctatttacagggagctgttgctggttgttctagtttatgcaaacatttagcataagtcttttccttatcttattgcttcataaattggagttcttgttattgtataatttcttgttagatcacatggttgtctgtccagttatgctatacaaccagtactagatgtcttacagaatggatgcttttatcttttctcagaaccttactatgcttttcactcttaacatttgatgcaacttataatccaaaatgtgcattcatgacaacttcgttgcaacaccttttgcagggttacactagatgggtccaatgttggagggaaaagaggcaaaaaaaggaagtctccctgcgtggcaatgccattctttagaaccccgttgagcagaatgttactgtcccctagcatacggataaggtctccttctatacaacaacgaacatcaccttctgctacaacccatggaatttgtcaaggtcgagagcaaagaacaatggatattgatttaaatttggaaccgggagatacatatgctgccacagatcccggagaggctggatttgatcacagtgctgccaaagatgctcaaggcaatggagaggctagattcgatcacagtgctgccatagatgctcaaggcaatggagaggctggatttgatcccttcgattcaaatgctgatgatgatgtcctagtcactctagaggagataggtgttgaccctggccaggagaatgtacagcctcagtttgatcctttcttcgattctgatgttgatgatgctatcctagttcctcaggagaatacacacaagaatgtcgtgcttgataatgacaaacggagagcaatctttgacgccatgcttgtaaaggcaagaaaaggatatttgaagggccatgagagcaaggaggtttcagctaaattctcggtgcctatcaggacagtacagcggatatggaaaaaaggcaaaagctgtttggatcaaggtatttcagttgatgttgcgagtggaagatctaggtgtggcagaaagaagaaggtggtggatgtgtcctgtctcgaagatatttcaatattgagccgcaccacaatacaagatgtagctactcaacttggtgttagcacgagtaaggtctacagaatgaaaaaagagggtgctataaagcgtgtatctagctcattggatccccacttgacagaccaaaacaaaattgatcggctgaagtggtgtattgaaatgcttgacccaaggagtgtgcctcacaatcttgtcttcaaaccactgtttgatttcattttcatagatgagaagtggttcaacattacgaggaagactgtgcgatattacgcagctccaactgcctcgcgtcgcatcaggacaattcaaaacaaaaacttcatcccaaaaataatgatcttaacagctctcgccagaccaaggtttgactcaaatgaaaattggatgttttccttttgtgacatacacagctgcaaagaggtcaagtgtgaaccgtcctgcagggacaatcgagatgaagcccattgagtcaatcacaaaggaggtaatccgaagcttcatgatagaaaaggtattgccagctgttcgggctaagtggcctcgtgaagacgctggcaaacctatatacatccagcaggataatgctcggcctcatattgcaccggacgacagaatgttttgtgaggccgcgaagcaagacggctttaacatcaaacttgtttgccagccggcaaattccccatatttgaatgtcttggatctgggtttcttcaactccattcagtccatccagtacaaatcagcctcaacaacaacagaagaacttgtagccgccatcgatcgagcatttgaagattatccagtgaggctatcaaacaggattttcttgtctcttcacgcatgcatgagggaagtcatagaagtactcggtgacaactcctatgatcttccacacataaaaaaaggagtgcttgaaaggcaaggtcgccttcctttgcaactaaggtgtgatgctaagtcagtaaataatgctaacaattatctcaggtaaactactttggttatattttattttcatgaaaatcgcttcatgtgcctaactagtttgatgtgtgctaattagtggcattctttttactccttttcaggaccatggcagatacctgatatgaatttgtttgttgctgcagcagggtgcggatatgaaattgctgctaagctaatctgaaatttttggtgttgctgctgttgctgttgctgctgttgttgatatctgaaattgttggtgttactgctgttgctgatatctgaaattgttggtgctgttgttgatctgaacagaatgaattggaggctttcttttttttctctctttttctagaaagtagcccatgtgtgcagtcattctgtgcagaacatgtcctttgatttttgagaaagcaggaggatatatggacctgaatatgtcctttgatttttttattagtatttttatttcacatgaacacattagctaagcttatctaagatcaatggtgtgaactgtcaatggtcctttgatataattacagactagctatctcaatttacaagaaatagcaactgggatggcagcagccactttacaagctctgtgtctgaatactctgtttacagactagctatctcaatttacaagaaacatcagctgggatggcagcagccactttacaagcttggtgtgcatctctgaatctgtatctcaagttccaatttttgtttccaatttctcattataacatccaaaattcccacgcatattacatcactgacagtactaagcactaatcatctgatcaaatacacaacaatcagtccccagtgaacacgaccagaatttcccagaaacagaaaaatttccccttcgatgaacatcaaatagccaagcaaatgcaatgtgcattctctaaaaaacgaacatcaacaatcaacatacggctaaccaaatcagacaatctgcaggccgttcagtagcttaatctgcaatcaagtgcacagctatcttaaccggatgaaataatcaggtaaattctggacatccagctgaagaaagaaaaaagaaaggaggagacttgtggcaatggagcttttcgaagcccggcgatctcctgcaccaacgagacgtgcaccagcaccgtcctccacgccatgtatcagcctgcgaacccgccgccgccgcgagcagcgaacgaaagaatcagggaaaagccctcgagccaaagccgaatcgagaggaggagagggcagccgtactgagggcgatgatggagaggacgaaggcgaaggcgaggagcggccggaggacggaagacgacggcgatctcccacgctgccgccgccagcgtggctcctcctccggccatggtgccgcggcggcgcttcgtcggcggaaggggactatgcgcgtgggaggcggcgccggacttgagcgccatgcgtggagggcctcgccgtggcaggggcaggaggaccgccggcggaggagctcctcctgcttctccgcgccgccgactgaggggtaaagatggaaacggtatcggccggtgtactacgacgtcaaacattttgactctttttgaaatgagctacagcgacaaacaaaacgaaacggagggagtatatgttaatgaatctagaaatactagaaagtcttataatataaaatgaagaaagtaactattttgggcttgcacattacacacctctaggatacacacctgcatgctattttcctgagctgcatgccttgattctttgtatgcttgttcccatcttcatgtgtgtactttcctgcatgcgtctgcgataaaacagtttcatattttgcaattcttattttcacattaaatttgtagggtgacgaagaaattttggagtcatatgccaaatcatggacttctgatgtccttgacaaagcttttcagcaggattgtatgtcattcacaatagcaaggcatatggcttcgttttccagtgcagcggttctatcaaagtgcgaaataagctggttaaatcgcttatcccggtgctatgcccagaagcgtcatcgatcatgaggtaaatgctctcctgctttcaggaatattacttgtatatctttgtgttgtatttcttaaattgatcatgtgccatccttgatgttcggaaaaaaaaatcataccgcaggacgtgctcaaaggttttgttctgcaaattgcacaagattcacaatgtagtgatgaagttagctgaagatttgaaatcttgaagaattctagcttgcgagatgcatgaattcttctcttttaggtgagaatccagagattaaagacatcgattgatcgatcgataaatggcccaattaaaaacgtttcacatgcgctaaggcgcaaaagtcttggcgatcgtacataacataatatgtgccaacgacaaattaaacaactagagaatcatagttgcggttgacgagtacaaacctggcgctacaaataaaactgacaacaacatgctgaaggcctagctagaactgttacatggacgcttggcccatttcgccccatcagaattatggatttgtggattacattttgaggacaagaaccatcaattggtgtcgctggtggtaatcctgatgcagtaccgaacactttttcttgtttttgaaaaattgtcgtctcgtctgttagcatgcctgtctcatttcattctgtttatatagtacggagtatatgttgaatgcatcatcagttttttttgcatgtttattcatgagatgatgaaagagttatgtgatgtaacttcacatcacatgatcacatcgaactagagaatgaatgcgtgccaccactacaccatttttaattttgcaaaagaaaacaaacaagttctgccattatcatttgtagtatgtactacgtactagtataactccatatataggtactactccactatgctcggttctcgccggtctgaagcttcacagatcgatcaacgtcacagttgtcaccttggaaagttcaagcagaatgggaccaaattggcaagtagatcagcgagaggcatcggggaagatggctgggtacttcttcaccaacttccatgtggacgatcactaccaacttcttctgcaaacacaagcagtttcatctcttatgctactactactcctccaatgcaatgtcatgaacccaatttttatggctatggcctgtgagtcctgaccaatcatgagcccgggacaagattgattactcctaattaattcatgattcactactccagcccgggagtagaccgtgagctagacccagcagcgactagtacggataccacgtactacgttttgagcaacgcgtcaacatggagactgactttgacgtcaaaccaagctatacctaactactggtcggcgttgtcgccattaaccccatggagccaaccagacagctagctaactatgtacgaatcaatagtaatccatccatcaaacatatttctaggttgtttaacatcaattgagattgatgaaaaaaaacttattaaataagagatgaatataggtgagttttgtttttgggagagagaggtgggagtttagttgggagaggataaatagtagtgtagaaatgcttacattcttgaataaaatttaaatgctttaaatgtttatattgttggacggagggacgtaatactctctcctttcacaaatatttatattactgcgtagaaaagaactacatatttcattcgagaccgactggatactgctaggaccgtgttggactcggaacagttattttgatcgcgagttggactcaaaccggacaattgagccaaatgactgcactgcactctactagagagtttcatattgactagtagatcagcccgtacatcgccgcacttgtcattaattagcaaccgagatgaggaaaaaaaaagagttttcatttcgcatttctagaacatacccttccaataattaaatccatcgatcttttcgcgacatgctctctgtcagacaaaatacaatctgttcgtcaaggggaaatttaaaagaaaaaaaacaccagccatattcagtcaatttgatcatgtcaaagaacaatccttaagaaaaaaaaaagaaccgaagaagagggggacacacgagcaggaacaagctacgaacggagtcagcaaattttttttttaaaaaaatcagaagatcaaagtcagaaaccacgagtgagacaagggcgctgcgccgcctttgcacacgtcgtagcctaaggctgtgtttagttcatggtgaagttgtaagtttggttgaaaattaaaacgatgtgattgaaagtttgtgtgtatgataggttgatgtgatgagaaaagttggaagtttgaatacaaattttggatctaaacacaacctaattcccttgccggccgtttgctgccatgcgccactgccacaaagagcaatgagcacacatgcacacgggtagggtgaaaaacggcttgaaaaccagcttactgtttcaaattcgtttccggaaagtttttgactaattccagtttcaaaaggatagtagtattaccatactcgtttccaagaagaaaaaaaatattctaaatttgtttccgttttcgaaactttctgaaaataatattcagacccgcactttttgtttccggaaaaaaaagccaaaaactgaatactatctgaaccattttcatccctacacacatcggagcaaagtgcagcatgcatggcactggtatgatcgagcggtcaattctgaagcttccgatgaggagaagacaactgcagatagagagaattcattggtcaatgcatatagctttcagaattaatgtccttgtacacgctacacgacacggggaaattcgcccgcagattgatcgaaattaagccctttgtggatttttccaatggaaatgagacactactattttgcttccgatc

SEQ ID NO: 47551 - DNA, 3175 bp, Oryza sativa
atacattccaaggtcaaaagatctgctacatatgctaaatagatagtgcatgtgttctttcttttgcaggcttgtcagtctgtactgtagaaataaattaaccgcagaacatttttcttgatgtgtgatggaaaatagtcaatatcctgttatgatagtactccgtttggaatacatgggaatatcacaatgaatactagtaggtctatacatgtgtttttttaagggaaaattgtaaccatgccattataattttgcattgaaaaattataatggcatggttccaaattaccctttttttaaaggtacacgtggttctcgtatatgcacttgaatgaattatagctatggtattggtacctaacacaactgcaagcagtttttctattaattccttttggaaattaatgtagatttgtcttcccctacaaggctacaaggggataatatgttcactttccacagaaaaagtagttctgtagacctgcatgtttgccttcatgaactatagttgtaccaaataatcagatattctaatataaatttcttgctcaatcgactacattaatgccattccgttgctattttgcagttgagaaatttagtatgggcaactactagacatgatgtgtatcttctatcacaacgttctgtgcttcattggtcaccattcgccagtgagaagcacaaagtcattgatcttcaaggacatatcacgccatctgaggtccctatttctctttcaaatgtttatttgaacttgctagcctcatgaatagccacttctttgatatttgtattgtaactttgtaagcatacatattcaaattccatatatttgacttcagaagcaccaggggaatgtctccgaggggttttaccaggctcaagttagtacactagcagtgagaggtaatttgcttgttgccggtggatttcgtggagaactaatttgcaaggtaattttctttcataacctcttgttcaatctctgacatctatatggagttacaatgtagccatggtgtaatgtgtaaattttgtgtggggatgtagtttttggatcgtgaaggaataagctattgttgcaagtcaacacacgatgacaatggcatcactaattctctggagatatttgagaaacccaggtactataacatcattttaaaaactactactttgtttaaaatgaagtgagaatgtatgaatcataacttcaaaaaatgaattatgcagtggttcggtgcacttcctggcttcaaacaatgattgtggagttcgagactttgacatggaaaaatttcaaatttgcaataatttccgttttccttgggctgttaatgtaagcctttacttcattcatcaaactgtttatatctatatcttgttttatttattggatactcccaagtcctaatctattcgccacattcaagtcactactgaatgctttgctaaagattcttgcattccatgaggaaagaaagcctaatgttttattgatttaatcttgccccttgttttataccatgcagcacacatcattgagcccggatggtaaacttgttgctattgttggggacaaccctgaaggacttatagtcgatactaattcaggaaaagtaagcagaaagcaacgctcagcgattaacttccaaatactgacctcacatttcagaaaaagaaaagctcatggctgtttgtttctcgcagacagttcatgaactccgcggtcatctggactactctttcgcgtcagcgtggaacccagatggccggacattcgcgactggtaaccaagacaagacatgcaggatctgggatatccgaaacctttccaagtccgttgctgttctgggtggcaatatgggagccatacggtcgattcgctacacatccgatgggcgattcttggcaatggcggaaccagcagatttcgttcatatattcgacgtcggaagcgggtaccgaaggaagcaggtggtggatttctttggtgagatttctggcatttcgttcagtcccgacaccgaggctctgttcatcggtgttcatgatcggacctatagcagcctcctccagtacaaccggctacggttctactcataccttgattctgctatctgaatttgctacttgcaatcactggcagagtaatgtgagttctgaatcacaaaaaattgtagaagctagtaaagtagtagagaagatgtagatatgtccatatctgtagctgttactgtaaaggaacctgaaatgcatctgcaaatggcctgttgcttttgctggacaaaactgtatccatcagacttcagggtgagcaatcatcctacggaagagaagatgttatctggtacggcgctgtctacttcagcaaaggctgaaaaatatcttgacctagtttctgctgccgccggtggccggccggaccgccgtgttggacgacgttggcggcggcggcgaccgtgttgggtcgaaatgggcccccacagagcatatgggctggaccgcctcgttgggtttactacaattgagaaagaattggaaaaagtatacacaaggtccctcaacttgtcatcgcgataaaaaacatcctcgaaccgcaaaaccagatatgcgggtcttcgaggacttttggtagttttgaccccggttttggtctatgtgacggctgaattagcgtgagccccacatgtcagcgtggccacgtcagcctcctctctcttcttcctctcccttctctctctcacttctctcctctcgggcaagccggggcgggtcgggaggaggtcgctggggcggccggcgacgcggcggcgtgagcacgagggcggtcggtgaggagaggcgcgtggtggccgtcgggcgcgtcccatctcgacggctagcctatggtggcagcgtgtgggggatgtggcacccgggtacctcatggtagaagccaaagctatgcttcgggggtgggccaagggcccataacagatatagtaagtgtcgcatagttggcaagagaggaaagcatactattgtatcccaaatcatgtaacaaaaggcgagtatccagattattgggatacggggccttcattggcaccggtgggcctatgctggtataaaggacgccggtgccatctcttaattcttcttgggttttttatcttttgaccagagacgg

SEQ ID NO: 47552 - DNA, 10104 bp, Oryza sativa
gggctcacctcgacggcagacacaaggggatccacagccatggatgacggcagcggctccccatcgtcctcgctctccccccccccccccccaacgctctcgccgctgacgccctccccttctcccgcgtcgccggccgacatacctcctctcttgccgcaggccgcccgtcctccgcctcacatgtgctggagaagctgcgcccatgcccacgcccatgccgaggatgcccgctgcatcgcatcatgtcccggtcccctatcctccacgaatcccccgccattgccatgaagtgcgccgcatcggcaatgaatctgaccagcgaatccccagcagcggcggcgaccagttgaagaggtgcccctttggtcgccctacactgtcgtctctgtccctgcgagccgcctaccttctctagtgtcgctgccatcaccaccgtcgcgtcggtgagacgctggcgtggacgacggggagcacgatggcggcagcggccctatccttgcccggagccgccgccgccgatgaggctgagcggtgcggagttgtcggtgcctccactcctcatccgcagctgcgctcgcctgccgttgccgctgcctctccaccaccgcggtcacgctgccgccgccctccccttctcttgtgctgcatcgccggccgtcagagagaagagtgtgtgagagagagaaacacgaggtaaggagaggagggaaaagaaatacatgtgggacccacgctgacttagccgccacgtagactaaaatcggggtcaaaaccaccgaaggacctcgggtgaccggttttgtatagttaaagggcaccgcatatctggttttgcggttcgagcacgttttttatcccgatgacaagttgagggactttcggtgtactttttccgaaggaatttgcatcctgggttgttctgggcccatctgtacggccttcgttgggagctttccttactcctaccacgacgagtaaactgagcctcatttacgggaaggcccataatgagccgggcttcactgcgaggtcacccgcgatctgcgtggtcgaaggactgcaggagtcgttcgatcgagcatccacggcccagattaagatggatgaggaatttcttgcgtagttaaatatctgatgaaatgcatctcatttattatattcaggaaattattaaaatatataccaaaagaatttccaaaatgataactggataacccaggactgctgagccagagatttcttttccgaaaacatagttacaaagaaaatttacaagcttcatgtcctaaaatactactccgtacaagggaaaatttatgaaagcaagttctatttcctgatgcatatgtatcgtgtatcggtgattccatggctctaagctcaagtaggtacatactcagtaggagagggcaagagccgtgcaagaaaggttcctacagcagtaaacagcagaacaaactggatgaaacaaaagagtgaaactctgcttgctctagactgcaaccgcaggacttctgaactcccagacagaactctgcattcagctcttagcttctccgccatctcttctaacatcgccgctcggttcttggtatgctgtagtttaagttcaagctgcttgtaatcccccgacagagatttctgcgcgttatagagagctatttgatcgtcaactagaggtgcccaggtttgagcagctcttgtcaggatgatgctcttaatctcggcttctgtcttctccaggaagagccgaccaaggtaagatgcttcttctggtctggactcaggatcctttacattttgacttgttccttcaagaggttccgcgagatcgactaaaccactccaatcatcgtcgtttccatcaaaattatcatttgactctttactgatcactgcaaacattttaatctctgcagtaagcatggagcaaaggttatcataaagcaattttgcatggatgaaagttcgaaccaaggcatcaaaaggtacagcatgttatcaccacaataccggtatgagacctcagattcaatgaaccaaggaaacttacaggagaagttttgattggttgatcaagccacttctatatactgtagaacacaaagcgctttacccatttatttggtactatgcctaaatggcccagttattagaatactcaacaaggtaatattattacaaccgtcaaattgagatgtcaacaacttcagcaattaagttcataatgttttataggttccctgagttgaatcacggaatgaactagaattatcacttaagaaattgattaatcagattatagttgcttgacttaactaccactccaccaacatcatttatccgaatactttttatcatgactgaacaccataaggcagctataacttatttgtttccacagaactggagtaaacaacatcatgaaatagtaacaaataactgaaccatgacatggcattgcttcaacatcagtaaaataataacaacaactgaaacagaatttaacttggcaagatccatgaggctaaacgggaacgaaatcaagtataccattctcaagcgcttcttgcgttctctgaagcaatgaaatcgattccgcatacggatcagcactcgacttcatccctgatccaaggtcaccattgttccccacactcctctgagcagcatcagcatccgaatcaacactcccctgtgccaatctcctcaccaccacgctcccattctccacattgcagtaatctctggccatcaatggcgtctcctcgccgtgatcacagtgatcggcaagaaccttgtggattccattgccggcaatcgattgccgccgggagttcacggcattagagcagcgcagcgagtactgcgcctcggcggcacgcgcgcgcgcggcgcgggaggagcgccctgccctgtcggcggcgaagggcgagaggtcgttgtggcggcgcggggcgctcgctgcggtggaggacctgctgccgctgctccggtcctcgctgtggtcggagtcggcgccgcccgcgccgacggagaatcccgaggaggcgacgagcagcacgccgaggctcggatccagcttcgccggcgggacgaagcgggactcgacggaggcggtggagctctcctcctcctcctcctccaagaccacctcgtgcagcttccccctcggcgcgccgccgggcaggggtatccgccgcttgtgcagctgcgccgagccgctgccggcggcggcggaggcggctgatccttccttgcgctgctcccgcgggatacggcgccatcgacggagcccacggcctttggtctttatcacgggagagctccccggagatgcaccggcctccacctccgccgccggcgacccgacggcgccgttctccatatcggccgccggaggtggcatcaaagaatcgacgaaatcatcgttgaacgggggttgtcggaatcgagcaaggtcgtagtaacgaaaattttcagttcgtttggtctcgtggaaaggagatcgagggaggatgacgaactggacggcgacgacgacgaaagggagaaaagatacgaaaaagaagtgatttttttcccaccttaacagcagcccttttccagttctttctcttcttttttttttccaacaaaaatggcgcgttcgcgtacggtgtctgcgtcagttacagccacgtctcggcgaaacgcattttaaacaagcgagatggcgacgacgtggctagctctgcttagctcagcagcttgattgaactgctatgttttttttttaagaattacacggtataacgcaaacactcaccacgcacatacactcaccccatcaacgcacgcacgtaaatcctacccctatgagcatcttcgaagactgggccggaaaatccttgagattgatgcagttatgacgggtatgccgcctacaactgaaagctagttcctgtcaaaattaaaaatttgattgaaataggaacaatgtgatgaaaaagttaaaagtttatgtatgtagaaagttttgatgtgatggaaaagttggaagtttgaagaaaaagttgagaactaaaccaggcctaaatagtgaggtggagaaaaaaaaagacgaaagagataagggcacggtcaatgcaaggggtacctgaagtgccatctaggatggggcaacacccccagaaagctaatttcccatagtgcaaattgctttaggtggtagtctcacatttttatttcagcccctggtgtttttttaagtcctcataatttttcaatatatatataagttcaaaatttacactaaacatcccaaaatctagaaattgatataaaatctctcctccctcactcttctcccccaccgacaccccaaaatcccctttccccatgccgtcctacttcaccatccgagctcctcttctttctcatttatttcaccatccattcccatcctcgtctagtctcctccacccgatcctctcttcgtctgtcgatttgatgtgaggaatgctacggcggttgcgttgaaagcaaggggtaccgtcggcagttcccgccgtcgccgcttccctcatctccctctctatcccagcctccgtcgccactttctcctactctctcacctctttatcccggcacgcagggtggccgacggtgcgcttgtcacaggggccacggacggtgagaggggcgcaggggctgacgatgagcaacgcacaggggggcggtggccagatctagtcagtcgtgtcgtcgccgtcatgggcggatctagccacggcgcccacggaggaggtcggcgactctttcaatctctctctctctttctctccgtcatgggcggcgccggatttgctcatcgcctctctttccccctctcttccccgctgccgctcgttgccatcgtggccttcggctcctctaccacctcaccgcctacagctctgcccaagggtggaaaggggaatacagatgtggggagcggtgtccacaagctacggcgtctcctcgcttggttcctctgccaaaagtcaccaggagcgcgtctcctgggagaaaacgtgcgcctctccaggggcacggcacaaacgcgaaagataacggtgtaatactaaacgttattattgcacgataaccttccaatagcacgagccaaggtaaccgttatctttcatgccccctggtagaaaacacgcgcctctccaggagcacgagccaaggatacccattgctcatgctctaataacctaccaatagctggtgcaaacgtgcaaagttggtggaagctaccagaacaacctacccagggcactcttcaagtataaaatgtaacggatatataatgtaaattcaaaacttttgttaatttttttaatacaattgtttttatatggatgagtatacgtatttgcatttgtactatatttttttacgcgtatttgcatttgtactatgtttctttaaagaaaaggttactaattctgactaggaactggtgattttctggtatgtctaggcctgtttggagagtttaagattttgagaatcagctgtttggtagccaacttctaagtctggaaaagttagttttccagtttctggcttctagtttatttttttgattttacaaccacatcttctcagaatttaaactaaaagctggatggtttgggagagtttttgattctgggagaagctacagaaactcctccaaacgtacatagggtcttgtttgggagcttaagattctgagtagtagctggctgctagtttatttttttattctacaactacaacttcttatagctgaatcaactagaaactcctctaaccaaagccatatatagtctgtagtctggttctacgggcccggcttctgctgtaggcggacaggtcagggcagatcggccgaatagcgtagacggcgcctctctcggccctcgcggcggccaccacaaattgccccgaacgtccgacgtaaccgggccacgttccgcgggccagcgcttgcggtaaattgcttctcccgtccctcccacgcgacgcctcccgctcccgtgccggcaaccgatgggtggtcgtgccacactgccgcctgcaactgcaaggtgggggacactgcgcacaaccgcacccgtcgtgggctcgtgatggtcagcctggttgggggtgggcgggtgcggttggagttggagaacctgctgcgatgcgagatgccaccatcccggccagcacgctacccaacgccatagggccgccaccgcacgtctcctgtctccaccctctcctatcccatcatgctggcacatgccgctgtcgacgccgacgccccttccccatccagcctgccttgcttgccatgtcctactactaccactagtagcagtaaaagcctgcacagtgcagctctgcagatcgaggacagtctgttcattttgggcccagtagtcatcttgcagatgagatcaaaatccgcaaccaacatgacacggtgagtagagtagcaaccatggaaagagatgttgcacttatcaacatgtagtacagtaacaaccatcatcaaatgtccctacaactccgtctctctcatgctcgaagaatataataatctcattgattgaaacacgtataggaaaatttaagcggcaattaaggaagtaatagtatagttgtagcagtagaagagtacagcaacacacgttaattaatcacgcgagagcgatggatggatcggccggtaaggtctcggtctcgacctcacacgaggcggcggcagatggtgatgccgtcggcgatggcgagctggcagacgtcgatgcgcgggtcggcggcgagcctggagttgaggtccctgatggcgacggagaacctccggtccaggtccgacagcggcgtgtccggcggcagcgccaccgtgccggcccacagcgtgttgtcgtacacgatgtgcccgccgacgcgcaccagctgcagcagctgctcgtggtacttgacgtagttgggcttgtccgcgtccacgaacgcgaagtcgaacgccgcctcgcgccccgccgccgcctcctcggcgagcagctcgtccagcttctccagccccttcccctcgcggaagtccaccttgtgcgccaccccggccttctccaagaacggccgcccgatctcgtagctctccctgtccgggtcgatcgccaccaccttcccgtcctccggcagcgccagcgccgtcgccagcagcgagtagccggtgaagacacccacctcgattgtcctcttcgctccggccatcttcagcagcatccccagcagctgcgcctcatccgccgacgactgcatgaaccccctgcatgaattaatgggctaattagttaatcaaccccaagatctagcttaattaagcagattaattagcagagatcgtggtttcttaccactggtgcttgtccgtgatgaggcgcagatcgcgcatgcactccggctcccgtggcagcaccgtcgtgtccaggacatactgcaagttcaccggcgacgaacacagcaaccatcagcaaattaattaaaacagagagatcatcctaaacacaatccggcgagctgatcaagaatcatcagcagcacgtaccttgtacagggcgtcgctcttgagcagcgtcttgttggtgctgtcgatgtcgctgtgggcgttcttgatcaccggtgcgtcgccattgccggtcgtcatggcgatgagatcttcctccgtttgagctgttgctgcttgagctgctggtggtggtgcgagtcgattggttgggtcgtcaaccgagagctccggcgagcaatatttatcggctcacgagagcagggttggtggcgccaccaaacacccggtcttttttcctcccttccttttcaaaaaataaattagcaatcgatcgatcgcacggtgacctggttgttgagccaccaaacgtagtggccatgatcagtgcccaaaaaaagggtattttataagcgttaatttggtcttcccgttgagacggtccagtaaactgaacattattacagtactcagtactacatgtactacttcatgcatgatgcatgtgaaatttttgttttttttcccctctctttcttcttcttcctaccaccaccacctgccgcgacctaacctgctttcgtcgtggtttggttaaagaaagggatcgcacgcttttgtccaccctgtttatcccaatattattccgcctgcttaaaattattttgcccagggaagaagaagaagcttcagcgaaaacggcttctacaaagctgcgacaggtagtactagtagtacagtagcaaccaccagctcaccacgatttacctgtgatggaaatgattaatgagtggtgctgcgacttataattaagaaatgcagtagcactccattagtttaaatttgagatcgtgttctgaatgtatttttgggagaaaaataaccaggagaaagctcggagctgtcacgaagatggatggatctagtaggcgcttccattgatttgggcacagtgaattttctggtggcgactgtggatgggcagccaaaaaaggagtcaaaacagggttgctactgtccgaagactcctaaccctacatctaggatgttgtctatgtcattaactatattattatttactagaacttttaacttatgtgacattatattaattaagagagagtggagagaagaagaaactgggtctcatgtaagaaacagcttcaacacgagaacctatgcactagacattatcaagttttacattgggagaaaatagtgccgtcataatagataaagaataaatatgattgatagaaaagatagatgatgtatttattaatgacccactttaagaaactatgggttgtggagtgtagtttctattatgatgtcttattgacatggcaccatagacactacttatgaatactatggcttgggactgcccctgagaggatgcaacaattgcaggtcgctaccgcgaccagaggagggagcacgcaacaaacgtttttgtgacacactagcaggggcccaacggctgacttccttccgtccacacgccaatcaccaaacgcacgctggtagagtagtcgtatgcggttggaacagtagatgtacaacatcattggaccgagtacagtacagcgacgacaatagcatatcccattaaccctccattaattacggaacccaaaatcgtagtcgaatcgatcgattttgcacctcgaacatcatgatggtcgtgttgtgagcttatagtactcatttccgtcccaaaatataattatttttaacatagtaataagtcaaatatttttaattttgattattaatagcaaaaaagaatcaatcatacaaaattgatgttattaggtttattattaaacaaactatcataatatgtaactctttttatttaaaatattttatttttatatagatatttgttgatcaaagtagtatgtcggcgaccgtgtaattttggaacggagggaatacttcattctcccttcaccaaactcaatatatacacctagtaggcccactgacagggacacacaccaaccctccagttatcgttgaaacgaccagaaaaagctatggatgggtgcaccgtgcacctggacgattggttggcgcgaattcgtccgtcgcgcgtgcgatgcgagagaagaaggctccgatcggggcattgctggtggcgcgccgcatcgatcgatggggccaaaattacgaggacgattggcgggcgggtcgccgtcgctcgggtcaccggagtccacaactctcgcagagtggcaagggtggggtgggggtgggggtggtggtgccctggtgggccgagtggcccacgacgacgttatcgccggtgggtgtaagtcgggagggcactgattggctcgtccggagtctggtcattaccgaatgttactagatttgacacagtacttttgtttgtctcatagtagtattgatttcgagcctctcacactgtggtacttcctccatacataatactttatccgttttataaaaaaccagctataaatctaaacataggctatatcctgattaatagctagaagtta

SEQ ID NO: 47553 - DNA, 15901 bp, Oryza sativa
ttgaaaatcaatttattttgaagaatccctggcaactcttatgggaacatgagagaacacttgatagtggctcgcacgaaggaataacaaatgagatcgcgctattcatgacccagggaaagcttcttgcggttaattagcaacatctatgactagctagtggctattcctttgacgaagctggtggtgggatcaagtagcagcatctatgattgacttacatagatctagtggctcttgcggtttcgccggtcttcgcatccgggcatctgccgatcttcgggggtaggtggttggtgaatgaaaaaacgaattgtgttatttttttttaaaaaaaaagagttgcgtggaaatgtaaaatacttgtaggtagatatccccttcaccctaaaataaagctatttcgatcactcagttttttcttttcaaatgaagctattttctcatatatctatcatttcaacgaatcacaatcatcttttattttatttcttcatccaatttcttttaccaatcataatgtttcctgatcattttttacatttttcaagtagatgtggggtcctgagcgaagttgaccccactgctacttgtggaattgccagtaaggcgtcaatttggcgcgacaattgcagctttctccaagaggacatgccaaacttgacaacaacatttccgtaagatgctagagtgcagttgtcacttgcatatacagcagggagaaatgatgacgaggtttttggcttactgtattagcattaggacgtttagttcacgctaaaattgaaagtttgatcgaaattggaacgatatgacggaaaagttgaaggtttatgtgtaggaaagttttgatgtgatgaaaaagttaaaagtttgaaaaaatagttggaaactaaaccaggccttagtaacaccgtcccaaaataaggttgcgttcgggagggcacgcaaaacggagcagcgtttagcgcgtgattaattaagtattagattttttttcttaaaaatagattaatatgattttttaagcaatttttgtataaaatgtttttttaaaaaacgcaccatttagtagtttgaaaagcgtgctcgtgaaaaatgagaagaatgagaaggagggaataggaacagccactgctgacgttttggacattctaaatactagtgagtaattaattagaatccatattttccattttttccatattagatatcaattttatggagacgaagcaacacatctctacatgaacgtaggggtactctggaaagctaaaacatcgatattttccatccacaagctattaacctcatcgttaattaaaagtgatctaaaaaaattatttattatttattttggaacgaaggaagtacgtaccatctgatcttatagttaaaaagatacatctgatcttatagttaaaagatacagagagggtttggttatcataggtttgggaccacgggtaacaaaaacagaaggtcaactctggtttccgtggtgaataatttcccgaaccttgagaatgccggaggttagcttcgttcagacttggcttcagccttcatacgaacaattttcaagtcagatgcatcattccatattgtatattttacggagcatattttacttgttttagcttctttccaatttttctttgttttttttccaattacacgacaaacccactcacaagctaaatcaagtaaaatatgctctgtagttttcacaagctaagggtgtgtttggttggactgtagcttttgaaaaagcggctgtgggctgtgacttttagaaaattagctgtgagaaagacaaaagctcgtttggttacacacaggtggcttttgaaaaagcttctctcctgacgagtggaccccacatgtcatacacaggtatcttctccatctacacagacacaggaaaggcagggcagacgagcgaggtggcggcagacatgggcggcggcgggctagctcctgctccggcgtcggcgaggagggccgtcgccccgtggcatctgcctcctccggctccgggtctggctcgtcccgcgcgtcaccgaagaagttggcgtcgatgcggtcgtcggtggcgccgtcctcgtcgttgtcgccgtctccccacgagcagttgcggcgggagccgccgcggcggcggatgcgctgcggcgtgcggcggtagacgcaggcggcagggcgaggaggagcggcggcgacgacgaagtgaggaggaggaggaggagcgacaccgggggtagaaaaaagaaacgcgaaccgtttttttgtgtaatggcagagatgggtaattttttccccaaaaagcaggtgaaagcagagggtagaggtgcttttgatttatactacactaaaagctggctttggacaaaagcaattgtagcttttgggtcctttggttggctttaagcttttgcaaaagcaaaagcaggttgaaaagtctaaccaaacacaccctaaatcttgctattagtgagatatctcagtctacaaatgtaggcctaaaattgttcatatttttttgacgagctcgcacatatgttctttttcttagtttgacctcagagtatgctttacaaatatttgcaggaattcacaaaacacgtggaattcaactattttccaatcttataattagcttgtcgctgtcgtatgaccgacgcatagtccgtcatgttacttcccttcataaaaaaaaatcaatctagataaagatgtatccatcacctaaaacaacaaatgatataagattgtccagatttattatttttggtggtatcacatttttacatagtttgtttttttggatggagagagtagatgaaattgtacgtaccgtcgtaccgtcatgcacaaagtacttgaacagttgctaatgccgcggttgccaatgcagataacccaagataaaacatcactctagaatttaatttttgttctcagacacaaacctgcatgaaaaacatacaaaggctacgatataattgcagtgcagctgcttatttatactacagttcaggcccatttggggggtccattcaaagcccaaatccagccccacttcagtctccccgagatcagtgcttcgcacacggcttgcgccgatctcaaacgaggcggcggcagagggtgatgccgtcggagaccgggagctgcacggcctccacgcgcgggtcgccggcgatcttggcgttgaaggccacgatggagcggcggatgtcctggtcgaactcctccagcacggagtcgtcctccagcgccacggacccgccccagagcgtgttgtcgtaggccagcacgccgccggcgcgcaccagccgcagcagccgctcgtggtactcgccgtagttccccttgtcggcgtccacgaacgcgaagtcgaacttcccctcgttctcctcctgcaatgcacaaaagacatgagacatatgatcgagcagctggcatgcaatcaccaagacgtacgttgctttgctattgcttacgttggcgaggaggttgtcgaggatgggcatggcggcgccctcgcggaagtcgaccttgtgggcgacgccggccttcttgatgacggggaggccgaggtcgaagtactcccggctgacgtcgatggcgacgaccttgccgtcgtccgggatggcgagcgcggtggcgagcacggagcagccggtgaacacgcccacctcgatggtgttcttggcgcctgtcaggttcagcagcagcgacagcagctgcccttcctccggcggcgacgacatgaacccactgatcgaatccaacaaaaatgttacacaacacagcatcatatcatcagcttctaattaatcacgctgaatttagcatgtactacctccataaaaaaaacctaatcttagatttgaatctgaacatatatgtgtctaggttcaaaacctaggagtgtgtccagatttaaacttagaattagttttttttttttggaatggagagagagtataaattaggagacaaatagtactaggtgtgctcgctggtgatgaggcggagctcgcgcatgaactcgttctcccgcgggtacaccatcgtgttcagcatgtactgcacccaaaaaagggtttttggtcatatcatctcaatcaacgattgctcgtccatgcactgcaatatggggatgaaaatcacgaaaattaatcaactagaaactgatgtgtacctcgtggagggattcactcttgaggagggtcttggggctatcgttgctgtggatggccgtcttcatctccttggactgaatctgaatgccgccgttggcgccatggctggcatcgccgttcgccgccgccatggccgtgcttgatactcttgacgccggtgtcgttcgcttcagccgcctagagtgtgcagtgcagtacacagggagaagtgttaccaggagaggcattgctgccaagctctatatacacgagggatgggcacgctttctgggccgacagctagcttaggccggcatcagctggagtgtcagtggtggtgccatgtcatccactgtgtcgcggtcacgcagatagcatgcagatgcagggatggatgaggacaagtgcgtacgtcgtccccagcgcagcggccggcccagctgatcgatcgatcggtgcgcggccactgtgtggctcaccgctcatcgatcacacgcacgcggccgtccccttcggtgttttcctcgtgcggttgcttcttttcttcggtagtagtacacgcgcttgcgtggttggcggtttgcccgtgggcgcggcatgggcatgggcatggcggtgtggctgcgtcaccgaatcggcgtgctctccatcacgccgctcgcgtcgcgctcgcgccgggggttgtgagcggcgcggcgtgacgacggatggaccgcggatggatgggtgtcatggactcatggtcatgttggtgggatatttgggatccgcgtcggctgcgcctccgcgcgtcggcgcgtgcggtgtgagccgcgtgatcgggatcggatggcccgttggtgcgttccgcgctggtggatcgagtctattctccccgtctccaaataaatcaatctaaaacaagcgtgtgtttggcttggaatcaagtgagaatccatcgttttatttataggatggtctcatctatgtatttagcacaaggatcgaaatgctctttctcttaagggcatgtacaaagatagagttagatatgagctctacgttatttagagactagcattctacaacagttagagacaatatggtctctaatcattaatgtatcaaaatactttttattactctcctttcctttctttcaccatcatgcaacaaaatttgctctaataaatgctatgagtcgactctgagccgttgtcatgcataacaaccatattcttttctctttcttccatatcatcaaatttacttgcatggcaatagagagaccactaataaagaccattgtacatgctctaagagtttgaagggtgtgaccggcatgtcaataagagaaaaggaagtactattaagttggattggtccaccattttttcatgaagctaaccgagatctaaaggaaatgttgctttttagaaatcatcccatcgcaattgttctcaaggcccaaacagccaaaccaaacaccctaaaaaataagttcgctcaaacccaacctatcctcagttatagctccaatctgatccatatctctgaaccgcaatattggatatctcgacctttcaatttattaaaaccagtgtaatttgaatccctaaatggttttagagagcggtttcgctgacgtggcactttgatttagtttgatcggctgactcaacgtgtgggttcagcatgtctatgactcctccttttttccttatcttttgtctctctcctcacttgtctcttcactggcaacattggtaggaggtgctggcgcagtcgctctgtctcgctcccttccgcctctcccttcaagtcatgacgccacccaccttgctgaaggagagaaagatatgtgggccccacaatatttttttaatgataaatgggtccctcatatttttttattctaatgccacaagcgccacatcaataccatgttggacgaaaccaggtcaacaccaccacattagtgaaaccgtcatttaaaaccgtcgaaggtgtcaaaatacattggttttaataattggaggtgaagatatctggtattgtagtccgaggatacgaatcagatttagccactagtaaggcagccaaagtggatttattctttattttttggacggatttttggacggagggagtagttggtgttaggttgcaaaggcttaagcgaagacgggcagtggactggcttggttggctaggaccgaatggccgattacgctggcggccatgttcgggtgaacggcccatgtgagtggttgtttgggcttgttttggcccatttgtaacactaaaagagcacacgtgcataatacgaaagagatgtttatcctaggcatgttgatacatccgtaacagcaaccccttggaggagtatggggaaaggaaccttcctgctttgaaaaggagataaaggaattttgttggattcacactggggtatatggtatacgagaatatggacatggctataaatcaaaatttaactcagaaaattggattgttaatgtttcagttgattggaggcgaaacacaaagctatatgatgtgaaaaaaaaactatattttccactctgttttttttttggaatgtctcctccactgcaagcttaatctcaggcatttaatacattgcaacaaaatctaattgattgcaataagaacttagcaaatttgtaacaaattaacaccaatatggacgatggaaaacaaaatttattcccctttcgatcaagagagtccccagaatgcaacggaaggaaaacaagaattggaacaacaaagaaaacttgttgcaacgaacaccgcaacattaattgattatgtgcaaggctagaagaggaggcacctgggtgtgtacatcgtgcttctccacaccttcgtgcaagccatggacatatgctcctcggtgacagcttcaccagcgacggaggacaagcaaaggtagcatggagagggaggctattatgatgtcctatttggcactagcaagttatatatggtcctttagatggatgaggttaaggttgttaagtggatgagaaatgagtggtcagcatgcacattctcagtacaaatattttctttcatgttttgttggctcatgaataccatgcatgaactgtacatgtggaaaagttgacgttgaatttgaacttcaattattgtacgacaagatcaacagcaacagtagagcaacgtactctctcctacgcaaaataaatcaaccacctattacaatgtcctaaaataaacatcatactactacgaggttgttttattttgagaccgagagggtatagacactctagcgcatttctaagattgcccgatcgatcggtcgatctcacttgaggcggcggcacagcgtgacgccgtcggcgacggggagcaggcatgcctcgacgcggtcgtcggcggcgaccatggcgttgaacccgaccatgtagtcgcgcaccacgcggtcgtacgccgagctccccggcgtgtcgcgcggcattgccacggacccgccccacagcgtgttgtcgtacgcgaccacgccgccgacgcgcagcagccgcaccagccgctcgtggtacccgcggtactgctccttgtccgcgtccgcgtacgcgaagtcgaacttcccctcgccgccggcgagcagctggtcgagcacggcgagcccgtcgccgtggcggaagtcgaccttgtgcgcgacgccggcgtcctcgatcaccgggcgccccagctcgtagtactcccggctcacgtcgatggccaccaccttgccgtcgtcggggagggccagcgcggtggcgagcagcgagtagccggtgaagacgccgacctcgacggcgttcctggcgccgatcatcttgagtagcacggagaagaactgcatctggtccggcgacgaccccatgaacgacctgtgcgtacgtacgtaaattaaaacggccgacgtcgacgtgacaagccaaagaaaaagaaaaaaacgattatgcaacgcacttgggatggttctgcgtgatgaggcggagctcgcgcaagcgctcgtgctcccgcgggtacaccgtcgtgtccagcacatactgcaaagtgcacacacaaatatgcatctctccatcattttttcgatctcttcctccaaaaaaacgaacatgaaacacacaccactgcacacgtacatcgcgcttacacatccgcgagtctatacgtacctcgaggatggagtcggacttgaggagggtattgctgcccggccggtaggtcgccatggctagctagctagctccgatgatgatctctcaatggcctctctagctatctggacctcttacatgagtattgcagatcaattaatgactaaaaaaaaagataagaagaagaacaagacgacacggcgttttgttaaattggtaggtcgcgtgatgacctgaacgtgcagttactcagcgtctctaccgatcagctaattgctgacagtactttggtataaaatatggtgtgctccctccattttaggttattagaagttttaactttagttaaaatcaaactactttcaattttactaagtttgtagataactatagtaatatttataataccaaattagttttattaaatcaataattaaatatatttttataataaatctaacatgggttgaaaatgtttattttctataatttagtcaaacttaaagtagtttgactttgacatattaacctgaaacagaggtaataattgttaccggttcatctataactttaattattaaaaattttgagatgattaaatcgttagagtatcttaaaaaaataactatcaagttttttgagggaaaactttcaaatgtaactataatgtaattgagtgtaattacattgtaactgcactataaccgcattgtaattacattaatttataccgtggctatgttatagctacagtataactgatataaacctgtatttaagactagtttagttgactagcaccgggatcttatccgtagcctatgtgaaatttctttctagcaattatttttctattcaatgcacccatcttaaaatgatccaataataacaaatctgaaagttttgacaaaaattttctagcattctagcaattttgttaaatcataatgaaagaaagtttaatacttatgtttatgtaatatacttcgatagcatgatatttatttaattatttagataacatttgtgaaaatccaaattattaaagtctaaatatgaaggaaaggagggagcagtggcggatctatgtggacccccgtttttataacaggaatcaatcgtgtaaacagtaccatttccctggatcaagtagtctggtacacacgaattcttagctgaaatatcaagtgcacatacacgagtgtctagtatgaatcattgcatcataagcccgcaggcatagtcttaaatcatcggaccgagcggtccggaatacattccaaaaacagaagaaggtaaggcagcggagttaaggcagcggcacgccattgccacaggcaatgaccgtaactaagacctactgggcgccatcgtcttcatcaccctcctgttagtaagcgtagggatcctccgaagcttcatctccgacctctgattaaatttgtatattgcaagggtgagtaccaaccgtactcagcaagccaccacagcaataatgcacatgacaggggaattcaaaggatggctatagttcttttgcgcaaagcaagttttgtaattcttttcacaagcctaagatctagcatagactgatcaaattttaataccagcgttcacattaaacaacgacggttctgtccaccatccattgtgatcccaaggatagcttcccgccattgagtggtcatggttttctgaggacgtccacattcccgcctctcaggaagtggctccatcagcataaaaatcatcatgcaatatcccatcccacataagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagctttttgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccgatggcgacaccgatgtagggcacgcctctcggccctacctcaacggctaccccaccatagcgcacctacctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagcctttcccagataccacccaaatccaccgtccgccccagtcgaaaacaattgtttaattttatttctcctttcacaaatcatgtcatcaacatcatggcaatgtggcgctcatgtctctacatgccgcatctcaattaccttcccaaaggtaattgcccaagcatataacatttgataaatgtgagtatgtatgattttagaatagcatttctaagcaattgtcataattgactagggactcatacgtaaatatggttacgaaggaataaagggcaaccaataatcaaggcatggcataatcacaagtaggatgttcatcattgcatgcaattttatttgtaaacaaaacaatttcgcaattgggaccaacatgttcaaggaatagtgatgacttgccttgctcaaagtcttgcgggtcttggctttcacttggatccgcaactccctcgggctctatagttacatgcaaaaattgatttgaattcggttagaattcaaataaaaatccaaataaatccaaatggaagtcgaatgcgaaagtcgattcttttatattaactttactatttgcgaactagggcaaacccaatttcgatttatacatcctaaactattttttgcgggtatacatattttgttaccataagtttttaatttaatctacccgggcattatatccatataataggttagaaatttctatcgcgagctaaatatcggacaaaatcctaaaattattatacgatttaatttagtctatgactaaatgattaaatataatacacggctaaaatccctagtaattaaatccgaatttctaccgtgaatcgattacttatagagattacccaaaaataatctataataatctataaggatttttctacttgtttagttgttaattacatctaaatcactaccgcaaattgatttcttatagaaatttccaaggataatccataatttatattaaattttgcaattctacgactataattaatctataattaaattctaattattttaaattttctaaactttcctaatctccctctaatttctatttatttttcctccctctctctcttctttttccttctctctctcttttcttttcttttcttttccttctctctcttttcttttctttttctttctctctctcttcctcccggtttctctcctccttccttcttctttctctccctcggcttctcccttcctctctctctctcggctccctctctacccggcggcacggcgacaaacagggggggcagcagctcaccgacggcggcggcggcgacgacggcgcacggcgcggcacactgaggcggtggcgcggtggcacgaatgcggcggcacgacagcacgagggcggcggcgcggcggctcaaaggcagcgacgcggcggcacgacgacggcggcgcgtggagaaggggaagaggcagaggagggggagatggagtgaggagaggggagaacggtggagcttttataggggagaggggggagtaaggggaagaggggagagaggggcgggtgacgcgacggcggcgcggcggcacggggcgagaggcggcgatggaacgcgcgcggcgacgggacggcgacggcgacggcacggcagtggtggcgcgcggcgcgaggcggtgatgggacgcgcgcggtgatgaatctcttccaacgtagcttgttccttcggcactcgtaagcacttctttaattgagacacatggaagactgggtgtacatcggcgatattttttggtagctgtaactgataggcaacttctcctcgtctagcgatgatttggaaaggtcccacatatcttggtgctagtttccctttaaccttaaatctttttgtacctctcatcggagaaacctttagatagacgtaatctccttccttaaattctaggtttcttcttcgggtgtcggtgtaactcttttgtcgtgattgtgccacctttaaacggtcacggatcaagcgaaccttttcttcggcttcttggataatgtcaggtccaaataccgcccgttctccagtctcggaccacattagcggggtgcgacatcgtcgaccaaataatgcctcatttggcgacatctttaggtttgcttggaaactgttgttgtaggagaattcggtgtagggcaaacatctctcccagtctttgctaaaatccaatgcacaagctctcagcatgtcctccaagacctggtttgttctctctgtctggccatctgtttgtgggtgataagctgtgctaaacgcaaggtaacttcctagggcttcatgtactttctcccagaaatgcgaggtaaactgtgtgcctcgatcagatataatcctcttaggtataccatgaagacacactatcctggtcatgtataactcgactagcttggcactgctataatttgtcttaacgggaatgaatctcgctgtcttggtgagtcggtctacgatcacccagatggaatcatatcctgttgcggtcttgggctgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaagggggaacacaaggacggtttgtggctatttgcataaaggcggttgtaaaacattttattgagcaaaacagtaaaactgttgagtaattaaagtaatattaaatctccactgatcaacgctacaccacgttgaacaggcccaaccaacccacctgtactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcatccacagcccaccattcagtcgcattttagttggataattacgaccataaaacatggccagatgtctcgagcacgcagctcaacaagatactagaatgtctaatactgcaattatcccatcgactgagctagtggtaattaagcatggctaagcatatagttctagctaggtcacataagtaacacaagctagtcaatttattacccaaggttgacaaagaacagatatcaagtaaacatggcgcaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttctgaactcttttcctcgcgaccgcggacttccgaaacgacggaaactacacgctggcacgcaaaacgaggaaaaactctaataaacaccaagaaaacagtacataaaaagtaaacaaacatgtagagctcaattttagatgaattttgcaagttgaatggctcaattcggagttcgaatgaattagatatgaattttagaaggttttgagccatttaatgaatttctagaattattaccgatttattgcgcaatttaaatcaattatgacgtcatccgacgggggagaggtggcgccggcaagcgggccccacctgacggtgactcacgggtggcgggcgcaccgtggaccgagtccacgcatgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagcgggagccagctcaccggtcggccggccgggagcgacggcgcacggcccgatggtcgccggcgacgaccaccggcgcgacggcacgcacgggaggcgacgaaaagaggggaaagggaaaggagatgaagggggtcctcaccgaggagcgccggcgacgggacgaccatggggaggcgaccggcggcggaaaggatggcggcggccgacacgggaggcgacgggaacggcggtccgacgacgcccgaccatggcggagccgcggccgagggccggcaagacctagggaaattattggagcggttagggagggaaataggcgaccggagcggcgagaataccacgccagagaggagaggaatggtggggctcaccggcgaccgagaggtaccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggaggtggctcgggatgcacggtggaagggtggttgcggtggtggaatggggaaacggagcggaggccggggtagagcttggcacggcgttgccgacggcgcaagcggcgaggtgcggcgacgactaacgcagcggcagcggccggctgaaggcggtgtgtggcggtagtggctcggcctcgcgatgggaaggtg

SEQ ID NO: 47554 - DNA, 2250 bp, Oryza sativa
caagccgggccgcgggaggggaaggagagaggattttgggccgagcccgaaagggaggaaggggaagtttattttgttttctttttatttaaattgatgcaatgacctttgtgctattaaaactatttctcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaattgatttttaaacccgaacgaaaatcggggcgttacaaatctaccccccttacaggaatctcgtcccgagattctgggatggctagaaagaaagccggtgctggtgggcggtctgactgatctgcacattgaactgccacattctgcttcgaactgattgattgactggttgatcaaacctgcacgattgcactggctggattcgacctttctgttcctttgctttgccaaaactggaccgactggttctgcttgaactgacctaggccagaactgcggatactcctgaaacttacttatcttggactgaactgttgaggttggcaattttggtaacctgagaattcaccacgctggctataagaggatgaaaattgaatctggcatttgtaaatcatttaccctatgtccgcttggactggtcccaactcaaatgacaagtaaatccaggaaacctgcttgacctgtctaagctaagcggttgaactggcctcatgggtgtaccttagaattcaatcggttgcccggggatcggcttaattcttctgataccttgcaacttgcttcttcaagtgctaccctgattgcggcactggttgaaccttcaactaaaacagcgacgaagtgaggcaaaactcttctccgagacctaccccccttacagggagtagtcttacttccgcgtggctgggatcagttgaactgttgtccttcaaatatagccaacacttctctgatttacaaagagccctgactttgaaaactgaaaacttcatcggtccatcaaattgaagcaatggcgatgcactttcaccccgacaagatttggaacttaacccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgttatgttgtgagtagacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttacggtttgaccatttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggccaaactcaactggggtctgagccttggtcctctaactccatcttcagctcagaagcactacacttctgaaaaggggga
